United States Patent 7,365,185 (GENOMIC PLANT SEQUENCES AND USES THEREOF) - sequence listing, part 58

SEQ ID NO: 69553 - DNA, 77884 bp, Oryza sativa
  unsure (1)..(77884): unsure at all n locations
caattagtccagcaggttctgaatttccagggactcttccagaagacatgtacgggcacaacgcatagagctagaataggagaaaaacagtgttgtcaaccaaaaagatcccgaaaaagaagaaattaaaaaataaagggaaattattagctatttgagaaggataaaacgtaggttcaccaacaaaactacaataagcaccaacacttaccagaagctaaagcttccaaacgaggatccagaacaggaggataatttacatttatcgaatggtaaagcttgaagtttataaatcccagaagtgtctgcaggtagtatagaacagtcaaaaaattgaaagaaccattgtaccaaacactgttgagatcggcattttttttatatatactaagtgatcaatcttgaaaagttattgctaggtatcgtaacattatatctgaacattttcagcatgatcataggtctgtcaggtgtacatggttatagccagactgcaacataatttatttacaatagtcatatcttccatgcaacagaatattaaatattaaacagagattccaaaacaaaacaagcatatatggcttcagacctacaattgaaacaatagcagcaatcatagaagattgtagcctgcaaattcttgcaagacagaaccccccagaacccagaatggtgcacttaaagaaatgggcttgcatttacccccatgatatttccttttattttaccgcgtgccatcgcattttattgtggatcaaattttcgtaacagttccagtactatttggatagaagtggtgctatattggtgaataaagcaggaaatacatagtaattaggaaattaggacagatcatcgtcattgtcacctcatagaattccaaaaaggtaagcatcacattgaagtcaacgtcatcagttaaaacttgctgaagacatgtggagttagccaggtgatcttttgaccttgaacttcagcctgcaaaaagtagttatattatataaatatatatactatagcatgcacagttacagtgattttaaaggcaaggactgcaagtagacataactacacaagcttacttgataatatatgcccttgacggatataaatgtctttcgcagggaatgagttcgagatatatatgcttgccattcatggctcaacctacaaagtacaaacatgtcccccaaattaataaaaggtattagcaacgccaaacaaagtcaggtacagcaattcattatagcagcaataaagatggggcaaatgtcatagacttgtagcatgatgaacaaatgaactaggaaactacaagagccccttggctgggagtgttgtgtgtgaatttgagggaggggattcatttacaacagagcatacctgcggcaattatgaatccgctgaacttgcacacgttcaccttcaacagcaggcaacgcagcaaaaagatgcaccattgttaggcaatcatccaagtcacgaagagcatcaacaaaagttggatatctgtaaagcaaaaatatggggatgatttatagaaacaaatacggtatggatgtcatcagcaaatcactttaaacctggtacctttcaagaataagcctgtcaagtttgtaagttggtggtcggttcaataatctgtctgcaagatctttatttttcttagcaaacgcctttttgaccttcttcctgtggaccttgatttctctgaagtcaaacaacaatgaaatgtcattaagagtggagacatcacaaaccaagaatagcatggtcttataactcacactttttaatgcaaagacaacatgcaccacactgtatcaactaaagttctaatgaaactctagattatatataaagcatgaattatgattcccttgtcaacgatcaagtaattgtgagcaactagtctatctgccattctgccaaccatcaaaatatcattgatgaagcaccgaggagaataattcacatggcctagctaatggctctctgaaaacctacattataattatttcctcaattgtattcagtaataaaatacaagtttctatcttgcttgccattttctccgctgcataaactgtgacagaaacaaattgcacaattgcagcaaacaaatcaaataacaagaacacaacacaaaccgatcactagcacaattaagatattttcatattgcctatctcagtggcctaataacaaataagaaaattgaaagcattgttatctcattaaaaattaaatatgtctgcagctaaattttgtgatagtgatacattatatgcccttaattgcacagagaaatgtgcaatcaaccaaaaaggcatgcaattcaaatgctcagtgagtgaatactgaatacttctgtagccgccaaaaaaaaacacagatggtagaccttttgcaagaaaacttaagtacctaaacttctcaatcaagggatcatgggccaggaaggcaatatccttcatgtggtagtaggtcttgtggttcccttccaccttcttctttggatcccggggaaagacgcccttgagaatgcatagcttcctgcaacggattgcaaaattttaagcagtcagaaaaaaaaaatcctacatcgcttgcagtataaaagctatacgtaacgcagagaatagtgaaggtaatcctaatggccaataggcgtatcgaacaaattaattagcttaatggagtgtacagcttaaagcttcagcgtaaaatgtgtaaaatttcccagacagctttgttagctccaacaaaaccaataaaaatagccacaactacactcgttaatagctccaaaatgacccaacatatcattagtcagtactcagtagtagcagctgggagattagaggatgacctgaaggttgcgaggctaatctgcaggtacttcaccgccttggtcctggtgatgtacttcgccgcgttcccctccttcttcttgccctagagcatccacgaaagcagcggtgagaggctccgcgtacaacaaggagaggggtattcggggggaggaggcgggaggaagacggggtgaattaccgcaggccggtagtgcttcggcatggcggcggcggcggcggcggcgtggctcctcggggaaggggagcgggggaaaggagaggccgaagaggggaggtgggtttttagggttttggtttatattgcggcggatggctttggggccttgggttgggctgaaaggctggaacccggcgcggcgctcactgagaagaggtgaagactggagacttgggaggtgggagccggcctgtcagcgtctgcttaacgcttagtacatattcttctcgtaaaaggggattgttcagtcgattttagagagagatgtactccctccgtctctataaaaaaacagacacgctaaaaaagttacgacagtttttcccttaaaaatatatcggtttgtggtgcattgaattgacgttaagattagtgctaaaataatagtatgctaaggccgggagttcagcatagcaaacatcttttcttgaaaaaaaaagagacacttctcatatatttatacaaatttacatagtagttacatcccacttacacaccacttacatatataattttagaatttacatatgtaattttaggacttacatatgtaattttgagacttacattgtaaatacactaaaatttcatatgcaattttagggacttataatgtaaacacataccgactattttttcatgaaaaatatggcgccataaatatagctactctcaaaaaaaaaaacctataactatatgtaacatcctacctccgtcccaaaatgtaagcatatagaatctggacacatatgtgtccagattgctatattttggggcggatggagtattctagtatgaatatatgcatacctttgtctatattcattgtactggaatatggcagatctaattctaagtttatttttgtgggacaaagatagtaagagtttgtatcactattttgcaggtaacgtggagtagattttcggtcattcagaagtacattttctctaagcttgtagatttcggtcatctaactcttttataccatgaaggtgacgtgatataccaacaagatcagtgtactttaataccatatcgccgttttcttgaatttgcccttgaagtaatccttacatgagctttttaaaaccatatatgcatatttttgtctatctcgaaccgctagtaacaactagaaaccaaattacgataatatagtcactgctttaaccagttgctacttgtttgttgcaacgaatgaaccagtcacattatgcgggcaactctgtaacgagcaactaacaaccccataagaaacaaacacaaacacctccttgttcgagtaatagactgctttgttatctccgaaattacgtgagaaaaagaacctcggatttattctatgttatagtttttttactcggagttatcaagctccgaccagtaatatattatatacgatctagtatcaataattaacaataaaaaaccataaactgggcatattcggctgcaaggtacagcgttgccttgcagccaaaccgcggcatattctttgtttgttgtatggtgtaacagatggctagttatatagtagcactgtacttggcagccgaacaagtgttggtcgaccaacttctgttggtcaaaaccaacaagtgtttatagaccgaggagtcaccacagcaaagaatggcttacgtcaaaatacgtactctatccggatgtttttaatacatgacgtcattgacttttagttttatatttgatcatctgtcgtattcaatatatttcaaataggataaaatacaaagtcatgaatataatacacaatacatctaataacaaaataatcacaaaaaaaaaacgataacacagtttttttagaaacatggtatgaacgcagcactcacgacattcacccactcactcgtatgagcaccttctaaacgttggacgacatatattgagattaaccaagtcaccacaaacgtttttaccatcgatgataaaaaaaagcaatatatatttcaataatacgaatctcatatgtacaccaaaaaaaatggtgtcataaaaaaactgaagaaggtacatctttttacatgctatctactcaagaaggtacatctttttgacatgctatttactccctctgttttcaggtcataagtcaaactgtttcaaatttaactaaatttatagacaaaatagtaatatttactataggtgtgtttagttcacgctaaaattggaagtttggttgaaattagaacgatgtgatggaaaagttggaagtttgtgtatgtagaaaagttttgatatgatggaaaagttggaagtttaaagaaaaagtttgaaactaaacccagcctatactaaattagtttcatcaaatcaataattaaatatattttcataataaatttgtcttgtgttgaaaattttactattactttttttctacaaacttaattaactttaaagtagtttaactttttctaaagttaaaatgtcttataacctgaaacggagggagtagtacatttgtattcaaggtaatacaatacgaaggtaatattaaaaggtttgaaaatgataaagaaaagaagggggaaaaaaggtttctcttgggttggacaaggccttatcaaacccggcctgaactatactaccgcacaacacacaaaacgtcgacgactaatgacgtcatcatccgggaccccacctgccagcgagctaactaaaaatccaaggaagcaaaacgaaaccgcgcgccgccaaccttttcgcggcttcactttgtttttcttttgtcttcgtttttttcccgcggcgcgattacgaaaagagctcttcccgccggcgccaccgcccgccgaccaaaactcctccataaacccctctctccccgccattccccacctctctctcccctcccctcccctcccttcgcgcctcctcatccgcctctctctctcctccccctccgatggcgacgcggccgcggtcctccccgtcgttcttcggcggcctccgggcacgcgagctcggcggcggcagggtgccactgccacgcgcctccgcggcgcggctcccctacctcgcggacctctcctcctaccccggcggccgcgggagcggggtcatcgccgtcgagcacgccggcgaccccgccatacctttcgccatctccttctgcaaggtgagcgagcctgggatcttttgtccccccttcgttttcatgcgttttttttcccgattccgacatcgaaagggttaagatttgatgggaactgattgttcgatgaaccctcgcatttttttttcatttcaggcggagcagatctctcaccttctggcggtagctgatgaggacgggtatgttggcatctacgacacccgccggcgcctcccatccagctcatcgtcattggggaaatcaggttcgattggatcccccctctttgatctagttttcgcactgttcgattcagttcgtggatgtctggggccacgcactgggtgtcatgttcgattcgttccggtctgaaaccgtgacattctcgcagctgaaacgaagatgtccgattgggttgcccacaacaatgccatctttgatgtgtgctggatcaaggtaacacctgttactctcaatcattgaaacatgttagagttagtggtataaaagccaatcctcactcacttgtatcatcttctttttggcgttgtttatttaggacggttcccaattactgactgcatcaggcgatcagactgtaagtatcgcaataagatcatttttcagaagtagaatagaattgtttgtttgttctgcattacaattcatattaatgtgatggtggactgccttttgatcattgggattgtttgttctgtatcaggtgaaaatatggtctgtggaaaacaagaaatgccttggtgttctgtcagggcacaccgggagtgtgaagtcgctgtcatgccattcttcaaacccaggttggtgttatgttgggaaacaaaaaatcaattcttcgtatatttgtgcctgtaaaatttgccaggaacttgtattcaagaacttattcactgcagagctcattgttactggatcaagggatggttcttttgctctttgggatctaagaatcgacccaaaaacccctaatggtcaccgtgaagcttgtctcatgtatgttgccttggctgttgcaatctaaatttcccctttcaactacagtgatacagaaataacaaattactatatttataactctgtttggaatgtgacacatgctaggtcttcccttgttgtcaaacaagcacacagtcccacacaaagaaatcgaacaaggtctagagcaaaggtattgaatttgcatggatttgctattgctgggtatgatcatacatcctactgtggtcaacttgctgacgctggtaatttttaggctgcttcgacgagtatcacatctgttctttatttgaaggatgatatctccattgctacttctggggctgcagacaagtatgtcattccccattcatttcattcttatagttcaaaaggcatgatgtgttgtctgtggtattacatttgaatacgaacatgatcactttgaatacaatttacctcatttttgtgtaactctgtccaaatattaatgttccactttcaataatgtctgccagcattgtgaagatatgggatacgcgaaatatcaaattgtctctctccaacagaagctctcaagcagcaatgcaacctttggtaagcagctaacaatcactacgcaatatgtttgtagcccaatttcaagacttaccgatcatttgtgcaggagggtgtgaaacatgggatctcttgcttgtctcaagactcgtatggtgcctatattgctgcgtcatgcatggataacaggtataaccgcaatcaaccacactgcctcagacttaatatgccatttgtgaaggctgcctttgactttataagcctttcaggatctatttgtacagtgctcttcatatggataaaggcccaattaaggcttacactggcagcaaaattgaatctttttttgtcaaggtcagtgagtgaacaagctgagttgatttccatttttcaaaccgcatgcctgcttgttcttaggtagttttatctgctatgttttataacacctgatatgttggtcaaatgcagtctgctatcagccctgatggaactcacattcttggtggttcgagtgatggcaacgtgtacttatggcaggtagttgttggatcatgttatcatttcgcacacgcattagctgctcttttactttctattcatgccactactttttcactgacataggtggatcagcctgaaagaggtcctataattttggaaggccatgaaggtgaagctacttcagttgactggtatgttctacatacaattgtagtttttttttgtgtaaatcttatcaaccatccaatgttcagatttcagtacgattttttcacaattttcaggtgtgcatcagaggtcgggaagatcgcaacgtcatctgacgattccaaggtgagtatgtgattaaccttgcaaattttgttcattcaactttcatgaatcttatgagaatgagatccttttctttttctattacacacctacatgttgcaagcgaatttaaatgcctgttttggtatgtagaaaggggagctgctgatattcagtattttttttaagaaaaccactgataacaacactttatgatgtgtatctatcaggttcgcgtatggaatactgagagaagggtgttcccaaacacaagttccccaacggtcatccgcaagagaataaccgcaccaaacactggaagccggtctgctagccatgagctagctactacctcaagagatgtaggagtagcagcctgcaccagtgcagatggtgaattgccaactggttcacgctctccccttcagcccagagtactggagtttggcacaccggagtcagcgaagaagagagcctttaggttgtttcaggaggactcattggacataaggaaaagcccagaggctcaaatgaacagcccttcttcggttctaagccccccacattcactgaagaggagaacaattcgggactactttgctagtagctcatcttgtgagcacaccaagcatgtccatgaccttgcactcttggctcactcgtcaactgtgaagaacctcaaaaatgctcaatatagctacaggtgcctgaaaaaataactttaaagttttgaacatcgatttcactaaacaacaattattatctccctctgaaatgttgctacctaagatgatagtttagaactctagaatcattgtcggcggagaaagtaaattattttccccaaatttccagctatgaaaaaaccctcaccaaacaccatcaaacaagagttcaccaaaccgcccatgcggccatgctgtcacgcaacgcaccgcattgcctgatggccgctcgatgcatgcatgcttccccgtgcacatatccgacagacgcgccgtgtcagcgagctcctcgaccgacctgtgtagcccatgcaagcatccaccccctccacgtacaccccctcctcctccctacgtgtcaccgctctctccacctatatatgcccacctggcccctctcctcccatctccacttcacccgatcgcttcttcttcttcttcttcgttgcattcatcttgctagctagcttagcaatggcggatcgcgaccgcgccgggcagtactaccagcagcagagagggcaggtgggggagacggtgaaggggatcctgccggagaaggcgccgtcggcgtcgcaggcgctgacggtggcgacgctgttcccgctgggtgggctgctgctcgtgctgtccgggctggcgctggcggcgtccgtggtggggctcgccgtcgccacgccggtgttcctgatcttcagcccggtgctcgtcccggccgcgctgctcatcgggctcgccgtcgccggcttcctcacctccggcgcgctgggcctcggcgggctgtcgtcgctcaccttcctcgccaacacggcgcgccaggcgttccagcgcacgcccgactacgtcgagcaggcgcggcgcaggatggccgaggccgccgcgcacgccggccacaagacggcgcaggccggccacgccatccagggcagggccgaccaggccggcaccggcgccggcgccggcggtggcgccggcaccaagacatcctcgtaagcacgcgccgcgcgcgcgagtggctcgcgtcgcgtacgggctgggtttagcctgctgggtttcgcttcgcttcgtagtagtctcgcccccgaccgaccgagtcaagagtgtgtcccgaacgtgaccgtgcctacgtgtcgtgtgatcctaaagtctaatgttgtaccagctgctgcgtactactgctactaggtaagatcgatgtagttttcgatttagagttgtgaatgataataagcgaggtcggggggagcaagcgatctggggagtttgtgcttgatttgagttgatgatgaacatatgtatgcattccgtgttcctctgtaagaaaagaattggtgaatgaacccatgtctctttgctcaaatgtcagtacttgaatgctacattacagcctagcaatctgctgattgccgttttattatctccaaaatggcttcccagattagtacatgttctctctgaaaacagttgaacgtttttcacagcgaatgcaaacgaatctgtctaatgacatattgtaaagccattttgtttaggacacatggccgcctactcgtcacgtggacattttcaacgagtgatgtgtcttggttaggccacgtcggcctgattgtcggccgtcgtgagtgctgaccgttctaggctagctattgttgaggaagttgggctttgtcccataaaggccagcccaaaacaattaggaggttaaagaactggaataagttggtgtttgaatctcctaatctcctaatggtgtttcacgcataataagatggtaatgcgtgagaataagattggtgtttgaatctcctaaagtgtttcacgcaaaacgagatggtaataatatatgattaattgtgttttgattattaccatctaagtcatctaagttttcgcacgaaacgtaccaagttttcgcacgaaacgtaccgtttaacagtttgtgtttcacgcaaaacaagatgataataatgtatgattaattgagttttgattattaccatctaagttttcgcacgaaacgtaccgtttagcagtttgttttcgcacagaacgtaccgtatacaatttgaaatacgtactatttttatccaaaaatttattcaacttttgtttagaaaaaagaaaagaacagggcctcatcttacttgaatagttataggaggttaaagaacttgaatacgaacctgtctccttcgttttactttctcctcctttatatattgtgtcttcattctattttatacatcgtgtcttcgttttaccctgttctctttatatattgtgtcttcatttttctctatacctacataacctttcgaactactatacatagtagagggttatctttcactctgctctcttatatattgtgtcttcattttactctatactcacgtaatcttctgaactactatacatagtagaggggttatcttcagtctctattttactgtcaccatatcttgtgtctccatttcactctgttctcctcatatcttgtatctttatttttctacttatgtgttacgtaatatctataactttatcaaaagttatcaaggtgtacactagcaactatcttttttaggatgtacatgtcaataaaataataattttataactaataatgggaaaaactttccatttatacccgaatgaccgcgatgcacctaggctagccagagttgttggtggttcaagcagctacgaataccctagtggtaaccatatatcttcaatccaattcgcccgaaaaatgacggttgagaaggcgaagtagtatactgtagtatatattctcggtctaattcatatttttctttaagataatagaatatctcacattttcattaaacaataaaaatgaaatatccggcctctgcaataaggatacacacaaaccataaagaaaacaatcataaaaagggaaataaatagacatcgtgaatataccatgttgtgctcccgcattttgcacagctagaatattgacatgtacgctagctgaacttgattagtcgctaccaagtaccaattgacacggtatttaactatattgattatactccacagtattgaactctattgctataggcgaaatgtcttccacttcttttgcctggtaaagtgaggtgctctttataaaaacatctcagcaataaactagtatgtctacatgggtatatatagctctctaattcattgtctcgtttttctctatagactatctctagattaatagataattttgctctctctcttcatttaatctttttcaagtagaaaaatatgttgacataaaactcttataaagagtttttaaataactattggggtgccctaacgttgttcaagccctcgggccggcggccggcacatactaccaagcagggtctgctggccctttggtcgatccgacattggaattcgttattgtaccattattagaaaaagaactaccattggaatgtaattgttgtaattttttttaaaaaagtaacaaatttataaatgcccctttaatcaacagaggtatccagctaataagcttctcgtatgttccgaacggccacattacagttgctctagcggcaagtggatgacaggcaattaaagaaaaaaaaaagatcttcagatgtcgatgtgagaatcacattctcttttctcatccgccacccagttccccgtctgtttggcaaaatcaggcaactagagagtcctcctctccctggtatatgcacgcgcccgcgttcgtgccgacgcgtgtgaaacggccgaggtcgtgacagcagcggcgcgtgttgttttttcaagtgacggaaaaactgacgatgtcccgcgccaccggccaccgcgcaaagagcgggcgagggccccacaccaaaaattccatcacaccaaatatacacatacatgagacattaaatatggataaaaaaccaatggataaaaaaccaattatacagtttgcatgtaaattacgagacgaatcttttaaacctaattacgccataatttgataatatagtgctacaataaacatatgctaataacggattaattagacttaatatattcgtcttttaatatattcatctcacagtttatagtttatagacagaatatataatttattttattattagtctatttaatactttaaatgtattttcatatatgttaaaatattttttttccaaacaactaaacacggccacacacaccccctccaacacgggccccaccaacttggggccccacgatccagtggctgacacgcggggtcgtgggccacgtcaattcgaagtagagaaagcaaaaaaagaaaaaaaaaagggaaagcgaaacgaacgaaagcccaacagatccatcgaccgaggagaaggcgagagcgagccgagccgagagcgcaacaaaaggaaagcagggaaacctcgccgtcctctctctccatccatgccctagcacgcgccgcgcagcctacgagcgggagccacacctcgaggtaaccaccaccaccatcgccaccctcctcctcctcctcctcctcttctcccctcgatcccgtccgatcaaaaccctagcaccctccgcgcggcgctggcggcggcggcggccgatccgtacggttgcggcgcccgcgtcggtgggagggcgatctgaattctgggtcggcgagtcgggcggtttttgcgtgtgtggtgtgttgtgttggtagggaggggatcgtccggtgccgtgatcgttgggtttgctcgttccgctgtggggagggcgtcttttggtttgaccatcggcggcgcggggcggggtgcgtgtacagatctgttcggaagtgcgtgggaggtggggggattgggaatcgcggccggattttgctggtattttggaggagttgtgatgggatctgtatgtgcgggcagattcagttgtaaaggctgccgttgagtttcatttcataggttgttttttttttccttttgtggggattgttaggtgttattccaagccgttaagtgatctgtttgtgctttttgggtttggggttggtcattggcgatgttgacttgggttaggcctctgaaagagcgcggttatattgttgcgatacattatgaactattatgctgttgcgatacaggatgaaccacgtttctattgttagacgaattgtcccgatgaacccctgttcatctctaaatggctgccatgtctttaatacactgaaaatgccttcagaagctttgaacacagcttagatttactactactggtgttgcctgacatatcatttttacaggtcttcatctgttgcactcatgatttagcaccagctgaagtgacctctgagactgcgcggtgacgtagcctgttgctaggataaaaatctcagtagttaagcatggcggattctatggtgtcaagtttctgggggcctgttacttcaacaactgagctctgcgaggaaaattatgcacactcgtcatatattgcagaattctacaatactgtttctaatgttccatgtgttcttctggcacttgttggacttgtgaatgctcttcgccaaggttttgagaaacgattcagtgtcctgcacatatccaatatgatacttgctatcggcagtatgatcttccatgccaccttacagcacgtgtaagtttttctccccctaaactcatcagtattgatattgcaataacatcactgaccttcaatgctattaatggtgctgctctccaagaatactattttttctcttatgtgcttcaatatgatggaacaatatgttacatttgtgtgttaacatgcaagccatttgatgaaaacaccatgacctttttttgttattttctatggttttgcacataaacattatggttaactttggtgctatatgtttcctataaaaaaatattcatttgcatagggcccttttttccctacttctagtcgttttgtatagagaacttaacaaaaatgagtgatgtccttttcttgtaagaacaaatttggcatcaagttatggggatcagataactcttgatttgcccctttaccaagggcatattcttttgtaccctttgttattttttttgtctacagtgggcatttgttaacttctcaaaggatttagctcttgttcaatgaccattagcaactaagtgaacagattaagatttttgggctaactaattccgcagaggctaatggctgattaatcaccacataatatatgcattctgattaataacctatgtaaacttgtacacttccagattagaaagttaaaaacatgaggtctattggccactataatattattgaaattggcaacaccttgtttattattcgacacttttgaagctgtgcacttgaacaccgaacttgtaacactaacatgtttcacattattaacgttatatgaaaattaattcattactctataaaaaaggaatacttctataatatgaaaaaaatatttatatccaccagggtcatatctgggattgtgaaaggtcaaatgcttaactaaaagtgaatggatcagcagagggagtacgtattaataacttaatgtattgtgtttttcataaatattacttaggaggcttgcttttcctttagataacaagtcaatgtggtgctccttgagccagtaaatatggaatctgtttcatgtttagaagaaagagtaagactgtggattgcactctgctagtaagaatcctatgatataaatttatccttttgatttacagcataagcataccctagttactgttgcttaaaaatttgaacggttagtactcaacgactcactgcacaaattgtgccacaaattgtccagttattgcacatgataacagttagcttccaatgcctcatgcttctatgtgtcagtgtatcttaaagtagcattgttctgtaatacgactgcggactgccacattttggttctttgacatattgaataccatgaaatccacttgatattttgcaactgtttgttatgcaaatcttttgcagaagtaattcccacagttctgttttagttatctgtggcgatccagtttatatgccttagtgtcaaataaagcacattccttttagttgccattttgcagattagaggattgcgggctgtaaatcatctcccaataaattaggtcagccatttattgatgtgctgccaattgcatcacattgttagcttgctcaaaagctatagcctattttataccagcaacatgtagcccttttgactaattgggggcagctagtattcatcttctaattccagcatgtttccttagtatgcacaatatgcagtgctaattcttttggtcatgtattgttttccagtttacagcagagcgatgagactccaatggtgtgggagattctcctatatctttatgtactttattcaccagactggcattaccggagcactatgcctactttccttttcctatacggtgctgcttttgcagtagtccatttcctggtgcgattccaagtggtattcaagttgcattacgttggcctctgtctcctatgcatcccacggatgtacaagtactacatacaaactaaagacatggctgccaagcgtctagcaaagctgtgggttcttacgttgagcttggcgactctttgctggctatttgatcgaatgttctgtaagaagctttcacattggtacgtcaacccacaagggcacgcatggtggcatattctcatgggatttaactcatactttgcaaacacattcttaatgttttgccgagctcaacagcgtgggtgggagcccaaaattacccaccttttcgggttcttgccttatgtcaagattcagaaaccccaaaagagggaatgagttctctatttgtcagtgctgttctccaggaccttaaagccaacgccctcatgtgcttagacaagaagcagaggcattttttttgtatatgggcttccaagtgattacggactacagtgttatgatgcctcactagattttgttaacttttaactaacgcctgttttgtaccatacttaattgttgctcagagattagttggagtgttgtctcatagttttggtcattattttttgtttctctacatttgattttccgttctaataggactgaattttatttgttttttgtttgtcttgaatgttgtcgaacagttttagtcaagttactgcttcatatggccatagattgatcttctgatggttcaattaattctttttctgctgttgtgatttttgctcgacttgaaagctatgattatgtacaattcgatttatgtacgttcatttaacagcaactatacgtgcttcttgcagaagcactgttatccgtttctggtggtaatcaatatttaccattacttccaatttaacattggtctgcctcgagatgggtgttgatactcgtgtggtagcccatgctatagggtttttgtgatgttgggcaggtatggggttcttttgtggcgctggtaatctgaatgggcatccatactacgactgacgaaaaattaagaaatgcgacatatggtgatatgtagaatgcgcgctggtaatctgaatgggcatccatactacgactgacgaaaaattaagaaatgcgacagtaccgttatgctgattgtttccttgcattttattagggtgtggctaatgggcgatcgatccccacgccccctatacacacctctccttccttactcctcccctttttctcttcctactacactataaattaaaaaaaaataaaaaaataaagttggaaaaaattatgtatagatatactatatataaaaaatatttgaattcaaatttaaatttgaatcgggtataaaaacttttggcttataaactttgggtgaataaactttgggtgtataaactttagatgtatagaaatactatatatataaaatatttgaattcaaattcaaatttgaatcagatataattcaaatttgaatcgggcatgtaaacttttgagttataaactttaggtctataaactttaggtgtataaactttagatgcataaaaatattatatatagaaaatatttgaattcaaattcaaatttgaaacgggtatgtaaacttttgacttataaactttaggtgtataaactttagatgtatagaaatactatatataaaaagatttgaattcaaatttaaatttgaatgtatagaaatactatatataaaaaaatttgaatttaaattcaaatttgaatcgggtatataaacttttgacgtataaactttgggtctctaaactttagatgtataaatttgaggtgtataaactttaggtacataaatttactaaataggaaagtaatgcgatgctaaaaaaaggaaaccaggtggagggagggggagacccgatccgatcgcccctggcggcccctggcgatcaatcgcccaataggagtttcgattttattatggatcgtttagctgaccacatggagatcatcagaaacttcgtgcagtatatttgtaggttgagcttatttaaagctagcactagtatttatatggacgtgactagacagctagtggtagctggtttgtctaaatcagctaccactccatatataagagaccctatccacctatacttcaaataaaattttctcttaaactacttatccaatctacgatccgattacaccattgtgttcgtaacaattaaatctttataacaagatctcacatgattatattttgatgaaaaattataaattacttttataatatatctaaattacttttagatttcactgaattacttcttcgacatataaaagtaaattcaataaagcttaaaagtaatttatatatattatagaagtaacttataacaaaaggaaagtaactttaatttatgccttttttttcattggacgtgactacacaactagtggtagctggtttatactccatctagtgtttcctttcaacttgaaaaatgcaatagtatgtttccgttttgttttaagatacttttataatatatgtaaattacttttagactttattgaatttacttttatatgtctaagaagtaacttagtcaaatctaaaagtaacttatatatattataaaagtaacttatgtatatatcaaaaataatttacaaatataaatattttttcatcgtaatataatcatgtaagatcttgttgtgaaaatttaattgtaacaaacacaatggtgtaattggattgtagatcggataagtaatttgagagaaaaaaatataagaaggaagaaaaagacatgcatgtctaagaggaaaaacaagcatgcacgtcagcacgtgtagcagtccttctggttaacgctaaaccgagaagcttctcggtttagatttttcctatttatatatattgttcttacaaaaaaaaatacactaaatttgccatcaatcctacgtgttctgaacttctatgaggggaaaaaaaagagagcagacatggaaactaaaatatcctatctttcgaaaatcgaagtccataccatttcctaaattaatgactttatagaaaccatgtttctgttagaaggatgtattaaagaatacaaggaatcatgccactgatacgcgtccacaaaatactggtaagaattcgaatcaagatctgtgggataaacaaggataagattccaatctcacagcagcaccgcctaatattcgccgcatcatccaatctcacgctcacaattgtcaaaatactcaaatagaaatagaaatgctcaacaactgaacaccaccatgtacatccactaggccactaacactaactagattgtggtgcgacgtcacgcgcgtgcgcaggttaagccacctgccacctaccttagcacaccatgcagcctagtttctgctgagtggctgctgactttgctgagtgctgagcagacagcagctgccactaaccatttgcctcagtattcatctcaagaacacatttatcaaaagcacaggtggaaacaattctgatgagcgagatttgcgattgcaaaacaatagcaatgtaagttcaatgacaatattacattattacaaatccaaggattatacaggcctcaagatctgaccaaaacaaggccatagtatgatcctcgacaaatggtgaaagggagaaaaagaatactttgggacttgatataccactatagcatgcctggtaaccaaccttatacccatcagtacatcaagtatcaatatcataataaacaaaataaacaccgctaaggtaaagaaaagaattccgaaacaccaaacgagtcttcttttttaacggggttaattaacaaaacagggaaatatttttgaccgatgaattgaagctgccggggtgcgattctacctgggtcggtcttgaaacgaccccaatcaaggtacttcaatctttcaacctactggaacctcaataatgtatatgatttacctcaataaagtaaagaaaaccaatctctgaatcaccaccatcagctatccatccttttgcttgctgaccatcttaatgaacaggaaaaaaattactccaaattcattaactaagaataataactccttgcactttccaggctcattcagcgcttatgttgctagactaccaatatgctgatcaagctgcatctgttcaagcaatgctccaataacagcagcttggtcatgcccatccagcggggcattcagactaggaccttcaccgttgcttacactgggaggcatcagtggtgaaggtccaacagagtttatggattcagcagtagtgacttgcttctctggtggagattccttaaccagtgtgtgtacccaagagagatctggatcatcaccaccagatctcagctcaaacgatgatgaccggcgaagcttgcccaattcttcaccattaacaccccagtcaggtgtccctgaaggtgatccccactttgaccatgatgagcttagaggggagccaacaacacctgatgctcttgcagcactcggcccaagatcacgagaactgagacttctcattgtctgctgttgcttctcacgctgagcaagagcagcagcaagatgagagttcataggggacccagattcaacacatcgaggagacatgcggccaggggaggatataccaagtgatgcttgcaacagagatgagtgtgaaggcaactgctggttgtccacagacttcggggagaagactgtgttgattggtgaaagaagtgcctgctgctgttgctggaactgattaaggaaagcagccttgtgagatggtgaaaacataccaccctgatcagcattactatacctcggggaagagaccatctcagcagagaagagatcatccaagtttgacggatttagggacttggtccgagacgtgtggtttcctgttgatgaaccaatacgtgaatagcacaaatcatttataagctgtgaatcaatatcctgcatcagggagtaatcatcagcaggcatatcccttgcactaagtgaggtacggagccggctcgactgaaggctgctgcctggaaggtgtagtgtcggaacatttggctgctgccagcccaatgaagggggcatcccattgcctgaaggggacattggtggtgtaaatggggacatgactgctgaaactgatgatggagaaccaggcatcaagcccattgctgcagccatctccattgtagctgttgccgaggctcttggggatggtactgcagatccagtggaaacatatagtggtcggagctcatcagttgtatgcgcaaagaaacagacacggcgattacagcttgtgccatccttgcaaaggcgagtacggtactgtgctggatggagccaacactcgaacacgccatgagcatattcacacatgtcaccacgccggcaaactccctttctaaagtcggggcatggcacacagctgtagtgatacttgcgagggtcccgacgccgtgcgttctcccctgggtgaacaaacgggcactcagtccaatcatgtgagtacgcccgcgagcatggcctgatcttaaatgagtacatgcggaactcatcggaagcatagatgctgttcttgatatcgggaagggacggatccactggatattctttcttttccgatgtcacaacccttggaagatctgcaaactttgtcgtcatcatcacagcagctgatggagatcgtgcatcttctgctgtaggggatgatacaggtgacaacatagagtttgcggcccttgtcaccacccggagaacgccatgcccagcctttgggcatccaagaagatcttggagggcaatcttggcgtcaaacatctttggaggaacagagatcacatcagctggacgatatccggaagcatccgtggcatcagcatcagccccagcagcaagcagcagcttgacggcctccacacaagacggcgagccaccagacgccgcacagtggagggcggtggtgccgtcggagccacagcggcgattgacatcgacggacgggagggacagcagcaggcgaagcaccgcgaggctgccataggtggccgcgaccatcagcggcgtgcggtgctcgaggaccttgcggcggccgtaccagaggcccgcctcgtccgcggcggcgggcggggcgcgctccagcgcgcggcgcaggccctccgcgtcgtcgtccgcggcgagctcgaggagccccgcgaaggcgtcgtccgtgtcgacggtgagggttttcgccatctcggcgacggcggccgccgcggcggcactcttcttggtcgcggccgccagcgccaccgccgcgccgactccgtcgacgccggccgcggcggacgcggagatcggcgtgccgttcatcggggcttgtcggatcggaagaactgaagccatcagcaaaaacatcagtcaagaaaccagtcaagggagtccaaaaacagcacaagaaatggactagaaaccaaccgaatcggatgcacataaccagaaccgacgctacaaaaatggaagcgtaaacacgcaaacaaatccccccaaaaccccaccaaaaatctcctccccaaaaccccaaatcttccccttagatcatgagacctccaccgagccaagaaacgcaaagcaaaaaaaacaccacccgctagatcggagggagcagaaaagggaaagccccaaactgaccttaataacctcgcagcagcagcagcagctcgcgatgcggcaaaccatctcaccacgccagcatcgaccgaatcggcccgaagatctccgcagcccccatggcgaggcaaatcgggggggggggggggggagaaagcaccaaagatcccgctataaaaacaaataaaagaatcccacaaacctcccaaccaagaacggcgcgcgcctctcgcttgccgaggcgttcgggggagaaggcaaagaccgcgcgccctgatctagcctgcttctcgcgattgctgggggaggagaagcatggggcgcggaagcgagagagagcgagagggggtgggggaagaaggggggcagtaaaaaaaggggaaagtgatgagagagaaagcgagtggtgggtgtggagactttcggagttcccgcagtacgcactctctttctccctctatctctatccgcagcaattataaccggcgggtgtgggactgtggttaaacagggagtgaaaaaacaaaaaacgggttaacagtgctaggcacatagaatatccttaattaattaattaattagttagttaccaaagtttttctagtatgagtactagaaatatgaagaaagtttggtagtagtactacattttgtaggaagaggttattatcacctattcgctttttaaaggggttgggtacaaccttgtcgtttacagcaattgaacgtattattgcacagtgttgatagccattttaatttgggatatgaagaatgctatatgtattatttttttttcttacaaaactcttattaaacacagatgttgcctgtggatatgttgtatgagttgactagacgagaagagtaaagatttggttaaaaacttaaaagtgtattattaattcttatggtatcgattaagtgaacaccaaaactaaaagtctatttttcatacagaaacttcccgtttatatttaatatcaaagataaatttgattcatatatatactattatagaaattaaagatgcttttaccagtattttggtacgtcatccgcatttgagttggtttttaagttcgttcacttttgaaaatacatgtatgtgtttgagttggattttatgctcgtttgtttttggaaatacaaaaggagtcgtataacaaatcattttttttaaaaaaaaactcatgctaactttagatgaaatacggactactaattgcagctcacgatttcctaaaaaaatattcaagcgaattctcactgtgaattttacctaactaaaccttataacaattataaaattaaaatagcatttatccgttgcaacgcacggatattttttctaggaactataaatttactgtattagaaaaatatcactactattcgctaaacatgttgtgtgccagtgaaaactcctaaaatttgaattatcgttgtcacgtttccaggcatcttctcctccaaactatagagaggaaaaaaaaaacatcaatggtgctgcgacgagcttgccaccgttcggagacctcgttagcacattgatgagctcaacggcaccggtaaatatgcttgtgctgtggtaaaaaccgttgccggacttgccatctccgagatttggccaccgccatgtcgagctcgctgtcgttgcacatcctcccccttctacgtcggccgccactgttgcatgctcgttgtactatcgatattgagcagcagttgtatcctcctccttcccgctacagttttcgttaatagtaatgatttttttttctagtaggacggattttgtaatgatatggattaattttacgctatatcaaagggaacacaaatctttgaaaaaggcagtttctatatttgaagttaggcatgggaaaccgaatcattcctcaaaaaagttgagagtcagttgattcatttgcgcattaatttccatgacagcagaaattaggcacagatctttgatgtccttcacaaaggatgtttaagcagatctgaccatttttctcaaagaaaatgtcaaataaacctcttttccagcagaaaatgtaccggcaggcgtgttgtcaaatcaagtacactcctcgagccaccatagttttctcttctttctcagacaaacagtagcatctcatctactccggtgaagctcgtgccgcttgagttgagaagctgtcaaaaggaagtacttccagctagaccacccatatacacacacacataacaaaatatccataaatctctcactaataaagtaccatatcagtttaccaaaccttacccaagcttagtagttttacatggcaaaaggttaaccactccggcacaaagaagcgtatcgcgcgaacgatctacgctagtggggaaaatctgatagcgaccccgtccaggcatcgcaccagtgcccggtcggcgaccacgacgacgactactggagtacgtaaaaaaccgtagcaacaaaccggcccacacaagcccccccaccgccgcttcccgaggcgactccacgactcgaccacggcctctgccgccgcgtgcagatcggtccgagccaagccaaagccgccggcgcaacaccacgagaccgatcgctcctaccacccatgacatgagatgatgagaggagacgccatgagtgcgcgtccctttcgcggcggggtctcgtccgctctcgctctcgctcgacttctcgaaatttccgacgcggacgcatctgtcgcgtgtccgcatccgcgtccccggtgttttttcaccgcaagggggaagggggtggcgccacggttggtttggcgcgagccggggtgtgtgtgtgtttgtgtcggcgtggggcgcgcgtacggcgcacgtaaaaacgcgcgtggtccagcgggggatttgggcgcgatcggcaaactcctgtagcgtgggcgtggacaggcgccccgcgcgcccggcaggcggtggccgtgtggtgtggtgtggcggttcatccatcctggcgcgcggtgcgaaattccgtcgcgcgcgcgatggcggccgaggatatcacggtctccgggggtccgcgagctgctgctgctgcgtttggggttggcacgcacacatgcagcgattggtgccgagcaaaagccgaacctgctcgaaattcggttggcaattgattggggagtttgcctgctcggtttgctttgcttcgctttactatttgcttgtgcgagtgcgacactggcctaccacgagagcgtggcccggccgctggcctgcctatcccagggaagagcggagctgccgtgcgtggcaggcaggcagggccggccgtgctacttgaggagttgaggtcatcatgtcctgcccgcacccagacagcggcactgtgttgacacaaaactctcacaaactgcgggctactgctggctggagtaggagagtactaatattcttcttgatcaggtgcgccagatagccagtggtgttgtatgctgcgaacagtctctctgcctttctgttagattagattagttagagattagcggaagagatgctgatagcgtaggattgagacaataacccaagacccatggcagcgcacgtgtttccgcaacggtatagctaagccagccacaacggggtcatgtgcgcaggctagagatttcggttatcctgagcgaccggtgacacggataattttgtttataatcacagggcaatttgctattgcaactcggctactaatcctagttggatggactaggtagcaaggtgaaaaacaaccccccaccaatgctgctctccaatcagtttctctggcaggtctcttttaatcatcaacatttcagaaacatgcatgccctaccaatgcaagcaaagaccccaagctagtaccatatgaatcatagcctcagggatcttctagcagctacatcttcttccaaaatcaaaagttttctcaattagcctagttttccgtctatatccacaaaataaactaaaacctaaaatctaggaaattcagctattttagattcttagaagttgtctaccaactatcaactcctcggaattttaagctactcaaatagagtgtttctttagagagagataggtattggagttaggcaccacaatcagaagagcaaccaacttggttgtgtggagtaaacatcatatgcccggcaagttcggcaaggacatggtggtcttgcccctcatcgaatcctttccgcttctgacgtgatgtagtacatataactatcattccctagcgcatcatgctgattccagggatttgggctggattggtggcggcccagatcagcttatctgttgtagctaaaagttgaaatttaaaaaatattttataaataattttatcataatttattggtctttaagtcactaaggttgtgttcgttcacgcagatcaactgaccttttaaatagtgcggaaaccagagcaattaattaacttatgattaattaattattataagcttaaaatagatttatttgaacttttaaaaaactttcatataaaaggtttttaaaaagggttaattgtattcataccactgcaaatatgccaacttaaaaaataccactactattcagcatatcggttatgtgccactggaatatgggaaaattggaaccatgccactcccgtccagttttctatcacctccgtcatctctttcccacttcattcgcttctccgccatggacgccggcgagccctccacctcggactcgctggtccttgccactgccaccaacgatcgagcatcttgtgtcggactcgtaggtgcacttctcctttgtttccgatcgagcttcttgtgtctcatctcatgccttgttttcttcctgctcgcaggttgagttgctctctgaaaaccctgctgcgcttgccaggtaccctgtgggcactgagtacgattgggaaggtatacaaagattgagagatgacgaacaaatgaactagatcctattaaaaccatgggtgccaccaatcccgccgcggagggcgcgtggaggggaacacgacgtgatgccaccctgcgccgcagccgccaccgcgatggcgcagtcgccacgcagcctccacacgctaaccagcttcggccgcggcgccgatgacgtcgagatgaggtcacgcccgcgtccgacgtcggtgacgcggagggtgccgggtccgacttcgacctcgacttcgcgttcgcgccgccggtatcagcggccaagttggtgccggccgacgacatcttcgcgcacggccgcatcgtgcctgcgtacccggtgttcgaccgcaacttcctcgacctctcacctggcgatgtggcagagcctgcctccacggcagcgccctccaccgacacctactgcgcgtggacgccgcgctcggcgccgagctcgcccagcctcgacatcgcagcgagatcaacgagggggaattgcaactccgagacgacggcgaagggtgttcctgctgcatctacagtggtggagagagaggggaaggggaaagagaagagaggggaggaaggtggggcccatgtgcggttggggctaattgggatttttgacggaaaatgtgatggagtggcatggttctaatttctcccgttttgagtggcacatagccaatatgctaaatagtactggcatttttttaattggcatatttgcagtggtatggatccaattaaccattttaaaaacacacaccgttttaacattttaacgctaaaaaaatagaaagctatagtttagaacgagagaacacttcaagaacaacataagatgcaatctaaatattatgaatagctaattaagcgtaaaagaatggttgcgatttaagtggtagatctaatcaaccgataaatcaatacaccaactattagaggttgtgttgaaataattctccgtcacaagatttaatgacggttctataaataatgtgctaagagcctgcagaagtctctatgatgaatgaaaagtaaccaggaagtttattgtgagatgtaaaaaacaataaaaaacaaaatagcaaatgttccaggatcagttcataatatatgcacgcttaatatattagtctgtttgggccgaacacacatactaaaacatacacactcaacagtttcgttttccttctgctttatttgatcaatactcgtgcacttatactgtttgcatggcgatgaacatgcttgcttgtagtatcatcgataagtttccctttaattttcttctttacatctgtttaatttgttcaattttattttattacagctaatattttaagcgtaatggaatcattctttgttcgatggaggtatggttattggtttatcacacaccaaatctttctaacaaaaagtcatgacttgtaatcttatagtctctaaactatctatatgatgttctaaatgtatacggtaagaaattatgcagggaatgatgttttattgatcatttaagtgagtaccacaagcagtatgtttattctacttgtttattttattttatataaaacatgtttactctattaactaacactcccttctcttttaatttcactattctcttctaatttcactaggtcatgagcaaccgttacaacagatacttcaccctatatatgaatttaacaccggcataagtttttgttttatcataattgttgtgttttctagaagttaaaagatttatatattatttgcctatttattttataatataagaaaaaaataaatatatttatgaaatggtttatgtcatttagtttttctatctattatttttagtttctcgaaacatatgatatgtggtaacgatacttgtcccaaataatttgtaaagaattttacaaaaaaaaattcatctttttaatttttcttttctcctttttatgtgtttgcattggtccgatcacgcactgttggattgtggtgccgtgtggcccatctacacacggaggagcttttttctctctctctttttttttacaattcaccatagtaacttgcgtgcttgccatttttatagagagagagtttcttaccatttttatagagagagagagagtttcttacctggtgctctttccaccgattgtatctcgcctctttccaccgattgtatctcgccacgtgtcgctcaactaatggatggtgagggtagccaatcagctgacattaaaccagccaatatgagatagatagatagatgcaaagcgaaaagatattttgggaagtctctagaacatggatggtgtgcattttgtttgcttctcggtttttttatggatattctagatttatatcaaagatgatagataattgggtagtctataggatttatgtttttctttcttttggctatttttcatgtatagtttttctagatttatctcaaaatttatcaccaccatgtggtctaatgagatgctcaagatgagccagctttcgaaagatagatgggtctaagaaaataaataaaaaattttacttacaatttataatcggttgcatgtgaaccgatgagactgcatatagcctgccagaactaaccgatccaaggaaaagcaacgtcaagaagagctgcgtattggaaccaaatagatacagattttggttccaacacctgaaggatgtaacgctcgtataatgtagagagattcttgagaagcagaattttatttagtcattagggcctgagatacattccaggattacaacagcttttagggggctactacaggcatcactggttacatgcatatacagacggtaacacccaataataacctgaactcctgaaggaagatgataggatattaggtcatctaggacaacaattacgctggggttgctctgaatggaagcaaatccccgggtaactaagaccaacaaacacttgggttatttacatggattacatggataaggcttgagcatgtcgagttgtgcttcatacgtcgtccacgtcgcttcccccaacatgagcatcatgtgtaacaaagtagtggctgccatcaggaccagacaccttatacctgcttagcgaaaaaaggggatatggttttgaattccagagtaatacaagggcaagcggcttgatgcataactctttaatgttaaattgtagagcttgttgaaacacagcaaagcaatatatgaggttaagaggattacctctctaaaataaatttcccttccttgtacctctggctcttctcatgtgcagcttcctagagtaggggcaccataaaacttagatgctacgcaatacaacatatatgacaacataaaataatcacaaatcttacatatttccatccaacaatggatccgcagccaacacagaagatatcagacacagtatgcattccggttatcatcatgcgatcctcttttactccagaagtcacattgacactgcccacaaccaacatgacttaatcaaaagagtataatacatgggcggtccgtaaacttggaccagagtatcatctatgtctgtaaacttgtaaaatgcacatctagattgatccccaatcttggtttaatctatcacccaaggtccaaaatgcagatgacgcagcttcgatgctgatgtgattatccacacctccacggtagctagacttttccatttaaacccctttgctataatagcccccaaatcgacttccactacccacaaatcaacaaacatgtatttcctggtattctggagattcatagtataagttatgcaccaaaagatttaactgggagcagcgggagccaatttagaggcatactgtggtagaggggcctaaatgcaaattctcaccaccgtggacaaccatatcagtgcctgagttgcaccatctatactttgaactttgaatgggcctaaatgtgcattttacaacttcatggatctgtacgacaccccgatccaagtttaaggaccggctgcatattttactcttataaaaacttttggttcgtagaatgctctagagttatatcatgcaactttgtatttgtaccaaatagtgagatatatttcaaccaaggacattaatttgctagggctaccaaatactccatttgtttcatattataagtcgtttaactttttcctagtcaaacttctttaagcttgactaaatttatagaaaaatgtactaacatgtttcaatacaaaacaaacatattatcaaaatatattcaatgttgaaaattgctaattttttctattaacttagtcaaacctaaagaactttaactaagaaaaagtcaaatgacttctaatatggaacggagggagtactacatttattgatctgaatgatggtgaactttacataacaccgtaaaactgttatcttcctgtaatggtaaagaaccacaaatttattttgctgcagctgaattctacagcaacactggtaccttccggtactggactacaaatggcagtctatggagacatgtatatagaaaattacagtggtggttagtctgctcttagtagtaagcttctattaaagtctatccaggacagctggtgtacattaccagagatcttgactggctgttcaatagtccaaatctaacttcaagaaaagcaagttttcaatattgaataagagttcaataataggaaagggaatggatgctttttccatatgtggataatgtgcccatctatcattcctttttccaataatgaacttaggcatcagattggtggtgaagcaattagggaagttgtcacatacctttactcattaataaatagaatcataactacagaagttccacatacaattattcttagtactgtgttgtatgcaagtagctttagctgcaagggatgcagttcgatatcaacttcacacatgccaaactttgacttataacgcaacttcttctaataggggttgtattattgcataggagatcaatttcaagcatattgagcgtcattctatgcaagtaagtggtgtaactttagctattaacaaagcgcaggcaagggataggtcttgtgtccatccatccagcatctctaacatagcgcatatccaccactcctcgaaaagagtagaataacaagagagtaaattatcacaaatccttgtctattggactctttactttttttccaaagagaattcgggtttctgttttggccattgcctatttattggtcaccgtaatatacgcccagcgatctcctgtgcacaatccagtgcaattacaatttagaggattccctgtctgcttggtttaccatcttccttatcctaatagcggtttcaagttacttgtactaccaaagaaggcagtcaaatcttaaaacagattcgtaattctcaaatttttcattgtgttaggaaggaattggctaggctacccgcgtctgaacccaaacaaggtgtggccgcagtacaaatcgctttcaatctcgccttgtaaaacgtataattagtggcctgacgaaccaggactcaagaaaagaaagcacagtgcatttcccattttcccccaaattccacacatatctcccggcgtacgctacctaaagtttgacgagcgaacaaaaattcgagggcaagatgaggcccgggaaggagaggccacttacaccttattgaagaggtacgccttcccgtgcttgcaatggaaggactgcaagaaatggaaagcagcaaccatgaaacaatcgctcccacatccgccgtgctcgccgaatcaaacaaagctagccaacaacaacaacaacaacgagaagaagaagaaaggagggggctgaagaggcgaaccttggagatgatgtcggaggagaggccgaggtgcgtgtggcagtgcttgcagctgtacaccttcccttccaggtgcatcacgaacagccgccccatcgcctccgtctcctcctccctccccctcgattccacaccccgatcccccagagcgccgccgcgatcggtgtccacccgactccaatcgcgatcgccgctagtccccctccctcgccgccgctcgttcgcctcgaatccgagattaggattgcttttgtttgtggggggagcagtctacgcgaggaagggggtggcttgtctgcagcactgaccgggtgaccgaagcaaaagcagcaactggggttggggatggggattgggttgatatggggggtggaggccgcgtgcgtgggaatggacgggggaggagaggaatggtaattagtatagccaactaaacatatatagccaatttaatagctaattcatacaatagttatttactataatattaatatctggtccatctgtcatacacatatttcgtcttgaagttcgtgctgcagttggctacagatctgtagccaactactcttctctcttctcgtttatttctttaaaatatgtttatagttggtttatgatatgctattatatctgctataaaggtcctttgaatcgtaggaatgggaaaacggaggaataggaaaaatgtaggattctgactggaatacaagtgtaaaacagaggattgcaaaacacagaaaaaacacaggagtttccgtttgattgtaccacagaaaaaacgcaggaattagagaaaagatgaagactcataggaaagtttccatgaggtagaacctcatgctagatttcttccaaaacttacatggcattagacattacatagaaattttataggattttatagaatttatttcttcgattcaaagggctgtatagaaaaaatttaaaatccttgagaattcctgtgaatcaaggggcctaaaagggatcgcgggggatgcgatgcggtgcggtgctgtgtccgattgcgtgggatggcctgggttgcacacgacggcacgagctaatttgtgcggggggaacaagtacaactgctgccgtgctggatctggtctgcccacctgtggattttcgttcctggatgcagcaacctcctctcgtttttcctttttccacgtaaactcattaaggctgtgttcgttactagttggttggaaactcatctcctcgcacagaaaacagagcagtctattagcgcttgattaattaagtattagttaattttttatttaaaaatagattaatttgatttttttaagcaacttttgtatagaaactttttttttaaaaaaatgcaccgtttaatagtttgaaaagcgtgggcgcggaaaatgaaagagtaaggatgggaaccgaaagttccgaacacagcctaaaggaaggaaagaaaatgtagtactcgaggagtgtttagttctgccaaacttttcaatttgccctctcttttaagataagaaccactccttccgcccctaaatacaaagaattattagtggatgtgatatatcctaaaattataaatctggacagggagtatatctagattcatactcgtagaatacggagtagtatcttttatcgaaactatcaactctatacgaaataaatcaaaggccatattacgtatgatatattagagcacgcgataaataattcaccattctatatgcaccaaaactaaagttaagcttatgcatatagagtaataaaaaaaaattagacatataattaataggcaaatcggatctatgccattttaaatgtgtggtggagagacaaccgaagagtgtcatttcttataaaaggccatgattatgacttcctttcataatctacttcctctatgttatcaagtggagtatttgctttaaacatatatatcctcctttctaaagaacattataatacataccctatacaacgagtaattctacatcgctacatcctatataaagccaactaatatagcataaacaaacgcctttagactctcgaatggaaaaataatattttgattttcaactctcgttgtctaaaattattttagccattacatacttaaaaaactatcatatcctatacatttgaactgaacttttctatggtaaaaacaagtataaatgtcttggaaatatactcattactcccactgtgacatagatccatcctcataaaaaagtagagtgctaagaacgagctagccatcaatggtttttaataaaagtagatgaattttaactcgaccaatggcagagctactaacgtatacaaacctacacaataaagaacattttgttaattgtcatcaacttgtatgtccatcctcaaactccaccattccaagagttaactctgttataaatccagcataaaaattagctgtgaagaattgaatacgggttaaagcaataagtctttgcctcacatgagcataaagttctcaaataagatgaaaaaaatgtactagtccaatttgatgaactaatgaacattagtccaagcgttttcttcagaaatggaggataaaaagtatttaatgtctctgttactcaattatttttggaaaaataaccttgacaaaggatagtggagtacaaaattatagggccactctggcaaatgtgtttgaaaaatgatatccacccaccaaaggatatatcccaatactatctattcattttcatattctaatcccacttttcataacctatagtattcgccagacatgtcctacaggtaaaaacaatattatagcctggtaataaaggagttaccatgtgttcttgctagccaaagttcaagttcccccaaggcctcaaccgttactttttgctcaaaatgttttctctcttatcattaatgctaagtttctccttaatatcccacttttccttttctaaaaaaaatgctaagtttctccatagtatccccaattttcctttttttttttaaaaaaaagcatgtcccacagttcaaactaataaacgacgtttgacaactcttatagaaaaaaagagtcacaaacacaattgccgccacatccaattggtgatgtccgtacaaacggacggatcgcgcgaacgcacgatttccgtccgcggagcaggaccccaagccaaaactgtgaactgcccaactcgtcagagacccatcgctcgaaccatcttgcggcggaagaaaggaagcaaagctgtgagacaccaaaccacagggaggcgaatcgcccggagtccggagaccccggaaccagccacggccatgtggcggcgggcggcgacggcggcgctggccctgggcgcgggcgccggcggggccgccatcgcctactccgacgacccctccgccaccctcaagatctgcgcgcacctgcccccgcgcctcctccgcgacgccgccaccgccgccaccatcgccttcgactaccagtactccctctggggcctcgacccgggcaccccggcctgggtcagcgccaagcacgacgcccacctccgctccgcaaaccgcctccaggagctctgcttccgcaacggcggcatctacatcaagctcggccagcacatcgcccagctggttcgtgctacgggaaatcgggctcctccctttgattcgtgtgacgtctttgctgaaattttggttgctgcgtggagttgaggtcgagctggttgtttgtttgtttgtttgttccaggagtatgttgtgccggaggagtacgtgcagacgatgagggcgtcgatgctgaagagatgcccggtgtcatcatacgagcaagtttgccgagtgtttgggaaagatatgggagaatcaccggaaactgttagttccttgccatcctcctccttgcattactgtctgaataccacttctatacctttgctgtgggaatgtaggctgctgctcaagcgcataacgatcgttgaattcacaattcacatgacaacttggtccaattctggcacagactattgatgcttaaacagattagtgggtttatgggctggattatgcacgggcttgtcaatttggaagcaaatctgacgattttttttctctttgtcctgatgtgtaggtttttgtagaattcgatcctgttccacttgcaagtgcttctctcgctcaagttcatgcggcaagaacacatgatgggcaaaaagttgcagtgaaggttgcaatctagagaaacactgttatttgtctcgagtacactctcatattttatttgggactcttacattagcactatagagtttgaattttgtccagcatgctgtcttcctttaacatgttccattcctatcttaatctcaggttcaacatgatcacttgacagatacttctgttatagatattgccaccgtgggtttgatagtgaacactcttcattatattttcccttcgtttgactacaggtacccctcctaatttggttgtattgtttcctttttattgacatgcatgctacctcaaaaacttatggttagatccagtttagctcctctttatgggaactatatgattatgcattggtaggaaactgctagccaacaaagtcccacatctttatgggtttactgttgcaaattttgtttctgcaatccttgtctgttcatgataattcctggctcactgcttttttttggtgatttattgggaagcggcatgcctatgcaaaaatcatcaatgggttggtcaaacacaataaaaggatattatcatcttggatagttacacaagatgtttggcatagttggtgtatcagctcaagattaaggattagaattatcgattttgatctttcaactcccttgttatttagttagggcgcttaggaaggatgagtttgatgctatccatacaattccaaaatttaaaagttgctataagcaatgcaaatatagtttcttaatgataaacatgtctacattctacagtatgtgagttgaataatatatttttattactgtctagtaagttaaaaatagtgccccattacattggaattatggttcttactttgattggatcgttttttttttccttgggaagcttatgttacaacaaaaatcatagactggcatcaaaataaatgaaatattttctcttggcaatgttggatcaacggtttttcaaatatgaaaccaacaaaaggactgtgattactttgaatcaagtcaacagcagttccttggcatgcaaagagccccataactactttagggatttgcattgaaagatgcagtcccttccacttcttcagagatttttttttatggtgctgtataactgcaaatggtcatgacacatgttatgatgatttccatttagtgtaaatgaggcaaatacacacaatcctttgcattgttggacagttgaattgagctcctcacaagtggcacgtttgtgtaattatgcatttgcagtacacaattatgttgatgtgaccatagttctttcattgaaaattagtgaatctacttttccacggaaatcctgttttgcatcaaagtttatgccattaaaattggttccttgcaggtggttagtcgatgaaatccgtgaaagtgcacctaaggtacctttctaatatttcttggcaatttaacattactgctgttaacttttcttttcaatatgttctgctaccatttctttttgttaattagtaaatgcatctctggcctttacgagttgtcatcttataactttatagtccattttatggtcatggactcatggcctgttgtcagtaggatctctcgtgtttatcctgaattttatgctcagcagcatattttccagttgggtgtcttcatgttgatcttgacttttatttttttctatacaattataatatactcaagtgtaaaggaacatatttacacaatttggattggtactgatttcctctcttggtttcaggaattagatttcttgaatgaagctaaaaacagtgaaaaatgcgtgcaaaactttagaagattgtctccgcacattgcagggagtatttatgtccccaaggtctattggactctaagctcatctagaattctcacaatggagtttatggatgccaaggaggtaactgatgttaaaggaattaaagaacttgggattcgcccagtcgatgtttcaaatctagtaagtaccacagtacagtttcttgaaaaaaaataaagtgctaataacttctttacagactctcacttgacagttgtgtaggtcagtaaagcattttctgagatgattttcaagcatggttttgttcattgcgaccctcatgctgcaaacatgatgatccgacccttgccacaagatagcaaaaaaacttttggtgagaatcttgccatctagcatcagaaaagtttttatcttcgctgaagtgtatctgggactgagatctcttgtccagtaataatgcttctatgataatcttaataatgcatactggcagtattttgtcatgttattgcctcattggatgagcagatgagtttttaaatgcatggtggggtagctttttttttcttgaacacgcatggtggggtagcttcaccatgtgatgatcttcattgcagtaatatatatgttaagtgagatgtggcatgtgtatttttttgtgagaaaatgagaatatgattgttttcttaagatcctaggtggaaacaatgcatattgcagcttatatttgttggataggtcagttattgcatttgtttattacgcttatatgattttttttacttgaacgtaggatggagaaggccacaattgattcttcttgatcatggtctttacaaagaacttgattatgccactaggataagctatgcttctctttggaaggtgacaaattgacaatgttatcgcagttttttctatgatcacaactgagtagtcattactaactttatgaaatttgttgatgcaggcacttgtttttgctgatgaaaaatcaattaaagagaacagtgtcaaactaggtgctggggaggatcttcatgcactttttgctggtgttctcacaatgaggccatggaaaagtgtgattgacccggctgtcgatcatcttgttctagatggcagtagtaatgatcgttctgaacttcaggtgatttatattatgcattattaatgttctccatgactccatgaacactgacagtatatgtaactgtgcaacttcagtaataaccaatagtaccagtaactctagggtaatccatgtatcacctcctacttgaaatggaattcaatcatttctcacttttttattttgttcattgttgctcaaagtaacactgctccaaatcttttgatctttccaatagtaggaaaaaaggccaccgaagtaatatggaattgctgattatcagcccagcttgctctaaagagatcggggaccaatttagctgttttttaatctgcaatctaaaacctatttaccatatatatgatggttttaagttttcatgttttcctagtatgtttggaaactttgttatctattgccatgcttgtataacattacatcttttttttttgttcattttcaattcccgtcctcattcttcttatgatatttttctccttgcaccttcaattcatgagatgattgaactgggacatgttagtcaaggttttctttttgggctagctgtggaaaatcatgtactttgaggtccttacgtgatatgtttttctttgtcacagatgtatgcttccttatattttccacaaatctcagagcttctaaggagactgccaagggtcatcttgttgatgcttaaaacaaatgattgtttacgttccgtcaatcatgccctggtaagtgaaaaggaatcatgaccataaatatgtaggctgtcacatagtaatatcttctttcttgcatttgtcacttcccttgatgcttttgataatcaagacgtaagttgtactgcaaaagaaaataattgatataacaaggaagcatgggatagctacggggttttatcatagttgttgcactggcttgaattgtttaatatcctatgcggttataagcaatgaaccccacgaagccattataaagtaggtattatttcttttaggcttcattccctctttatccgtgttcttctctgtagaaggtcaatgcagcatcgtataaggggcactctagcaagttgtacaaaaattcgagaattaattataggtccttttttggctctgtttacacgtatgatgctttgtcaggttggaggttcttcaatggaatcatttgtaatcattggacgaatctcttctgaggctgttttggaagctaaaaggatgagtagtagatcaattctgaataaactaatgatatggctagaggaaattttactggaagctcgattctttagtttgaagttgctgttgtgttttatgcagcttaagaagttattggcctgttaagcagcagatcagcataccaactattcttggactagtgtaaaatattagaagctgtcattttagtttttctttttgagagagaaaagtggcatttagttgaaaaattctttttctctttttggtatacaccattctttttggttaaccattttgctaccaggcttttcattttgattagccacttccaaacagaagatgatgccactatgacatcgtatgtttattctaatagatggatagaattgtagaaaatcccatcactgcacagtgtatatatataactctagttccatggatccagcaaatgttggcccgatgaatatgctgtgccaattgcgttatacaagatgtaagagtaaaattgctactggaaagagagtcactctgacatttgccagagcaaatttcgtttggtcaaatttgtgttcatcgtgatgtcgatctccattttctttaccccctacttttctgctagcattttatcgttgtgctgatgttctgcacttctggttcatccttttgagttgccgctcctactgtcacgttgacacgttctatactttgtcctagaacatatcatagaccactagaaatataaagcacttaaatctgaaatacaatatggcttgtagtagttaaccacttaacgatgcagtgtgtaactaacacggtatttttcttgaaaaaaatgtttattttgaaattcagtagctcaaaaaactgccacagattgccgcagattccccaagcatttgttgcaaaatctgccacatctttgtttccgcatatttctgaagaatttggaggtaattggattatggagatcaactacgatcggaacgtatgcatcggtgacagttttactgagccgagtgaaacccagcgattgccaccgctctctgcaagcaaacatcgtcgccgatcagccgaacagtttgggctcccccgtccgccaccgttgcagttgcaggcccctcgccgccgttggccgccggtcgcgtccgccggtgcttgctcatgtgcccgccaagcgcctgccccgtgaggcacaccttgccgcactcgtcgcacttgtgctgcacgatcttcatcttgcccacgtcgctatcgccgtcgtggcttgatgcaacgacgacgccggcgatcttgtcgttctcctcgccgtcaccatgggcgaccttgttgttgcccgcgtccccgccggcatcaatggcagaggccgactcggccttaccgtgaccgcggctttcgtcgacgtccgcgtcatggcatgctgcaacgtcgtcaacgacgacggggctcttctcctcgtcgtcgtcgtagcggctgccctcggcgccatcgcatccacgctcgtcttgtccgttgatgtcggcggcgaagaagctttgcctttggcttgctggagccacggcctccgtgaccgccgtcgtcgtggcgtcgcgcgctgcggcggcaatggcggcgttcttggctttcttcttgtggccgaggacatgcccgccaagcgcctggtggctgccgaagcacctcccgcatatgctgcagacgaagcgcttggaagctctctccgccgcctctgccgccgccgccgccgccgccgccgaagccgtttgcaaaccctcgctcgcctcgaggtcagggcctctgcttctcttgccgcgcaccggcggctgcggctgcggctcctgctcctcgccaccgtcgacgaacctgcggcgcttcctgttcttcgcctgcaccaccaccgcgatcttcttgggacacacgccgcgcggaggtggcggcgccgccttatccgaaccatccagctcggccggcaacaatggcgatctgatcaggtcgacgagtcgagccttcttgcgtgataccttcccgaccccgcggccgcggccgccgcctcctgcctccccacgcggcgccattgcgtcatcatcatcagagctcccctcgtcgtcctcctcctcctccgccgcttggccgccgctgccatccagcaacgccggctggcgcggcgagaaaccgtcatcatcgtcgtcgtcgtcgacgacgcgcctcttccgtttgcaacaacccgttccttccgccccggcgtcggcttcggcatcgtcgcggtccaccggcggcgcgggctggcgtgcaaggaacacgtagcggtcgacgtcgtcgtcgtcgtcggaatccgagtcagagcagtaggggtagtcctcgccgacgacggccacaccctcctcgtcgtcgtctccgtggtgcccgcgcgcgcgcgcgcgatcgccggagttgacggccatctctctgcacgtgctctccggctgcgccgcgcggctgttgctaacgccgaaacgtgccagtaggtagcgtgcgtgcgtgcgtgcgagccctagataccgtgggtccgtggctgcagtgcacacacgaggttattatgactaataactgtggaagaacgaaaacctacagcgtttttgttacggacacgggacacggcaacgccaactttctacatctctgtccttttttactgaaccaaaatgttcagtctaattagcatagagttttgtttgtgtatatttatacttctttcttgaagcatttttgcgcttgtactagctgctgatgttgtttttgagacctaatattccatccataacaaaattacaagaccagtgccttttcatttcgccacatcggtacaaattaataatatagatgaagatgacatatgcaaggtttctagtgatctactacccccgtcccataatataagagattttaagtttttgcttacattgtttgaccactcgtcttattcaaaaaatttgtgcaaatataaagaacgaaaagttgtgcttaaagtactttggataataaagtaatttaaaaaaaataaataataattccaaaattttttgaataagacgagtgatcaaacagtgcaagtaaaaactcaaaatctcttatattataggacggagggagtagtagatatattgttcgactccatgactcatgactgcgtataggtattacagagaatactcctgtgttagtactactccagtctaatcttgttagcagcacgggaattcaagaactctgcacactcgacatcccaactggcatcaaaacagacgcaatcctcctcacatatatccacagcatcatgaagatactcgcaacgagagataacatcttcagttgtcgtgccacttgatttatcgcgagccatttccagaaagtcagtgcggccattgtacttctctagatctggatggacaatcttagccccttcacactcacaatgataacaacgaccttttaacaaaaataaacaagggaaaaaatggcaatcagttatcgtaatagaggaagaaaaaaaaatactatatcatagcttgcagaagataaggatacatcagtgacagcagcatttagcaaagcagtaaaggtatacacatgtaaagataaggataaatgttttgaatgtggatgaagctaactaactttgttattagaggaaatgatcaatggaaattgtgctgtatttcacaatgttttttatatgacaatgatgttaaggagacaaggactgagtatgaattagttagtgccatcgttggaaactgtcaaggcgatacagtcatggagttgctcatcatggtcaatctgtagttctgtactgacaccattgttagcactaaatgatcaagcaaattgatttatatcacctcagacaatgtctgagattaaacatagattcacgttttagttgttactaacattttggagcaaacagcagaattctacttccaaaaacattgcttggtttgaacaattctaggcatgaccccaccaaacaatcttggaagtttgattgaattaatttctgtggcatctcttttaattaaaaaaaagaaaccatgcaaatcaacacatgtatgtcctttttgttcttttcaagtcaagttctgcagcgtaatgaaaatcttttcagtcgatttcacaacgccatggtgaaactcaacacatagaataaagaaacatctgtaacacgctaacatcatatgatgtagcaatactcaaatggaaggagagtgtaccaggatgccccatgactggacagcaggtcagttcatcgatcacgccttccttgttgcagcactcagcaaaaaaaagtatggggactgtctgagaagaatgcaaatctcttgggctcgccaaaaagttgacgtgagaatactgagatttggatcgatgccggctatatccaggtccataatgtcggccaaacatagtataattaactatgtgtgaattcaagccacagataacatgtagctcatactcaagtccctatgattcagaagtttatacaagtgaattagataatcttgatattgacatttttggtaatggtcgaaaactgaaggggtgaacggacataccctagtcctctggttgtatttcttcagtgcatcattaaccttcccacaaataaaactttgctcagccttgaactcttcctgaatgcacgacaaagtcatggaggccctctcagagagtacaggaactgtctgaactgaaccacaggaagaggggcagaatcgcatcagattgtgcacgaggagctgcacatttaaaatcccaccagtttgaaacataaatggatctgtctgcaggggaaggggcttcatggaaaaggttgacatgaaaaacttcactagtgcatcaggatcaggatgatgtgctgcggtggctgcaaccatgcaagcaaggtctaggcccaacatgtttctctcagcatggcattcttgccttgccatttcaaccgctccccaaagattggcgcccgtcaagaacaggtaacgcatagcctgctgttcagagattgtgcaaaagcaagcgcggaggtatgcaacaagagcattgagggagcggcacgcgacacgaacaaggcttcttgagcatgtcatctgcactgaaacctcctcttgtggtggaaacatggtctcataccaaactgtgttgaggacaatgttgtgcacagggttctcaaaggggccatagcagtggccggccttgaggagccccctgtggtagcgcattcgcaagccatccatcggcaggcaggcaataacatcaaggtacaatccatagatcttgtcaagcaggatgctcttcaatgatttcatccgcacaaacggcggctgcttctccttaatctcaagtgaccgaggaagaaaggtagctccaacaaggtccactggttcttgttgctggtgcttcaccaatctgctgatgttcttgacggctctgcacgagaggcaaccttccatgcttaggagattggaagcctccccaatctgagaagcgatggaatacaacctctcgacaagggatttggggtttgggtgccacccagcaatggcggcgcaagtgagggctgtctcggtggtcagcgaggcgaagctgaaggcgtcagagctgcggtcctgctcgatgagccgcacggcgacggagaggtcggcgtcggccagccggagatactccagcgcctcacaggtgtggaggtaggggaagtagttggtgaggaaggcgacgagcgcctggagcgaccgcgcggcgacgcccatgtcgcggaggaggcggtggctcggaccgcagccgccgacgttgctggtgtcggcgacgatccgggagagcgccttccgccgccgccgccgcgtcgggatcgccgccgacttgccgtcgggatcgccgccggcgaccaccgggacgcgcttcttgtaggtgatggtgttgacgacgatgttggagacggggtccaggaagccgacgcagaggccggccttgaggaggcgcgggagcagcgccggcatcgcctccacgggaagccggtccagcgccgccgcgtagaagccattgatggcgcccagtagcttcgatcggtttcgtctcatgcggcccggtccgtcgcattcgaggagagaatttttttcattttttagatttttttaatatttaccgaaataatctatcggcaaaaaatttttgcaaaaatagaccctgccgccccagtggtgggcggcaagctgacgtggcagacggcggatcgaccgcgccgtctaccgccgtcggccaaaattgcaattatccccaatgggcggcaatgggctaattgcaatttttgccgcccataaagaggttgtgctcgtactttttgcatttgggcccaagggacccagatgcaaaaagtacggccaaacgatttttctatgttatgttaataataaataaagaagtatttattggtaaaagttgttaatattgttataaaaatgtattgaagttggttgtttcgcaatttcatatgttaagtaaggtattattttgtaacttattcgacgtattagtactcggataataattaataggcctatcgcagtctcggtcgtagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaaccgctacgtgaggatccctctcctctctcaaaacgcgctttagtaaccctgtattgctctggtagttcaagctgcacgacacggctaggtggagttagaatccttctggtgtctatccattctttgtattgacatctccttggtggttcctaagaggaaagaatagatgtaaagcgagcaaagttagtaaatgttgtgagaaaataaggattcatgtaatcaaaatattcttaccatgaaatcgtcgtcaagaatatttggacaaacaaagaacgttcgacccaatgttgtaggctttatggaacgaagaacctgataacgatcaccacacctgcatcttggacgggcttcccatggagggagtgccgtagttagcacccgccagtcgctctgttgttcacgacattgtcgttcataagccgcttttctccgtaagtattgctcagtactttcggatgcgaaataccagcgaccttcttgtaaacaagtggttaggtcgagaacgggattttctgtatcgacccactcgatgtatgcgcaagctgtagtgcgggtctgccgaatagagtagtgttacgaagaataaagcgattgcccatacggaatgaataagcatatacatataataaaatacctcatggtcatagttagggcacctaaaaaagcgccttcctcgaatatcaggattcctcgaagccattagttggcatcgatcaccgcataggcagagaggacgctggcaccaaggtggtagtaggtatacacaagtatcgctacgccagttcggatcctcaacacctcggcgtgaacgtggcggggcatagtgggtacgcctaattggcgccgaaagttacatgcctgatcggcgccgaatgttacattggtcgtatgcggcaaatggcgggcaaatacttgtatcgcacgcgaataaaggaggctgcatcggtgcggcagaaagtagtcgtgcatgcgctgaaaggtatcgtgcatgcgccgaaaggtatcgtgcacatataacaacaacgtagtcattatacaagcatacaatactggaaagtgaagcaaataaacaaagagaagactgctctactggccctgccctacgccgcgaccacgcttggtcctccgggcctgtgctcgcacgtggtcctgggagtaggtgaaacgatccggtggcacagcacgggtagcacgagtgtctggcggcggagtggcctgcgcctggtcctgtgtctgcaccagcggtgcgcctcccagctgtgaggggccgatgacatcctctgtcgagcctgaagcgaagtcgaagtcagtgatgtcgaagagcaaggtggaaggcagcaagcggtccgacgaggtcccagcatggtccagtggtggaccctgactcgacgtgccggctgcctatgacgaagtcccggtgtactgccagaactgcgctgagtgcgaggtcgacgcagctgcctgagacgctgaccctgcagcctgggagaagtgggcggcctgcgtcatagcgaactgggcgaaacctacacatcgacaacgggacccttgtaagctaagacataaaatgcatataaattgattgtcgaagtaatgttgttatttttaggtacctatggggggcacaacagaaggcctagccgaggaaggcagggtgctgaacggtgcacgaaaccctgaagcaatcggcaagtgaaacggctcacatatatgtgcgaggcatgtatagaaaaatccttaaaaatacttacctccgtgcggagggggagtcggcctaggaacgtgcgcagttggacggggaccagtcggtacgggtggccgctgtacagctgcgtctgcccgagtaacgttgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaatgacgacccggttgatgtcgtcgacctgcatggttaattttttcgtacatattcgtaaaatttgacgaagagaaagatatgaaaacataaaggaatggtgcgatgcatggtactcacagcacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcgtggtccacgacctcctcggttgcgagcaaccagtcctcaacaaaagtcgctaacttggcgggccagtcgccagctgactgctgacccttgcgtgagtaactgcgaattaatgtgtcatattagtgtgaatcgacagatgttgcaaattattgcggacaggtagattttaatgcaacaactgaaagcgtagtgaaagatcttaccggtgaacagcagctgggacggtcgtcggaaacggtactggaaagggctgacggaagccgaactgccgcatcacgcggaaaggtgcgtgaggctcaacgcagatgtcgtagaccatcggaaccgtagtcatccagtacgcctggtccctggtgcagagtgtggacagacccaacggcgcctggggctgggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgagaagatcgatgcaacgtatccgacgatggcaccacagagtacccatcgtagggtagtcgacctctggtcgctccgcgtacagtgacacctcatacgcgtgctggtccacctcagggcggccgatcgcaatcctctcagctgcccagatagaaagaaagagagggcacccaccaaaggtcgcgctgggatccgtcttcgtgcaagcctcacaaaggccacggtacagagccgccaacaacgcggaaccccagctccactgaggcacctcgcctaccgcggcgtcggcgatgctcctggcgtagtgcacgagtcccttatcgaccgcgtgcccgtgaccgccacagaacatcacccagccaaaaagccagagcaagtacgcctccaaacagcggctgtaggagtactcgtcggcctccgcctgtagctgctcaatctgcaagtgttcgataaaatgttaggcaccttaactgtggacaaaatatgtagtacgcttgtcatttcggtacaaaaacactcacggagaactgaagcagccacctcttcataggtccggtgttgcggtggtgtgccaacggctcgagcgggagatgcggtgcgcgctgtactagtgcgaaacgtgctgtcagatcgtcctgccagtccacacccgtggtcactggcccaacatcgtctcccgcgagtggtagccccaacaagtacgatacgtcctgtaggataggggctacctcaccgcacggcaagtgaaaagtgtgcgtctctggtctccatcggtcgaccaaagctgctaggagggaccggtccacagtccatcgtctggccgggtccgcatcgccggcggcagcctccaccagccgacacatcggtaggaggccggcctcacgcagcctgcaataacaaattaatatgtcaatataaaaattattacaacgcaactaatttatagtaatacacttttcgtacctctcgacaaaggagtcgtgaaccataagtagctcaccgcacgtccgtgcccggaacgtcccaagctgagccccctgcaccgcagtaaggtgagactggtgtcggtgatctatcgccgggtccaacaattgaggtgtatcctgacgtgccatctctgaaaaatataatgtttcgtgttagaacaattcaaaaagtagtaatgtcaaacaaaagataacttgtaaaattataaaatagtaataaaatcatgagaataattatggaggctatttaaatatagcaaacgttactaagggtacataacgatgacgtgcaatttaacatatatgtagagttcgataatataacataacataacataacattacgtgtcgaagtccgacattacatcagcatacctaaagacactaggtgccttagtctaacgttacatcacgagacctaaagacatgacatgtcgaagtctgacattacacgacgaaacataaacacatcgataagttcgaaacaaattacaagcaaagccacatgccaacatagaacataagaactacaccacgtagctagacgtggcacgacgatgcctaggacgttgtcgagtggaggtagtgccttcacccgtagggcgagctccatctgctgctgatcctaatagtcctgcctctgccacacttggtttctccttgtctttaggacaatgcttgtaggtgtgcccacgttcatcgcatttgctgcaatgcttcaccctgccagcctccgactcgtccatatcgttgcggatgcgacgagtcttcctccttccagccttgcctcggagcttcgatgggtcagaaatattgagtacttcatcgttagtctctatgaactccccagctatgccgaacccataaatctcgccgctccatgtatgatatattgcttgcttactgaagtactgtgaaacatatactgcatctggtatgccacactccgctgcggcagcaatgacatgggtgcatggcctgtggagcagcttcggctttgcataagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagttccaaacaaaatgctgttgttcggcatagagggaagaactgcctggaaccgatccctaaaatacctgcatgtcccatgtaaaataaactccactatgccaactagtggcagtccatggacaccgcgcatcacccagttgtaaacttctgccaaatttgttgtcattatttcatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcatcggtggtcgatggagccgctgcacgctgatcactgcatttggctatcaactcatctaatcttttccaaagctcattgaattttttctcctggttctgattgcatagcctcttaaacatgttcatgagctccttgttcttgaattgcttgaagaaattagctcccatatgacgcatgcaccacctgctctgtacatcttcccactcaccagggtatcctcgttccatactcccaaactgcaactcttctatcgctcgcagaatgccagcgtgcctatgatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggcctcgatactttcctgtcatgaatgtcccatcaatgcagagaacaggacgacagttcacgaatgccatcttgcatgcatgtagagctaagaacgccctttgcagcacactcttgccaggatgttcaattgaggggaatttcttcactttgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatacgcgtgcactctccagggacaaccatctttttccttaacacaccggttggacttggcaacccaaaactctctatgaagtgacactgcaaaatgttttaccgcctccttcatatcttctgctctactataaatcgctccctgaataatctcattttctttgtactcccatctcacactatcctcttcagagacgaccagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacacccccgtcctctcgtgcgttgacctcctccacagaagtctcatttacttcagcacttggtccctcgccatcatccatgttcatctgtacacatggatccttcgggtgaacaaacggaaccatagctagaggccacccacgttgcaatgcattttccacataccatctccatactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatttgacagatctaccccagttggcccgtaacggacgtttcctgggccatggtaaacttggaatatttgtttgtttgacatatctgtcaacgaaataactagatcatattactctttcatgcaataaacatctacaacgcaatatcttcttgtgtatgccaatgcaacggtaaagtattaattccaaactagcagatctacgtagttaccgatatctacaatacgcacttctagattagtacaactaaaaccctaaaaatataatgtatttattcaaacaaagttttaaaaaatacacactatttaactcaatagtcacatataggatctatgaatattacctgaaatcggcgtctgaatccggcagggcttcgccccttcttctcttctcctcccctttcttctttttttttcactggatttgagggggaggaatgagggctgggggctgggcagcaggccttttataggcagcgaggcctgccgcccggccagagggcggcaaggggccgcctgcaaaatggccggccccgactggcttttttgcattcgggcccctggcggcaagggctttactgcaaaaaaccctccctccgtcaccgcccgtccctcccccgtttgccacgtcagcttgctgccccagaggtgggcggtagggtctatttttgcaatttttttggccgatagattatttctgtaaatatttttaaaaaaatctaaaaatgaaaaaaattctcgaggagatggccggggcgggctggccgccggtgaggtttgccggccatgatcggaggaagaagggctcacagattgggaatgatcgccgttagggaacgagagagatcgtgggccgtggggatctctactcggctcgttcggatgggccaaaaatctagcacatccacgtctgtgggctgggccctggaagaaaacctaaacgcgattccatggacttcaatgctcttacatatgtatttgacatggtctttggcaatgtttatgggaggtgttggcggtatggcatgagacccttcgaccaaaatctgccgaaggttatgcgaggggtggggatccaagcccgagacgtcaaagttagtcggggcgaagccccccccccccatggcgaagactatggaacaaggacggcgagaggcgaaggatcgtgcgggtactctactaagccggaggcctcttgggcgaaggatgtagggcgaagagtatatgtcaaagggagacgacttcgccaaagcaagcttgcccccgcgagggccgaagaagcctttcccggcccatcaagcctaggggccattgggccgacgatcgcctaacggcccatcaggagtccatgaacctctattacactatgtacccatgtaaatgtccctttcataagggtaaccatgtaaattcccctgtataaccaaaaccctagtagtaagaacctgtaataggggctataaatagtctcatagggccatgtaatagggggatccaagaaaaattctctaatcaatacactttactttcaaccactgttgagtaaccacgtctttcgacgtatgcagttgtcgtttcgacaacagctggcgccgaccatggggatctccgagcgaaaccactgagagcgaatgccaccgaagaaggtcgtaaaggagaaggttacaaggcgaaaggaaagcgacgctggggcggatatggccgctgaagagggagcagagccttcggcgcctgtcgccgaagatggaggagcaccatctacttccgcacctgcgccatcactaccgccttcggcccctgctacctctgtgcaggtgccgaacgcggctgacatggcgaaggcggctgcggcggcgagggcactccagaccagggcggagatcctttcgacaagtcaactgctggtgccccaagccgctccgtcgcagccggcagcggcccaaactgcgcttgccgctatgcaagcccaagtcaaccctgaccccgagacacaaaccgaagccgacatggaagccatgcgacagaacatgacacgactccaagacatgcttcgccaaatgcaagaacagcagcaagcgtacgaggcggcaaggcggtctaaggtcgcttcggcaccaatcctccagtattcggcaggctatgtcccaccccaagtctatccacaagtgccgacccagccccttccgccacaagtcacgcaagcgccaatgtacttcgtcgggcagccattgaccgcagcagcgcatccagcccctcatgtgcaactgcaagctcaaccggtcgctacccaagtacatcctcaaccgcctggccaagtgccacaaacaatggtagaaggggcttcggctctgcaggcgcagctccaagctttccttcagcagctcagccaacctcacaacatttcaagtacagccccttcggcctgcccggaggggaatacaagtcaaggtgcgcctagttagttgccttcgaatcagccaggtctgggggcttcgccgtggagtcaaggaccacagttcgactctatcaatgctgctcaggcgccaaccgttcggccgcaagcaccaacgccaggcttcggagcaaaccaagcaccaaaccagatcgccatgacatggtcacagccaactttcgacccattcatggcggctcatcaagcatcaccaatcggggccgggcagccgaatgccatggcccaacctcatgcgcaagccgtgatttcgcccttcgccacgccgtacccgcagcaaggtgccatgaacagggcagggggcgaaaaggggctaccgctgagtgggggaatcaagacccgtccaatcccaccccagttcaagttcccacccgtcccacgctactcaggcgaaactgacccaaaggaattcctctccatttatgaatccgcaatcgaagcggctcatggcgacgaaaataccaaggcaaaggtaatacatctcaccctagacggtatcgcccgctcttgttatttcaatttgacagccaatagcatttactcatgggagcaattgcacgatgtctttgtccttaactttcgaggaacctatgaggagccgaagacgcagcagcatctactcggcattcgctagaggccgggggagtcgataagggagtacatgcgtcgcttctcgcaagcccggtgccaagttcaagacataactgaggcatcagtcataaacgccgcttcggccggtttactcgagggcgaactcacaagaaaaattgccaacaaggagccgcagacgcttgaacacctacttcgcatcattgacgggttcacaaggggcgaagatgattccaagcgacggcaagcaatacaagctgagtacgataaggcttccgtcaccgctgcttaagcccaacaacaagttcaagttgccgaaccacctcctctcgttgttcgccagccccagccggcgatccaagcacaaccgccaaggcaaggtcaagcccccatgacctggagaaagttcagaaccgaccgtgcaggcaaggctgtgatggctgtcgaagaagtgcaagccctccgcaaggagttcgacgcttagcaagcaagcaaccatcagcagcctttccacaagaaggtccgaaaagacctctactgcgccttccacggacgctcttcgcacaccacggagcaatgccgaaacattcggcaacgtggcaacgcgcaagatccaaggacgcagcagggagcagcggccgaagcaactcgtgaagtagctcaagaacaagcaccccccggccgaacagcgccaagatgcgcaatgccagagtgatccaagtgattacaatggccgacccgccgatccaactgtcgaagcgacagaagaagatgcagctgtgaacggtccacaatatcacttcggcaggcgaaggggctccgcaatatctgaaccagcaaatcttttttgggccagaagatgccgaaggagtaatgttctcgcatcaagatcctctggtgatctcagccgagatagctggttttgaggtccggtgaatcctggtcgacggaggaagttcggccgatgtcatctttgccgaagcgtatgccaagatggggttgactacccaagcccttaccctagcaccgacatcgctccgaggattcggcggagaagcagttcaagttcttggccaagcacagttgatagtagccttcggcacgggggaaaacagacgcgaagagcaagtattgtttgacgttgtcgacatcccacacaactacaatgccatcttcggccatgcaaccttgaataagttcgaagccatttcccatcacaattatctcaagttcaagatgctcggcccggcaggagtgatcgtggtcaaggggcttcagccttcggctgtttcaaaaggcgatttggccataatcaacagagcagtgcacaatgttgaggccgaaccgcatgaccgggcgaagcacgcgccaaagcccgcccctcacggcaagatagtcaagatgcagattgatgatgccgaccccacaaagctcgtatcactaggggcgacatgggcgaagaagaagctaagaacatcctagaggtactaaaaaagaacattgatatctttgcctggggccctgatgaagtgggaggtgtttcggcagatctcatcatgcatcacctggcagtcaagccagatgccaagccaaggaaacagaagctacacaagatgtccgctaatcgccaggaggcagcaaaagccgaagtcaaaaaattgctcaaggcaggggtcattcaagagatcgatcatcctgagtggctggcgaatccagtgctggtgcgtaagtcaaatggcaaatggcgcatgtgtgtcgatttcacagacttaaacaaagcatgtccgaaggatgatttccccttgccacggatcgaccagctcgtggattcgacagtcggctgcgaactcatgagcttcttagatgcatattccggctatcatcagattcgcatgaacccggccgacatccccaagacagcattcatcacaccgttcggcaccttttgtcacctcaggatgcctttcggtctgaagaatgccggagcaaccttcgccaggctggtgtacaaggtcctttacaagcaattggggcgaaacgtggaagcttatgtcgatgacatcgtcgtaaaaagccgcaaggctttcgaccacgcgtccgacctacaggagacttttgacaacttgtgcgcagcgggtatgaaactgaatcctgagaagtgtgttttcggcgttcgcacaggcaagctgttgggtttccttgtttctgaaagaggcatcgaggcgaatcccgagaaaatcgatgccattcagcaaatgaagcctccgtcgagcgtacgtgaagtacaaaagctcacgggccgaattgcggtactcagtcgattcctctcaaaggcagccgaaagaggtttgcccttcttcaaaaccctccggggcgcgggaaaattcaactggactcccgaatgccaagcagtgtttgacgagctaaagcaatacctgcaaagcccgccagctctgatcagcccagcatcaggaagcgaactgctactatacctggcagcttcgccagtggcagtcagtgctgctctcgtccaagaaacggattcaggccaaaaaccggtctatttcgtctccgaagcattgcaaggagcgaagacaagatacattgaaatggaaaagctcgcttacgccctggtgatggcttcactcaagcttaagcattactttcaggcccacaaagtcatagtgccatcacagtaccctttgggcgaaatactccggggtaaagaagttactggccggcttagcaagtgggcagcagagctatcccctttcgacttacattttgttgcccgcactgctgtcaagtcctaagtgctagccgactttgtggccgaatggacaccggcattcgcccctgaacccgagcccattgaacagccctgggtgatgtactccgacggttcgtggtcgcacaagggggcgggcgttgcggcagtactcacttcgccaaatggtgtgccaatttggtatgctgcaaggttacagttcgacacaaccaacaatgcggcagaatacgaagccattattttgggcctaagaaaggcgaaagcattggggattcggcgcctgctaatccgaaccgactccaagctggtggtgggccatgtcgacaagtcttttgaggcaaaagaagaagggatgaaaaggtatttggatgccgttcggtctatagaaaagtgcttcagcggcataacggtcgaacatttacctagaggccagaacgaggaagcaaatgccctggcgaaatctgccgcttgtggtggtccacattcgcctggcatcctttttgaggtcctgtatgcaccaagcgtgcccatggacagcttggaggtcctggcaatcgaccaggtcaaattggtcgaagacccatacgactagtgaaccccgtttgtgaagcaccttgaaactggctggcttccgatagacgaagcagaggcaaagcgcttgcaattcagagccacgaagtataagatggtctcgggccagttctatcgctccgggatacttcaacccttgcttcgctgtatttctttcgccgaaggcgaggaaatggcgaaggaaatacagcaggggctatgtggcgcgcaccaagccgcaagaatagttgccttcaaagtatttagacaaggagtttactggcccactgtgttaaaagtatgtgttgagcaaatcaagaagtgcgaaagttgccagcatcatggccgaagccaaaccacgccccagtatgagttgcagcccatcacaccaatctggcccttcgccagatggggactggacattattaggccgttcctggcggcgcgaaacgggcacaagttcgcaattgtggccgttgaatacttctctcgatggattgaggccgaaccccttggtgtgatcacttcggcaacagtacagaagtttgtatggaaaagcattgttagtcgtttcggagtgccaaaagagttcatcactgacaacggcaagtagtttgactctgacaagttcagagaaatgtgcgaagggcttaacctggaaatcaggttcacatcggtcacgcacccgcactcaaacggagcggccgaatgtataaatggtaaaattctagaagcactaaagaaaaggcttgagggggcagcgaagggcgaatggccagaggaaatgctatctgttctctgggtccttcggacgacccccacaagaccaaccaagttcagcccgttcatgcttctctatggcgatgaggcaatgaccccaacagagctaggggctaactcaccaagggtgacgttctttaggggcgaagaggggcgcgagttgttgctcgaactcttggagggggtaagagtcgaagcactcgagcacatgcaaaagtatgccacaggcacttcggcaacttacaacaaaaaagttcgaccgacggagttgttgcctggtcatcttgtcctaaggaaaaaggcgaaccctatagccgttggcaagcttgaatcgaagtgggaaggaccgtacctcatcaagcacaaatccaggacgggatcctttcgactggcgacactggaaggctaagatttcgaccattcctggaacgctgcctctctcaagcgtttctatgtctagaacgggtggcacccaaatcgccaacttgtaaaaatgtatatatcgttatgtaagcccttcggcactatgtaagcctttcggcaagaaaaaaaagagaaaaaaaagaggaaaaaaaagggaaaaaaagaggaaaatggaaaaagacaaaaaaactagatgtagggctattatccaccacggaggcccgaacgagtataaaatctttgtgtcctctgccttctttttatttgtttgtgcgattgataatttgcggaaaaaccccaaggcaaatgcctgatcagtgaaaaaggccagggggcgaaacgaatcggccgaagcatcgctcgccgaacgattgaaaccgcaacagcttgtttcggagaacaattagccgaacaccgttacactcgatcgaaaggaaagcacgagtgcttcctataacgtagaacaaaacggatcgaaaacggaagccgaaagctgaaaagtcaaaacctatttcgctaatatatgcaaaggggccgacacgttccgacccaacaaaaagcacgtgaagtgacaatgcaaaaatagcgaaaaggaaataagacgcacctttatggattttaaataaaaatgtatcgaagaatacatcacaatggtacaaatgaagagaaaggagcaatggcgttacagcccggcttacagataaattacatcttcgccctcacgatctctctctctctaaggagtgatcgaacgaactaggttcgtcatcactactaatatcatacacaaccctaagaggagaagggggtgaaatacagactagactgtaacgacgttgagagatcgcctcctgccgatcagtcttctgatggtttcgccaaaagcgagccatgtcctccaaacgtcttgaatgaacaagatcgtagtcttctaaggttcgcccagggtgcgcccgaagccacccggcaaccttaaaaaccttatagctgcgtccgtttatcaccatttcacgataaacaggccgaaatgggcatcacacctttggcaaatcctttaatgccacaaatttcttgttttggtttcgccaactcccagaagggggccgaatgcacaactttcggcgaacaccctggtagacaatgcaaaaagggcaaaaggcgaattgcatagtaagaataggcgaaaaaagaaaaaaatattgcataatgtgaaatgggcgtaatcataaatacgccaaagacatcgaccatcaaaaagtggctaagagtgagtcatatatattcaaaatatccaagggcccctttttcggctacaataagaagggttagcggcagcccgccgaatacacatcgtttgccactcctggcgaacacaaaaagaagaaggaaaactacaaaaatctaaggaaagggcggagggcctcacacctgtgggtaatcctgggcatcgcctcgacccccttcagccgtcgcgtcctcttcttcgcaaaggtctgccgcctctgccttcgctagttgctccaaaaggcgctccttggcggtggaccggccgtccttctgccagaactgtttccgccacgcacgaagtgcgggcgaaatgtcctgcgcgctaatctcccagtcccccttcgcatagttagggaactcggcgacgtgctcgcagccgaactgttgcaggagacccatagtaaaggccgctgatacacgcgcacaacaatcgccgtacgcagttgggcagtccgaaaccgaaccaccagctttctgggtccactcggagaagtcgaaggccgaggcatcttcggcagggacccctcgcacttttgcacccatgtcagtaagggtgaggcgaagcgtttggcacgccgttcttgcagattcggtagttttcgccatctcccgcgaaaaccgctgcgactcctccgcggcgctcgcttcggccttgctgacctctaggtgaagagcctccatcttcggctcagtaaggttataataatccatcagcacggcggaatgggccttttctttccttaattcggcctggaggcgatcaacctcagctatggcttctctcgctttctccagatcagccttgaggcgatcgacctcgggcctagcctctctttctttctccaacttggattggagccgcttgttttccgctttcgccttttcagggtgttggcgagggcctccatctccaagttcttgcggcctatttcgtcatccttggcccgaagacggttcttaaacccgtcaagacgagcccgcacggttcgctctgtcgaacagtgagctgcaagaatctggatgcaaaataggaacggcgaagatagcaaatgttaattatgggacatgtaaaaaagaagaggaaaactaggaatagataaaaagcatacccgaaccgtcaagcttttaatagcagaacacccctcatcgaactcattcagttcggtgaacaggctcggggtgctggcatgtaagacaagattgcttactccctccacaaagggaataaggtctgcccgggtctcgaaatcgccatgggcgaaatgaggcgccacaagggaatactccgaagcagatgtttcgacggccgcacccttccccttcgccttgactagcggcgaaacaaccggctgacgcagagggctaccgaagaccctcgccccagctgtcaggacccgttccgcggaggctgaagccccggcggcggcgctacctcctgctccatcagcaccaagtaaaagaacgggggcagtcgaaaggtccaggctgcggccagcgggtgaagtcagagtctcgtcagaagactcgtcgtcgctgaagacgcgagcgacatcgacgagtcctttcttcttggatatctttttgaccggacctcccttcgccgccttgcctgccgaaaacgcaattagcgccttcgccccatccaactcctttcgacgaaggggggagctgtttgattccaccccggtctcattgtgacccgggccatggaggtgacgaccatcgccatctccgtttgagtcaaggtcacctctatctttttcgcgtttccatctctccacacaatgccgaaccacttctctgttgaccacctcccgttttgtgcatcacagccaccggaacgtgaccacgccaacgacgccctggagcacgcaccggagcgccgccgcttcaaccatcgtcatcgtccgaccattctcgtccacctcggagcaagccgctgcgccatcatcatcgcctcaacctcctcttcaatacgcctcaagaaccccagccggagatgtgaaggacttggagaacgcaacttttcttcaccggcaccgatctagaatcgcctccgccgtcatcatcgattactgctgcctcggtgagccattgttcgattcctcgcgcatacaccatctccttgacctcacaaccctcgtgcatgcttgcttgtagcagctcatcgtcccatttgagccgtcgtcgttcacccaaggaggagcgccgtcgccgagccgttccacaagtcatcgctgccgccaagacctcgacaaccttaactcgacccacggtaagcatcctgaaggctagaagaccacatgcatgcatccttttcgttcggaatcgacttccatgcacacatgcactttcaccccatgaaccaccgccgctcacaccactgtcacgattgtttccgacaacctctgaccttgagttaaccatgggtagatgcgcgaggagcttaggaatgttttctcttttggtggcaccgcaagaacggccgctgtccattgccggcaccgacgagaagctcgtcgagtcgccgctgctctgctgctgcccttgccctcttgctgagagcctgagacactgaccagcggaccccacatcattaggcgctgagaattccgcttagagagagtttaaatcttgcaaggtctaaattgtaaaatatgttagaatgacatgtggaaccaaggactaattagtaatgaatgaaaagaatctgaggactcttaatgattttggttcatcacatactttggactgcgggttgattcctagaaatctcaagggcctttctgcatattggtccctcactgacacgtggaccccatccttaaaaaatctgaagaataattaataaaatgcccaaacaaatatatgtttagcagaaaaatgcacaaagttgtaaaatccatataaaatcaaatgaaactcattttgagatgattccagttgctgtagattcttaaagttatgaactctattttagaaatataaaacttgacactcactgtacaaataatgtctctaaaatttatctaagataggtcatacataaaacatgtacaagcttataaaatacatagaaaattcatctcaactcattttgaaacaaaatcaaattctacagattcatcatcatgcactctctgattaggtgaaataaaagtaattacttactttgcatcaaatgcctctaaaactattatctctagaatgattagttttagataagctaaactttagaaattcatgtagaacacaatttagcttcaatttgagtaaacttaagttctgtaggatcaccaaaacatgtatttccatgttatgatataagattatatacttactgtgtagtaaaagtctctaaatattcatataaggatttactaacatagagcagccattaatttgtaaaacttgtagaaaattcatttttaatccaaatgaaatgaacaaagtttctatagaaccagcaaatagttatcttcaacatagtaaaataaaatttggcaccttttgtagagaacatagatcaaaaccttaacttagtgaaataagaatttaaacacatagtgttgtttaagtaatacataaacatgtatcagtatatatacactttaggtctaattaaacctaaataaaaacttgattgaccagtgaagccatagttccatcctcatccactaaaacttagaagaacttagctcatataacaatttctaggttaatataatatattgctagtctagattagagcatatctagtttataaaatatgaaccatagtagtaaagatcataaacatgtgaactaaaaatgttttagttaaccaaattattccttttattcaacttaaacatgaagtagcaagttctgaacctacaacttgagagtcatgcacatataaaacactatatgcctaaaacacgttgtaacttgtaaaatctataagaaaatcattataactccaaaaattgtgaaaccaaatgtattagtcttagaaaacacacctctacacctctgtgaagtctaatataataaaaatcactttacaaaagtatttcataacactacctaagactatactactataaaccgataaaacttctaaaattcataactcccaaatccaaatggaataagataaaataggaattatttcacctaaattcattttagaccagtacctaatcactgtgcataaatcatgcattttagagcattttggatttttagctctttcggtgtttaattgcatatcgtgtcctttatctagataattgcataattggtgaagaagtggattaggtgctaacatttctctgatcaaggcaagttttctcctcccatcctttgaacacatttaatcccataatttgaggaatgaaaatatttgtttgcaaagttgcatgtgaatttagactatatcggtatttaaaattgggttaaggtagttatgacctatttgctgcataccccaccttgaataattgatcctcttactgtttgaacccttagaaatggttagagtacactctttgtgctcaaatgggtttatatatgctctatgtgcaactacttgcttagccatgcttagaaatatgcaaatgctcattccatctgtaattaaaatgtgaattttgatacatgaacccttgctggaataaaattaatatgatgggtatttgcgaactaaaatgtataaaatgtgattttatacttgggcggcaagtggtgtgcatatggtgctagttgcataccgatagggggagtgtttgcccaagtccataaggaccgaacttgtgtcacccatttaaagttattcgtatatccacatgtgctagtatgggatggcctaagctaattaatctatttaggactagccttgcattctagtaggccggtgtgtatgagttagtcgataattctgaggaattagtcgatgattcagagaaactttctatttgccccgacgtggtagtttaggtgactaagtctatccaatacaacggtattgtgccacgtgggtgggttcccgttgtgtccgccaccacggcgttaagtttaaggcgtgggcccgccacttaacggttctaggcatattccaagtatgcctaggatggaggaacacgtatcgtgttggtgcaaggctaggttctaagttgtgtaaaggcttcgttatgacctctagatcacattcgacatgaagagtgtgatggagtcttgcaaactcaaaacaaactagagagttcatatcatgtgggtaaagctgtacaaactctgcagagttctttaaactaatcgattagccgtactcacggtcatgaacgctttggtgatgtgtcatgagtatagactttatgttttaaaatgtgatcatgtgacattggtttgaaattgataaatgtgttgagttgtgtgtgtgaggtgatatattatgatttgttgtcaaaggatgacaaccagagattgattacgatggaattatgatgaacttaatattgtaacttaaaattttgttttgttaattgaagcatcaactcctttacaaaagaattgcgaaacaaaacttgctttatgctgaaattgaactacatattgccttcctttgaatatttgccttcctttgaatatatgccttacatgtagtatggtaggattgacttgtgcttgccagtacattaacttgtttaatgtacggactcttgctgttgatataaccttttgtctgcaggtttagatttagtctttgagtgatgcgggttccgattgctgttgatataacccctagtcggtgtgcttgtgatcgggtagtcaagcttctgctgttctctgataagtttatttggccggtcagcctatgtaattattaagatgttgtaagtcttaagtttctttcatcttagttgtgtttgctatgtataatcatgcttaagatgaaagtgtggatctagggcacatcctgggaactagattcatatgagtatgagttaggaatatttgagaggttgtagatctttagctatttttgtcaagtctcctgaatgtgtaacacatctagtcaccgccttcgagtggtttgacgggcacatctcaggctgaagttgactgacaggctaagggcccagcaatgtctccaatattcctctctcgaggcgtcggatgtttcattatgcttgtttaatgacttgaattattcacttcatctctcaaatataatggaaggtccggagagcctatggagagcctatgacaatagcgccgtccacggcgatcttgggctttcggttcggcgcaatcgccctgcgccggcaccgaagggcttgtgcggaatcagaaccagcctcgaaggggatggtgtggtaaaaccacctcgccatccaatggcggtcccacttcgacatggcggcgttcaccggctagagatcggaccgctcggggcgaacattaaagtttacgctcccgaacactgtcttcttcgttccaactggggtaatcaccgtcttcgaattcacggtggcgaagaatatggcgccgaagagttcgtcgcttggctcaaacccggaagtccggcacgcccagtcgaagatagcgatccggaccagcgccgacgggctcaactgcgggagctccacctggaaaaggcgaagaatctccggcaacgagttgcacggaaaccggagccccgcctcaaaaaacacggcgaagaccactgtccggttgtcgacgggcttcggtacaacggctttccccggggcgaaagcctgtccctcgactaacgccctagagctgaccaactttgccagctcactatcgtttatgagagaaattcctaaataggcggtggtgtcatcgtcaatccggccggggtcgggccccttcgccgaagaggggttaggcttgcggggagccatgacgaaggacgtatgaagtggcgaagtgtgtgtgcagtggcgaacaaggggagtgagtgagaaatctaaagggccaaggggtgccgtgagagcaagaacggagaaagagagtgcgagcggtgaaaatggcaagtctggcggtgaaaagataacggggaagcatatatagcccaacaaggcgacgattcgcctacccaccagtaataaagcgccacgtgtcgtgagggtaggcgaaacggtaaattcccatcgaccgagctacacagtaaaaagcccacaaagggaaggcccattactgttcctttcggtccggtaaaaataaaaaatatatatcaccgtccgcaggaggcgaagagcggcaagtcaataccagccgcacagacaacaaactttatttgcaggaacaatgtaggtttcggcaggagcatcggttgaaagggggcgccacataccataccacataccacatggtttgcatggtctcggccgaagctccaatctcacccttgcccatgaggggcttgttggcggtatggcatgaggcccttcgaccaaaatctgctgaaggctatgcgaggagtggggatccaagcccgaaacgtcaaagttagtcggggctaagccccccccatggcgaagactatggaacaaggacggtgagaggcgaaggatcgtgcgggtactctgccaagccggaggcctcttgggcgaaggatgcagggcgaagagtatatgccgaagggagacgacttcgccaaagcaagcttgcccccgcgagggccgaagaagccttttccggcccatcaagcctaagggccattgggccgacgatcgcctaacggcccatcaggagtccatgaacctctattacactatgtatccatgtaaatgtccctttcataagggtaaccatgtaaattcccctgtataaccaaaaccctagtagtaagaacctgtaataggggctataaatagtctcatagggccatgaatagggggatccaagaaaaattctctaatcaatacactttactttcaaccactgttaagtaaccacgtcttttgacgtatgcagttgtcgtttcgacaataggaggttatgattttaaaatcagctggttgatagttggcttataagaatctggagaagctgctaaacccgaattttgacatctagcttattttctgaattatgtaattattgttttatatagattctatgtgaaaaactagactatttaaagaagcttttgatttcgagagaagttaccgccaccagaagcttctcaaacttgctttttgtgttatgtgttgtatcttgctacttccgcaacaacttcaaccaaaataaatcccccccaaaaaaaacctcctatgcctctccaccatagagacttggtctaaatatttatcattgagaaatttgatgatttggtaaattttagacctgccacccgtgataatgacacctggatcaggatgacaaaacatcaaattcacaatccacagaatggcagatccacaaatcccaagagtatgcaatgtatatatgacatcttggatggttgtccaaaactatgaaatatcaaaagcaatgcctttgttcaagcatcctagcatgggcattcaagaaatttgcgcactttacatccctacggaaatcaaagtagatgcaatcctcttgtgatatgcctactgaataagtgacactctcgccagaactgactaaatcttcattgacgataccatttgaatggcttttacacgccatttcctcaaagtcaatgtcacggccgtgatatttctggctttcaggatgcacaaccttcacaccttcatattcgcaatggaaacaacgaccttaggaaaggaacatcagttatagcaataaataaaggattaacgcgacgaaaagatcaaaaaaaggaaaaccaatgtcttttcttagaggagaaaccaatatgcaaggctacatcaactaggcagtttctattccaagggaaaatttacaatatgaaaagtggatccattttacttatcttacctttttctaaaagcatggacattataggacaacactaaaaaaaatccaaaataattatcagtacaaaagcatttttttggtgtacgtccaatggacggaatgcattgcaaattaaaactaataagtaaataatagatagacacattattctctttctttttagcaagcatgacctattaatttggctaaacagacatcttgctttttttatggttctattttcttttttcctagccctaggtgatatcctaatctctagtaatcatcaagcacggtcaacacaggccttcaagaagcagctggattgtcagaatattttaattttaaccaaaacatgaaaccctgtttggtcggatgcattttgaatttctgatgccttttcttctaaggcatgtaattatgcagaatagtctatcatatagttacacaaaccatcgcaacatgctgtatatgtaatgcaacggctgcaactggcatgcttctagctccatgatctagtgttgtagaaatatgcatatagagagaagagagcataccaggatgtcccatgattggccagcacaatggttcatcggttatatcattgtcgttgcaacactcagcaaagaagagtgttggaattactgtgtcagaagaatgtgatcctcttgggctcgccaaaaagttgacatgagaatacttggatttgtaccggatcttgcatgaactatcaccataatggagaggagaaacaccagacttgataacatatggattcaagccgcagataacatgaagatcatattccggtccctatataacagggcaaataagaatcatatgcacttattatttatttatctttttttaaaaaaaaatctataaagggtaaaaggggaaggaaacaacttatagaccttagttcgttgtgtgtatttcttcagtgcagcattcaccttgctgcaaatgaaattctgctcagcctcgaaatcttgctttatgttcgacaataacctggatgcaccctcggtaagtaccggaactgtctcaaaagaacaatggggagaagtggatggttcttgtgataacatcagcgagagcagctgcacatcaaagctaccacaagctttcagtggcaatggcccgaagaaagctgacaggtaaaaattcaccagcgcatcacgatccggatgatgcgcagcggtggccgcggccttaaatccaatgcccctgtcgaacttgtccttcatggcgtggccttcttgccctgccatttcgattgctctctgtagattcacctctgccaagagcaggtatcgaatggcttgctgtctggagaccgtaggaaagcaggcgcggagataagcaacaaggccaaggagagatctgcaagcagtagaaacaagggttcttgagcagatcatggccacttcagagtactcttcctctgcaggaaacattgtgtcataccaaacggtgttgagaacgatgttgtgagcagggttcatgaaggggccatagcagtggccagccttgaggagtcccctgtggtagcgccgctgcaagaactccctcggcatcttggcaagaacttggaggtacagtccatagatcttgtcgacgacgatgttcttcagagattttgtgcgcacgaatggtggctgcttgaccttgttctggaggaattggggagcagtaactccggcgaggcctggagatcttggtcggtggttcgtgagcaatccatggaggttgacaacgtcggtgcaggagaggcggccttctttggctaggatcccggagacctgctccatccgagcggcgagggagaacgacctgttgacgaacgctctgggcttgggttgccacgccgcgactgcgcgcatctgagcgcggtcttggtggtccgggacgcgaggatgaaggccttggtgttacgatcctcctcgacgagccgcgcggcggcgaggaggtcggcgttggccaggcggaggtattgcagcgcctcccaggtcgggaggtaggggaagcaggcgacgaggaaggcgacgagcgcttcgagtgaccgcagcggcatcctcatgtcgcggaggcggctgtggttgggcgagtgccaggtgacgtcgctggtgtcggcgacgatccgggagagcgcgctccgccgtctcctcgccgctgtcttgccgtcgacgggacggccaagaaccatgggcttgcgctccgggaggcgcttgtaggagagggtgttgacgacgatgttggagacgggatccgagaagccggcgcagaggccggccttgaggaggcgcgggatcagcgccggcatctcctccaccggcagccggtccagcgccgccgcgtagtgcccgttgatggcatccagcagcgccgatctgttccgaacgatacgatcctcgtggtcgtatctgtaggggcgctccgcgagggggtctctagcggcgccgctccggcgacgtttgccggccatgatcggagaagcggcagagcggttcgctcaggtttgcccttgctcaattaatcaaaatcgattccttttagaaacttaaaatccacagagcgccagtgactgccgctacctcgttgccgatctgcagcgaccccgccaccgacgtgcgccgcctcgctcctgttgctcgcggctcgttgcgatgcctcacgcgccgatccggtttattccggtgggcactctcccggcttgaagcccaagcgtacgtcccgagtcccgacgaccgcccactctgatgggcatgggcctagaggttttaggaaaggaaaaggtacaccgaaggtccctcaacttgtcatcgagttacaaaatcattcctcaaccacagaaccagatactggacatccctcaactaataaaaccgttcactttagatcctccggtggttttgaccctagttttattccacatggcggctgagttagcgtgagacccatgtgggctacacatgtcagcattgccacatcagccttctctctcttttcctctgttctctcccatcctcatctctctctctctgttctctgcgactgcgaggctggcaatgcgaggcggaaaagaaggagggcgtcagcgaccggcggccggcgaccggtgaccggcgacgcgacggcacgcgggcggccgggggagggccggcgcgtaggctcccctgccggccgccgcccacgaggtggcggcgggggacgagctacggggaaggggcggtgcccggccagtgagagaggaggagggcggcgttgtacctgctcatctgggaccacccgacactgcaggtccaggagatgcgggcggcagtggcgcacgcgtcagacttcccggcgctgccgctagccctcgtatgggacgtgctccgcgccaacatcttcgactagctcagcgccaccttcgggttcaacgggaataaaggagcacctcgtgctcctcctcgccaacgcgctccgcatggacctcctctacacggcgatgtacctgctcatttgggggttgatgagactnctgtacaatatggagttcatcaatcaactcgc

SEQ ID NO: 69554 - DNA, 5382 bp, Oryza sativa
gcgcggctcccctcccctcccctcccagatccggccagagggaggccgggggagggcggcggcggtgaggcgaggcgcggggcgacgacgacgacacgcggggcggcggcggcggcggtgcggctcccctcccctcccagattcggccgaagggaggccggggcagggcggcggcagcggcggcgaggcgaggcgcagggtcggcagggcgccaattttttttgttcgtccagtggattttcgtaggcgggtgattgtgctgcctgcgaaaatcatcaattttcacagtcattggtatacaggtgatccttctcccgtctgggaaaactacttttggccgcctacaaaaatgtttttttatagtagtgttactcccaataccattgccccccaatttctaaaaggaaaaggtatgaataacacacaccccatcccgcagagctatcgaggtcgatcgaattactccctaattaaacttgaaagccagacactttggttggaccgaaatttatgaaatttcatgattttcggtactttcagactgaagtttttgaaattttaacatattttgattggatttgaataaactttgactaaatttaacaaacatttgagaacatctgaaaattttggtcaatatattgatttgacagtggggtccgaaattaccgaaattgcaatcattggggtgaggtgaccccacctacaggaatcggaaccagggattagagaaagagagaatagaatcaacaaacacgtacgggtcacatccacttatctatctccattatattaagccttctgcatcttcttctgctgctgcggtggtgtggttgttgttgcgagctagacgctatagccgtcgacgctgcattgcttgtatgtcactgtcagtgactgcctcctcagactgaaactaattaaatatagactactataaaactaattatataaatgaaagttaattcgcgagacaaattttttaagcctaattaatttataattagagaatgtttactatagcatcacatagactaatcatggattaattagactcaatagattcgtctcgtgaattagtccaagattatgaatgggttttattaatagtctacgtttaatatttataattagtgtccaaacatccgatgtgatagggatctggtctaatggcgattgcccaatccaccgcacctggacggttcgttcacacgcagcttacacgatcagggccctgtgtggaagattagcccagggctaatgttgagagctaatatttagtcatgaattggtaggctaaacattagcctagggtggtatgtttggatccatgggctaattcaaggctaaaagttggagagagagtagaaaaagaggagagagaaggagaaagagaactgctttttgatggtccccacacaaaattagccccatttgcaccccttggaggagctaatgttttgaggagggttaattcacattagctcaaaattagccctactgtttagattcttgagggaatgagggctaatttgaggctaaaaggtaagggctaaacattagcccatggaatcaaacagggcccaggtctaatcggctgcttgaggtggaggtgagaggaagttggtttggggaggcggaccagtttgcctagctagacttttggggaggagacgccgagcacgaggatctatgcaccgacgtcgccagtgatgcgacccgagcagcacgagggcatcggcctcggagcacgttgaagcggccgacgatgatgcgggtccggtttcggcgccaccgcatctagatcaggtctctctgcggcggaagcagttagcatggcgggggtgatggccatccgggcgagctccacctctgctgccggccacccgggcgagctccgcctcagccaccggtcgcctgagcgcacgcgagagatagagcaagggctggggagggattgggttgagggggatggttgactggtggcctccgggaggatggtaccacgtatgcaagctcagatcaaaacggctcaaaacagtgtttagaggggttatttatccagtatgaagagttaaagagtggaaaatgtatggtatttgagtttagggggtaattcggtcgaccgcgatagttcaggagataattcatactttttccttcctaaaataaacatgattcccgaatcacaaaatcccaaaaaaaacattcacaaattacaaaatcacaagaactattggagcatggaagcgggagagaaccaccgccaacgccacgtcggggaggggaagtaaccgccgcttgggccggtgtcgtggaggataagggtggcgagcgtgcaggcgacctcgcccttttcagagtaggggttggaggcggagacttgcgcccagtgataggaggaagggatgggggattgtaactctggactataggaccgtacatataatatctggactaccatttatccagatttattgtcttaaaagaggtcatatcccctcctaggattagttttttttggatggagggagtagctaatactaaatgacaaacccacctgggaaactgttttaaacactcgggtggatctagacgtcgatccacccgagtcttgcatatcatctaaataattatgaaaaattttcaaaaaaattaacatgataggttaatatgtaatatatcatttcacaaacatgcaagttcaaattctacttctacaagttataaaaaaataacaaatttaactgtgaatatatgtatactagttagagcttaatttgctatttttttacaacttataaaagtcaaatttaaacttgcatgtttatgaagtgatatattacatattaaatctattggcaaaatttgctataggacactcaaaaaatatgtaattagtcatgatacaccacaaaaatatgaattggctataggacaccacaaaagagtggtaattagtcggaggtggcagctcggcacgggcagctacggtggaccaagaaaaggggcagtgtggccaggcgacacgtccacccgagatataaaaatctatcttcaaacctacctagctaattctttagtttgtctacttgcatggttgttgtaaagtcattgtcaatagaaagtaaaataaggtcaaaacccagctatctgccagttaaccttatactatatgcaatcggggaatgatgttgcgcattagttaacttgtctccaattgttttccaaaatcatgcgagttagccgcccttaactaacgatcacgacgttgacttcaatccacatatatatatatatatatatgtatgtatatatatatatatatgtatgtatatatatatatatatatatatgtatgtatatatatatatatatatatatgtatatatatatatatatatgtatatatatgtatgtatatattgtatatatatatatatgtatgtatatatgtatatatgtatgtatatatatatatatatgtatgtatatatgtatatatgtatgtatatatatatatatatatacatgcagtgacacttcatcgaggtatcgtactatcgtagtagtaagtacatattcttctgtttcatgaaacagagggagtacagtgtatcgttattacatcttctccttccaaaggcaaattaaatcatggcgccatcgctgctcgcgccacggctagccgtgcccttgctcctcgtactcgcggcagcggcggcggcagatggcgtcgccgacgccggcgccggcgccggcatgacgcacctccacttcttcttccacgaggtgttcacggccggcccgaacggcacgacggcgacggttgctccgccggcgcgcagcggcgacgggagctccttggggttcgtcggcgtggtggacgacatgctccgggagggcgcggacccggcgtcgcgcctcgtggggcgcgcgcagggggtcaccgccggcacgtcgctcgccgccgccgacggcgcgggcgcgatcacgacgatgctgagcctggcgttcacggaggagggcccgtacgccgggagcacgctgcaggtgttcggccgcgcggtgctgggcacggtgatggagcggccggtggtgggcggcacgggcaagttccggatggcgcggggtcacacgctcagccggcgcgtgaactcgtcggaccccgacaacctcctcgtcatcgagtacgacgcctacgtcaccacgtctcccatttagctagctagctatagcctagctaccatggatgggtagctttgatttgtgatcgatcttgtaatgtggtttttttcttgatcatattctaaataaacaaaatcgtgtgttttgtgatatctgcataaacaaattcaatgttgtatgcgtctatcttgtgaatggctactctacgatcgccggtaagcttgttagcttgcagggcatgccaagctaagatagataatttgaacaatagattaatcatctaatgactaaaacaattgatgcaacataaactaagtgaaaatgaactatataaatatatacgatattataaaagatgatggagagatatattgaaatattatatgaattaattatgtgtgatgatttaacatgcttacattttaaatctttaaactttaataaattattaaattatagataatatagtatatttgcatgatgattaaatgtaaaaattattagtgaatgatgatgtggcatctctgtatgttactaatatttaataattggtgggctatactttacactttacagtaagagagtaagagaggatatgtggggaacacaaaccaaataagagccaaactagttcccaagacgtaataccgtatttaaagtttagcaccacacaattattttttatcaacatttaaaatgagttgctaagcacccctcaaatagctaagccaacaagcacaccggccaaatagttaagatagggatcatttgccatttgccacatgagcaataatgtgggttgcacatgtacgttcagcttcatctagagattttttttttcttcagattgtagccattgcgattgacctttgctgctatccatggcattagagatctcctgtgtaatgagtaaggttgctaagcaaacaatactaaatggttatttaaattatgacaaaattgtgttaaggataattcatcacctgtaaaaccgttcacattgctagagttttctgacactgtagatgaagaaggcgaggcacttcctccgtttttcgatatctgatcatccatagaaagttcaaggggatgttctatgctaataaaccgtccgccttttcctctatgcctcaattttgcttgcttttggcgagcctcaacaaggatcctctaaataaataaatgttatataac

SEQ ID NO: 69555 - DNA, 1549 bp, Oryza sativa
ccctaataagccgttttggcttattaaaaaaaagcgaaacgatgggtgcctaaaataatagctagtagtttatttttgggctagcaatttgatttgttcaggaaccctcgtttgtaacttttaggaactctgatttgtcagataaccctccttacaaacatctatgaactgttttattgtggtcgtcccgtaagatagggtgagtgattttgcaaaatggattgtggataaaacgaatgaaagtaatttttttctctgtttatctatcaattccttctgacactggcatcttttaggttggtcttgaatccctaaaccttggaatatgtccaaaattaagtgatcttcacattgaggccccaaagatgtctctattggagctgaagggttgtggtgttctttcccaggcatcaataaattgccctcgcttgacatccttagatgcctcattctgcaggttgtgtcatccttcatatttttcttctaaacatcactgactggtgctaactagctattttgtgtcttcaggaaactaatggatgattcactgtctcaaacagcagaggcgtgcccgctaattgaaaatcttatcctgtcatcatgtgtatcaattgacctcaatggattgtcctctttgcattgccttcataagctggccttgcttgacctgtcatacacatttttgaccaacttgaagcctgtttttgacagttgcccacagttaaaggtgtgtgtggttagtttgttgtactatttaaatcatttttttagtacatgtcacatagcaaatgaaaaaccttggcccagtatgtttactatgtgattttaacatatcactgctggtctgctgcatattttagaattgttgtgttctgtaatactgtttgaaaatacttgcgatgaacttatacaatgtattgcatttatttattggggtgtctgtagcagttcattttcatgctatctttcaaaaattctttattttgaggtttattctacgagaaccattggaaatacatattttaatgaatcattgaaatggctattttctgaccttatgcactcctattggcagatcttaaaactttcggcttgcaagtatctcagtgattcatcattagatgccctatacagagagggtgctcttcctatgttggttgagctagatctgtcctactcatccattgggcagactgcaatcgaggagcttctttcatgttgtacaaatttggttaatgtgaatctgaatggatgcacaaacctgcatcagttggtgtgtgggtcagatgactgcagttctggtgacatgcctgttgatgtttgtccacctgattcagcaccagtgaggagtgaagagatcagtgaaaggtctgatcgtctgcttgaagttctgaattgtactggttgtccaaatattaagaaagtcatcatcccttcaatgacaacctatctacgcctgtctaaaatcaatcttaatctgtccacaaatgtaaaggaagtggatttgacatgctccaatctttatactttgaacctgaggtattatcat

SEQ ID NO: 69556 - DNA, 734 bp, Oryza sativa
acataagctttactcccggttggagttaccaaccgggactaaagatgtatttttagtcccggttggtaataccaaccgggagtaaagattcccatgctatccccgcctttaagtccccttttttttctctcctctttaagtctctcggtatccgcctccagcgcctcctcgatatcctcttcctcccctggcccttccccttcctccttcccctctctgctccccctttctatccccgcctcctcctcctccttcccctctctactgcggccgggcggcggcgacggaacgaggtggcggcgacggagcgaggcgactgcgcggcggcggctggtggggccgcggctgtgcggcggcggtggagcgaggccgccgcacggcggcggcggatcgaaccggccgcgcggcaggcgggcgtgcgacggcggccgatggggccgcggccggcggccggcaacaacggcagtcaacattgtttttttatttgtgattcactgtgatgtacttttgtatggacaatattgtgattcattgtacatttgtatggatctgtgatgtataagatttgtgatgttactttggtttgggtttgatttgggtatttggggtttgatttgggatatgtatcccacttgattcgagagaaaataaaaaagaaaaaaaaagaaaaggaccatctcaccgccgctacctctctttggtctcggttggtgttaccaaccgggactaaagat

SEQ ID NO: 69557 - DNA, 1269 bp, Oryza sativa
tgtctaagcatatcgtaattctttctctccgtggcgtgccaacgtactaacttcgcttcgttggggttggcaaagattctcttgaaacgatcaatgataggtagataacacacaacctttgctagaccacccctctttgacttctttccttcgtcagcacttttctttcgcttgtatcgagaagccttgcagacaggacaagcatccaagtccgcatattgcttgtggtacaatatgcagtcgtttggacaagcgtgaattctacggacctctaaccccagtggacacagaacctgctttgcttcgtatgtcgtctcgggcaatgtgttctcaacaggaagcatagccttcaaaattcctaaaagatctgtgaaactcttgtccgtccatctactacttgccttcagcttcattaggtctaaggtaactgacaacttagtgtattttgctttgcatccagcgtacagaggcgtctcggaatcactaaccaacctgctgaacttcattccatctctctcattctgggctgggtcctcaacgtcacgtaacatgtcttgcagcaaatcgtgatccacatcaaccatttcaccgccaaatggagaaggtataaacatgtcatgctcatcttcatcttcctgattatgcgcaccacttctgtctgctgctgctccacttcctgattcttgctctccatgcttcacccaacatgtatagcccttcatgaatcctcgttgtatcagatgactatgtacgtcctctccgctatcaaatatattctcattcttgcaatctgcacatggacaacacatgtaatcactgtttcttcttttctgatcctcatccgcggcgttcataaaatttattacgccctttctatactccgtagaatgacgtttacatccaacttcgatcaattgctacaaaataaaaaaaacaaattacatgcacatcttataagatcagtaatgctaaagtaagacgtgatgaaattgctcaattaatgattaatattactcacttgattgatccattttgatcacttttgggaattttctgttttccttggaaaaagacaaaaaatcgccccctacagcctcccaccaaaatagtgaacagtgagatacatttacactaggtggtggggggtatttatactgtgcgacaaatatatgtaacggccctaaaataatcaaccgtgacaggcatacaagtaatctctatcgggccttaataaaagcccgtcaaaaagagtgtcatctgtgacgggca

SEQ ID NO: 69558 - DNA, 1052 bp, Oryza sativa
tagcttggtctctgaatatggtttctttgtttatttcatgtgtaggtgactcgatgcctcgggagagtatttgcggtgatggaccgggagtcggcttggggataagacgacgtccgtggtggtcaaagatcatgcgggatacttaggctagagttgatgcacgtggttggtgaagattatatatggcatacgatagaggtattgtgtgcgtatgggatgcggagtcgaatttggaaggagtccaaattttggtatgattggttatgtaaagtttgtttcttgtactagagggtttcctaaggcgtttaggactcctagtatgagtttagttcgtggctttaggctgcttacctcgggtataaatagagggggagcgtgaggcttcctggtattgcttttgagagcaattgagttgagttttgagttagggtttcaagtttagtcgaaatttttgtaaggagtgctgttggtgcactttgtaaacacagagagaatcaataaagtcgtcatccactttaagaattcttcgatttgtgtttcaccgggtttcggtggtctaaccggcgacccaccggcggttagaacgacggcatcgcggcggtcagaccggcaggtgcaaggcggtcagaccggtgtcggcaacaggcgacaggagctgatctcggcggtcagactggggggatccgatcttgagtcgaccgacggcaaccaggcggtcagaccggcaggacaatctcggtcacaccgcgatccgtcgaattagagggtaacttttattcccgctaaaagttttcggtttttgggtataccaaccattcacccccccctctggttggcttagttattgtgattcgatcctacactaaaggcaaaaatcagatatgtttccaacggatggcttagatttcggccgagttagggtttcagccgcccttgggcctaaaaaacgcctggaagggctagtgtgtgaggagcccctttgagttcctttggtggctcctgtgctttgtgcgtgagagaatgcctttagggctttggcctttgggcgagtt

SEQ ID NO: 69559 - DNA, 956 bp, Oryza sativa
aaagttgaaggtgaaaaacaaagttaaaggtgaaaatggattttgagcaaagttgtagggcaaaattgaacttaaccctatggatttttagacttctctataattgacttgatgtgaaaaacaactcatgaaattaatgaatttccctgatatcttgtttcgcaagtagtagcgactagcgagtatgacatcactacaacgtgaactacgggagcagggattgttctcaacatgcaagatcctggtgctaccaaggttattccaacttccaaaacccggtttgacttaacaatttaaatttgaattatattatattaacccctaattagctggaaattttcctacacgttagaggatggcccattaaaacttaggtaaatatatgtagcctaatgtgcaatccactcaaataaatattattgaacctaatctaaaagttatctctcgtttcttgcatgatactataaactgaaaaaacaattagcaaaatagattaatatgaaatatatcaccctataaacatgtaacctcaaatccgatttctacgagctgtaacaaaaataacaagtataactgacaatgtacactaactattttcagtttaatttgttatgtttgttgtaagttgtagaagtcgaatttgactttggatatttgtggagcgatatatttcatattaatctatattatagatttttttaaaaaataattattatttaggtgatatgtaaaaatgagacaacgtccggtcgagagataaaaatccatctccaaactaatcaacataccaatatggacgtaacacgttgtagaatacccagttggcaacttcagcgacacatggagaaacatacacggtgcggcaacatgaactgatgaaacacggttgcagaaacaataagaggtacaggcgtacagacaaaaaatgcgaaaatatcaaagcacacgataatcaa

SEQ ID NO: 69560 - DNA, 657 bp, Oryza sativa
ttagagatagaattgagatatcaggtaggcaaatatatcaaccaaaccagagagatccaaagagatcgaagcgatgcagccgtgaagaataccaatgtagtcgatagattcaccagggccgacggaacataggacttaccccttcgccggagatcgaactgaaccgatgtagccccacgtcaggtgccaaattccgccgattgataagtaaaacctcagaaaagggggtggcgatacgccgagagtagttgtattgatctgtgagataaattacaatgacctcgggtgtacatatttatagccatgggtagatactagtctttgtaggacaagaaagaaactttcctaaagataaaaagaaaacataaagtccttataggacactaaacacactttcctaaagataaaagtaaactaacaaactatttctaattaatagataacttaccatgccgcatccttcttgaactcggtcacttctagataagttttcttaatagattaatttccttaaccgaatatagcacgaatctgactattggcgatgtgataattctcttaggggcttaccaaatttcaccgttaacaggtgcatatctcggcgaggaaagtgagatacaccacttgaatgataatgacatgcacaatcgagcctct

SEQ ID NO: 69561 - DNA, 30337 bp, Oryza sativa
attccacttgtgggtcttcaaggttatgctcaagttaagttcctgaaggggttcagtgaagatgccaaggtaatccatcaaagggttgctcttcttcttgtgatagattgttttgcaaataacttctgaaactaaatattactcatatttttattaattatataaagctaagattatgatcctattaagttcaagaagtatgattgagtttctaaatttcatgacgaataatgagaaacaacattcactctagatacatttttcacaacttgcttaaattgtgacaatgaattcctggtttggcagatgttgtatgaagatgcaagtcaagtggctactgatgcagtaagcagcatcaggactgtagcttccttttgttctgagaaaagagtgatgacaatgtatgataataaatgtgaagcttcgaagaatcaaggagttagaacaggaatggttggaggccttggttttggtttctcattcttgatgttgtacctaacatatggtctctgtttctatgtcggagcacaattcgtacgccacaataaaactacttttggggacgttttcaaggttagtaaatgcaaaactttaatattaaactttttacccttcagagttttcctctttttaaactcataatccctccataaacaagagatctgcttttacgggggtgatttgacatagttagtcatgttttgcaggttttctttgcactggtgttggcaactattggaatatctcaaacaagtgcgatggcttctgattctacaaaggccaaggattcagctatctccatatttgctttgctagaccgcaagtcacaaattgactcgagtagtgatgagggtaggacattggccaacgtcaagggaaacattgatttccgacatgtcagcttcaagtatccaacccgcccagatgttcagatcttcagtgattttactcttcacataccctctggcaaggttatccaatttatatgcttgttgcatagttatattttctgcattaacatatccagcaacttactatatggatttatgcagaccgttgcacttgttggagagagtggtagcggaaagtccacagcaatcgctttgctagagcgattctacaatcccgagtcaggaaccatcttgttggatgaagtagaaatcaagaacttaaaggtcaattggttgagggatcagatggggttggtcggccaagagcctgtgctctttaatgacacaatccgtgctaacatagcctacgggaagcatggggatgtcactgaggaggagctcatcaaagctgcaaaggcatccaatgcacatgagttcatatcgagccttccccaaggatatgataccaccgtgggggagagaggggtgcagctatctggtggccagaaacagcgggtggctattgcgagggccatattgaaagatccaaagatactacttctagatgaggcaacgagtgccttggatgctgaatctgagcgcattgtgcaggatgcgttagataatgtgatggttggcaggactacgattattgtggcgcaccgcctctcgacgatcaaaggtgctgatatcattgcagttctgaaggatggtgcgatagcggagaaaggaaggcatgaggcattgatgaacatcaaagatggtgtctatgcttcacttgtgaactccgttcaggctcatcataatactcaggataagatttttgttttttatttaccctctctggggatgtaatatatcttccttgacccttttttgttttacaattgagggttgtagtagtattaattatttggattttaaagtgggatttgagaaggtgctctctgtatgtatctacgcggtgtcggtttattaagcaacgagaaagaaatattgtcctacagatgctgatatgtgggattgtccatgttcgatgtgcatgactgcaaatgagctcatttttgtgctgtacgtttatacctatgtggttatcccaagattaccgtatatgatatgtaaattctgcacatacattttcatatgcagcaattcaaatgctctacctatgtcattatcgggaattaattaaccagatggggagaagcaaaacataccatgataccgacgcaactgaagatcgtgtttgttgccgttggaggatcagtgaggcacacgcacgcgccgggatccataccgccaacggcgccaccgcgcgagcagagcggagatctcgacgaatcccccccgtacagcaagcccagccacggccgccggcgacgctccccgagttccgaaggccgctcgccgccaccgcgacaaccgcgtggtcccgtgggcatcgagtagccccagcaccgtgcggcgcctaccgtccgcaagcgtatcccaagggggcccggccggatgatggccgccgccgccggcgacggcggcggcagccggcaggcatcgcctctttcgccgcgcactgggccgcttggggaaatcgaactctacggcgaggcttctgaagcgaaaggctacgtcgggcgttcttgggccagatcaggccggtttagaggcggcaacgcaattttgcttggaataagttcactctaggtcccttaagtcaaaaatttatcattaaaccacaataacagataagtatgatacgtcctcaactccgaaaaccagtgaaataaggtcctaaaacggttcggaaggtgattttaactgacgttgcacttaaagttaagaaaatactatgggactcacatgtcagcgagtgttatgttaaaattaaaaaaaattgcggtgggcgccggcggcaagccaggcttgccatgctcagccccagctgccgttgccacactcttcttctcgctggcctctgcatccctctcgacaacgcctctgtacccgaagctgaagtcgtcccgctccacgccgtccgctgccgatcaattagtcaagtagcaagaacagagcattataagctcgccgccatatgcaaccacggaaatacgggtgcgagggagggtggtgtgtgttgtacctttacacggcgaagcgacggtgatgcggactttcttgacagcgatgcagacctagatctcaatatttttttttataaaaagtataaaattttaactcatcctattttaaatgtaggcctcaaatttagtaggctaaaatattatgtccatttccaccatgcgtgctcgcatgcctcatgttggagatatatagcgcaactctatggaaaattgaaggcaagtaatgaagagaacaactagtagagatggaaatggtcaattcacgattatttcttagcgttgttttttgtaataatcaggcaagaaacattttctttagaaaaagatgcaggaggcacatatccaggctgtaaagacgactgacaatatggtcagctggtagtccagccgagagcaacgtgtgccatcgtttgggttacttggcactttcgcactctccaccatggatgacagatgttctccggtgtggtcgatgttgtccgggaattgaagtggcgaaatacatagcgactgtgccactgccactgccagccgggcgccggccacacccgccagccgtctgggatctacggtggttatggtcgcgagagctcgatccagcggctttcgacggtagactgtagagagatcgattggtgtcaaactgtcaataatgaagcagtggagcgctggatccttgtgtctcactcagtcattaatttggtctaaagatttccaaactgtcaataatgttctgggtcgccaagaacatcaaaatgtcgtgtatgcgacgattagtctcgcttggaaagacttggacggacaacgggtcgatggaaacaataggacgcaaggcacgatcaaagaagtttcttctcgatcgaattaacgcagagcctacttgaggacgagaagatcatgatgtcgtcgtggatatataccttaccatggatacaaactgcgtccaatacttgacgtcaacacgttaagtccgcagtcttaccgcactaaccaccaaattaagtggaaattaatttgcaagctgagaacgatgccacggactaactgtatcgtgccaaactatcaaacgactcacgttatactacaatgttttggaaactgttttcattccatgggaagatatccagtcttttttacatatcatttaaacagttatcatttttttaaaaaaaatgacaagattcttactataaaacatataccgctccacaaacttgcaaactaaaatttaatttctataaattgtataaaaaatatactaactacgaatatacgttaattattttcagtttatttcatgttttttacaatttgtagaaattgatttcagttttgtatattcatggagtgatatattttatattaatctgtatatgttgttaattttttaaatttaataactatttagaagacatggaagaaataaaaatccatgccccaatgtttatataaacgatcgaactccattcgtccagatcacctcatgcataacacattacatgcatttgcaagccatacgctctctgtaatatggataccaaattgggagcgcttgctctcatgctcccgcttctactgctgatttccgctactcgcgtagcctacggcggcatccaacccacgccgcctcccgcgagcttccaagccgccttggtccgcatcgagcccgcaggcatcaactacacgcgcgccgtgcagcgctcccgctcccgcctgtccatgctcgccgccagagcggtgtccaacgcgggggcggcgccgggggagagcgcgcagacgccgctgaagaaggggagcggcgactacgccatgtcgttcggcatcggcacgccggcgacggggctgtcgggcgaggcggacaccgggagcgacctcatctggaccaagtgcggcgcctgcgcgcggtgctcgccgcggggctccccgtcctactaccccaccagctccagctccgccgcgttcgtcgcgtgcggcgaccgcacgtgcggggagctgccccgaccactgtgcagcaacgtcgccggcggcggcagcggcagcggcaactgctcctaccactacgcctacggcaacgctagggacacgcaccactacacggagggcatcctcatgacggagaccttcaccttcggcgacgacgccgcggcgttcccgggcatcgcgttcgggtgcacgctccgctccgagggcggtttcgggacgggctcgggcctcgtcgggctcggcagagggaagctgtccttggtcacgcagctcaacgtcgaggccttcggctaccgcctctcgtccgacctgtccgcgcccagccccatctcgttcggctccctcgccgacgtgaccggtggcaacggcgacagtttcatgtccactccgctactcacaaacccggtggttcaggaccttccgttctactacgtcggtctgaccggcatctcggtcggcgggaagctcgtgcagataccttcggggaccttctccttcgaccggagcaccggggcgggcggcgtcatcttcgactccggtaccacgcttacgatgctcccggaccccgcgtacacgctggtgagggacgagctgctgtcacagatgggctttcagaagccaccaccggcagcgaacgacgacgacctgatctgtttcaccggggggtcgtcgacgacgacgttcccgtccatggtgctgcacttcgacggcggcgccgacatggacctgtccaccgagaattacttgccgcaaatgcaaggccagaacggggagacagcccggtgctggtccgtggtgaaatcatcgcaagccttgacgatcatcggcaatatcatgcagatggacttccacgtcgtgtttgatctgtccggcaacgcgcggatgctgttccaaccgcccaccgcctgatacgggagattatgaccgttgattttgtgcgccgtatgtagtactagcactctagcagtgtagcacgtacaattgtgccgtagcgaataagttctgcacaaattattttctgccatccgcgcttagttgtaagtacgcgagcttatgtaatagtcttccaagagaaattgaacgggcataatactgcatgtacggttacaatatacttataaacataaacgtttaaacacatatatagtataccatatgattagtactactagttattattttccggttctaatgtaaaaatacaaacgaaactatagagagtggaatttaaatgtaactctcgacggacgtctagttgtttacatgtaaattaaatagtcatgatttttttgcaaaaaaaaatattgaaaatgtcttaacagtaatatatctctatctccatctctatatactattataaaaattaaagatgtttccgtcagactttcgacacgtcatccatgttagaatcggttttaattttatgtttgtgttaagtcctatctctttttcttacgccaaagtgtctatcttatctaagacgtgcgcgatttaattgggccccgcaccttttcacgcgtccattgccgcacgcaacaattgggcccgtgcccgggcctgtttttcacacgcgtctttgcgtgccatggcgattgggcccgcaacacccttgcgcccacgattttgtcgtttctgcatgtccgattgggactgcgtcaccctcgcccgcgatttaaaaattgaagatgtttttgccgaaactatagtacgtcatctgtttccgattcccgtcacgtgtaacattcattgcgaagtcacgactcgcgagcgaactacgagagagagtccgtgtggatatcatgtacgtcattgtcctaattatccgattctattcgtattacacggcacgtataatatgttagcatgatttcaagtcagtctccacacatgctcgtatgtactaccagggccgttacaacgatccataagaatacaacgatccataagaatcagttttactttcgaaaataacatcctaactaaaataaaggataatcgaagttgcagattccgtctgccattgattctctgccggacttgagataaagctacgcgataaatcgagctcgtgttttgaggcctcattgtttggcttatgcttattcctagccaaattttaaattttagaacttaattttaaaattaacttttgatttttttatcgtactttattttatagcatttgcttttgagtcactaagaacatgcatataaaagatttgcacacaaataggagatggattctaatctctcgggtggacgtccacccgtttcttgcatgccacctaaatgattataaaaaaattttccaaaaataattataatataggttaatatgtaatgtatcatatcacaaatatgtaagttcaaattcgacttctataagttgtaacagaaataacaaattaaactctaactagtatacacatattcacagtccaatttgttatttttgttacgacttgtagaagtcgaatttgaacgcatgtttgtgagatgatatattacatattaatctatcataataatttttttaaaaaaaattataactatttagatgttatgcaagaaacgggtccacccgagtgtttaaagcaatttcccccacacaaataatctttttttttagtaagtgattcgaataagcacatgaataaacgaaataatgggctttgattatttatccaccgatacatatgtacaaattaaattggttctagccattgcaacgcacaggcatctttttagttactctaaaaaaatacaagttaaaatccaacttttataagttgcaacaaaactaaatttaaccttgcaacatgtaaaagttcaaaattgaccttgcatgtgttatgaagtgatctatcacatattaatctatctagttaatttttaaaaaatatttttacaatcatttaagtaacatgcaaataattaaggtcatctgttttgacaagatgagggcatgtttggggggcttctgacagctgcaacacttcctggaatcaaaagctctctcacaaatagtctagcttttcgtccaaattctgaaaagctagttgtcgaatttaaagaaatgagctagaatttagaaggaaagaaacacatattttttagattttcaaaaattagataccaaccagtaacttatcaaaatcttttaactccaatttagtcatggacactagtgggccttgcaggctgcaggtgccgattgtacgtacagtactacttggaataagttcatctaaggtcccttaatttgtcaacgaatccgattttcgtccttcaaccaaaaaaccaattacaattggtccctcaactatcaaaaccagtgcagatgaggtccctcagcggtttggatggtggttttggctgacgtggcgtcttcgtagctaatttgactttgtctttatttgacgtagcattgacatggcgcttacgtggcaatgtgagctggaaaataataaatctcgtgggacccacatgtcagtttcacacagaaattaataaaaaaaggtggggcccacgtgggccccacctgtcattctcagccctcctcttcttcctcctctccccatctccctctctcttcaactctctcccctctcctctctcgcgacgcgcgcgacggcagaggctcggctccggcggctatggacggaagaggtagggggcggcgggaggtggacctagctgcggcgaccggcggagaggaactgggcgtcagcagcggaagcggagtctcgaaggctggcccccaggcgatgcggaatcgacagcgggagctgcgggaagacggcagccgctgtggccgcccgcgcatggaggagaggtgggagccagagagcgcgagctcctcctcttccgcgacgccaccggcctcaatgctcgatctcaccctcctcgcggcgttagagctccgtctaatattcttgtcgagatccggccagagtagcaccaagcccacgaggccaagctggccatcgtcccgccacagctcgatgagacgatggtgctcctcgattggtgagctcgagccggcggccagatgcagagcggaagaggacgcagagcacgtgctacgacaagtccgcccggcggccggctgtgtccggtgttctgtgttcatgtgcgctcctccatgggggaagccgccccggtgtggcgtgcaaccgcggggaagaaacaggctttcaattttttgcagcggctgcatttttcgcttgatttcgtgctaaaattttctgcttgttggaattaatgaatgggccttagcccattcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgctcgctcgcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgctcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggtgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccaacaaatttgtggccgggtgcattattgcaaaacttcctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattccagttcaatcacaccaccagaacaaactgatatacacatgaacttgtctctgaggaggatgtcagtgaagctcctcgaaggagtaagagacaaaggacggctaagtcttttggtgatgacttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaagacgaagatttctttgacacttactcacctgttgctagattgaccacaattcgtgtgctactttccctagcagcctcacatggtcttctcgttcatcaaatggacgttaagacagtttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattgggacttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactcttgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccattcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacactgctgaggtactggcgtactactctggcgacatgtaccagagcgtgccgactagctgcgtccgcgacggcggcgccgcggccgacttgctgaggcccaagtcgcagatcctgacgcggccatcgacggcgccgacgaggacgttgcccggcttgatgtcgccgtggatgaccccctggcccctgcgcgtgcagttgcttcacgccggcgagcagctgcttcacgccgacgtagtccatgacgaggtggagcttgctggtctccgggtggcaagtcatctcgcggagcctcacgattgcggggttcccggtgcacgccacgagcatcgcggcctcccacacctcctttccgcctccctcgccggccggcgcctttttccttctccgtgcgcgctcgccggccggcgaggaaggatggccgggagggagagagaagaaggcgccgtggatgaaaaggatgtgggtcccactatttttacttttgtccgactgacttgcgggccccatgtttttgtttttattttaaagttttatattttgcttctagtgccacatcatcgctacgtaagacgaggaccaactcaaactagccacgtcagcgccacatcagccaaaaccaccatcgaaaccgctgagggacctgctttgcaccggttttaatagttgagggacctgttatatctgttttctgatcgaaggacctaatcgaattcgttgacaagttaagggatctcaagtgaacttattccgtactactttgggggcaggcgagacaaaccgttccagaggcccatcgttgactcgtggtaggcttgggactaggccaggtcaagtgccgcacatggcccagagcccagacgaaccatgagtcgcgcgtgaatgttttttttaattttcaatttattttattaaaatatttaaaaataatttttggttttaaaattttacaaatctacagcccaacgctttctgagagggcgtttttaagaaaacaccccttctaaagagcgttttatgtcatggcacatatccgttgactcatggtaacgtggaggacacaccattttgcaggtagcctcctccctgcccttgccttatcagctctgagcccgagatcagtcaagccggcatgacccgacttacacgccaggctgagccgggctcgccacaggatgcactaacggcccatgcatgacccaataagattcgggccgtgctgagtcggtccgaaggcacagaagcccaccgaactcctccttggaataagtatattttttatccctcacctttctgggccatttccaaatggttagaataagtctatttttcattcctcatccctcatcttgtttgtgtcatgggccgggccgtcggttggccatctatacttgtcgggatagatcagtagctcatgtggctgtctgaaaccatgagaccggaattgatgggcatcaaagataagctttcacggtagagctcgataaatcgtgcgcttcgacctcggaagacactcagaaagctagcaatcaatcacagatgaaactgaaatcatacgtttgtctactgctctttttaccccaagagcaaggaaaacaattacggtgtactcaagacagcatatagtacgaaactgaaatcacccaaagtcccagtcatgaacgacccatctctgtggtggcccaactcggtggttacgtgcgtcactttaatctccacccaacaacacagcccaccacctcattcaatcatccttcaatcatttcccacgtcatgcgctggccgcttccctccacgactccaccagccgcgccaacgtcacctccgactcgccgccgtcgcgcagcgccgccttcgcccgccgcatggccgccagcgtccgctccaggagcgccctcccgccgtcggactccatcagccaccgcaccttcgccgccacctcctccgccttcacggtcccctccccgacgtcgtcgtcgtacccttccaccgccacggccagccgcatctccttctccaggaacaccctgttcatccgctgctccgcgtacagcggccacgccagcatcggcacgccggccacgatcgactccagcaccgagttccacccgcagtgcgtcacgaagccgcccaccgccgcgtgcgccagcacgtcgcgctgcggcgcccacgacttgacgacgagccccctgcccttggtccgctccaggaaccccttggggaggagcgcgtccaggtcgggctccggcggcttgtcgaacttcttcgccgggtcgtcgctcggcgggctccgcaccacccacaggaaccgctgcccgctcgcctccagccccgcgcgccacctccttgatctgctccgcgctgaacaggccgatgctgccgaagcagaggaacaccacgctgccgttgggctgcgtgtccagccacgccaggcactcctcgctccggttctcgcccacctccgccgactttatcagcgggccgatgcagtagacgggcggcgtcgagacgcccggaggcgcgcagctccccgcggcaatggtctcgacggcccgcggctcgagcgagcggaatgtgttgacgaggaagccctgggtgcggcagaggtcggcggacgctttcagaaattccgcgtaggccgggtcgtcgcgttccatgagcggcaggacggagtgcgtcgccgggaacgaggggatgccgggggcgtgcacgagctcttcgcccatctccccgaagttcgccgtggtctgagcgtgcaggaccgggaggtacaagaagaaagccaggatctcggcgccggaagtgtagaacatgtaggcggggacacccagctcgtcggcgacgtcgagggcggcgttgcagaagaagtcgatgatgaggacgaccggggaggcgccggcgaggaagtcgcggaggccggggttggagaggcgggtgacctcgaaggtgagcgactcgtggtgcttggacgccactggcggcacctccaccttcggcagacggtggaacgtcatggccgggttggccgcggtgacgccggcgaggaaaggccccgtcgcgccggtgttgccgtacggtgggtcgacgacgacgacggtgacggcgaggccgcgggcggcgaacaccttgccgagctcgatcatggagaccaggtggcccatgcccggcgacgggtagagcacgaccggcttccgggccctcgtggtggctgcgtcgccggcgtccatcagtccgtgacggatcgagcactcgagcaggtatagaatctcggatgcgtcgagacgagtggagatgggagcgacgacgaacgaacacgtaaatagaggcgcgacgaacggttgctgcgtcacgagtcactactccaacccccgtggtccagtggtagtggtccagtggtgagtggtgaccggtgagtggagacaggatttataccgccgcgatgacgagacacagactgaaaggacacaacccccatttccgggaaaacccccacaacccccatttttggctacaggtattttaggtgtcacgccaaaattataagtttaattgaaattaaaacgatatgttggaaaaattagaagtttatgtgtgtagaaaagttttgaggtgtgtttaagccgtgtttagttcccccaaattcccaactttccatcacatcacatcacatataaaacttttctacacacaaaactaccaactttcttccaattttaaaacttttccaccatcaaatacagccttagttcacgctaaaattggaattttggttgaaattgtgacggaaaagtttgaagtttatgtgtaggaaagttttgatgtgatggaaaagttggaagtttgaagaaaaattttataactaaacacggccttgatgtgatggaaaagttagaagtttgaagaaaatttttggaactatgtgtttagttcacgctaaaatttaaagttttattaaaattggaacaatgtgataaaaaagttgaaaattttaagaaaaaacgagcatggtggcccgcgcagattgcacggccagcatcattatattttctcttatataatagcatatatgttttttcaatgtattattcaaatatattaaaatgacaacataattttaaattttatactaactttacgaaactactaatatgtaatattcatgttgtattttataaatgtattagttgttaattatttttaatatcaaattttagttatttgtaaattatatttctatatggactctagtctcgtctttcaatatttctttttctaattccgaattttcgttatctgtaaattgtatttctatatagactctaggctcttcttacaatattatttattttttaatctgaattttttattatttataattgtatttctatgtggactctaaacttatctttcaatattctttaatttttaatttcgaatatcagttacttttaaattgtattcctatactgactttagtttcttcttcccatgtttttttaatttcgaattttagttatctgtaaactatatttttatacaaactttaaactttacttttaattttatgtttattctgaattttagttagttttaaattcctatatagactctatactctatttctaatatttcttatgtttaattctgaatatctattatttcttaattgtatttctatatagactctagtctcctcttctaatattccttattttttaattccgaatttcaactatttctaaattgtatttctatatggactctgtttttctttttctccaattaatataagaatttctaagccgtgagagcgaacgtggatgttactttttctattcttttaataagttaatagattgggaactaaacaaggcctaaactcggccttactctactccatccggaacccattgataatccaccagaactgctcgccgaaaatacagacggaaaaaactactgttgtcgttaagactggtcacgtacagcggccaacaaacatgacactgccttgaagtcaggaaaatgaaaaacgcctataagtccttccctcgttgcgccagctcagattttcaccgatgtgaagcgggcgaccgcgctttgctaggtttctcgcttcctatgtgagcgacgcagaacctcgccaaaacgaggacgcgcagcgaggagaagacgagggtcgcgcacgctgtggacagcgtagcctcgtgctcgtgtgccctagcgcccaaaatccccttccgccacagcaatatcccctattcgccctcccaatatccccttccggcacagatcggattggaagagcaaagcaaaaaaaaatcttggggattgaaagggaagaacagatcggattcaacaagatgaaaaagaaaaagaaaacaaaatcatcacaggattcgcgctgcatcagctccaaccgtcacgacggcggcaacgtcgccgctggcggtggcgttgagggcggcgaactcgtcgaggctgatgaagccatcgccatcgcccacgaaaaaccccaccccgatctcaacggcgtcggagcatggcattgccgcgcgccgcgccttccccatccggcgtcgagggggggggagcagcgggtggtggtggtgttggtgatgacgtcggcggcgccaactcgagctttaggcggcgcggtcgaccgggacgaggcgccacggtcgacggaaggcgaggcggcgcggtcgataggaccggggacaacgccgccaccgtgcccgatgtgcagccgtcgcacgttgtgcggcagcatccgctcgagctccgccacgccgccgcggcgtgggaggtgagaaggctcgccggcgtgggaaggaggagtaggagggggccggcgcgcctgagagaaagagaaggggcgaggtcgcgagaaagagaagggtaggtgaggaattaatttccttcacctgcccgtgtcccccgtgcgctagggtacgctcactatgggctttgtacccttcaacaatagctttatcttattaggtcactcaataaggtacttatattgtgagcttgagtgactttggaccattttcttaggttaagtctctcattacgtgccttacaatatcaataccttaaggtggtgggctatacgatctaagtttaaaatcttatcccttataattatttgtattaggttatttcctaatattcttgtttttttaagtaaggaagacacattcgaatcgggtagttggatcgaaggattgtcggcttgtcgcaatgtcatcgattacgaatggaaccacgtcacccgttcacatgtttctcccgaacctgcatgacaaattaaatactagtaggttataaccaacgccgagtttatatactggagtactactccatgcatggttgatggctgatgtcattgctaccgtatgtgtgtgcatgtactctctcatctcaaaatataaagcatttttagtatagtgataatttaaataatttaaactttaactattaatagcaaaaatataaaaagcatcaatcacataaatttgatattaatagatttatccttaaacaaactatcataatatgcatatcttttttatttaaaacatattaattttatagatattattgattaaagtagtatctcgaagattgtatcaggtaaaaaaatacttatatattttgaggcgggtgagtatataattcgtgttatgcatggccacatgggcatatataggagtataatcctagggggtctgtgttatgcgatggcaatgatacggcaccgtgccgatagccaaacttaagatcttcttttgatttcattcgctatttcacatgatttctatcattttcatacttggtattgccaaaatacccctttggttggttaaatcaagatgagctggtcgttagattctaatatattgacgtgtaattttttttcgcgttcgtgaaagctggttgttagattggcgcacgttaaggcccaaagtgatcgaagcggccgatgaatccgatccataaggaaaaagtacacagaaggtccctcaacttgtcatcgggataaaaaaacgtcctcgaaccgcaaaactagatatgcggagtcccttaactatacaatgccggtcacccgaggtcatttgatggttttgaccccggttttgatctacgtggcggctaagtcagtgtggtacccacataggccccacatgtcaggtgtccacgtcaccctctctctttcccctctctttctctgtttctctccttcctctcactctttgctctcgcactcgcagggcatggggatgccggcgctagggcgcccatggcagcgcgcgcggccggaggatggtgcggccggtgacgggggctcctagggcggcgcgagcttcccccaggtgacgcacaggctcagggagggagcaccgagaaccaatccccactacaagaatcctgttaatccatgatgaaaaatatccgtcacggatcactagaaaaccatcactaaacagcatctgtgatggtttaagaaatcatcacggattgagagtcatggattgacatgcgtgacggtttgtcgaaaaccatcacagagtactagaatcagtgttttaaaccgtcacaatattgcccaaggcctagttagtccaccccaagcccatttctgtgacgaaaataaccgtcacggatgaattgccacatcatcatagatgcttacatggttgcttacatggatgatgacgtggacactacctcagcccatttgttaacaggccagaatcaaagatgggccaattttggcccaatttcagccattttcgcagcaattttccagccatttttgcaagcccatttcagcatattgcagcccaaattcgtcactaatttttagcccactcttcagcccactactgcagcacatatagcccatatacacagcccattgttaaacattcagcccacacacacagcccacaaggaattaatgtagcagcacattaaataaaaaaaatcttatgtttccatccaacaacatatcacatgaattttcatccagcatcacattacacaagtcttcatccaacaacagttaccatacaaaagtgcacacaaccttatagtttaccatggcacaagccaataacacagactcaagaaatgcatacaagtccagcagcttgattcatgcagcatgcagcagcagcaaaatgcaagtagcagcaacaaaatatataccaccatgtatgacttaacctggtcgaaattgacttcacacaagttagcagcagcaaaatgcatgtagttataggcaaaagatatgcaccatgcatgtcttaacttggtcgaatttgactgagcaaaagattaagttttgcttccatctcagattgactcctcttcatctcctctcggtctttaatccttgcctgctcagattcttgcactttgtttgacaaatcagccacctgtgcacgaagctcagcattggcccttttctccgcttctagttctgtctcagtgctctgctcactgaatctaggctgggcattattgaagcccacattctgcaagaaccgattcttcttggtgttctcagcaagcacgtcagcaacaacttgagccgctgacttaagttcttcaccttctgttgttgtagatagcttgttttccatctgagtctagcaagaaagtagcaaacatggttgatgttgagagaattaaaaataagcactacaaagatcaaagtctgaaaattatcttacaatagcctcctgtacaactggggtgtagcattttttttttcttgctgtagtggaactccttgaataaatcaaatgcattaggttcttcatcattgtatttgtcatcctgagaacaacatatatgcattaggtccagcatgaattaagatgttacaaaaatctggacagctactgttcaactgaaaatctaaaagaacatgttcaactaatttctagcctcattcgttgcacacagtcactatgttttccacttagacaaacaactgcaacagaggtctttcactgcatacacatagacataaaaacaataacttttaatctattaacacactcaacttagatatagatggaaacctaactcgtcacctgtcacacaatcatgtattggcataatgtagggcggcggtgctgcagatctacaggatggcgttgtagggcggcggtggtgcctgatgtcgttggtcggctggtgtgcagcggtgatgcgcgatggcgcggcaagcaaggaggcggcgttgctgaactacgcggcagtggtgggcagcggcaacgccgctcctgccaaatttcgccgtgggcggcggcggcggtgtctcagattggtcgcggctggatgtcgaacattacggttggtctgtttggttgttgcctaacattggcataactcaatttgttataggtgtggcatggcaaacaaattgtggcctgttggccacaagtgtggcaatgtttggctagaaaatgagtatatgacatgtaggcccatgaaacaagaaagtatggcttgccataactgaaacaagcaaccaaacactaagctaacaatctgtggcatgcctaacatgtggtgtggcaatgtgtggcatcaaaccaaacaacccctgaggggttgaggtaaccttactcctccgtacatacacagaccaaaattagtacagaatcctacaataacacatcaaaccaactatcgcagtggtaggacggggtgccttctactggcaggtcatgggttcgattctcgttgggcgcattttgtacttctattttaccaattcgagttcttttttcctttttttttgaacggaaaaaacagcacagtagtgctttttcattgaatatagaaggagaaaatacaacccctaggggtaaaacaaaaagatctttagactatacactatacagagtgcgggatgagctcgcgcaatcttttagccccagctaaagcccacaagctggcctcctctttgatttttgctaggagaacacctgttgccatctctttgtgatcaaagattcgccggtttcgctccttccaaatttcccaaactactagcaggataagggaccgaaggcccttctttggaatgccgggtgtattagctaggctctcccaccactgatggactgaccgggcttcctcccattgggccggttccaactgctgatatcccgcccatgtagcaacgaggcgccagattctcttcgtgtatctacacatggcgacgaggtgcaaggctgtctcggtgtcacaacgacatagggggcaatgtccgttattccgccagccccttgtcgcgagtcggtccgacgtccagactctattttgaatgatgagccaggcatgaaatttacatttccctggcgcccaaactttccagattagggagttgaagtttgtgtttggcgcccccaaacattgggcatgataagccgagaaagctgtatagtggccgctgcttgtgaatttccaaacaatctgatccggctcctcgctgtctaagtgcacattccgtaccgcctcccacaggcggactagctgatcgaggaggttgattgtgatagatgaacccgcatcgagggtcaggtcatgcacccaggagtcgtcttctttcccttgccgtagggatttcttcctatttttggagatctcatagaccaacggcattaggtcttttggtcttcggccattaatccatgcggagtcccagaagcgcgtcgtattcccatcgcccacagttatctttgttgaggcggcgaagaggtccctatccacaccatcacaaggcgtttccaaacccacccaaggcttgcttggatctctccattcgttccacaaccatcgcaatctcagagctcttgtaaatttctccaagcttaggacaccaaggtccccctggctggtcggcaagcatgtctttgcctagttgaccttgcatttccccccggtgatatcccccgtaccagcccaaaggaagcgacgtctctgcttgtcaagctgctccagggattccttcatcaccttcaaggcagtgaggagataaattggctgtgctgaaagcacagactttacaagcgtggttctcccggctgctgccatgtttttccccctccaacttgcaattctccctgatattttgtcgaagaccggttgcaagtccgtttttcgcagtcttcccagaacaagcgggaggcccaagtattttagtgggaaatttgctcgcctcgccggaacgccttggaggacctcttccaggtctatattgccgcatcttatggccgcaacctgggatttctgaaggttggtgacgagtcctgtggctgtgccaaaacgatgtaggatgttcgcggaagtcgcaacatcgttctaggtgggattaatgaagatcacagcatcatccgcatacattgagatccgcagccgagttgttcttcctcgtaattttgaaattgcacccaactctgttgccttggaaaggatacgctgtagaggatcaatcgccaagatgaagagaagcggcgagagggggtccccttgccgtagtcctcttccatgtttgatccgttgccctggcgagccattaaggaggacttgggatgtcgaagacgacagtaaagcccctagccagtctatccatcttgtcgggaagcccttgcgctgcagcaaggccagtaggtaatcccatcacacggagtcgaaggcttttgttatatccaacttgaagagcaacattgcccgtcttaggcggtggtatcttctgatcatgtttcttacgaagaggtagttgtcatgaatacttctcccctttatgaaagcgctttgattgaccgagatcaactcatgcatgtggggccttaaccgcagctctagcatcttagcgaagatcttggcgatgctatgaattagactaattggcctatagtccgaaacgctttcagccccatccttttttgggattaggacgatgtttgctgagttgagcaaattcaggtgcgcacatctcaggttatagatggagctgaagactagcagaatgtcatccttgatgatttcccagcaaactttgaagaaggccccagtgaagccgtctggtcccggtgctttgtcggctggcatttccttaattgccctatgcacctcctcctcagtgaagggttcccccagcgtggctagatcaatcggtgtgatgtccaacgtctcccagtttagctcttttggcctcggccccggcctccctatgaagcttgcgaagtgatcatggatcgtcaattccttttcaccgtgcgtcaccgcccaaccactgtcctttttcaatctttggattgtattccttctccttcgcgcattaaccctgaggtggaagaacttcgtgttcgcatctccttcacggatgtgagttaccctggaggcttgctttttccttgccctttctatagaagcgagtcctaggactttccgcttgagagccgccctcagtcgcgtttccgggggggagagttctctgtgctcttgtgccacgtcgagtctttggatgacattgagtgccatatggaattgcaatttagcctctgagcagatgccttttgtccaatctctaaggccgaccgccgtacgttgcagcttttgattcaggcggtgcataggctcagtgtgcgaagaaggttggctccagatgtccttgactttgtccttgaaccccgggacccgtgtccaaaagttttcaaacttgaaggtcctcggacgatgtgggccttgcgggttggacagtacaagagggcaatggtcggatggccctgtaggaagggcatggagaacatggtgggggaaagcaagatctcattcctcattgcaaaagcaacggtcaagcttgacaagggttgcctttcgacgctcattactccaagtgaacttcctgttttgcagggggatctcatgcaactcacatcgatcaatgactacgcgaaaacgtctcatgcgtgcgaggttgaggttgctattgtttttgtccctagcacagtagatcatgttgaagtctccaaggatgagccatccttccccagggctgggccttaatctcctaatgtgccggaggaacgaatctttgaggtggtgccttgttggcccgtagacaccagtgaggaggaacgtaactcctgagcgaatatctgttatttgcgcggagatcgagaagcggccgattcgaaactcttggacatcaaaatctccactactccaaaggagaaggattcctcctctcgtgcctctcgccggcttgaaggcaaatttatcaagcttgtagcctcctaagaaacgagcaaggccgtcatctatgctttggagtttggtctcttggaagcaggccaaggtgcactttgtgtcaagcatgagctcatggactgcgttgcagcgcgcaggtgagtttaggcctctcacattccaggagatgatatctagactttgtgccatttaaaaacgaagagttctctatatctggaccggcccttagcctcttttaaaaaaggccacttcggggcgcatggcccattaacgtttggcggcccaattcgcaagtctgtgttgaaaaggcagcctttgggcaggcgcggcctgatacgcacgcggcccacgagctggcgcatggccggtcttgtagtgcgcgcgtggcccaggtgacgcatgggcagtcttgccgcgggggggggggggggacgcgcggcccaagcacgagtgtgtgcggcccaaaagccggcccgtgaagaggcgggggcgcgtccgagcgcctgcagggtgttcgaccgcgggcgacggccatggagtggcggccgggtccgaagtgggaagcaagtctaacaacagtctgtcggagcgggtgcaaacacaacagcacgcaagtggaagaggaggaagacgaagttcttgccaacattggctacaaaagcacaagtcttttaatgaagttgggcaggttgcacgcaggccgccggcaatccaaccaggagaagcagctcgcaggccgccggcgatgtaatcgcaaatcgaagaaggacgatacatggagcgaagtggactccgaaaccaactccagccgaggtgaatacgcattaggcggcgacggtgtcctcagcatcctccaccgcgtcggctataccttcgccaactagagatatcagcgccgcatccattgtctcctgttcttcgtcgtcgatgccgaagatggtggtgagggcggcgatgacgtgcgccggcaatgggccatcgaacatggcgacgtactcggcgatgacctgctcaattgaagcgccttcttcgccgttgaggcccagccttttgaagagaacgcgttggcagcgctccatcgtcggccgtgctggttgcttggcaatgcgctcactgcgtcgggtgggctggctgtgctgccttgtgcggatcttgaggcgtcgtcccatgtggagcggtcgcgcacacggcgatcttggtggcgacctcggcggcgaggcgatgatcggttgcggcggcgaggcgaacagagcatcgaggacgcccgtcgagatcggtgacgccgaggctgctgcttgggcaagctgggtggcaaccggggaaggtggcggcggcgccacaat

SEQ ID NO: 69562 - DNA, 698 bp, Oryza sativa
tgcttcactgtgtgcgtcgttccgcttaatttgctcgatcgattcacgcgagcacaatcgcatgtgcgtgcatgcgtgcggcattcaatcaaaatactcctcctatcattcatgatcctctcgctacaccacttacaggatctgcagctgatgatgatggttgatgagctgatgttgagtgaacaaaagggatggaggacacggccgggcacgcggctggccgccgtggtccgccaatccggcaagatattatggcagagatgataaggtgcgtgcccatgtcgcgtgcagtccagtgctctcagcctctcgctatccgttccagtcgcgattctcgtctccaatgccggttactacgtgtcttgccgccattcatttattttcttattccggttttgcaattacgtgcttatgttttctgttaatcattcttgcaaatgttgtgcaagtacagtaccagtactagtagtagtgagttgtgaaagctgacgtgttgctgtgcccaaggttgtactagggttgtagcacctcgaggacgaacatgcccacatagacatttgttgcgatctggggcctattctgtttttcggtgattctccaatctatcgttgagtagcgtgcctgacaccattcttttttatctttacagctaaagaaacacagctttcgatccatttgtttaatcaatcttgtccttg

SEQ ID NO: 69563 - DNA, 971 bp, Oryza sativa
tgtttgattaataagatgcagctagcacaattgtactggttgatcatacaatttactgcaaaatgacatggcagtgggtatagccagctgctagctatactattgaccttgctctaagtgatttcatcatctaaacaccagcacacatcgcggttggctaggaaagggaggagccaacccaactcgagagtcaggcagtggggcaccaggctgattcacaccggcgcctcgaatcgaagcggcagtggtgcttgggggagcgatgacggctgtccactgccaggcttcggctgaagtgcagttgccaccatatcatgcgccgccacgaggaagaaaaattgacactagggaatcatgggggagctacagacttattccagccagccacgggaagacaatgctggtgacgggatagatcgacacggcggtgtacgagagcgcgaagaggagaacatgtcgccaaccacgcgcgaaggagtgaagtacgatgtattgggaggcagacctcgtccctagaagtggagagcaaacaatccagaatcgggatttccaactattgggagcttcgctagggactctgttggagtcattttttgaacaaaaatctgattggaaatcatatacagacactattggtgatgctctaaacaacgtgacacttaataatagcttgtcaagtagccttcttcctggaataatgctatctttttctcgatcgcttcgtacgtgcctaccacatagctgttctaagagatacttaggttgtgttcttcccctattttcccaacccacatctctcatttttcgcacgcacgtttttcaaactgttaaatggtgtgatttataaaaaactttctatatatgaaagttgttttaaaaaaaatcatattaatccatttttcaaaaaatatagttaatacttaattaaccatgcaataatacgtgctttgttttgcgtgccgggaaggaag

SEQ ID NO: 69564 - DNA, 36297 bp, Oryza sativa
ccccctgcatcatcagtcatttccaagttgacgcccccccttgtggcaacgggagagctcaacaccgggcgttgggctaatgccggcgaggtgacccgcgggggcggcgagtcaatctgcgggaatggctctcccacaggggggtcggtcgccgcagccgccagctcaatccgcaggagcgcctcctctacttgttggcaagtagtcgtcgaggtaggcggcggcagcgccgacttgatgcgcgcgaaggcgtgttcgaccgggatcggctcccaggccgcgttctggaaccaggcttcaatcctcggtttggctgggcgacccgagagggctggcgtggcagccttgtctgcgatgatggagagccgctgcagttggctcaccggcgacaacgcgttcgtctggggttcctgatacaagaagctggagttgtgcagtgcgtggagcaaacgaaattcacctacctctgcctggttcgcggatttgtgtagaaggggaatgttcatcagtttgctcgagtcgtagaccggatcagccgtgcgccgcgtgccgccgccgctacggttggcgcctcccctgtcccggcgacgcggggagcgcgtgcgctcacggcggtagtcgttgtcgcttccccgcctatcatcccggccacggtcgagatcccggcctcggtcatcacgatcatcatcgcggtcattgcggcgccagggtctcgggtggtcattgccagacccccgacgacgaccacgcccgccgcgcccgccctgatcgcgggcatggcggccatcgcgatcagcacggccgtcgcggtcgtcgcgctcgccatcccaatcatcctcgtcatcgtggtcgccttcatcatgaaggcgtcctccccgtgctgcgcgtccacggcgggatcagtccgcgcggccatcgatggcgtcgcggtcagaccggcgttctggccggcgagcctcccggtgcgctcgtggaccgatcgtggcggcggcgggtggtgcgggaagtcttcaaagactcgccctgggacctgttcaccgtcgagcactcccaggctccaaggcggtaggcggcgcttggccggctggaagctgccttgcccctccaaatcaatggtcgccgccgtgtagtcatgaatctcctccaagtggaagagcaccggatggcgcacccccctctgccagtgctccagtgggttctccaccgcaaataggggcgccaggttcgggtccttcgcccgctttgtaaagccaagccacatcctcttcgggatggtgctaggattcgccgtccacgcccataggtcgatggagcgcgtgttaccagactccactgggtggacgacgtctgtctcgatctgttccagggcgcaagtgcgaccaatgatgcgctcagcaatgtccgcggcccaggcatgcatggggacgccgtcaagacacaaccgaactcggaacatcaaggcgacaccaagcgcgctctcgaggctgcgccacttgatgaagtggatctcaatgccgtgccgcttgacgtatcccttcgccagcgcttcctcacaatgttgacggtgctggaacttgatgaggaaagcttgtgggtgatggagagacacggccacctcgccacggcggagcttgaactcgtcgaggaaggcctgctcgacgtcgcgcggctcggtggtcggcggagcgtgggccgcccaggagaccactgcggtctcactccattcacgcagctcctcgtcaatggcgtacgaggtggggatgaagcaagtgtcctcctcagggcgcgtcgccgggtcgccgagctgcgacatcttagccaggggcggtcgcggaggcggcgtcgggggccgggtgacgggatcctgcttggcgggtgatggcagtggagcaggggaggcgcggttgcgtggcgaatgcgctggcgagcgggcgcgacgaggggcgggggggtgcgtgtcaggaaggcggcgcgtgttggtacgacggcgaggtggagtgcgttggcgaggcggaggcggggagtgtgaggtagaacgaactcgacgtggtggaggggacgagagccgagcacggtcagcgcgagacgcgccgcggagtcgaggcgtgcggttcgcagcgtcacggtggcgacagtcgcgcgcccgatggccggagcgacggcagaggaagcagcggactggatctctacactgggctgcacggtggccgcgggagaggcaaatgaaacatttcccactgatctgcgcccaaaagtcgcggtgggagaggcagcctcgcctagtccggacgacgtcgtttcgccttgaaggtggccggtgcgccttgcttgaatgctctccgcttgaatgctctgcacgtctccaccaatgccaactccagctgctaggccacgctgtgggcaacatcctgggccaactcaactcgagtgaatggcattaatgggccacgccaacagggatgctgggccaataatatagataaataaaaatatataagtgcagaattggacatctaaaacaagtgtttcaaatggtaagacatatttcatatcttcctgctcaatgtgggttcaaatccaacatgctgcggattttttccccatgcgcaccatatttttttagtttgccatattatgcatcatatacatgtaacaaattaacaaaattattttgttcaaatttaacaaatcatcatatacatgtaacaaataacaaaaatattttgattttttccccatacgcaccatattttttttagtttgccatattatgcatcatacacatgtaacaaattaacaaaattattttgttcaaatttaacaaatcatcatatacatgtaacaaatcaacaaaaatattttgttcaaatttaacaaatcgtcttttgggtttgattcttcttgcaatcatattttttgtttttctttgcgctacaatttttttatttttctaggctaactagagtatgatgaatgtaaaatcatacattgtgacggttctgataaaaccgtcacgagttcgcgggctatgaatatccacagggctcatctgtgacgaaaaacaaaatatcgtcacggattacgtttgtcagtgacgatccataaatccgtcaccgagaatccatcacggattaacaagtttcttgtagtgcccgcagcagcctccaccggctcgtggtccagcacgacgacgtgctcgccgcggacctccccgctcagtgccgctgcacctctttgtcatgggctgctacctcggcggtgccgacgcgtgcgccgagctcgttgagagcggcaagctgtcggtgatggtgaagaggttgggggaggagcggctgatgcaggagctcgctagtagggtccgggtgctcatgaacccgacatggacgacgccgcggaggtggccgggagggagaagcggagcacgccgtcgatgcggcggcggagaaggaggagcacgctggccaccgcgccgcggcgggatccggcggggacgagggagacgacgacactgacgagaaggagaggatcccgtcgggagtagcgagcgcggggcacgctgacgccgacgaccaccatgccaaccgctagggggctaccgcctccacaggctccgcctccgccaccgctgcctactggccgccacgcgctcgactgcccgccgccaccgccgcgcatttgctccactccgcttcgctggccgtcgcgcttgcacgccgcctccgcgaccgccgtccttctctcccgcctcgcccctgccaggttacagagaagtgagagagaggagtctaacgtggataaccctgacatgtggggcccacgtgggtcctacggtgactcagccgctacgtagaccaaaactggggtcaaaaccaccgaaagacctcgggtgaccggttttgtatgcttaaggaaccccgcatatctggttttgcggttgaaggacgtttttttatcccgatgacaagttgagggaccttcggtgtactttttccgatccataaccataatcataagagcaggtataatagcaggctataaaccagctataaacacatttcaaaaagataaaagaggagagagaagggcagcgctccgggttacagatttgtagctagctgtagcacggactctaaagtacatatgtgtatgacaaatgggagcagatattaattatgtagtatatgtttatagacaactattgtataaattagctatcaagttgactatagatgatttggagccagcaattgactatactattaagcttgctctaagcagaaggcctaccttcctttgcggcttcgggacgatacgatggttacgcgcagaccggcatgacgccccgtttgagaggacggcaatcggcacggtggaaaacgaggctgaaatccagacaaacctaagctcctgaacgcaccaaagccaagcgttctgaacgcaccaaagctcctgttcaaccgagtaaccaaaccatacatcaatcagaagataccacggtaccaacaacaaaacaaaggggaataaccagcaaccgtgtcgtggcgagctcacaaatcgtgtcacatcatgcaacttgcaaaacaaagtagaaattcagaaataactggcagaaagactagaggatttcttagaggaaggtcgccacaaatacctctgaacatgcaagcatgaagcagtggcgcacccagttcagatgtctactccataatgggcgaaaagccgagtaaacaagagaaaatttagataacaatcagcgatcagacgaagttaatgacatttgcttacgacggtgcagccagcaggcgcctacttgtccgagacgcatccaaaaacaaggctaaagaacaacgacggccggtacgtgtcgcgcgcgcggatgatcagaaagaatcgacgactatcaaacccaggagaggacgagcagcaacacggtggagaccatcacgaagaccctcaatggccccagcgccacgccgctcccggacacggcgaacgcgagcgcggcgaccgcgaggagcacgctggggaggcggcgcgcgcgccgcctagcggtggcgacggcccggaccacgacgagcagcgtgacgacctggacgagctgcaggcgcgcctccagggcgcccacgacggcctcctcgagctggtccatcagctcggccgcctcggcgtcgacgcccgccggcgccaggcgcctggctcgcgcgagcaggggcaccagcatggcgaggcgggcggcgttgtcgcgcatcctggcgtgggcgacgtcgagggcgaactgcacggtgtcgacgtcgcggaggagcgggaggaggttgcggagcaccaacgggaccatgggatgcgcgttcgccattggggctgggtgggagggggcgatccggcgatgcagctgtgggttttgcggtttggagctaagaccaaaagggggttttggtcttggggtttttggcattttgcagtggaaagggagaaagaagatgaggcgagtccgcgagtggtgcagggatgtcagattgtcagagtactttgtgtgccaggcttaacttgcgtggaacgttagcttaaatcagcaagtgcttcgtttaagagctgagaatcataattaggtctactcctactagatgctgataccgtttagtgatgacaaactggagttgtgttcttatttgacgagccgagtttagatacaaagtttctcttcgaacttcaggtgtgtagttaacgttaaaattgaaagtttggttaaaattaaaacgatgtgacggaaaagttgaaagtttgtctgtgtagaaaaattttgatgtgatggaaaagttagaagtttgaagaaatattttgcaactaaacacggccttctaacttttctatcacatcaaaactttcctacacacacaaactttcaacttttccgtcacatcgtttcaatttcaactaaactttcaattttagcgtgaactaaacataccctagaatgtttactgatgccaatctagctatccaataaaggctgtgtttatttcacactaaaattagaagtttggatcaaattgagacgatgtgacggaaaagttagaagtttgtgtgtgtaggaaagttttgatgtgatgaaaaagttaaaagtttgaagaaaaagtttggaactgaacaaggcctaaacacggcgaaagacaagtaattctttcaaaatttgttctcctttccctcgagtccaccggaggtccggactagtatactaaagagttcattcatccattgcaatggccaatggcaatatggcatgcaaacggttttagttgtgtagtatggtaatttacttttttttatatggactagttatacaatgttattaggtggcttatggactatttttatattatatcgtggatgtcttaaaggataactaatttagaatggagggagtaaagttgatcaatgatccctatgcatgaaaaaacaaagcggaaaaagagcagtacactactccagtcagcacaagcattccagcgagcaaacgtagggtgtgcttggtttgctaccatgttaaaatattggtactatcaaaacctagacaagttttggtagtgccaagatttcggtaactttttatgtgctattagtagcaaaccaaacactattaaaatactgttcaaaatgccaaacaatttgataaggcatattttagcttcaaaccaaaatggccgtactatcactccgatcaatgcatttgtagcacaactgtgcagaacacttgcagcagggtgcaggcgttcagctcaccacgtttcacggacaccatcactccgatcaatatactccatcagtgccgggaggtcagctggacaggttatgaagggctgttttggatttgcccatattttggtagcttgaatatttggagccaactaatttggttatgcccatattaaatttggtagtaatccggaatattcttcactatagtatcacaattcggctctagttggaagtaaaccaaacatgagtacatgacattataaacttatggtagtgccaaaatcgcctctattttttgtactatcaaagaattggtaaagtactgaaccaaataaacacgagcaaacttagcgatacaccacaggttcaagacgacatagacctcgtttgctcccagatgccactcgccccatcgaagctctggcaagtggcaacaggggatgatctggaatgcgtcggtatccaaacagccagaacagctgcaggatcgtgactctcacgtagcttgaacatccaaacgcatcacttttgggggcccccgcgtcgctcccagggcaggggcgacacgggaggcgactcagccgctgccgcagcaccacccctcgctgccctccttccgcctcgccaccgcccgagcgggctgccggaaaccgtgcggccgcaaggacggcggcggcggggccttctcccccaaggtcgcggcgttagccttagccctgacctatcttcggggcggcgacagcggcgctgggcgacggcgaggcggcggaggcgctgggcgacggcgagcgcaaacgacatggcgaggcggcgctgctggatccggcgtctgctgcgcggatctggcgcgagggttgccccgagccggcggcggcgcgcgcgggggcggcggggtggccagatccggcccccttctgtccggatccggagcaggaggccgagccctgaccccaggcggcaaggcggcgggtgcggctgtgcagagccggcgagggcgaggctgtggcgcggccgtacggaggcgaaggcggcatggcttggccgtgcggagacggtggtgcagctgtgcggaagcggaggcgcaggcgctgaggtggaggcgcgggaacgagccggctggtgcggcgctggcgggaggaggagcgtcggctggctagccggccggccggcagcggcggaggcagcgcgtgtacgaggtgcgactggcgagagcagaggccagtgaggctcggccggtggcagcggaggcggccgtggtgcgtggaggtgcggtcgcggtgctggtgcagcgcgacgaggctgcccggcgtggaggcagtggctggtgcggcgggaggagaggccagtggcccggtgaggcgcgaccggtggcaacgcgcagagactggccaacggggggcgccggtgcagtggtgcctacgctccggcggaggttttggatggcggtggagcaatggtacatgtgtggtagatcgacaggtggtggacggcgggtgaaaacctagcccggccttggccggacaggtaacgatgacgttcgagtgtcattcccctcctgagggcgttgtcgtgccgtcttgcccctcaaggatggttgccgagcgaaagctcggtctcggctctctttgagaccttgacggatggcggtggcggtgttccgtcgcttctctcgttggagatgtcgtctaggcatccccttgccgaaaccccccgagcaattggtgcaagcacactctagattctcaccctcttgtggcggcgtcctaatttctacaagttggccacgtcggagggcctaggggggagaggtgttccatcttctctcacaccctctctccctgaatcctgaagtcttggatagagttggctttgtgttgattgtatgggtcgggttttgggtgatctcggcagtgttctgttgttggcctagcggcggtcggtcacgcttagcggcggctggtccggtgctagccttctcctggatctgtgtgttggcactgtcggtgtgtgggtggtggtataattttcttttttcctggttacgaccttccaaggttgaaatcttgtaattttttttcactctatcaatataacttcgcaccgtctagtgcgagtcgttcaaaaaaaaaaacttatccagaacagacagaaaaaaccattttacccacgagcttgactctcttaaccaaaatccacccgcaacagattgtagcagaaacatggcgtggcaaaggtttaaacagaacacacaacacattgctgcaatcagattctagaaaattcgtgaatggattaatcatgccatccaagaaggcaagaatttataatagatccagcaaatgaattggcagggggagatcgaaacaagatcggcttggatatctctgaacagaacaaggttttcgcatcagaaatcaccttgtctcaactgtcaaaatcagaaggggagggtgaaacaacaagacgagcaaaaaagcaaacgaaaaagctaatctcccgatccatctacgctgctcaccaccggaaagccaaggaacaacacgaacgcggcgccgtcgcgcgcgcgcgcgacgtcgaaagatcaggcccacccggtagcactcgaagaagccgcacatcgccagagcgaggatcctcgcgaggctcctggacacgggcacgccgcgcctcgactcggcgtacgccaccacggccgcggatccgggcgtaaccgagaggagcacggcggggatgaggcgcgcggcgcgcgtgacgaagacgtaggcccggatcatgaggagcgtgcagaccacctggtccagctgatggcggcgctcccggaggagaagcgaagaggccctgatatcgtcgtggatcctctcgagggtgacccgggcggcgtgccgctgctccacgccgtccacgatcatgggcggcgacgccgtgacctcgcgcaccaggcggcggacgttcctgagccgagcccgcgccttggcgaggtgggcggcgttgtcgtcgaggtcggcgcgcgcggcgtcgagcaggatcttgacgtcgtcgacgttgttgatgaggtaaacgccgaggctgtcgagcagctcgtcggccaagttgttcacctccattgctgtgcgtgggttcttgcgcttttggcgtggttcagtgttcttctcatcttctggccttttctgttctgggggatgctttttggactaaaacatgggtggtctgtgggccagacttgtcatggtgtacaatagcttcgtggtagactgggatgttagattagctcacactgctaatccgcaatcaacactagtccataggagagaaaactgacatgattatggctctggtgaatttcaaatttcagatatcaaacatttttttcttgcggaatggatcaggaaaaattctcacatttcactcccacacatcgacagcgcgagcgaaagtagcgacacaccagtacaccggtagcaaaaattaacgtgacataatcccagatgtcactcgctcgcccaaccgaagctgtaacagtgggggatgatctggaatgcgtcagtaactcagtatccaaacagccagaacagcggcggcagtatcgtgatcctcgcgtaggtcaccgcgcgtcatctcgtcgactcgtcctcgtcgtcaaccccttcgagctcggggcggccgaacacctccgactccacgtcattctcaatcgcaacagctttgcagcttcacatccctttgcagctttgcagagataaccatccaaatcaaccagaaacaggttgaagcagaaacacagcgtggcaaaatgcttaaacagcatatacaatgcatcgctgcaaccaaattctaaaagaaaaacatgactggattatgaatgtcctagaacttataatagatcgaccaaatgaattagcacgggaaaaagatggaaacaagatcggcttggatatctctgaacagaacaggttttcccgtcagaaatcaacttgtctcaaatgtcaaaatcagaagtagacggtgaaacggcaagatgagcaaaagaaaaagaaaaagctaatctcgactcatctacatacgatgctcaccaccgaaaaagccaaagaacagcacgaacacggccccatcctcgcgcgcggcgcggtcgatcagaccaggcccacccggtagcactcgaagaagccgcacatcaccacggcgaagatcctcgcgaggctcctgaacgccggcacgccgcgcctcgactcggcgtacacgagcgcggcggcggatccggccgtaaccgaggcgagcacggcggggaggtggcgcgcggcgcgaacgatgaagacggaggcccggagtaactggagcatcaagatgagcaggcgcagctgccggccgcgctccaggaggagaagcgaggacgcgccgaaatcgtcgaggacctcctcgagggcggcgcgcacggcttgctgctgctccacggccatgggcgcggtcgcgacctcgccaaccaggcgccggacatggctgagacgagcctgcgcctcggcgatgtgggcggcgttctcgtcgaggtcggcgcgcgcggcgtcgagcaggatcttgatgtcgtcgacgttgttgaagaggtgaaggccgacgctgtcgagcacctcgtcgaccaggtcgttgtcctccattggtgtgcgtgggttcttgcagttaggcgtgtccgcgtgtggtccgtgttttgcggactgtgggtggggggatgcgtttggactaaagcctgtgagcctgagtttacagagtatcaggtttttgtacgtacaaagctagcttagcttggcttgggtagtttggccagttgggtaggagattgggaggttagattagctcacacttctaatccgcaatcaacactagtccatactagtccattaggagaaagaactgccatgattatggctctcgtgaattccaaattttgtactataaaacatttttggttccggaatgggtcagggaaaattttgacattcccttcccacacataaacggatatgatcatatgaagtacccttcaatccctcgtcgtgcagcggaaagccaattgcacgattgcgcgcgtacgttcacgccgccaaccacaaccgcaccgctcgacgcggcgcgcaggacggggaggagccagatgcggctggtgccgaccgtgacacggcccggacgaggacgagccacgccgcgagacggaccaccagcctccgctcgataacatcctgcaggagcacgagcgccgcggcggccggcagcggcgtcgacgacgtcacccgagtgcgcgggtggcgtccaccaaaatatcccccgccgttcggagctcggcaatcgcgcgagcgaggagacgtcggcgaggaggtgataaagattgaggaacgcgtgcagctccatttcgtcttcttcgtcaaccactccgagttcgaggtggccaaggtcctctgctgcctccgcgtctgatcaaccccagaattcctgaacgggatcgctcatctcctggaacactcacgcacgcgaaaaatgaacagagaaattttgctctgcaaacttcgcagccattttttctgcttcctttctcctctatcgattcgcgaaactgaacaggaaatagccctggtggcctccaaaacacgcgccatgaaacgtcggaacggcatcgcgcaccatcccaaggcttcaagatcatgcctcatcactaaactcttgcactgtgccgacacaactggtcatgcgctgactcaacgaggaagataaccagcgtcatcgtcgtcaacgacggataaacagcacgagcttcacttggtgaagagagtttcccctatcttaattcttaagcatccaaaatccaccagcaacagattgaagcagaaacgtagcggggtaaaaggcttaaacagcacacacaacgcattgctgcgatcaaattctggatcgtgcaaatgaatcactacaagtggactatagcacacgatcgagcaagatggaaacaagatcggtttggatatctctgaacagatgttccccattatcccatcagaaatcaccatttctcaaatgtcaaaaatcagaagcgcgggcgaaacaacaagatgagcgaccaaatcaaacgacgaaactacactaagacggatagtgcagcgcgagcttgacttgatgaggacagcttccccagtctgaattcttaagcatccaaaatccaccagcaacagccaaccgattgaagcagaaacatagcgtggtaaaggcttaaacagcacacacaacgcattgctgcgataaaattctagatcgtgcaaaatttcaaatgctacaataggactatagcacgatcgggcaagaatgcaagatggaaacatgttctgtttggatatctctgaacagattttttttccccatcagaaatcaccatgtctcaaatgtcaaaaatcagaagcagagggtgaaacaacaagatgagcgatcaaatcaaacgacgaaactacacagaagtgatgaaacaaaactaacaaatcatcaagaagcccgtgctaatctcccgatccatctacgctgctcaccaatgaaaagctactagcaaacaacacgaatggcatgtcgcgcgcggtcgatcagaggcgcacccgatagccctagaggaagaagcacatcaaccgggtgaagatcatcccgaaggtctcgaacgtgggcaccgtgccgcgccttcactcgacgtacacgaccacggcggcggttccggccacgaacacgagggccgcggcggggaggaggcgccgcaaggcgcgcttgatgatggcgtaggtccggatgaagagcagcaggttgacgacctggtccagctgcctgcggcgctccaggaggaaatcgacgcgcgccctgagatcgtggtaggcctctacgagaaagacgcgctgcgcctcccgctccacctcgtccatgggctcggtcatgagctcgcccgcccgctgaaggacgtagccgagctgaatctccacctcggcgatctcgtcgtcgttgtgggcgaagtcggagcgcgcggcgtcgagcacgatcctggcggcgtcggggttgtcgacgaggtgatcgtaaatggcgaccacctcgtcgaacagggggttctccgccattgctgtggtgcgcgtggcagcgtgggcgcgtggcgtggcgaggctgcgtgttcggggaatcgggggtggttttgtaggccagagttggggctccgtgacgggtggctttgtgggccaaaggtgtcagtgacacaggtaatcaggtaatcaggtaatcatttgtccagtacaatagaagttagatgtgttcacactgctaatccgcaatcagccaatcgccactagtcctgaggagagaagtgacgtgatcaaggctctcctatgcatttcaagttccatatcaaacaatatgggttccggaattgatcactaattaagtactacttcttcgtttaagagctgtgaatcctaattaaggcctacattacaaatgccaacatggtgatatcgttggtgacgaagccaatgaataaaaaaagaagaagaagaagaagaaagagagaaaaaaaggacaacggaggcaaaatttggagctgtttttcacttgagaaagcttgactgatgccagtctgtctagctatccagtaaagataactgattccttcaaattttgttctccttttcttttgccgcatactggtctactggacaaatgatcggagcttgtcccgtacactccggtcagtacttcgtgcaggaaataacatgtttatactttgcttctgtaaagtaaatcagcaacaaatcatactagtgcacatctatgctgttttatgtacgagatcaaccgtttgtaatcccaagacaccactcgtccaaccgaagttgtaagttgtaacaaaggggattgatctggaaagcgtcagcaactcatgatcactaattaagtactactacttcgtgatccccgcgttgtccactcgtggagctcggccatggcgtttgcgaggacggcctcggcgcggccgacgtcggcgaggaggtgatagagatctcctgaacgcctgcaactccacgtcatcgtcttcgttaaccactccgaactggattgctcagcctcagctcctggagtactccaccccgcacgcgaagaaccgagacatgaacagagaaattttgcgctgcaaacttcgcagcctttcctatattaaggaacggagggagtaccatctatttgccaaaccgaacaggggaatggccgtagtggactcctaaacacgcgcaaaatccaccaacaacagattgaagcagaaacaaacgcattgctgcaatcaaattctagaaaattcatgaacgggttataacaatccaagaacttatgcttgatcttgcaaatgaatctagcaggatccccactgatggaaaacagtatcgaattggatatctctgaacaaaatttttcccatcagcaatcaccgtatctcaaatttctaaatcagaagcagagggcgaaacaacaagacggagcaagcaaagcaaacgaacctacacaaaagcaatgaaacaaaaccagcacatcatcaagacgcatgtgctaacctcctgatccatctacgcttctcaccaatgaaaagccagcgaacaacacgagcggcaagtcgcgtacgcgggcggtcgatcagaggcgcacccgatagcccaagaggaagaagcacatcaaccgggtgaagatccccccgaggttctcgaactcgggcaccgtgccccgcctccactcgacgtacacgaccacggcggcggctccggccacgaacttgagggccgcggcggggaggaagcgccgcaaggcgcgcttgatgatgccgtaagtccggatgaagacgagcagcttgacgattcggtgcagccgcctgcggtgctccatgaggacatcggcgtccgccctgagatcctggtagagttcctcgagggcgcgctgctcctcccgctccacctcggccatgggccagtccatgatcggctcgtccgccgcacgcaggtaaaaatcgagcagattctccaacgtggtgatgtggccgtcgagggccgcgaagccggagagcacggagtccagcatgatcttggcggcgtcgggatcgtctacgagttgttcgcaaatggcggccacctcggcgagcagggccagggtgctctccgccattgctgtcgtgtgggtggctcactggctccgtgatgggtggctttgtgggccagagttgtcagagaatcagattgttgtacagatcattggcttgcgtggcaagtttttacattagctcacaatactaatccgcaatcaccactagtccagaggagataactgacgtgatcaagaatttggttccagaatggatcagtggaaaattctcacagtatgccacttccacacatatactgcttatttacaatctctcgaaataactagggaacttagcaaacttcaattaaaaaactcaaacaaataatctgctttcctcgaatcagatatctttgaacaggtacgcatagcagaaaccaccttgtctgtccaaatcggaagcagaggaaggaaacaagaggaacgagtaaatgaacccacaaaattgcacctagcacggtcatcatcaagatgcaatatgcatgtgttgatttctcgatccatctacattgtacgctgctcaacaatcacagccgaaaagccaaagaacgcaacgaacaccctgttctgcattacaacagctctgccatttggacttgacttggagaagacagcttcgcctctcttaattctaaagcatccaaaatccaccagaaacagattgaagcagaaacatagcgtggtgaagaattaaacgacacatacaaacgcattgctgcaatcaaattctagaaaattcatcaaagggctataacaatccaacgatttatactagatcatgcaaatgaatcagcaggagaaagatggaagcaagatcggcttggatagctcagaacagaattttcccatcaggaatcaccatttctcaattgtcaaaaatcagaagcagaggacgaaacaacaagacgagcgaccaaagcaaaagacgaatctacacaaaagcgatgaaacaaaactagcacatcgttgagacgcctgtgctaatcacccgatccatctacgctcctcgcctcctcaccaatgaaaagctcgcaaacaacacgaatggcacgtcgcgcggtcgatcagaggcgaacccgatagcccaagaggaagaaggacgtcagccaggtgaagatcctcccgagggcctcgaacgcgggcaccgtgccgccgcgcctcaactcgacgtagacggccaaggcggcggttccggccacgaacgtgagggccacggcggggaggaagcgccgcaaggcgcgcctgatgatggcgtaggtccagatgaagacgagcatcttgacgacttggcgcagctgcctgcggttctccaggaggaaatcggcgtccaccttgatgccgcggtagtcctcctcgagttggacgcgctgcgcctcccgctccgcgtcggtcatgggctgggtcatgagctcgttcgtctggtgctggatatggcggagctgaatccccaccatggcgatctcgtggtcgttctccgcggcgttgaagtgcgcgtcgtccagcagggccctggcgtcgtcggggttgtcgacgaggtggaagtacatggcgaccacctcatcaagcagggggttctccgccattgctgtggtgtgggtggggttctaacttctaactgcgtggctccgtgtccggggaatcggactatcggcgggggggtgcttgcttttgtaggccagaattggggctccgtgatgggtggctttgtgggccagagttgtcagagaatcagattgttatccagagctttggcttgcgtggcaagtttacattctgctccattgctgtgcgttgggttatttgccctcgcagcctcgctcttgtgcgtggctgcgtgttttgggggtgtttttggactaaatatgggtttctttgctagagttgtcagttgtaacagagtcgggtactcgtgttactgtccaagcatggtttggttggttaagtccattagagctcaggctgctgatctgtgagaactggcatgaacaaagctttaacggaatttgagtctaatgtcgagcaatttggttccagaatggacaaggggaaattctcgcattccactttatgagcagaaagctaatcacaccaccaaagaaaaccctgttgcgtccaaattcctgagtactcgtggtcaatagcaaaggggttgcatatgcatctgaaatgggaggcgtgagtccataatccatatgaccataattactgcatacagcataataacaccttaagttgaaataacgagtgaaccacctaacaaacttcgacaaacaagactcgaagaaatcaacagcattcctcgaaagttcgaatccacacagcattgcaggaaatatacaattcagaatgtcacatgccggttaccagcttttgggtgaggagcggtagataacgtcaagaattgcatcttggagaaaatcattggagaaacaaaggaatgcatatacaacaaaacgcgaccaccattcttcaaaagttcttgatgagcataagctcagttccgcgaatacagcgcgtcagctgtctcaattgcatcatctgccggttacccagcactgttatattgcaacattacagccaggcaacaaatgttgcacagcaccagatttacgaactgtgctggtaaacttaggcctagatggctagctcaacgagagaccatcaacctttgcaacaacaaacaaaaaaaaaatcaacagcagaggtagttcagagaagtctgaacagaacgacgtaaaaagaaggaaacaccaaagaatcacataataggtgcatatcatatcctacttggctcacagctgataattcctaatcattatgactatttcaagtcaaaatagcatcagtaactgacagtcctcatcaacacagccaagtagccagaaaaagcacagatcatctccagaaatatgatgtccaacaaacttcatacttcacagaacataaacataaaaaagttacacagatattgcaacacaccaattacccactgtgtgatgtactgatgtattgcatgccaattagttcagttctacaaccagctaaagtgagttcttaactaatcagagacaaccatttcaggaactattgggatgctaccaaatagcaaagtggctacatcttgaagtcagactggcatttataatcgcgtatcaaaattcacaaaaaacgtccaaataagacatctacagatggattactactatgtggccaactgaccaccagtgtgcacatagtcatggcaacagaaatgattcaccattgagcatgaaacattgttataagccacagtcgtttattaaataaattatttgaccagctatcactaacaaatgaagtagaaaacagcattcataaaaaaaggttatgtcaaagaaactctgatgataatcaaaacctacaaatctgaaagtgaactatgtattctagctacagaaaagagtcagactaaagttttactgcaagaccgattcactgatgatcagaaatagtcaatcagacgccaggaaatggtaacaaatgacagtgagtactgatcaccaaaatgatcacatactaacagacaaatgagcccaatgagtataaaacaaccagatagtacaactaagaaacagatccgagttatctttagtttagtaatatcgataacctaacacatttatggatgtatggatcaccctaaactcttaacctaaatccaaaaacattcacttgctaaatccaagacagtaaatgtaccacatcacaagatgaaatatgtcgaaatataaactgccaatgcttcctcataggccaaagccaccatcagcaacatgacaaaaacatcaaatgtgatgcaaacagaaagcacggatataaccacataatcaaagtaagggcacaccatttatggcatcaaacggccccagactatttcatggtcattagcatcaatcaatcacatgtacatgcatccatcaaacatttctttccaaactaaagaatatagaagtgcacccaaagcctagaagcagaaaatgaatataatgaaacggtgaaaatttgtcccaccaccatgttttccacaagtgcgtatccacattccatataaccatctatagaggaagcatgcacatgccaaaaggcatatacaggacatatattgcacagcataaaagaagcaacactgaatctaatcaagttatagttcctcggtgactggaacggcaactagaacccgtaggtactattgaacagacttgagcagcagaaaacgcctcgagatcagacagcatagcacattaatcaactgtgacatatggcaacagattaattagctcatttcatccattcattaaaacgggatatctcaaaatcatcaatcaatataagggcacatccagatatgcaaactgcaaaccatcagtaagaagtaatgagaagctcagaatggagaaaaagcataaccgcacagcaaccattcggcgttcctcagttacgcatcacaaattgtttcagacatttagcgtcaccaccgaagaaggtagaatgataaaaggaaaaacaggaatggaacataacaagtgttcagatccctatgtttctgtaggctattaagcaactagctcatagaagtcatactattctcatccagcactctaccatcatcagttcatcaccacaaaaaaactcatcaaatcttccataggctgtcgcagcagagcaaaacttcctgtgcatcagatcaccagtttacctcttgaggcggaggaagatcaccacggcaacagctgccgcggcggcgccgacggccgcagctccagccatcaccggccacgcgacccgcgctccctgcagggtcccaggtgtcggagcagccaccctctcgtcctccgcagcggcagcggcagcggcagcggcggccctggccctggccctctccttcatggcaatcacctcctcctcgagcctcatcttcaccgcgcgttcggaccccaccttgccggcgagctgattggagtcgcgcttgtccgccttgaattcatctttctctgcttggaggagtttctgcagatcctcgagctcctcgcggagcgcaagcaccttcgcgtcggaagaagaggcgatgtactggaagacgaccgagttctgcttggccttatcggaggtgtccttcaggccgtcgatctccgtggcacgccccttcttctcacggtcggcagcggcgagcttctcctccaggtcgtgattggtggtgcggaggtcctcgatctcggcgttggcggcgacggcggcgtaggacttggcggggttcaccggggcggtgacggtgacctcatcctccgcaacgctgccgtccggcacggtcttctcggcggcgacggtggcgtaggacttggcggggttcacggccgcggtgacggagacctcgtcctcctcgacgttgccgttggggtaggtcttctcggcggcgacgtcggcgtaggacttggcgcggttctcggcggcggtgacggtgacctcgtcctccgcgacgctgccgttggggctggtcttctcagcgacgacggcggcgtaggacttggcggggttctcggcggcggtgacggtgacctcgtcctcctcgacgctgccgttgggcaaggtcttctcggcggcgacggcggcgtaggacttggtggggtgcccgtcggtggtggcggcaacgtcgtcgccggcgaagcatccgatgggcgcggtcttctggccgccggcggcggcggcggggtaggcgagggtttcgtcgcccttctccatggggaacggtgggttttggagtgtggattctctctgcctctctgcgatggggacgggtgggggaaattcgctgtgaaaaaggcgagactactttcgccttcccaatcgcgcagtgccctttttatgccgaagggggggcttgatggattggtggagaagaaaaatctcggacggcatttgggggaggggtttcgcttcgcctcactgaccagtggggcccacgaattggtgttgccccgtgaccccacctgtcagtttgggtggtaagtggtaaccgctctggcgagcatgcgtgccagccaccgcgacgccggtggggtcgcggtgtcagcttggatcgtggcactcgcgttgcgccattgcgtgctgaagaagatggtgcccccggtgcgtggggaaaaaatggttgctactagtgcgctgcaccgggcacgggacacgcgtcgtgtcacatctccgcgaacctcgcatcgtgcaacaaaacagtgtgaggcttgtgcgctcgcatcgtgtgacaaagtagcaatcgatatgctcccaagtcccgtgatcccgtcgtttagcaaggggcactgtgaccaggggcggatacaggaacaggtagaggtaacagaacaaactgaacaaactactcagggtgtttagttggggaaaagtaaaattttggatgtcacagcgaacgtttgaccggatatcggaaggggttttcggacacgaatgaaaaaactaattttagaactcacctgaaaaccacgagacgaatcttttaagactaattaagccgtcattagcacatgtgggttactgtagcacttatggctaatcacggactaattgggcttaaaagattcgtctcgtgattttccccataactgtgcaattagtttttctttttatctatatttaatgcttcatgcatgtgtccaaagattcgatgtgatgtttttgggaaaaaaatttggggaactaaacgggccctcattgcgtctcaaaatataacaacttttagttggatatgatatatcctaatactacgaatctggataggaggcatgtctaaattcatattattaggatatgtcccatgcatccaaaaattgctatattttgagacgaacactatattgtcatcttctaatggattatgacagttaattttaatggaggcttcacggttgtaacaccgatattgggggctcgagacccccaacgacctcacggtgaatccgtcattgagtgttactgcgtgaggcctatacggttgcatcttatcagtgtatcacaaagtatcaatcgatgctcgcatatgatcccatcgtttagcaaggaaaaatattggtaaaacttttgtatttactaacttctctctctgttttacgatgtaaatcattctatcattttccacatatatatctatctagattcattagcatcaatatgaatatgggaaatgctagaataacttacattgtgaaatggaggaagtatgttccataaaaattcatcttatgtatatttgtattaaacttactctgtccgtccaaaaaaattgtattaaacttactctctctgtccaaaaaaaggcaacctagtactaggacatcctaatacaacgaatctggacataaagtatgcataaatttattgtactagaatgtgtcacatcctagtagaaggttgagttttttttggacggagggagtatgtatgtacttatgctatgtgctatagaacaccaaaactctgtgttttttttattgtagcatactaaaaaacatgttacgtgtatgtatgataggataaaaaacctgataattaattgttaaacaccgatggtactgtattattttgttacatttgatgtaaatgaagagagaaacaatgtgaaaagtatgaatgtattcttggggatatctaatgcgcactattttttttcccgctccaactcaatatcaagtgatagaggggatgagtttggacgtcggcactctagcgaccaaatagcgacagtggcagctagtactgtcccatagcacgacgctcccacgggaggtggcagttgacgtcgtcccgtcatgccggttcgattgagttgcaacgatggtagggggaaggtaccaatgatgctagtgtcgtaaaaaagatccattactacaataagttttttttaaaggatctatttgcaaaaaaaagattttaaaagatagaatgttaaaaatctaatgaagatgagcgagaagaggatatagagtaagaagatagtgacggtttggtttagaacttttaggaaaatatacattttggagtaagtaatgtcatatattgtgtaactgtgaaatttaaattgcatgactttaaatattaaaacagtaatgatattttttgaaccataaagtcattagcaatagcatttatctaattaacctttttgtattgattattgaaaagggaaagctaggagagcaatcaagcgaaattgacacgtgtcacggcagtggacgaatattccatattgcccttcctttcacccccccccccccccccccccggggggcgtcccgtttctgccatcgagtcgaacaaacaaaccctagaactccaataccccatcgagccccggaatagtactccgcccgccttgcggaaacaaatcgaagaagaagaaggaagacgcagccgcgtgcccccccatccatggatctggagatcgtgggccggcacgcgctgctgttcgacgacgacccgacggcggaggtcgtcaactccggcggctccctcgtcccctgggccgccgtcggcgcggacgacctcctcctcgaccgccacgacgtccggcacctgctcgaccgcgtgcctcctcgcccccgccgctcctactccgcggccctcctctctgccccctctctggatggcgtctccgaggctgaactcgaccgcgagcgcttcctcgacctcaccgccgacgatttcggcggcgagggctctcaagatgcggtctcttcaggtatacgtctgttcccgctcctcttgacctgcctatgcactctttccctatcctctatcctgtattgcaactattctgcgtatccatcagctgccctttcacctttagttgcaattgggcgatgcgagctctaagaatccagtgtttatcatcttaagagtgctagcaagaaattagactctcaacaacaccgcctgatgtatcatgtagtagaggttagaaaccaaacagttttttctagtcccctttgctctcactgggatccacagagaataaaaatctgctgtagggatcaaacaagagtgaaggactgaaggtaccagacaatatgttgttgatctgtgtgcaagagttgcctctgcaattgtaaggacatacagcaaagataatttgttatgtcataatgttgtttggtttcagttgtgtgaattttcaccatctcggatttgtttcaagtcttactgaggcttcatttggatgggttcaaatgacatcattctgaacccaccaaatgaaaccctgctgaggttaagtccatgaaatgggagggaacttacatcgttctgacttttgagcccatccagatgaagctaagtacatggactgtagatattcgatcttcttggttagaatattattttagttcaatcttctgaaacatcgcccttgaatggatctcagttgtttaaaagttcttttgtttgaatgttagtagcaaaattaagcttctctctgttgaattcctgcagtagctattcttctagcaaccaaactaggaaatagttacattgttatggagctcgatatagtgagagtgagcaatacttgcacaagtagcacaactagcaatgctaattggacccaaacatttttttgttgtaccttttgtaagtttgcaggaaggatgcttgaatttagttgatgagcatctttaatcagttcaagtaagggacttctatttcttctaagatgcatatttgcatctacacgtcttcctctacattcaacactatattttatgttgcttgtggtaaacaatgttacatctgacatcttttctttatacaggaaatgggacagatacaggttgggctgattataattctgtccctttctcatatgggagtactgctggttcagatgatccaaataatttgagcacatattattgcccatcttttcccgtgcctgacagattgttgaataagctggtaagtacatggactatggagtctgtctgactgcttacattgaacttcttttaataaatcggaattttatttctttatgcatttttgtattaatattcttcagctgatccagccataattatccaaggtgcatatgttcttctaaggattaaatgcctatttcagatggttggagcagagatgaggttcctactagtgatgcacattgtttccttacatatatcatgatgtaaggaataggcaggtgggattagaatgatgtaaatgttacacacaacagaaaaaagtactggcatgggatagctgttcttatgatataccagctaaattcatttgagctttgatcataatcttgtacttccatgcactcagacccttactgagacaatgttttcgcccccatattttttttcatttgcagcctccttctgagaaggttcatcaaattattgcaagaactgctctatttgtcagtgagcatgggggccagtcagagattgtgttaagggtgaaacagggtagtaatccaacatttggtttcttgatgcctgaccatcatctccacagctacttccggtaccttgtagatcatcctcagttgttgaaagatggtctagatgctgattcaaacaagggctgcaaaactgccaatagtgagagtgggcatgatgcatcatcaggcggggctttgtcattgcttggggctgtctatgagtctggagatgaggatgaaggcatgcttccgcctagtccaaaaagcacggttcctggaaaagacgtggttgtgcatgagcaaggtcatgaaagctctgtatctgctatacattgcaacgaagaaacacgggatggtcagaaagcaacggcagcagctactgttgcagctaaagataaatctattttgactaagaagaacccaatgattactggcagcagccttcttgctgctcgcctagagaaggccaaagatgccatgatggcatcaagtacgtcagatgtttctgacacaaaagttgtgattctggaaccaccatctttcttgaagcgtacaatggagaaaatagttgaatttattatcaggaatgggaaagagtttgaaggaaaactcattgagcaagacagaacaacaggaaggtttccatttcttctgccatctaatccatatcacccgtattatctgaagcttctcgaggaaactcaagaggtaatgtgaaccacgcttgtttatactttcagattgcaatatttcctttattatccccctttctgtttgctgtttggtacactaagttttattaatcccttatgatatatgcattgtttcaatgtatatattcattatctttacaagtttacccagtgttttatgactgaacttctctcaaaatttcacgcgctcaatcctttcaattgattgttcatcaataatgttttggtgaaaccgcactaggcatcaactgctagatatgttcatataaaacctcttgtgatgatgggctgatagaaatccaaattttcttcattcgttggttcatttgattgttctttttggacaagcatgtgttgatctaccttatgtttcttttttttttttgctctttttaattcttcagcactttttttgtgctagtgcctgaaatgctaatggcttttctataccaagctttcctcctgtttgtttctttagtgcacatgatgtcttacacttgatctctgaacttcaggtaagttcatatgtggacatatttcattgctgatgcactacctacctttccccccttatttttttgttgataattccagtcactaataaaatatttggtttcattttctagcattggtaaacagcagattaatttaaagtttttcttgttgttttggagagtcttgtgttaccatttccatacttgatttacttcccagtatgtttgtttgtaaattcctagttgctttgttctactttttttctcagtactgattttattggctaattgaaatgcataccatctatgttgatgtacttgcattctgcgtattcttgctttttgagaataaatctcgaacttccagagcgtgtttggttgctattttttatttgcgtggagaatattattatatgtatatgcaatgtttctgaacttgtctgtttgaggtgttttgtaggcctccccataccaataaacaaatggaaaattgtaaatgcacttaactgtgatttaaattctgaatgattttgcagtccaagtcccgtggtggttcttcagagcccaaagacagaaaaagctcttcagagcacaaagaccgaagaagctcttcagagcagaaagacagaagaagcccttcagagcgcaaaggtagtaatcatggtaagggagaaagtaaaagcaagaaacggtcaagtactagcaaggatgccagttctcctgatagaagctctgctgagccgtcagagaagcagctctatgacaaacacaaacaagggaagggaaagttccacatgatcattagtggggccaagaaggaacctcctcggaatgtcactgcagatgaagctgctgctattgttatggcagctactcgtggatttggccctgccaatattcaaacaaacacactgaaggacactagtggaattggtcagacccgtggagataatggacatacttcaagctttggaagtttctcctctttacaggacccagatgtaccatccaaacctgtttcaaatagtgaggcatgtacctcactcacaagtagtggtcagcctaaaaatgaaggcactggaataattgatgatgattggattgcaaacactatcgcaaaagctgctgctgttgcagcctctaaagaagctgattcttctgaagcatccatgacaaaagagcagaagctgaaggctgagaggcttagacgtgcaaagatgtttacctctattattaagagtggtggcagcaagatggctgatttgtcaacttcagctgatcaaactaatgaagctggaagggcctctcctggtgatttgaacttatctgagtctgatccacaaccatcagctaaggaacgtgaaggtagctctgtgccatttgaacgtgaaggctctaatctggccaagcaggagaaagactctgatgacgaacggaacagggcaaggaagtataggaaaaaacatcacccagaatctgacgaggagaactatgattcagaggagagctataaacactctaggaagaagcaccgttcagaggattcaagagctcatactagtgatgttcacaaacataagctcaagagacactccaaggatctggaacccaggcatcataggcaccgtgatagctcttcagaagatgagcatgagcacaggagctccaagtcaaggcatcgtcacagggatgactatcactatcacgaggatgatgagcataggagttcacatagacaccagagggaccaccgttccagttcaaaaaggaaaaaggacgatgaccgagataagagcaaacaaactatagttctcccagaagtctcccagaaccaggaaaagccccctggtgacactgctcaatcctcccaggcaacaactgaagtgccgagtgagttgagagcaaaaatcagagcaatgttgctagaaacactgtaaatctgtaataccctgtggggattatgctgtacaatgggataatgtagccaactctccttgttcagcaccgactcagggtatcaagaagtgtacttgttcggttatctctctcatttgaaatatgtgtactgtgtacaggatagcgactgcgttccgcaatggccatattggttcactactcggtaccaaggccatccaacatggggccttggatgagttggatcctattcgtatggtattgtgtattcgctgtttttcctcgcctccccgtttgcatgagccgagcgccgaacttgggctaatgggcaccgttcgatcgaagttcgaacaaatatatgcaaagcacaggtttcaaaaaaaacgaagagcaaacgtaaagcacgtaatatcacacagattaagtaaacaggcatgtactcctactctcctagtacactaaaattctcctaaaaacgcaattacgcctaattaattagcactatcaagcaaacatgccaatgtaatcgagttcgacggagcccaaccacagcttgcccttctgctccgccacctcgctgagcgtgacgcccttggcagccgtcaactcctccacctccacgccgtcggggttgagccgtacgccgaccaggtgcttggctgcgggcgccgcgcccagccgcatcctctcctggttgagcgccacccagtagcctccctaggtgtcgcgcctcacgttgtcggggtagcccgggaggtcggcgaagagctcgtactcgccggctttggtgccccgcagccagtaccggaacgcctggcacggcacggtgtgcgccacgacgaggtgcgtcctgtctcggctgacggcgacgccgttcgggtacggcaggtcggtcttcagcacggtgacccgccgcgtccgcgcgtcgtacttgagcagccgccctgtcgcgtcggcgttcatcgtgatctccccgttgaacctgcgggtgtacgtgctgctgctgtcggtgaagtaggcatcacccgtagcttggtcgacgtcaaggccattgaggaagtggaaggggacgccgtccgcctcggtcgcgaccacctgggcctcgccgccgtcgggcccgaccttcatcagccccttgtacgcgtcggcgatgtagagctcgccggtcttcctgaacaaccggatccccagcgggcgcccgcagatgctctccctctcctccggtggcacctcggacgacgagcagagagggattttccggtagttcgcattgtacgcgaacgtggtccagccggcggcgctgcctccccacttgagcacgcggccgtccgagacgccggtgtagaggccgtccttgccgtcgaaggcgaggctctcggcgccgctgacgccgtcgggaagcgggaggtggtagctccaccgcgtgtcggtggtcttgatctgctgggccgcgcacggcgagatcaccagcagcgacgcgacgctgagcagcagaagaaacgtcgccgtaaaatcgcgagccatgggtcgcctcatcgttgcacgtagccgagaaaacgttttcgatggagaactagccgctacctgcatgtttttataggttatggctcgtgacagcctcggcgtttcccggtgtccaagttctactcgaggtcgtcagtaatcctgctcgaactagtactctatccgtctcgtattataagtttaattctttttaagttaaaattatttagatttaattaaattatagaaaaattaaaaacatctgtaataccattaatttagttaaatttaaattatattttaataatatatttgtttactaaaattattagtagtatattttttataaatttaattataaatttagaaaaatttagaaaatgttaaacgactcgtaatacgaaacgtattgagtattgcagatggacgggaagacgaaacccaaccgaaacggagccacgacacaggcttggattcggttttcttcacccccgcgggctccggctccgttccaagttcccaatgccaacctctccttccacgaacgccacgtcgcggtcgcgggcaacccacgcgcccagccgcccacgccccaaccagattggcatcgcggccgtccatcgccgcatcggcgcaggcgcggacccgaaacccaccacacggcaaaccaaaaaaaagaggcctcaccgcacggacgcggaaatgggtcgcgacccaacccacgcattccgcccccggctccgatctgctaagccccctcggatcgggttgcgggtcccctcctcccccccgacccaccaccgctcgccgccggccgcctccgacgaggtcagtccccgctcccttcctcgcccttccccccatccccacgctgcctcctccgcctcctccgtggtgttatcgggtccagtaaccggagtcataaaccctagccgagggcgcggtctacgagctgcttcgtgcccgatttcatgggattcgagtgtggggattggacccatggaggctccgatttagcttgtatcttccagatcgctcccttgtatacgctgattgcgtcgttggtttgggacactggggattcgggcgggttgagccggtgaggtgaggggatttaatgaaggtattttgtgcgtgtttcatcaaccgggcggaatggcagcttgctgcatctccagatgttttaatgggatttgtggattatcagaggcgttctgtagtgtgagtgtatgcttaggatatgagcttttcctgccaatttctacttgcgcgtgtatagttatagcttgtagctacaagtagaagagggcatggagaaaatatagtaacatcaaaggtcactcattgctttccagtgttttggacgcgtgagagtttgtctggaaaagagagtcaaaatgatgctattaccttttctttgtatggatgtagtgtctttatatatactatattgctactagcgttgcatgatgtgcttgtttggatctgctgcagtgggcgatcatatttagatacaagatagcatgctggagccaacagctatggaagtgccgattactagctcagtgaacactgcagtggtgcctgtgcctgtggtgcacaatccacgggcacggaaattgcggtctgcagtttggcaggacttcactaaggaacggcgtgctgatggaagctgtgttgctgtctgtaaccactgtaagaagcagctcacagctactagccggtcaggcaccacacacctacgcaaccacctcgcaatctgcaccaccacctccacgcgtcgtgctggtaagcgccggaagcttattgtgcgccgtattctccacaacaaaacctccactgatggacagtctggtgacggacatgcttcgggagaggaccatgacaacgatggcacgcattttgaccaagaactcagtcggcgagatcttgcccatatgattgtccagcatgggtaccggttttcaatagtggatgatgtgggcttccaaaagtttgtcaagaacctccagccacggtttaggatggtgtcatatgaaacagtgagggctgatagcatgacaatttatgaaagcgagaagctgaagctgcaggatgctctgctcaagatcccttgccgacttagtatctcagttgatatgtggcgatcgaatacacagatggacttcttgtgtttgacctgtcactatattgaccatgccaatgatgagtggaaagttaggaaaaaaattctgaactttgtgcatgtggaggcaccttttacagatgatcagattgctagtctcattctagagaagttgcgtgagtggggtattgacaggaagctagctgccattgtactggacaactgcgcctctggtgagattgttgctagagagcttctcgtagttctgcagcctaggagactcctcctattaaatgggaatttgttccaggtgcgctcttgtgcgcacattcttaacctcacagtccaagaaagcttagaacagacatctgatataattactagagtccgtgagatgattcagaatgtcaagttctcacaagaaaggttcgaaaagtttcaggatactgcaaaactgttgcagatggaccaaaaactgctagttcttgattctcctaataactggccgtctacatacttaatgtttgattctgcatgttactatcatgatgttctcatgcgccttgcagaacaggaagcacattatggtgcttttctcactgcgaaggagtgggccgatgtgaaagccctcactgaaatacttgatgcgctctatcataagatggagaagtttcctgtggaaaatccgactgcaaatctctattttaatgacatgtgtgaggtgcatgttcttttgaatacctggcgtaatagtccatctcctgttgttgcacaagtggctgaccgaatgctgacaaaatttgaggggtactgggatcttactagaccagtaatggcattcgcatctattctggatcctcgatataagatgaagtctgttgagtacttctgtagactcatttatgctgctgatcaatttagagcaaagacaacaatagatgacattcggcagagttttaccaatttgtgcagtgaatatgaacagtcaggaaattcattcaagaatccatctgctctcttctactctgcaaccagtaattcttgcatgagttcggtatacagcaatggtgatgattttaagaccttctcccgtatcacattatctgatgctcgaaggggacttgatcaatatatacaggagacgtcatcaggccaatcctttaagtctgacttagacatgtaccttgaggaaccggtctatcgccaaaaggaagggcatttagataattttgacatcctgggatggtggaagtcctttgcagcaaagtatcctgtcctttctcaaatggctcgtgatattttagctgtccctgtatctatcatcccattggacagtgatgctcggacattaaatgagtatctcagtaccatggacccttcaacagtgcagggattggtatgtgcgcaagattggttgcgggaagatacagaaggtaccactaggtcacaccttctacagtaagttatatttctgccgggcatgttaatctgaattatttgtttcacttgtgcttttgcagttgctagttcagacggtcatgcagatgacaaagcggcacgtggtgatgaacttatcgtgttaccaaaataggtaatatattggacgcagatcacttgtttcagtttgctttgatacttttatcttttcccagatgtgcattcatgtgacgttctcatgcggaaagtttgggaggagcttcaatatttatgcttacatattcaagtgtttgactttctctgtttgctcatgttttcaaaaccttgaatacattgaagatcaaatctatatctatactctggtgcaaagattatgttcaataatataatttatccaacagcagtgcttgggcttaccctgagcagaatatccctactttcaaatagtagtatgcgttggaagtttgagttacatttttctcgaacaccagttcaagttacatgacaccattgattgagaagatcatgtgcacagatgttgctaagcttacaaactgcctaattgaattgctcatgaattcttgtttgtacaatttcataaatgcataaggggaataaataaaaacattctctaaaaagaaatggctacgtgaagcaccatttgctagaactgaaacctgttgaccatagtatttgtactcttaggcttgtagcctgctaatttactcacggcttcagatctcgatattagctaatactccgtattacttaagtacttccttctatacgttttcatataaactttctttactctccatttgcaatcaacttagtgtgattttttttaaaacccgtacagctaaaaaaatgaagaaaaatagcacactgtatatttcttttcttcactagactactggagtacaacaatcggagtatccgatccacagtaattcaccaccgaaatggtagtgttttaggtgcaattttcttcgttggtgcaggttgcacaatggtattaactttagccaattgcggttgttatgcttgtggcctgatacttgacgaattggttaagttaaaaatatgttacttcttttattgtattgggcaccaggattattacatcttcatttttacttgtctgcagttgagacttctgattgatggctcctgagtcctgaggagaccaaggaggcgaggacgcaagtaactgcattatttatgttcaacagtccaatttccaggcttccagctacacccctgtaaatgtatcgttctagttctagatctgtttgtacaatgaagtcgtaggtacctccaagaaggtagtatcaatttaggcaattgactctgcattaatgacttaatgtgtattatgctgctaagctaagttatctccatcgtagctaagttatctccatcgtatttcttaagaatatgcagttatgcaggcaacactcctgaagtggataactttgaatccaacatttcaaatgtgacaaaatttattctactatcaaagaatctgaatctgacgagtgacgacttgtgtttatgtcttttttttttctttcttaaattagccagtataaagaacggtcaagtctcttgaggcttatcaagatgttgaaaatcgtctctctcaactcacagaactttaaagttggtcacgaaaacgcaaaagtatgatgctag

SEQ ID NO: 69565 - DNA, 4343 bp, Oryza sativa
  unsure (1)..(4343): unsure at all n locations
cgtgatatgaatcgatagaacctcgcacacnaacacacgaaacattgctgacagataggttagtataaaggtttcccgcaaatagaagggaatccttgggtttaataacctattaacctcacctcagatcacatgataatgcagtgggatcctatgctcgtaaacacataatactactacataagagtacttaacaagcaagagaaagtatcagagattccattgggggagagaaaaatgtgatctgaaaagttgggatatcctgaaaattcaacctctccttttttttttcctacctgatatatactcctttccacaaagatgaaaggttgcaacaaaaaagacaggatggaattgaaggagtgaccactgcagcacatgagctggtaaaagttctttggaaaagattggcaagatatgattgcttcagcaatagtaaccggtgcttacctggtggatccaataggactcagaatgattcagtataccaatgaccatactggtgatgcattagcttttgaaagacacatatagttgcaaggacattttactttatacagatcccatcaagggattacaatcatccatccatcagcacagcttaacaaataggagatgcaatgaaactacattatggatgataacatttagccatgcactttctctagttgacatcgcaatattaatatcatatgtacatgttgatttcaaggtgttctgtagctactacattcaaggtctatggtgaggataccctagatagatgtgcacacatttctccagcactccagcttagtgacatatagagctttcagctgtggaagcagatgccttgagtgcaacgtgtgatatgtccaagatacactacttacccagtaagaaacaacaacaatatgttgatcctgtcatcctgacagtttgtatgtacagcatttcttaagttaaacaataagcataattctagccctctaacatgccaagctggagcttaaactttacggctagaaattaaatcttcagaagtttatatagtacataattgtatttcacagttactatcctggcatggcattttaactgctaaaacaaaacacatatatggtaaaaagttaatatgcttttcctaacaacagagtaatagatttccacaagtaattcacggcatgaagagaagttaagaactggtgcgaagggagctattatttcatctttcattgtaaaattcccaatcacattgttctaacacttaacctcggttgtatgttcaatacagatgtgctattctgtaatcaagtcactaaggctaagaaaatgaaaacagataaaataactgtagccgaatagtgtacaatccaacccccagcttgaattttctgcagatagaaatgacatcaagtcagattaccttttgcagtaactaatgctctggtatcagaaaccaaacataagcaagaaagagatagcactatttcatgggaataagttgaaaacacaaattagaagttttgtatcgctaccaggggtaattttattacaaattgtccaaaaccaaagtgattccaatgcaacccattgccaattattacttaagggtaaagtatatgaagccagaattgattattgaaatagaccaaagatctttgaaaagttcttcgataagggtctcaaaaaaaggcggggaaaaggctagagcattcagaatatgaacattaaagatcaccaccactctcaatagtttaatacaacaatcttactgataatttaacctagaatccggattataaaaggttatccataatgtgtgtcctagtgatctattaaaggagttaattggcccatcacaactggaagacgtattagcatttaagtaatgataaactcagacaggtatctcattattgtcaacattattctgaactggaaactccatgcaattttatttgaaaaaaccgaaaataagaacaaatatagggaagaagtgaaagcatacaaaccacaatgaatgctcacacaaggatattagtcaagcacagaagtatcatctaaaaatctagaccaacatgatccattgtgcaactttctagtttctaataccaaaattcgtttgatactttgatgaggatttaagaaaccaaaattaggattaaaacctatcatacgttttcctgcaaaataacactggatgattaaaggcccagcaaaatggttgggacatgatgttgcctggaaacatgcaataaaatcagagtattcaatagttctatgttgtatgaaatgaccgtttttaacaattgagtagacatatcctcattttaacacaaggcaagaatgatttaacaagaaaatacagaaaaggtgtagacaaaacaaaagattaaaaatgcagtccttaccctaagagacaagaagtacgagggtgcagatgaaggtaatagaccctcataaccaatatcatatgcaatccttccatcagcattaaacagcccatagtgcctctccgagctaggtccaggcttcgaattctcattaaacaacgcaaagatgtatgctttgactggtctctttggcttgagaggagttcctttcctcagaaagagcctctttcggaggttgaaattgtaagtccttgcattctcaactgaagctcctgcctcagtttgatctccactagaagcccagccagtctccgctactcggacctccatgtctctatacccagcggcctgcagagcagcataagctgcatctatctgagcatcgaacatgttatcataatgcagactagtattcgggtcaacaattccaggattgggcttgaagagagcgtaattaatgtcaatatgttctggatcacttatgtaggccaaaaagggatatgcgttgacatagaaaggtgagccaatttgttgaaagaagtccagcagtggtttcatatacaccatgacatcttccttgaaaacacatgcagaaggtggatatgaagtagcaaaaacagcttctgagtgtggtgtgaatagctcaattttgtcttgcaagtgaaatttcttgagtccattatagacattcttcacagcttgaacgaggggctcggccaagcttgtatcttgacctcccagcacctcatttcccacagtgatcccaactatgcgtgtctgaggaagatagggctgcacattctcattcagccagtcgatcgacctgctctcattcgccgcaaaatccttcacgagctcattggggatggcgataaccagattgagcccagatcccttgaatgcatcaagaacgctgtgatcggaatcgtatatcttgacattccttatctttgaagctctcaggagttgtactactttatccggagaagggatgttgtttgctattctcccgtagtttatcccatagcccccgggaaacgcttccacggctctaggaccttgtcacaacaaataccaacaatcaaatttcatatcattaataccaaatcaaggaattatttttttttctaggcatcgcaatcgaaagcatgaaaggctcaataactggtcaagaaagagaattggcaagagaattgagttgaattggatggaaagatgggaaaaaaaatttcagtaccatgtgaagggaaggcgaggaggaggcagaagagcagcagcatccagtgagcacgcccgctccgactccgactccgacaactcatcatcatcaacgtcgccttcatagcagggacaccacaatccgcttcacagccagaagtggtggtggtggtagcctcagttccagggcggggcatggcgccgcggcggcaagttccatagacggaccaccgctccgccacggccgagcacctccgagcaatcttggcccgccgccttctccacggattcaccaagaacggtaaagaatccgcaagaaccggatccctcccgccgccgaccaatcaaccaacgcaccaccaccaccaccaacaacaacaacaccaacacgaaggaatctcgattcccgctcgttatagtccacaactcctcctcctcctcctcctcccagtggtaagcacacacctagtcacaactccactcttctcgcggactactaaatataaccaaccaaccaagcgaagcagcagcagcgaagcaagcaagaagggtggggttaaggaaggattaggggggtttgcttagcggggaggagattggggggggggttctatttggatggattgaagaggaacactcgcatggcttcaaataatatcttttgtgatgatgactatgaaagccatgccattccaggtggtgaggccacctcacgatttcaatgggtttatttggggctacaactgcccg

SEQ ID NO: 69566 - DNA, 3363 bp, Oryza sativa
cgcccacattgacagaagtgtcggacaccatattttggttggatatctctttaaacgcagtgatgggtgaagaatattaaaaaaaggaaagggtcttatgcatttgggttttaaaaaaaagagtcaaaatgtttagatcctgctatgtgcagtgttaaaagacaatctttatccccaataatttattataacatgaactagcttttttgatgttttgattcacaaggatggaaagaccagtttccgtccatttgaaagggggagtaattcactgagggactcaaaagtatactgttttgtttgttacagaagatttgtggataagctgtttctgttttcccaaaagaagatgacttgtttggtgatggtgaacatatcgagttaaataaaaaaactgaaaatcccttatattgtgggacggagggagtacttaatcaatcacacattaatgaactgctccggtttccgtgcatgataggagtgttcccaaccgtgacaaactaacacagccgaagaggtgtgatctctttgtgcactttccttttttttcctatgacactatcaattaaagaacttttattgtcatttatgtgtttttattcctataggatttaagaaacatactattgcattttttcctattcttttttctgtctgacgaatcaaagagacatttattttgaatatcagatattcctttcgtcctaaaatatagcatttaatactagtcctaaaatatggctacttctccacctaccttatcatctcaatcaatcacgaccatttcatattttaatttctccactcacttgcttatcgtagctaatgacaatgtttttcatttaattatacccttcttcttaattaaaaaaataaagtataacgataactagtatatttttggatgaaggggtaactattatgatcgtaagggagtattaagatgtacctccatcctagctatacaaatgcataactgaaataacatggccaccattttaatcagacaaagtctcatttatatagatttcacatgagggccaacctttcagtatcattttatttctatcacctaaaaatctaaaacccaacttcccgtgctcatggataataaagaccagtgagcgtagatcgatcaagatctacacttgcatgctcataaataagcacacagttaagtgataaatggttggaagaagtagataggcagaggcaggccggcagctgaactgatgccaaattgacaacgacccgtccttgggtacttcctccgttccgtaataaattcacttttagcttcttttattggtttcaaaacaatttatttttaataaaaataatcattgtgccgaatgttataaaaagcaaaaaaaaattatattaaaaatagataaagtaaaaaataattgcattagaatttgataaagtagggatattatattttttctattagtatgcttgggatgaaaaaaaagtaaacttacttatatttttttgttttctacggcccgttcgattcttctgtaaagagaggattaaattttggatactcgtggcacgttttttaaactgctaaacggtatgtttcatgcgaaagatttctatatgaaagttgatctaaaatatcaggttaatctatttttcaagtttgtaataattaaaactcaattaattacatgttattacaacatcgttttacgtgaaacacttaatcttcatcttcaggatattcaaacaccaccgtaggcgtagtacgtcaaaacactgaattgtacattggactattattggagtgctggttcagtgcaatatacatgtagaagtatctcactcattactccaagatgatttgacattttgtccagctgctattgtaggtgaacccaatgctacagttatgctaggctatcatcgtctgctcgttgatttttgtcagccttaactaaaatttaaagtttaaatacccctatttttaccgcacggttaatttgcacactccaattgcctccaaacattcagttttttttccctattttttgagcagatgttacaagtactagcccatgtaggccgcccttatcttcctcagcccatataggctgcccttctgattctcaaatgaattaggggacaagatgtcaatatctttcagggccccatgattaatgaccatgctataccaacattatggtgcacactattaacattatgggcctaatacagtcatctgtcttggaacaatacccggcctgcaagtagaactgctgtactacttaaacaacttaattattacgataggggctgtctataactagccaaatgcttgtgcgttgcaacggattttcttaaagtatataaaaatattgaacaaaatgggttaatatttctcaacaaaacgtatatattttgtcgttgagcataaaacttcacaaagtagatttgttgaagcaagtatagaagtccgttgccttgtcaacgattatagtggttcaatcatatatacgtgtgtattttgattgcctcaaggtgatgaaaaaatgtgattagtaattattcactccaaaagaaactgatgttgaataggtagttgaatttgagagacatacaggttacaaatcaaacacccataacaagagcccgtgcccataaattagtgatggaggtggtgatgacaaaaccaccacaccactatcaacatttaaaatagtatagatatagtacaagtggattttatatttcttttatgctactaattactcattgtatccattatatgaaaacgcaatgggacccgcatatcaatgaaacatcggttcttctttcgtccttttagctatgcatctggacaagcaaacatataactagtattgtagaaacaagagaaatagaaggcgtaaaatatacgagtggaaaaatacgagaagctagaatctactctcaaacacacgatgggattttgtgagaattctaggaggaccaaattaattcctatgaaaaatcctattaaactcctccatgttctaaagtatcatattatttccttaggattagctctgcccctgtcccattggttatctttttccctgtacctctatgatcatataatcatagtggacgccatcaactcattaagctaatccatccatcctaatatgtagcaacctcatcttagattgctagatattgagacggtgggagtacgtggctccacacatcatgttcccagttgacacacgtagcatctgttattcattcattcatactggagtactcctagtatatcctaaacaaattactaacatatttctaaggtggacaaaataaataattaaatattctctaatagacaattgagagactcag

SEQ ID NO: 69567 - DNA, 8208 bp, Oryza sativa
  unsure (1)..(8208): unsure at all n locations
atgacgccgcttgtagtcnnnnnnnnnnnnnnnnnnnnnnnnnnnnnnnnnnnnnnnnnnnnnnnnnnnnnntctgctagaaacttgtggtatttatatatttttaagctcagatggaatggatagtgtttgtacaattacacatcagtaggtagcatttaatctcgattacatcaaaaaaatgacatggtttgatgcccaaccaactgcattggccattaatggctgggcctaaaatgcaaagctactgtgacaagagagccttgtggcagctgcagcaccggctccccggcgccacggcggcgccgccgtcgacggtgttcttgccgtccaggtacctgccggcgagcatgtcgaagaggaagccggcgccgacgccgacggcgaagtcgatggtgtagtggcccctgcaggcgaacagcctgacgccctggagcaagttgagcgcgtcgtanaagcgcgccatgccgcggcgccccgcgcggcgcatgttctttgcggcgatcaccgcgccggcgacgtggccggagaagaagaggaagaaagagacgttgtcgacggggaaattcatgccggagcccaggaactcggtcggcagcggaagctgcgtggcgcagccgagcgcgccgcgggaggtgaacatcatcatcgcccccacgggggcgcgcgggcggccctcgccgaggatcgcccccaggatgtacgccgcctgcatcgccacgaacacctgcatcgcatcgcatgcatgcagacattggcggcattgtttagttccaaactttttcttcaaatttccaaattttctatcatataaaaattttcttatacacataaacttccaacttttccatcacatcatttcaattttaaccaaacttctaattttggcgtgaactaaacgcacccaggtcaggtcacgtcacgtcacattcatcccagattctgctgctactaccagtcgtggccaaggggaccaggttgccagctagagagatgcagaatcttatcacgaaatccatggatatcgtgaacgcgtgatgcagccattggaagcctttatcgcaaaaacattgggcttttctccaacgattggtttttcccctaccagatttgcctttttcttctgggaaaagtttgagattttcatcagactgtttcttcttcattcaaagattgggtttttcttctgggaaaagattgtggttttcatcaaagattgtttctttttttccttcaaagattgtgttcttctcctgggaaaagattgtggttttcatcaaagattgtttcttttctcctacaaagacttggtttttcttctgggaaaacattgtgattttcgtcaaagattgttcttttctccttcacaaagattgggtttttcttctgggaaaaggctggggttgtgctggtgtgtggattttggtggcgttggtgcagcggcgccatcagtttcgcgtgtgctcgtcgctgtccaccagcttcgtcctgctacgtgcctaactggtcctaaaaacttgtggagtacaagaactacggatatgacgagaacggtgcatagccagctttgatttcttctcaaggattggcagtttctaataaggtggtaattaacctagcaaaattcttttaaggtctattcggatttgaggaatttcacgggaattttggaggaactcaagtgtaccctatgaaaatcatataaaactctcgcgttttgaaggaacctctactgaatagaagaatgcatgatgctttggagtttgttggtacaaaccagtatcctgcttgggccaggtaaatgtatgacaaacctagctaatgtacctttctacatgacagaataattatgttaactgtaaatattactactagtcacatttgcctagtttgtgttttctgaaaccatactgctagagacaaaatttttggttggacgacaaactttgccatagccaaccaatccaagcatcgtatgccacacaaaatgcaaactaataagtgtagcaaagtttggctagaaaccgactttagcacaagtactgcataatttcaagggcctcattaaatacagcttgccaaacagtatcacccaactaactgattagcccctgtattttttttcagctccttcacctgattattatggtaggttttttcttcagctcctttaaaattatgtttttcctcaaaacctacatttgcttacatccttgttttaatctatttgtgctaagttttgtatcaaaatgattaatctgtatgtataactgtgcagattactcactatacttaacctgatcaaataataatctatttctaaccggcctaattaatcggcttaataaaccattggtactgtctaaagtttggcgtgtcaaattgaccgtagctttacggcattgcgcgtaatgacagctattagtgctggcaaggacagatccaagtgaaaaacaaaaaaaaaaagaaataaaagaaaagaaaagaaaatttactgcaatgtgcagaggagcagcaggttcattgaatctggattggtactcaccgtgttgagcgcggcgaggagcgagttgagccatgggcgggcggcgatccccgcgtggagcgcggcggtggcggcaaaaccgaggtcgaccggcggcgcggcgggcggcaccatggggatggtgtactccacggccatgaacagcagcagcccgcacccgaacgccgccgccgccgggtgccgccgaaggacccccgccacccccgccgccgagcaccactccggcctcctccacccacccacctggccgccgcggcggacgccgccgccttccctttccatcgcgccaccagctgctctgtccggcatcggcgccgggtggacgaccttgtcggcgcgccgccgcgcgccgccgttcgcgggcagcaccacgacggcctcggcgttgcccatggaggatgcggtgttgcccgtgaggctggacggcgncggcggcggcatgggcgggggtgggcgagtggctgggcgcgcagcgagcaggtggaggtggcgccggtggacgcggggggcggtcggtggtggcgcacggcttggcggggcgggtgatgcgggggatttttttttttctggtgattttgacgggttttttgtttggttttataagtgaattttttttggtggtggggacgcggcggagatctcaagggtaggaaaggagaggaaagaaaggaggcggcggtggagttaatgttgtacggaaggcggtcatctgctagggttaacggggaaaaagaatatgtgatggaaactattcatgtaaaaagtctgaaaactaccgctaaataaaaaaaataaaaaagatgtataaaatttgtccgtgttattgtaagtaaaatatttactcacagatttacttataagtaataattttactcatgatgacgtggacgaatatcaaaaatttaaatttttgatccaacggtagttttcgagttttcattatataaggtttgcattacttttttttttgctaactgttaggttggcaaataaaagtacttcctcccttcattgttttaggaggatcaaatcttatcctcagattgtaacatcttgtaatagagatagtacagtaccttggccctaaaataacttatagagtctaatcatttaaattcaaattagcatgaggaaaacaaattattcattattaacaagaaagtttgattggttggtggataaataaaagatgttaaagataatatttatataaccatcgttttacgaaagatatttgaaagatgaatccgttgctaatgccctgtttagatcccatcaaaaaaactttacaccctgtcacatggaacgtttaaacacttttataaagtattaaatataggctaaaaaataactaattgcatagattgagactaatttacgagacgaatcttttaaacctaattgctacaatatttgataatgtggtgctacagtaaactcttactaatgatagattaattaggcttaataaattcatctcgcagtttattaacggattcagtaattatttttttattagtacccgaacactccatgcgatgccttatataatacccgatgtgacacgcgcgaaactttacacccctgatctaaacaccccctaaattaataaatatgcttacagttctgactaattgtcaatcaaaatctacaaagtttgacttttcaaaatattatacatcctataatatcatttttttaagaacatagggggtactgtaattggtttatgtttgtccgggagtaactaattgaactccctaatcccattatcaatgacctgtcgattaaaagttaggagaacgaggagaagacgtcgtgaccactgaccatcaccgcggacagtagtgtgtaccgcgtgcgctggtctggcacgcacaagcgaaatctggtgtccccattgcatctctgctactatctcgcgccgaccatccaaacaccggcagtttcccacttttgctgtacaaatccaggtgaaatttccagcacaatgttaccactttcttgctcagttggccgtcggccctacagtatgcctgattctaaatttggattttttttttgtttgcagtttttcaagcttttaaacggcactaaatccagctgtatgtttcagaaaatattttactctgttcgtcctaaaacatagtattagcttttgtcgagatacatatatacctaaaattttgttatatttgagactaacagagtatataaaagttttctttagttttctaaagcaactttttattagttaatttattcacctataccctcatatagcttttttaaaaaatagataatccataaatttttcatatatctcaaacaagactatagctgagggaacaaatgcaatgtttttttttatgcactaaagagacttgtgatgatttgggtgtgttttatgttacatgttttcaactcgtaatatctcgttttccatgcgcacacttatcaaattgttaaatgatatatttatttttttaataaaatatataagaaagtttctttaaaaatcatattatttataagataatttataggtaatactcaattaataatgcgcaaatgagccactcgttttacgtgcgagagagaagttcccaaccttctctgttgaacacactctacaagtgtccgtgaaaattactaggagtgcttaatagtgtaattgctaggagtgtgtcgtttgaatcccaaggtttcatttatatatttttttctgattattatttgataaccatgttccttcttggttgtaaaataagtactaattatggccagctgctggtaggataggtcggtttgtttcagtttgaggtcgatcagggcgacgccgacgtgatatccagatggtccaagcaaatgcttggtcgcaacgggggaaaaccgaacggctgtggcactccactccactcacttgagcacgaaatggcgccacgcttggggcgtgtctctcacgcagtcacgccttctgccgcctgtcgatcaaaggaagggtgtctaacacacaaatcatgcccaagattggcaatcatcagggcagctaattagtaagtaaaagttggtgtcttctgttaattaattgattgatttgatagcataggtgaacatctaaatgttgcagttgggggtgatggcaaaggtcattgtaaaatttcagttgggagggaacaatgatgctaatatgctgggtttaaaattccagaacagtcctatcgaaccttccttccgatatgataatatttcggtcaaatttttttaaaaaatattattttgtgaatttggcatattttgtttaaatttgacctatttttgttcaaaaatcaaataatttcgcattaaaatttccgaaatttcggtatatcggtaccctccgatacaaataccgaaagcgaaagattaaaccctgctaatatgtgcaaaattttacctaaagcctagtggttgttttctgattacatgaaaaacatatacgcccgttactgatacaaatccacaggcttaagaaaatcgagactagcagtaaatccctgaccttatcagtaattcttgccacgtcaatttggtcctcgtggagaaattaatcaggtacagttgagtagttgacacgccattatgtgagaagattaaccaaattgttcgggtcactaatactctcacgatgggaagaagcagcaaatataatccaaatttatttgaggaagtttatggggatggagtgtttatcactgatgatgactccgtcagcaaacgcgcgcttgaatcgaatgaatttttaagatgactttgtgagcttagctgtagattgtagtgatagtctgagcagatagcacggcctatcaagcctgaccaggaatggatccatgttggccaattgacttggaacatctggacttctggagtagtaacattaattaattgactaataacaacttctaagaagtttatttttctactcatgtttatcccaaaaataagtttatttttaaataactattgcatcagagtttgtgaaaaaaatgtattgtgaatagataaggagagaaataattgccttggatttaaaaaaaatgagggtgttgtaatattttgttttattaatatgtgtgtgatgattgaaacataaacttattttgggatatagaggttacgcatagcaccccactgcatttctttcaatatttggacatggagcatgctagctagaccactggcaaagggtattgtccataatataataatatattttttctacttcctccctctatttttggagtttttcatgaagattaaaaaaatgtgaaattgaatgagatatgattataattattaagatgagaaagcacaaactaaataaaatatggttgtaattggttaagatgatggagtaggcaggaaagtttgctatatcctagaataaatctggaattctagaatttgttatatttcagaatagagggatgatttttatgctaagataaaataaaaaaacagtttttatcattggttatttataaaacttgtaatcttatttcccctttttatagttcctctcgttataaatatttagttaaataaacttttaatattttgaccatcaattttatatataataagtttataaaacctaatatatttttatcataacatggtattactttttaagacaagtatacacgtgccatgttttaatcttttttataaaaaaagcactgttattgatggtaaaaattttaaaagttaacagaagaaacttgggaccctttgatttataggattggcaaaggattttcatagaattcaaattcctatgtattttttcctaaatgttcctttgattcataggtaagaaaggaaactcatagtattgtatttatatgcttcacatttcatacaaaaaaaatagtgactgagttcgtttcttacagttcccaactcaccttctttgttttcggcatgcacgcttttcaaacggttaaaccatgcattttttttaaaaaaaattctataggaaagttgtttaaaaaaatcatattaatcaatttctcaagttttgtaagctaatactccctccgtcccataatataagggattttgagtttttgccngccacgccagtgggcttcttttttcccatttacagctccatgcatgcgtaaaccagttaaagtgcacccaatagttttatgtacaaagacacaaaatttgcatgtatccaactcccaaatttaactgcagctggttctggaaaaaatatgcgttccttctgctcaaatatatatcttcctagctcattagcatatagcacttcaaaccaactccgttccttttggggtgccactgataccagctttagctccatataatgtagaggcggagctagagctggagctttgccaaacaggccctactttcacacattcacatatagtcatgaatggctttgcattggccaaaactttggctaacttaattactctaggtagccagattcatggctggttcctatagttgctcccagctgttaactttcatagaaggatcacgtctggggaacagctgcttcggaatttctatttacttcgaatattacgaagcctgttgggtcatttattggctcccaatttgaactacgccattgttcctttatggagtaa

SEQ ID NO: 69568 - DNA, 854 bp, Oryza sativa
  unsure (1)..(854): unsure at all n locations
tcggctttgatnactgatatacncatcgctcgcaacnnnccaaganntatnctgtgcaactagaaccatataataatatatcaatatatacggttcttatgaaattcactttattttacctacagcaacaacgcttaaaacgggtgctgtatcatttaaggattctagttgcattcgagttttcttcagccgattgaactcatgggcttaacggcaacgatctgtaggccttgcaatgcacaagcatattgtaggcccatattttcaaagcacaagcatattctaggcccatataggcccaggacatttttaacgaataattgtatttggaataagttcgtctgaggtctcttaacttgtcaacgaatccgattttcgtccctcaaccggaaaaccagacacaacggatccctcaactatcaaaaccagtgcaaatgaggtccctcggcggttttgagggtggttttggctgacatgatgcctacgtggctaatttgactcggtcttcatctgacgtggtgcttacgtggcaattcgacccgagaaaataataaacccgtgggatccacatgtcagttcacacataagataataaaaaaaatggcgggccccacatgtaattgtcattgtcaccccctctttattctgcttttcctttaatctcctatttttaattttcttccctatcccttttccagcgccacaggtaaggcaagtgctcaacggtgttccaccggaagaggagggaaccgccacgccggccgaagcaacgctctcccatcctgggccggaaaaggaaggacccggcgtatttggtcctggtttcacaataaggtaggcaggacttcacaact

SEQ ID NO: 69569 - DNA, 6363 bp, Oryza sativa
  unsure (1)..(6363): unsure at all n locations
catgctgnntttgtaaaatcanagtcatctgccacaanacnananggtgcatgtaagatccccttgaggtataaaaagatgaccttgcccacttaaaggagggattttttttgttttttattagaagggatcnacaaggatcagggagggaaagagtgagagctctgtggttctccagctattttgtatcttcttcatacatagatccaccaaaacacaggagtagggtattacgcttctcagcggcccgaacctgtatacatcgcccgtgtcttgtgtgtttccattctcgcgaaccttccacacacacctagagcttagaatctcacccagggcccccggccgaaccgacaaaggggggcctgcacggtctcccggtgaggagccccacgctccgtcagagtagtaacaaaccatgtcaatttatcgtatcctcagtttagttactagtccagctttcacatcctaggtacacggaacaatttagtcgttggtacttaccatcaatgatcagtcccactgttaatcagatgatttgatgctgcaatcataccaggatagcaataatactagcacggacgagattcccctttcttcaggcctcaagacacaagcaatgcaacgacggcgaggttgtctccaccctcatcgtctttagtccctcttttctccgacgccggcatcaccaccggcggaaaggctacaagtggatcaactcataaaccaatagccgttgacgataagattataattagatcaatccataaacctatcgacaatatgaacataagtggatcaatctataaacccatgaacagaccaaataaacggataaccctgccgccttagccggcgaacaacaccgtgtcatggcagcatcagtcaagcaattgtttggccccaatcagattcagaagcaggcagagatttctttctgcaaaactggtcgctttcatttcatgagtcagagtctactcctgcctttatcaaaccagatcatcctccctgctgcttttttggtattcaaatcagatcgtgctggcttacgtcgcaacacgcgagaaaaggcagggtttttcaaaagattagatcatcagtaccctggaccaaaaagttcagatacgaaaaacaattaacgtatggagtagatcaaattagctgatgactgaagattcacagccataagcgaaaaccacatctgaaagaaacctgtcaatgcgacaggtaaaaagttcagaatatactaataatcgcgaccaaattttcaatttgtaggtcaaatacagtgtgtcccaatggcgttgtccgcagcaatcgccaaacaaatagcaagcatgactggcttttgaatgagctgagatgcatatatcaaaagcaaactgcatctttgccagcaacatcaaaagacagctcacgcttcgtatcagacccgaatttgaaggttggggctgcttcttctgcactgtgggaactgctcggcaagtcaaaggagaaaacaagtttaccggtagtgcttgatgaaccaaaggtaaacttgggtatatctgcaccgtcagctgacgggatacttggtggctgtgacagagtcggagtaggtggtggctcaggaagagacattgaggtttttggaacaggaaatgtgaaggccaaaccattgcctgtgcttttatccaagacctgagcagctgatgtggttgccgagtcagattctgaagtatgttgtgaagagggcattgacttggtcccactattctctatctttggactagattccacagcattggagctgcttggaggagccagaaccttaacaaaagtaattagatcaaggtgattaaagaattccacatttaatgctatatgcatctgctaagtaatttgtttaatcagaaacaaacataaatatggaatcacagaagaatatataatgagaattgaaaacatgtttggcattgcactagttttccagtaattcaatcttagttcacataaccaagactttgtgttcaattaaatatatagtaaccattggcaacagtaaactaaggatctcctatttcaaactcaatatatgtattttaacaaataggacctgagcagaatatactagagaagaaagagataaatataccttatttgcatctgaaatttcctgttgagcactaccactatcgttgatgctgctatgtctatgactatcagtagcaggcccattatgctggatgttggtgacaacagaggaagtagttctctttgctgaagtccaccttagctctagtggctttgctgtaggagaaggaatagttctctctagatgctggagtattttgtgagctgttttgcttgacttgggatgaacagataaagccgcagatttggaatggggcatattgtctaccattgaaacaaacccgagcgatgaaccactttcagtggtgccttcgccatgatgtccttgaagggcggatccatcattcttcttagaagcagaacatttctttgcaaataagggagtagttgcaccaacagtatctccatatgcttctttggaatatgttgttgacggttgcgccccaagaacagcaccaagaggtgctgttttatcctcaaatattgcctacattttgaacagggggatgagggcaggagaaactgtgtattatacgattgcaggttgtgatagaaaaaaaggttcatttactgacacctcagaagtcaggtaatcaccacatgaccacaacagttgtaagatatagcaaacaattacgtatcttactctcagttgtaactagcaaatcacagttcaaatctcagttgcatgaactacaggcatgtattttatatcaaaatctacggatatttaaacctttggaaggaaggatggtgtcactaatccacattaggagataagttgaatagcaacaatcaatgtgctcacaacagtttcaacatgaaatgcagctatctgggcttcattctgctgaggctactaaatagtttggatgttcggtctgagtggaccagtatgagttcatcttaacccaactcggcagtgtgaactaaaaccttctacttcggtttgaggaatggaatgagtatgtatatcaacaccccactccatatggctacaatggaaggtttgaaacaatttcgtgtcaacaacagaaaatatagatggttggcaaaaggaagcatatgtgaggttatgcttcaaagaacactatgaaataaacatatatatcatggtgatagtgaagaaacattaacttgaatgacaataccttacttccaacagggaaaggagatgaaaattgtggctttccagatgagttattataggcatcacgggatcctgtgtactgtaaacagataataaatgaacggtaaatgtatagccctcgaatatgagatttcaatgtttctttctagttgcagtgttacagtgaagctcatgagacatgcagatatcacacacaaaataaaatacaatcataagaaagttgtgtataccttgttagatcttgggaaaactgagccaatataagttgtgcgagaggaagttggaggcagagttcttcctttattgctctgtggtgtaagataattcggatagtttcggacaacagatcctggccagcatacaggagaatctgtagctattttagggaaaacctttgaggatgaattctctacctcaactccatgactcaaagctctgaatttcctcttttgagactcttgtacagatgctgaggtctgtgcttccatataggcttttgcaagttcaattggtgatgaggcaacatcaagcacctaacatgccattaaaagaaagtgatcaaatcagccataagtctatagatcaggcaagggaggaaagaaattggtatttcttaaacattgtgaataatttttgctcatgcgtgttcttaccagtatttaattacacaattaagagtaaataacaactgcagaataattcaggaaacatggatgcgtataatcaaatttctaaaccatccaaaccataattcacatcccatagaaataacaaggaaaaatagcctccacaaatgcttgagaacattgtttgtacagaaacaaaaagatgttgaaattgcacagatatgaatgtcttacatttgatggtacaaagacttcagtcccacaaggtgatcgaacatcaatctcttttgcaggagtggaccatctgtctgaaaacggaatggcttcgaaacctttagtggaagaccttggaactctctgatattcattaaaatgatcaggagtccttgagcgcataatctctataaggcgttctgtttcatccctgtaagagcaacatgatgcacatttaactatatttcaaatttcaattatcaaaagcaaaaaaattaagtgcttccagccaataagatttaggtcaaacacaagataacaaattgtcatcttactttgcaaacgattttcaagcagttcagcaaactatgttataaattttaaataaaatcagaacaaagctttagaggtgtaaaagaacctgcctagaaaaatgtttctgtttgatgatattctcaatttcagcgagaccgctgccatcgttttgatttctacaatcaccttcctggagcaggctggctttattatccagggctgtagaattggtgttccattctatagaatgcctatgtgtctgcatttttggatcaaagagaaagatatcaaaagctgccaacagataataatttatgttgtaaacatgctaacagaaacagactaagggaggagtaaatgtagtattgcccttgcaaactaaagttccgacaatttgaacaaaagcttctggcagttctcaacaaatacactaagctcaaaagagaaatatgttcatcatcatttagccacaacagtatatggacttgaaaggattagttcactaaaccaatgagcagatgagggaagtgggaaatggactctcctcaaatggctggtgagacagcggaaatatataagagcatcatgttccttaactgtgctcttaactgaaaagcagtttaaacttaggtgtgatgttacattttctactatactactgaagtactgatactgatacagcaggtcattttgtaaatcactaatatttaacacgatctacattctccttgctgctgcagcatttcttggattatctcattatatgacaaataagctctatatgcagtacacctgtaagtttacagtacgagccagaaagcaatcaatgcgtttaagattcaagaaaaaggaactgcacttacttcattggttacttccagcgattcacgccaggccatttgattatcgtctgcagacattagaaacacacaaaagggtaatccacgtcaaaacatggacatggtttgcactttgcacagacaaaaaataacgaactggatcacaatgtggatgaaacaaacagaaatagcttcttctatatctataccaaagtagaaaaacaaacaacttggctggtgtacaggagaaacagaagtacatatgagctaacaataatacccattggcgatgattctcaaaagctactccacttgattcatgcccaactacgcaatgccaaccttgtaacagaggatctggatccccgagacaccaaccattatgcccattccatagagcaaaaacatcccaaaccacataagatgattcacacaccaacaaattagttaccgaagctgcacgtcctctcaataagttgcatcatagacttctgctgtgcctgtggcacacacggcactaaaccctagattaatgcatcggcaagaggcaatctcgagcaagttcccattcactacccaaccgcaccgatcttaaaccctaacaagccccaactcaaaaacgcgagccagtggcaatcgcatccgcctcccctccccctcacccccccacccttgattcctctctagtcctaggaatggcacggctggcccaatcgcatccgcgaaacaaccacggagcagaaggagatgtgggttgggggattaccggaggcggcggcggcctntattttgttagacctgtgaccaggaggggactattcctttattcgacaaaaagccgggtgtatcaacccgcatggagaatgccgacccggaaggggatgcggggatttaattatcgacagagagacatgacttgagggttaccttcctgatgacgacgcgcgtgtccagatcgtattattaaataacctctttctccaaaccccgtctccaaaagaaaatatatttaccacaataacctcctcccaccatgaactatttcctccttccgcgtacaatcgcgttgaaccatccgcagtgtctattt

SEQ ID NO: 69570 - DNA, 684 bp, Oryza sativa
attcctgcagccctgtcccccggccgggctcggtacggctgccacgggcgacggcacggagctgcctaacccatggaacatcgaacaccttcgtcgcttctacccctgaggagggggggtcgggtgtcaggttttggctcaggccaaccccgcacccccctcgggtgtgtagggttggccgggggctaccacacatgcattacattcttatttctcttttttcaacatttcaatagaagcagtttcaatttcctaaaggttgtgtctgtgctgttctttccttttgaagaatcttggcttaaaataaggtcactcgtactcaaccttgccatcgggggttcggtccggtcagctaaaatcgccaaacggggcccagaaccgagccgtgccccggggcgtggtgaactccgggggggaatcgacaaaaacccacaatcgggtcacccatacccctcggtcaccacgttcccggcctggccagtctcgacatgtggatctccccaggcactagccccgacccgagccattcgaggactgggacttgggcacgagcccttatttcaagctaagacgcaaaaggaccacggcacagatcatcctcatctcgtatgtatagcaaaataaaactaacacaaaaattttttcatcatttctgattgcagattaagttaatttgtacacaaa

SEQ ID NO: 69571 - DNA, 50013 bp, Oryza sativa
tattatatttttaacaatagatttaaaaaatcattacatatttcttccacatctaagggttaaattgactttttttaacctatttaacggttagggtatggaagggatcaaaatcaaaactcagggggtatacaaggaggtgaataaaaattcaaggacatagaaggaaattcagggacatagaagggatcggctaaagtttcaggagcatagaaggaattttctcgtgctttaatgcataatatttgtgtgcatttttccagcttgtagatgaacaacgctagggtaaaagaaattacatctctttatgtcgtgtcatccaataccctgaaactacgaaaacaaattattgtgcaattttaccttggtgtcttaggccaaacaaaacctaaagtataggcaataagtgatgttccatatatctttgatgcataatattgtgtgcattttcccaccttgtagatgaacaaacctaggggagaaaaaaatacatctctttatgttgtctttgagtgtaggtctaccaacgatgcatagactccaccattgatcctcatgagagagtcatgttgtcccttttcagcgattgaaccatccttgatgactgcaatcacatctgcccctttaatcgtggacagacggtgtgctaccacaatggtggtcctgcttaccataacttgatctagtgcatcttgaacaatgcgctctgattcagcatcaagggcacttgtagcctcatccaatagaagtatttttgggtccttcaagatggcccttgctatagctatccgttgcttttgcccaccagatagttgtgttcctctttctccgacagtagtgttatatccctgaggcaagcttgatatgaactcatgagcattgcttgccttagcaacagctataatctcttcttcggttacttgtcctttcctcccgtatgctatgttggcatgaattgtgtcattgaaaagtattggttcttggcttaccaatcccatttgatctcttaaccaactcaattttaagtttttaagttctactctgtctagtgagattgtgccagaatgtgggtcatagaatcgctccagcaaagcaattactgtggactttccactgccgctctctccaacaagtgcaacagtctgcatatgacaattggtttatagcatgtcagtacaagtttaattataaaggaaaataaatatagagaaatttgtattattggtaattttcatttgaaaggcatatttagttctcttgccttgctcaatgaggatgagaagacaaggatcagggcaatccaacatactgtaggaactatcaagtttaaaaaggcaaaccttagtgcataggaactcatatttgtaacaattgagtgcacaccctatattaagagcgtacaagcacaatagttgtaggaagcaagatatttcctccaaaaataaagcgctcctagtttgctgcttttttttttgggtgcacaacatctaaatgttttacccttagaagtaaaggaaaaacaattaaaagtaccaagttaactgtacctttccggaggggatgcctaaggtaaaatcacataaaacttggacatctgggcgagatgggtacttgaagttcacatgattcaattctattgtgccattaaccttttctagtatgattccttcatcaatgcttgagtcaatattggactttctgtctatgattgctaatattgaagctgcggattcatgggcttttgatgaatccgatgccattgcgcttgtttgagaaattccaaaagctgtgaaaactaaagcaaagtaaacctgcaaagcgattacaagattgacatattgtcattgaataaaaacaaccttatataagtgatgccaaatgtgtatctcttactctgaagacatctttaaaggttgatttccccccatgtacaaactgtgcaccaacatagaaacaaagagcatatgtgagatacaccattaaatatgaaaagctgaaacctaggcctccaaccattccacttctaatactttctttcattgaagcttgacatttttggttgtatgttttaatcactctcttctctgcacagaaagacgctacagtcctaatgctaccaattgcttcagttacaacttgacttgcatcttcatacatcacctgtagaaatcgctagcagttagcaaaacaatatttactaatattgcaagaaaaaaattcattatgcgatgccaatcatgaaatatgtcagttgtaataccaaattaggtgtcatctaacaaaacacacatcttcatcaaatgtggaaagtgtcaggattgtctgtgaattttttatataaaaaacagaaatggtagaaattgctttgttcatactagggactttgttttcaccttagcatcttcactgaaccctttcaagaacttcaattgtacataattttgcaaacccaccaaagggatcggacacatgatggtcaatgtgagcttccagtcagaagcaaatgctatagtaaatcctgcaataagcgttacaatgcactgcactagtatggctaagttatctcccacaaggcgtcggatgttcaaagcatcaatgtacaactttgctccaagtgatccgctgtaaaatttagaagggtgaattgacattcaaaaaaagtgttagatataagaatgaaacttataaatccatttgagtaacaaacctagaatgggaaggatcatcaaaccaagaaacttcttgatggacgatgctttggaaagacaaacagcggacacgttctataagttttccaccagccattccaaataagaaatattctaattgaatcgataccagagaaatgattgccattagaatgcacatcaaagcccagaacctagaatcttttcgaagttggtgtggtggatagtaaaaagttcttataccaccagacatcattatactaaatatcgggaaaagaagtccatgcacaaaagcagttataatagctaatagtagaataggtgcttctggcttgttgagattaaaaagtcgcctgattggtgctttattaatatccttgttgtcaccacattctttatcttcaggttcatctgtaagaccatgcttgtgcaatccatcggatccagatgagccaatatgttttgctaaagagttttttcttctatttctaggagaatcattgatcattgattgttccaaagacaaacttctacttttaagtcttgaagttgacacctcactatattgtacatcatgcatttcttcagtatgagtctgttgtaactgaataagttgagagtaagctccatcgggatccttgatcaactcatcgtgggaacctgtgggacattcatttttggagaaacaaattgaactacctctgattcacaatgattatttagtacggagaaaataccaagtaatgggtatggaagtatggcttaccttgatcaactatttttccttggtgaaccactgctatgcagtcggcattcttgattgtactcaaacggtgggccacaatgagtgtagttctccctatcatgaccctatttagtgcctcttgaactagcctctcagactctacatccaatgcactagtagcttcgtccaacaggaggacttttggatttttaaggatagctcttgcaatggcaatcctttgcttttgtcccccagaaagctgagcaccatgttgacccaccattgtgtcatatgcctatatcatgtgaagataaaagggatagttaattctaatacactagtatatatggtactgttggaaacaaatggcgtatctaggaactacattaggcaacttatcaatgaagtttgctgcatttgcaagctcagctgctctcttgatttcttcatctgtagcattttctttaccataggttatgttatctttgatggaggtcataaaaagcaatggctcttggctaacaagactcatttttcctcttatccagtggagtttcaaggtcttgatgttaattccgtctattaacacttcaccatcctgtgggtcatagaatctctctaccaaactaattattgttgatttaccacttccactttgcccaactattgccattgtagtaccattaggtacttgtagacataagccatctagtatcaactgttcaggccttgcggggtagctaaagcacacatccttgagttcaacattccccttgatatcttctaatattattccagaagttccagtgatgtcaatatttggttttctattgattatttcgaataacctatgagctgcagattggccttctgcaatagcagaaatagagggtgatgcgttacctatagccctgttacaaacaaaagatgcatttagtgtcaaaaaaaaagaagaaaaaaaacctatttttgtagttgaccaaatagtgcagatcatcactacatagttatttgacacatgaagtttgggtccacttgttgagttgaacaagtttcatattatcttatgcttcaaaagtaacactgttgagaaatatggtatttagtataatcataggttaataccataataattagataattgggtgaaataacaattgtatcaataacaagaaatctttttaaagagaactggatacctaggcatggagttgcaaaccctattcctacatatatgatgaaaaattataaagctttacaaaatctatacttgtaacaaaatagttgtgtcatgttatttaatttaatttaatttatttttttagcattattcgtcttgattttggcatatggcaaaggagtattatattgtaatgtggttaattctaactattgtagaagtaggcatcaagtgcctagtatgcctcagtctttttacttgataataacatggtagctgagaaactatatcaaaatgtttagtatatgtactagtgtgctctagcatatcatgttacagagtcaacaattaggaaactcacattgaaccagtcaaaattgcaaatacgacattgatgacttgccctccagtgtagcctttgctaatgactaacttggcaccataccaaaatgcaagagagtaactgcagtaaacaacaaaaaagatagagcctattccaaaaccactgataatcccttccatgatagtggccttgtatgccttttttatgagagtattatacattgtaattgctctcttctcaccattgaaggagacaacctgtttttttaaatgtttttttatgttaaatagttgcaagtaagcattattattgatgtacaaaactaagcattattatttgtcataaattgaaataattagaacataccattcgtatagatccaatggtctgctcaacaacattccccgcatagctatatgatacatgcgtctttccagatatttgagcccgtaatcgagagactaatgcaaaagagaaaatacttggaggtatacaagccatcacaacaagagccagcatccagcctcttatgaatccgatgacaaaaccacctacaaaggctgtcaaaacctgtatatattttcctacctgaacatgagtagtcaaattattagtgttacatcagatctttgcattatgtcatgagcatggaaatctatgtactgaaattggaccccccccccctctttagaaaaacagagtgtcgtactattaataaactagataattaccctgacatgttgctgtgagaaattaagttgcctaatatgtacaaataagttgcagtatgcttttttaaaccaaaacaaaatgacttctaatgttttatataatttgcacgtggttgcaaatatagtgcacggtgagcatattttatgtataattgatactaattattgtgagagaagaaagaagagacaatttgtaccatagatctattatctaaagactacaaataattatgatgatgtggcttcatgagagaagagagaaataacattaactatattttgtggggatgaactatataaatatataacccagtaacactaaaaacacatctttctagttaatgctatttccaaagaaaaaaattctcaatgcatgtgcatcttttcaaatggtgctctaatggaagttttcttctagtttcatttagactagtctagtgtactttttagtcttgttaccttctcaccaagggcatcttggatcagtacggtatctgcagatattctagaagcagcttctccagttgtcatctccacatcaaagaatgcaatgtcttgtgtgataatcgcttcgaggtacaaggatcgaatgcatgccgactgcctttctccagccattgtccaacatgacacctctggaataggtagatggagcactcatgagattctgtcatatgtgaatgtacaacccaactaaacagaaattttgttgcattgttaacatgtccaattgttccagaaaatttgtaaatagaaaattactggtaaatttgctttctaattgtggcaaatgtaattaattaatctgttgtctcatgaagtaatagaccaaaacctcttaatatcattttgctgatctgactatgaagttcaggaatggtaacaagtagtaaaactatgacattaaaatagccaaacattcaacaactttagaaaccatttttatactcttggtgtgtggatcgctatgttactcttgctagtgatcttaaataatttctacggagttgatggtttaagggcatgtacaatggttgataggggtatttttcttttggaagttcaactaaaaacaacttaaaattcaacatataggcatatgcaagagacataaaatatgacaactaatgtcactcgtttgtactttgtgctcataatatagttgtgcatatatatgcccttcctctcttacccttctctcatctacatcgttaagatgtactatgaggcgatatgttaattgtggtgttttacatgcccccaacatatagcttgagattaagcattcttacggagaaaagaagccattgatgttcccactcccaagtagatgtaatacagaacaacctgggtaaaagaaaatgctagagggtaaaagaaaaggaaaaaaatcataatagggaaaacattttgagatattgagtgaaagtaagtcatatagaagcacaaactggaattctatctttttccccgttccaatattaaggttaccatgggaaagtcatttcatgccttaataaatagttagaaaaaattaacctaaattaccatgtcatatttgactttacaaacttgtaaggctaaactcaatatacatatggagaaaaatataaatgtgactaaatttgttgatagaatgcagcattacaagtttgtactttgtagggtgaaatatgaaatcataatctattgtaggctccattcaaaaaaaaaattctattgtagggcaaaatacgaatcataatataaattatcatcccattttcaattcttgataactatttaaatgatgtgtataaaatgaggttatgcgatcctaaagtatgaaacctcacaactaggtcggtggaccaaattaatattgtaaattgatacaagtttgatatgatatatgtctgatttgtagtcattgtgtcatgcaaattattgtggatgttggagtttgttttatatgttaggattagtcatatacctcctaattatttcacatattcagatcatttttttgaaaacaaatatattcaaagcttaatagtattgtcgtttgcaacacaaattaaaatgaaagtggttgaaatcttcaaggcattctcctatccgtgtcacttccaagggtgaccaggccagatggagctcaagcaattgctgccaccacccccacctcccttgcaccacctaagctactcatcagaggtccagacggctgcaagataacaaaggtgggactattttcttctccccctcatgtgcactagagtggtcacggtgaggtgttcgagacgagcggtggtcatggcagtgcctagatccatgcctctgtagctagatatagggtatttccttagtggagactaggaagaactatgtatgtacccaacgattggcatagtttcttttattttattcaatggtcccatttagttgattacatggcccaattacataccatgaaaccttttctttttgctactttagatgtccatattcaggcaaggtggtcggtggctgacggggggcagtggtgaggcaggaggccaatgcacatggtggagcggcggatgcaaggcatgacgatggcgaccgtggtctaggtgtggaggttggtgatggctgtggggcaagcccacccgcatgaaggctggagacaaatgcctttagatcgatgatgaggctggtggctagttgtggagaagaggttgacaagataaagtgcttggatttggccacatagagtcaaatggtggctgcagtttgtcttttgctacctggcttggctctctctttgtatggcaggtctacttctagatatggtagcaaggagtaccatggtgaggggtgtgccagtggcttaggcagcaggggaggagggctgttgcatcttgagaacggtgatggcgagtcatcttgtcccgccatcttgttttttccgatctgatctccccttctttatagagccccccacccccacccctacccaaaacaaaaaaaaattgtggccgatctgcttctagattcagccatatggagctccacggtgagagtgagacaaatgggtcgggtaacaagagcgagaacaattcgcgaggagtcgggtagaggggtgtcgctgcgcattagccatgtgttggcaatggtttgaatggttgtggctggctaggtggatggtgaggccacaacggcaataggaaagcatgtaggctccatgcaaaaaagcctaagctaaaaaaaggacgacgctttgggtgctgcgatcccccttgagagcattgccaagtaatcttcctctccttcactaacatgatcctctatgtgaaaatcatatctaagatttcttgaaaaggctacaatgcttcggtgtcatgatgtctatgggtgaaaatggtacggaaattcccaaccgaaccgatatcgtttccataaaaataaatatcaaaataatgttattttttaccatttctatttctagccatatacaaaatttacttttttaaaaaaaatatgtcagtgttgtattaaagtcgctactaaatagttaaattcataaatctacgaactgatgtcgtttctctaaaaataataaataatgctaccatttccaaacgttttatccctaatggtctccatggaggtaatgctttgggaggtcccattcaatgggatgtgcatacgtggatcaactataaattcataccagtggtttgcttggtgctacgctccttcccgcattgtcggcatgtggtgtagtatcctatttttttatcatgattatagcctccggttctgtagtcttgtattttattctattttgtcagaagaaatttcacgttgtctagtgtggttcatttaaaaaaaataagtaaaactatttttctctcagaataaatgaaattaatttgccaaacacttttttaagataatatttgtcaaacacctacgctaaacatacctaaggagtggcattaaacaagattattaaaaaccacgacaatatgaaacaagcgtgggcccatcacgattgttccatgattccacccacttgccgcgcgtctaggtaactactactactttctccgtttcacaatgtaagtcattgtaacattttccacattcataataatgttaatgaatctaaacatatatatctatctagattcattaacattaatatcaatgtgaaaaatactaaaatgacttacattgtgaaacgaagggagtaccaagcaagcgcggaccactaacgtaatctagtgcaacggattgactccactagagacgcctagatcgtgaccggacatctgaaactgcagttgcatcagggtgaggtaattaaggtgagccaaacgaagcgtagttgattacacctacagtaaattaaacgcgatttagacaacatactccgctacgcgtacgagagcatctcgtccggtggtctcgcgctaatgttccatttagaaaaaaaaaaggtcggaaaagaaactttaatcatttctgtggctatattttattttatttttgaaaaatggaaatcgaaacggtattaaaaatatcagaaaatcaattggaaatcagtacttaatgcaggaatcattgagctacagaatcacatatttgatttaacatggctatatgttgtgatcacggaaattcaaacttgcactatataaattagaatctctcttatatttattaatgtactcaaaatagctatttggttgagaagttaaactataggtcaaacagagacatgtatcacaaatattggatatttagaaatagagtaaaattcataaaactacagatattttgactaaattatcacaagatatagatttaaagtgatgtataacaaaactataaatttaacaataaatttatcacaaaattataagtttaaggctaagtatcaatttaataatagaattatcacaaaactacagatttttggggtttaaatccttaacactaatactatgttgagttataaatgtccgaaatttatgattaaatttatattaaacctgtagttttgtgatacaatactttaaatatgttttaaatatgtagttctgtgataaatttagtgataagtgagtgattttacgatacatcatgttaaatatgaagttttatgataatttagcaaaactacttatagttttgtgaatttattcttagaaatatggtgattactatattataaaactataatttccacttaaatataaaaacagttgataaaacaacagtcgttttcgttccatattttaccgttttcgtttctgtcagttaccattttcaaataatttgaccggtaaaaattatactccacccggtgcctggctgactgccgcccgatcgatcagagttgccacaacaggcaggccgcgggtacgtatatatataggctgtgttgctcggtgtgggtcgggaattaatcccatgcaaaaaataaagtggtagattagcatattattaattaagtattagctaaaagtttttaaaaatagattaagatgattttcaaaacaacttctacatataatttttttaaaaaaatatatatcatttaacagtttagaagcgtaaccgcacgaacgagagagtcgtggttagaaaccaccacaaacaaactcagccacagtacgtgtgacaataccttgctgacccggtggagaacggtactgacgtcgtcgccgccgaagcagtcgatgaccgcggagaagacgacggtcatgagcggctccgacatgccgttcgccatcgccgccaccgtgccgaccgccatcagcgccttgtcgacgccgtcggcgtacctgaacatccccaggaacggcagcttcccggcgtcgccgtcgttgccgctcccttccttcttcttcttctccctctcatcatcctctcctctacctgcagtcgacgccattggcaagagttactgtttctctcagctagctacctagctgctgctcctctgaatctctggttaagtgagaggctactcgatctctgcccgtctccgttttataaatttgtcgggtctcttcgcgcgctctcgtggtgagtggccgacaaagacgcaaccggagcggctgcgtgatggatatcaaaagcgaataaataaatcggcaccatatgccctctccgatccatcggttgcctgtgctgtgaggggatgtttagttcgcgaaaaagaaaattttaggattatagggtgttatatcaaacgtttgtccagatataagaagggattttcagacacgaatgaaaaaattaatttcataactcgtctggaaaccgtgaaacgaatttattaagactaattgatccgtcattagtacatgtgggttattgtagcacttatagctaattatggactaattaggctcaaaaaattcgtctcgcaatttccatgcaaattgtgcaattagtttttttatctatatttaatttctatgaatgtgtccaaagattcgatgggacgattttgagcaaaattctcttggaactaaacaaaggcctgagtttgcctgtgtgctctggccctctttagatttcaacttttttctttaaacttttaacttttccgtcacatcgaatttttctacacacataaactttcaacttttccgtcacatcgttccaatttctttaaattttcaattctgacatggaactaaacacagcctctgagtccctccgcatgcagtgatacactggtacagacgtacagtggaacaagggcctagatacaaccacacaaattggcacccgttatttgcttgtgaattaagcgtttataaaaaaatttaaaaaatagttatattaattggattatataagtatgtaaagaaacatgtcaggcaaaattcgacttttgacttgagggtaaaaatcagaaaatgcatagtacattgtacaacgtaaataaaatttgttattttcttcttaatgtaatagatcaaatttagacatgtatctttgtgtggtgtcttatattatcataatctatcttatcaaagtttataaaaaaatttatataatatttaaaccgcatatatacacctacacctaggtatattgtggaaaaggctatacgtactaactttttcttactaataacactaatgtgtcatattatgagtgcatctagattttttttgtaacttccatctacttaaatcaaacggttgagatgattgttagtaaaagtttagtaaaaaaaatttacgtgtagcattgctcgtatattgtaatagtacctagtgttgtagaaaatattttctggaggtatggtggggggcggcagtttcttaactactggtggaatttaaagtgtttaaagtcgattgccctttaattcatgtgcgcgagatggtcacggccactcgtacagaaacagaagggatatgatgttctcctgtgtagattcggaaaaaataaaataaaacgattatgatcattcccttctgtttttttatggtggaatctgtgcggtgctaaaggtcgaatgtcttttaattcgtgtgcaattatggtcacttgtacaaaaacaaataagagggcacatcttgatttgaaaaaaaaaatgatgatgaccgtcccatcattgttgtttgggttaaattttacggtttaaaaatataccattactatccacctaattgaaacaatgtcattataaatatgttgaaatcggagatatgtcactatatatcccttcactgtatttttttatatttttcttggaccaaattatcccttatctgctaccttcatccgctgcactcttcttcctcccacgatcgagcgtggcggcggtggcgctctgcactcctcttccaatgacggtgcggatggcagcggcgcttgagctcggcagcatagaacatgtcggagctcaagcgtagtgacgcggtagtcagcagcgaggccagcgcaacactcatgactatagaggcgagcatgcattattcactcggtactcgtcacggaaagccaagcacccaaaaccccaaatctccaaaacctccccaatcggtggcggcaaccatggacacatcctccgtatggttgtctcccacctccctgtcaagaatgtcacgctctcaactggctagcgcggcatttggcgctctaccctgctcatcctcatggacgccaacctccttctcgccggatgtccgaccctaacaccatggctgcatgtgaggaggctcgctctatcatctatgccgtggatccatgggctagagggattggatacggttgaagagagaagaggagagagggaggaagaagacatggacaatttgattaataaattttataaaataggctaaaagagtaagtagtggtatatctcaaatacacattgaattgtaatggtaatttttaaaactaataaatttataacgatatggatccaattaacccttgtttttatgatggaatatgtataatgttactataatcgactttcctttagttcatgtggaattaagtccaggagatgtttatggtcactcgtacgtaatgccgtaaaatgtagaaaaatatttttttgttgatttgaaaattttaaaatagcgatggccattccgttctttttatattggaacatgtaaaaggttaaaattgactttcctttaatttatgtgcaattaattaagcccaggagatatttagggtgtgaaacaaagtagattatgtgtgttggttatttaaaaaattagactaaattatatacatcgtacattgacttggcatgtgggtggaatttagaacaagaactttagaagtgagtgtgctaatgcacgtataacttggtagataggtgcaatctagtaaaaagaacttaacaaatgagtgtaggagtataacatcttgtaaggtgagtacgattttaatacaataacttaataaatgttgcaacaacgttattatttcaagtatttttttacacgttagtttttaagtacttagtttatcaatatacttgtgtgtatgtctataagcatacataatttttgtcattcaataatgaaaaagtcaattaaattttattgtgtaaaaaaatattgtatttcggttaagatttgagaaggtgaaataaaaaaaatccaaaccgatggtgcaaattggataaatagtgtgattcctatagattaaaacaaggattgtaaggtcctatagattaaatcaagtattgtaaggtaatatccttaatattgctatgtaatggtatattggcatcatgaaaaagtttgtggagcactcaataactaaaacagcatacgtagccaagttgttgcaccaaattctaaatcgtcgttcttgtacacctactggccaagttgttgcaggccagttgttgcacttgaatgtttaattcctaagtttatatactagatcatatccacttatcaacttacactacaagaaatttttctatcaccatgaaaatattgcaacaaaatattatttgtagtaaatgtattattctattaccatgatctaacttttcgtgcaattgataaattatattaaaaaaatgtaccattgttgttatagtttattttttgttgcaatatatagtgggctatagccacattgtgacgtggaaaactaacattgcgacatggcaattttattgccataatttttattttcgtggaaattggcgtaatctcttcgtccatgctacattatcgttgcattaataattttgagcacctcacagtatgtaattgttgttggcacaattatagttccttgtattaagtttgttgcaatataaattttcaacatataagttttaagggctttaaattttcatattttctatacatccgccgatagattcttttggtttaaattagtcaaattttcatatgttggattatgttgagagatgtactctcgccataaattttcctgtagtgatagatggtttttcaagtagtggtttttaccgttagtacaatttactcaaaaagtaattatggtatttcatttatcttaattcaatttggttatgtcatctctccatccacaaataatagcatttctacctttttaaattctatacacaaatatataagcattcctatatttttgctgttgtgcttttcattagctgctaacccatatgcacacacccaaaacataattggcctgtaaaatgaggggtattatcataaatagaaacaaagaataactttcgtttgtttttatcttaatctgtattttaaaaagataggaacgcttatatttgtggatggagagagtaaatagttcaactaaccgatatgatccaattaacaattgcgaattgaatgaaatgtactactggtattttatcagaccgcatgcatgtaaagcgcttggggtcaccatattaatcaactctttcttttccttcgtgtgcatgtgtgcgttatatcatattttcgccaaccttttcatttattttttcgttatctcttcttaattaagtttggtaaagatattctgtagagtgcattgttcgatgattgagacatatatgatcttttgtagttctcgcctcgaagggaaatatgatcgatacctacagatcgtctaattaatgccgccaactacaatggttggtaagagtaggacgtggcctctctattttatttgtcccaacctattttatttgtcccaacaaaagttgtttgtaccaccagtcggagatctataagtagatttcctctgaattaacaatgatgcggtgctgatgcttgcgtgatgttgcattattaattggcagtgtcactgaaaatttcttatgtctatagctggtgattagctagcataggcatcatctcgatctccgaatgacagataatataataaaagatgatcaaggaaatttttctcagctgttgttttcgggtggtcgattggtacatgtatggtaatggttgctttgcggtcaagatgaatagatatctgtcaaaagtaactttgattgcacgctgattcccttttggtgtttcatcttctctgcctagctcgcgttgttgtcgatcgatcgggttggttgttcttgcaacgtaaaggttactacgtgaccaaaaactgactcatatcaaacagacaacgaccaaggttgtgaaaggaactctgctatctaggccaggacagcagcgattaattattccgactcgagttcagacttcagacttaagctcaactgaagtctaaagttttgttaggtgaggcgagaacatcagctgttccatcaggcatgggttgctgtactgccgacctcggctagtcgatcaggtgagacacacgcatggtcccttcgcccgtgcatctaccgtaccaacctcggctgagaccgcatcagatttacaaagaaacggaaaaatgtgttcttgcctcttttatactttgtgattttatccttgtttcttaactgaatcttgtgttgccgatgtttcgcttagaggacttaatataatggtgtaaagacatgtattgcccttgcaatttgtccctactttcacgatggatttgtaattttgtccatgatttgatatcaagcctattgatatgaattttgctcctattttagcatgaatttttcgcattgttaaagccatcctaacagaataggggcaaccgggcaagcataagctttagtaaaaaaaataggataagattacaaagttgggaaaataaagataaatcaccattagagttactaacatggctaagaatacaattgtctatataaggaatggtttggttcacatcacatgtttttaatatataacgcaattgacattttgttggcattttttaaacaaaattgagttatatattaaaaaaacggaggtaacagtagtatacttgcattctctacggttcatccggatcggtagtctagcagaggttgagtagcacaaaaggaatatggatcatttgccgtgtcgctaaccaaaagaggacaatgataaaagtgtataattaggcgcacgcccgaccatttgattcatgatcaataatttagattgaaatgctacagtaaattaatgcatgattgaacctgtgagagatgtgtataagggtacaaacatattgttttcatgccaactgcatattgttttcgtcaacgggatttctcagattacttgcaatcgtatagacacatccagtggcatatgtatgactcttttcttatatatagctccaaacaattgcccaccactgatagtttggaagaccattatcgagtatatatatatgaaaattctttgataggacgacttgaaatagctcttttattaacgacaacatctgttcgtaatggacgaaccaagaaaaactagttcttggtatgaagtttaggaccactaatttttgtcccatgataataaggcaaaattggacaccacctagacactgaaagactcctctcgatcgggtagacaaagaaaaaccaaaaaggcacactgacgaatctacagatgtacaaggaacaaaatgtaccgtacctttccaggatgcaataggctagtattacccttaaaaaatgaaaaaagatgcaataggctacagtacataactgcattttttaggtatccatccaaaatctccacgaaaatatttttcggtgcgtgcttttggtgtcagtatccttaaatttcttctcctttatgtaaaaaaaatatttgtaaccattaacccagggaataccttagtaatacttatgtattttcctactgctttcagtcaaatataattattctgctttctttttctccaatacagtttgatacttgatagggattttgcctttatatattctcaatttgcactactgaagaataatgcgccacatcttaactttgtggatgtgtcaatcacctcaggcgcataatgttttgttggtttatcatgcaaggaggagcatatgaatgctcgatgtgaccagctaatttaattttattcgttaggacttaaaactaacggggtttcctaaaaaaaataatcagggattttagaggagttaacaggatttagttcaattcctctattaatttctagcttcctccactctaaggaaggcctaagatgattttattgtataattagggtatgtttagttggtgaaatgaaaatttttgggtgtcacatcggacgtttgaccagatgtcggaaggggttttcaaacacgaatgaaaaactaatttcaactcacctagaaaccgcgaggcaaatcttttgagcctaattaagccgtcatttgcacatgtggattactgtagcacttatggctaatcatagactaattaggctcaaaagatttgtctcgcgatttacatgcaaattgtgcaattagttttttctttttatctatatttaatgctctatacatgtgtctaaagattcgatgtgatgtttttacgaaaagtttttgggaactaaacatggccttagcatgcatgttttagccaagtactctctccgtcccaaaatacaagagattttggttggatgggactttttggacagagggagtaattcattttcatttcttagacaaatctctccatctcaattagttggcacctttcacttggctgtaaggtgattgccatagtgccatcaaagatcaagatatgccaatcaattagagcaatgctaccgtactaaatttttcttactaaacttttactaacaatcatctcaaccatttgatttaagaaaaagttaggacgtatagccttttccaatcagttatatggtcatgtccacctcccttgttgtcgtctccgactggcagtttgttctaccactcatttttctagcatgtagtagtagctggagccggaatgtcagttccttgcgcttacaacttgtcattgaaattgtaagtttgcctattgccatgttagtattcacttgcatggcagcatatgtatgtcacatgcatgatgtcatcatggcatcatctcactgaaataaattgttgacgatgattgtctcctaagtctgcattcttttcttcaattctaaactataacttccttctttttcattaacacatttttcaaattgctgaattatactttttttcaaaaaagaactttatatatatatatatatatatatatatatatatatatatatatatatatatatatatatatatatatatatatatctttaaaaatcaaataaacatattttttaaattgtaataactaatactcaattatttatgtgctaataatttatctcactttgcgtgctaatgaaaagctaaattaagttggagattcaaacgtaccctaagtcctaacaaagttcatttggtatgcacgttaacgttcgatttgcataggttatattgatcttaatttggaattattccctatagatctttagaaaaaaaggtcttaatggcaaatcaaatattgtcgtgaaatgtagtgcatgttaggaccaaagtataatgagactatttactgttggtattgctgtagaagttatgggttagctctaggggtgaaaacagtatggaaacttccggctaccgtttccagtttgcaccaaccgttttagtcggtttcagtaaccgacggtggcggaaatggaaacggtaatatcttctggaaatggtagcggaaatgggacgggctttttccgaccgttttatcggtaaccatatttgtatggtaatttccgttaaaattccgaaaagaatccgaaagttccccagcggctcagccagcccaacccatcggaagcctatgaatgaagaaagcttggtaggcttgcagcctataaaaaagtggaagtgactagggaaaatattgttaaccctatgacgttgcatgtggattttgctgaactttggtcttctcaacttatcgatgttgaagcattgttgaactttgtttatattgtttgtcaaacttattatcatatcattaattatcatataacggtgttatgtggagtgtgatgatgcaagaataaagttaaaaaatatctacgtgcatagttaaatgtgtgctatgccacactccgctaatttcgacatgaatttttgactttcgagtttcgaccaatatcggtatattccgttccgatgatcccgtttccgatataccaatattaccgatatcgttaccatttccgggtctaccgttccgatttcgttttcaagaaaaaaaaagaaaatgaaaacggtatagggtttttccaaccgttttcatccctagttagctccatggtttgtagacttgtagttgtatgtctaagagaatggtttccaaattttctagtttatccactcaccgaaaagaaaaaaaatatggtgtatcgtgagacctgagataccaatatatcagacatatttagcgagcttcttataatcaaaaccttcatccagatcttgagaaatatatttacagaatttttttaaaaaagaaactaagagttattttttagcttctccaaattctcgtaaactggttatcaattagtagttgctactccgaacaacacccaatcaggaccgtaatgtctcacgtaccaacactccatgttctccgccaacgcttcatgaaggcgtactttgactttacgtgacccgtccccggccgccatctgcccatctcctcatgcggccatcgccggcgctcgccggcggcggcaggacggtcgcaaatcttctctccgccacggagtggatgcttccttctccggccacccaagtccacaccatctccgtcctcccctcccactcaccgccgtcccctcctcaccacttcgcgttctccaacctcaccaccgcgcctaagcgcaacggaggcaagggggaagaggagggccgcccaaggttcgaggtggtgcgcgacgatctcctccacccgctcgccaatggcaacaaggcccgcaagctcgacgccctcctgccgctcctgcgccgccgcggcgctactgacgttgtccgtgctcaccgttgcattccccttcacccagccttgatcacatcttgtttttcaaatctgatggtatcttcactgttctggacttcggattgcaggtgacttgtgggggttgccagagcgcccatgctgcggccactggtgagatatggattacccattttgtttttcttcattccacttgaatctgtgtgtaatttccagttcattctttacatgagctatgaccttataagccttggtaaacgatcccaatgcatccctgcaaaattgctctctaggtcatgcagatttgtcccttgattagcgcgctgatatagtgaatgtgctgcttttctttcttgaattcggttgagtccaacgaaaatgttgctttgctcatagcattcactttttttttttcatttactgcattagcggtccactgtgctgagtggggaatgaggccacacatattgctgagaggtgaacagccagatatcccgacaggctacaatcttatctctttgatgtttggcaatgtggcttatgcctctcggtcagtgtacgcacacagagatgaaatgctttacaatcacgccagaaaagttgcaggcacaggtggtacagtgttgtgggctgatgatattagcaaagaggattttgttttagatgaagataatggttgtgaaattggttcgagaagagtagttattattaaggaaggggctggtgacgtccaagcattgctaggtaagtaatggactgtttttgccctgaactcctgattttagttccgttcatcagtaaaaataaattttcgacaacagaataatctaatacccataacttagaatgcatgtgtccttgtattgctatatttgcttataggttgaaaattttcactttgagtattaggatcagggcagtcaattttgctttcacagtatgttgttttcttattcacttgttaatctgaaacctttaacttgggccccaaagaaaagggaatcttgcatatttcacatggctttgttgtaccttcaggtgttattcggctagtggagtacctttacaatctgtcgtcatttcataaacatgagaatgttcatgtcgtggtagatgctgggacaggcacaacagctgtggggttagctcttggagcggtatgtctagggtgcgtttgttaatactacttgcatattatgctgccagaataaattgagagttatcattacagcttttgtacactttgaacttttgagagtttctaatggtattacaggtatcatgattttccatttcttttatataaaggctttgttgttggagatacttttggaatatctaaagcacaacaatgagaacagttcttgcacttgatctatcaaagaaaaattgggataaattaatgtctctgatgacaaatgtggtgcattttaacttggtcaagcaatactaattaaaaatcgtgtcaatcaaaatgttcatcacctagtatttccatgtctatgttgttgctttctccatccatctttgctagagatcacagtttttctcacgatccttgcagattgcattggagagtaactgctgtcatgcttgctgacacactcgaaagatataaagaacgagagaagtccttaatatctgactttaagaagctttgccataacaactaccatgaaatggtgggagaaaatgatattggtgacagtttagttgaatgggtggaacgattttcaccaagacggtatgcttcaatcaattaatttaatatgctgcattttactgagcattcattttattcaatacatgctgctttctcaagtgtttctgcaatacaatgttgtcttgggtcattttcaaggcatgtcactataaattacagaacattctggacgtattcatgattttgtaatttgagggtgttcatttactaagtactagtttccttattagtatctagtaattttcttggtaatattatagtcggcggttgaagtggacttgatgttctgattattatttgttttggtgaataattatgtccttctcatgcctttagttcttgctattagaatctttagaatttgcgttcgaatactgatttttcttggggcctttttttttttgttcagatttggcaaggtgctgaacggtgaaattgcattatgccgccagattgcgcagcaaactggtatcctgttggatccaatgtacaccttagctggttgggagcaagctgtggatctatgtgttggagacagtagaaccaaagtggtgatgatccatacgggaggaacgcttggcttctgcggattggcgcagcggtactcatcgcacttcacctcggatgagcaaacttaggccctgtttcttttagcttaggattattataatccagattattaggagtaagctaaaagatagcttattataatctgataagctcatttaggtgagctttttctagattattgggtgaaaaattacccatcatgccaccccactccctctttagacttgcaaacccaataatctaggctctaataatctaggaaagaaacaactaaccacttattctactacagattataacaatctagattatagtaatctgactcaataatctagattataataatcccaagctaaaagaaacagggccttaaccaggccaaccttactgcaagagtgcaattgcatttttacctctatttatcctccttttttaagtccttttgccacttcccagggctagagaggtactacttttgtatacgagtcagaattgcttgaatagtcagaactctgaaactctgaattgaattgcctaagccacactccagaacagacaatttcatcctgctgatctattgtgattacccatcaaattcatggtctttggctgaatctgcttcccattttcatctgaagattgaaacatacgcacgctgaaacgccgtaactctgatggtagtgcagtgcaggtatagttctgaagtctgaaatccttgcggtccttcaccgcctctggatcccgcgcagggaaagtagtggtggagacgcgggcgatttttcccgccggggtcgagacagacagtcctttcaggcggggacagaccacgtcgccgtctgatcgcgaggcgtcgagaacgacgacgccgccaacgacgtcgtcgacgaccccacgagagcgcggccgccggtgtcgctcgctccagtccacccacgcacgcacgcacggcacgttggcgcgcgcacggcgtgacgaatcggagaaaccgcagcaaatttctcgacgcaacgcgacacgacgtatacgtcacgacccccaccgcgcgagatcgattgggccgcgcgcgcgcgcgccacgcacgcacaccggacgcaacgcaacggaagccgcctgccccgtctcgtcgtcgccatcgggacggctgggccgcacgctgctcctcggtccttcgccgctcgtctgctctgcctgccgcacgcggacgcgggtcggcgcggcggagtgggggtctggggtctatggccgccgcgggtgcgggggcgagcggaccggcggcggagacagcggccgcgacgttccggcgggtgtacggcacactcaaggcagagcttctcaaggacccctccttcgacttcaacgacgacgccatccaatggctcgagagcgtcagtgcaactcgtaactcctcaagtttttttttctttttttttggggggcactgtccttaattagataaactacaatacatgaaatatttgatgttttttgtctctttagctttggtacgatctgcaagttgcaacttcttcattgtttttttttttgggtattaaatgcaatttgtcaatgtttagctgaaaaaaaaaatcactgaaccttatctctgaacagatgctggactacaacgtgcttggtggtgagaaaaacatgctattcagaaacaatgcgaccaaaccaaacaatggcacattgcgatatggttggcaagtgatttagtcatttaagatctctgctcttgtacaggaaaattgaaccgtggcttggctgttgttgagagctacaaaatactgaaagctgctagcgcaacagaaccgagcgaggaggaattgtttcttgcatgcatccttggttggggcatcgaatgggtacatgatacttgtatgatttagtgacctgggattatgaaacaacaatattagcaaaatattttctaaacttttttgttctttgagtaacctgcagcttcaggcctattttctggttcttgatgatataatggataactcacaaactcgacgaggaaaaccctgttggtttaggcttcccaaggtttgtcaagtaggattaacttgtccacatagaaatgtccttgtgttactgtagattctcgagtgttgttaaaatgttatgattgtactccaactaaacaaaggaaaaggtaaaaataataacggatgataatattgttctcagatgctactgttggctaaatagcaaggggcagctccacactagggataggtttgatcatggtattagcttgattatctagtaactagcataagatgcaaggaatgatatagatatgtagattaatgctgtttacaatttgagtcctttccttgtcttggttaaatggtgatttagctcatattttctaccttgagcaggtcggcctcatagctataaatgatggactcgtccttcgcagccaaatttcaaggatctttaggcgctattttcgtggaaaaagttactatgttgatctcctagatttattcaatgaggtagttttacattcttaggatttctcttatttgagaaccaatttcattactgaagcataattttgttgcttcctccctaggttgaaattcagacaacttcaggccagttattagatcaaattacaacaaatgaaggaaggaaagatctgaacaagtataatgtacatgtgtatgccactgaattacgaatttctccatggtgtcatactgacatactgcttgcttagtgccctagaaggcagttgtttgtcagtttcatttttactcttcttgcttgataataatcatttttgaattttatgcagatataggcgcattgtggaatataagacagcttactattcattttatttgccggtaaaaatgaatgactcccatataatattttgaaacttttatagcatcaattcaggctgttgctcgtcgatttcttcaaactgagaaaatgtttccgcttttgctgccccttggggaaatgttttatacttttcatgaatacttacactgttccaatatgtggctaatcaaagtaaacttagaaatctaattcaaatgatcagctttcgctgtaccatgactcatgactcatgagcatggttcctcacaaacaggggtacatatagctcagaatgaaacttgatagtcctagaaacaacttcttgtaattcatcttgtggaaaaatgcttgtgcacatgtcgtagtgaggttgagttttgtggttgtttttgtttggtattcacaagcaaaactttttcaaccttacaaggttgcatgcgcactgctgttgtttgatgagagtttggacaattatgctcaagtgaagcatatcctagttgagatgggtgtttactttcaaagccaggtaagatcatcttgatgtttcgttctcttttccacttgaatgcttctcttcttggtttttctgttttcattcatatcagtatcgctagtaaggttttctttccaggatgattatctggactgttttggtgaaccagaaattattggcaaggtaagtacactcctgcagtactatcacaagtttcatagtacactatcaaatgttctttggacttgatccccaagcaatcttaccacagataggaagtgacattgaagatttcaagtgttcttggctatttgttcaagcacttgagcgcgctgatgagaaacaaaaaggagtcttgtttgtaaggcccccgcgcagtactaaactgtatctttgcatagttaagcatgacgtcttattctgtgaatggcatgattgcaggaaaattatgggaaatcagatccagcttgtgttgccaaagtgaaggatctatataacgaacttcatctccaggtgttcccccattatttttgttttcttttaaaatattttttatacataaaatggttttttgttttccattttgtcgttcaatgttgaaaaatatgtcttttttttcttaagatggtataatccagccaagtttcagccttcaatccttgattttgaatgttcgactttttacaaaaagatgcaatgaagccttgatattatatgcaaccgagacgcttacccaaaaaatgctgtgatctgtatctgtttactcatttctttctgcagttgccgcgtgctttcctgccatgacaaattcatttatcatacctgatttttttttaaatctttcagcgggtgttttctgagtatgaaagggagagctatgaaaagctgatctcagccatcgaagcacaaccgaatgaagcagtacgagcggttctgaaatcttttctgcacaagatctacaagaggagcaagtagaacacggctgaaaaataaggccaattttggcatctcgtggattattctggttcttggcttcttgttgggatgtatagcataggtgtgataggtttctaacttctgggactttgcaacgaggaacgtgcctgataaataagaaaaatagtttctcattatatgttccatggatcatatggctagcaggatatttcgtattgcacaacatgaccagtgtgctgaacagcttggcgattacagaaaaaaatttgagaatatattttctttttaaatatttgcatttatatacatgcataggaataatttgtaaaaatatacctcttccgcacagtgttaacgcgggatcgctatgtaatcacagcatcaatacgcggtcagatcgttcagcgcggcacggcttcgatcccgcgggacggatgcgcggaaccgcggtcccgcggaaccatagtgcggcaccgacgagcggtaccgcagaaccatcccgcggcaccggcgcagaccagcgctcccgcatgccagtggtgcggcaccaattacttaattaacctaattaatcacactggccttaatcaaagcaaatcaaagcaaataatatatatagctaagcagctgcgcaagctagcttcctctgctaagcagccggtgccgcgccatggttacgcgggaccgcgttctccaccacgctcccgcgtgacagggcagcgcgatcgaccctattccgcgcttccgacctgcggaaccgaagctatgtcgcgtgtttgtaacggtcccacgttcccatcatgcgggagaggtatatttttacaaatcattcccatgcatatatataaacataaaatattaaataaaaaggtatattttcaatttttattcggcgattacatctattccctgcttgcataagttgcataatactatgagattaaacttgtaacagataaattgctgggatgtttttctcttgcggaaaaatggaataacaaaaaatattttctttgtactttattaaatttgttaatgtgtatatgatcatttatcaagatattgttacagctttcctatcctgtaattagtaaataccatcgggagaagggttgagcattcttcattcttcgtcacaagatacctgatctgatcctgcctcattctgtcgttggatattgcaatgtagccgagctgacaagctccaaaactgatgctctgtacatcaaacctcttctgtcccagtggtctatgcacaaatctgaacactatcaataataatacactatggtactccggtcgctccgcagattcagctgcagatgctactgaacctaatgatgctgatggactataaactatggccggccatgataaactaaaaatgagaactcgtgtgatcaaaattttgtagtaatagttaagccagtagagcagattttagtggaccgaccgtcccagcctctaatagatgcatggctgcactgtaggagaacttcctggcaaataggaaacatggaacggatgtagtattgcattggcaccactcagttctgtgctccatctgataattcacatgatcaataccctgtaaaatgcagcaaactttaagtgagaatcaattaacagaataacgtgccatagaaggtagaggtcctgcactacaggatgcggtgtctgactttattcttaggaatagaatttaacatcaggtagtatagacagggaaaccagtcaacataaacatggaaacacattccttgtaacaaaggttggagttcgcaaactggaaaggacctctgctatgcagatacatgtttctgagtagattagttctttattcaggacaaaacaaggagaattgattacactatctaaattgaatttcctacgagatggacaggttgtgaggcaaacaagtgagatagaacactagagcttttttatcattcacaagccaactgaaaaagaaaaaaaaagatgacaaaacaaaatccacagatattaccttaattgaattgatttgctcaggacttgctgactcatactcaaatgtcattggatgccaagtcattttgtctttaggatctgaggactggttccatgatgtatatgtcaaagttcttctttccagttcattttcatgtccattgatctacaaagttaaaagaatgggaaacattatgaattgttgtgaagaacatacgattatgtcctgcagtctgcaaatcaatatcaacaataacaagccttactgaaaataatgtctgcacatagtgttcatctggaatgcaatcatgctccattcgagtagatcctttctgcaaggtttagcatggatatcatgtctcagtgaagagctcaattgcaagaaacttttgtgatgtgagcaacagcttgaaattgacggtagcatttcatatgcaaacatatgaacaagtttgacaatctgaacttccatttgtcaaataaatatatgaaagttccatctgaatgcgtgcttgacatcttgagaatagataaaagagaatgtgaccggttgaaactttaccgatatctgctttcgacgaagtccaaatcctaatcttcgctgcaagagaagcataatacttaataagtgcaacaatcgtaggtattgataaatataattaattcagggaacaacagtactattgggtacataatgaaacattccttagaagggtgtaaaaatgagataaatcatttgattttggtgatcaagagaaaacaaaaaagactattcgtattcacatcatataaaactacatgtcagacagcagaataaaaactcgctttagttatcattgagcgaaggatagtattacatatgaaaagttgtttatacctacggtaaagaaatggtgtcacttaagaattggaagacaaagtcaatgattgttattatacatgatattagccaatgtatgttaaaatgatcctctcttcaaactagactgaaaaggaatccaaattaaactaaacacttacataattaggcttctgtccaagcaaagccttagttactaccatctgcaacaatcaggtcaaattcaatagaatcgttagtgctacatatagaagaatatgtaggattaatggaccaaaataaatacgaacagttgtcttaattcagcataagaacaatttaactccattcatttttttttcagttttacacaacttttagaagttggattaatctaatgagaacataatcagttcgcattgtgcataaggacaattctacaaggaacaaacaattggctaagataaatatatatattcttatcatgcagtaattatgtagctggatgatataggctatcagaaaaagtattgctgataaaatgtaaatgtatagcacaaaacccccattctgaacatatatagatttttttttttgactgaactgaacatatatagatttgatggaacttttctcagacaattatgctgcaacttggttggcatttttttcccctaaaaaatagcatatatatacagacaaagcattgccatcgaggcagcagagcactaggatactatcgttcttaattgattagatagtatcatttgattatttaacactgtaaggcatcaaatatctacaaacaagggaacagaaaactagtctcacattcacatcccatataagcaagccacatacctactaacatgtttgctaaacaagttgaagttcaagtcacaaaggttctaacatttacagcagaaatttgagggaaattgaaaaggatacttggaacagactagtaacctggttaataactaattttcttgaaatgggttaacatgtgaaggattgaaaaggactaaatcaagctaagcaagtactccaatgtcgaaaagaataaactcaaaaggcaatataccttgcaatgccttctgaatacttgcaagacaagtttgtcgccaacgactacttctgcatgtcttctggtcaatgctacccactgaaatgagaggatagatggttcagtgtaaaactctgaataaaaatgaaatactgattacaagaacaagaatggcaagaaattacagaaacctgtgatcctttcctccatttgtcctttaggataacaggagacatgcttggattgtaacgcttctcggtcttgtcaacaaaactggaaaatatcaacatactaattttgagaaataaaaattgaaatatggcatgtagcctataggaacaaacatgaacttgcaagatttcagatgatctttttactcttacctgtctacaaaacttttagtcgaagccatcaagtaagtatatatgtagctgaaattgtacagaggaacacagctgcagtagaaaaggatattttgaaatgttaatgttgaaaacgtctataagatgataaacattggtacataaaaaaaattgaaattcaaactacaacataaagacttaaagcatactgactagtggggaatatgatcagaatgtcactctaactctctctaacctatagagatgggtaacactcatcatgggaaactcttcaaggtgagcacccacaagggaaaccaagaaaaggcattcacggaattatgggatgccttcacagttgcatttttttttctaacattacttatgagaccaagcaaaagcgagagagcttctcaagaaaccttagcagcaccacaacaggaaaccacaatctaaatgcatcactaagaagaatgccctctatagagtcctgcaaagtacaaactggttccgtacgagttcacttgccgatttgccattactaaaccttcagctattaaaccaatcacgagtctgacagccacagaccacagttgaacatttaatcatggtccactccccataaaatttgaactatgtacgagcaagaacagggcactcgcatgtgggggaatgtaccgtacctatcagagagcaaaacaaagcgctggttcgctggatcctcgagggcggcggcgaacaacatcctctctgcctccaccatggtaggttcgccccacgccacctgcaaggcacaaccatattcctcgctactcaaatcgtacccaggtctcatgtcgatacacgccatcacatcagaagcaagagatcacgcaaaagaaatggccgaacctttacgctcctggcgagctgccgcccgtagaagtacgacgatcccgtggtggtgcggtcaagctggaagccaggcgccgagtggacgtacaccgagaacttgccctcctcgccgttctgccgaacacccggtcgatcagaaccaatcgaatagtcaaacagggacgaacaaatgaacgaactaaacgaaaatcagcggaggtggatgattggggctcacgcggaagaaggcgtcccagaggaagtcgagggggacgcccgcgcggacgaggaagaggaaggcgaccctagcggggcccccggagggcggcggcgcggaaggcggcgccgggaggggctgggtgcggagcagcgcggcgaggaggagcaggaacgagagcggcgcggccaggcggaggcagaggcgggcccgcgcggcgcggcgtccggccaccgtgagggccagcaccgaccccgccgacgccgacctcttcgccgccggcatcgtcggcgtcttgcgcgggcgcggcgtgcggtggaccagcccacaccgtgggcctcggtggcatttaaaagcgagcgcgaggagagagagagagagagagagagagagagagagagaggggagatctccttgtgatcgccgcggcggcggagaaacggagacgtgggggggcggtggtggtggtggtgttgtgttttcccgtagcttttggtgcgatttttgggcctcgtgacgcgcgcggcgtctgcgtcgtgcgcgggtgggtgcgggggccggtcgcacagaggcgaggcgaggcgcggcacgggcgtgcaaagtggctggccagtcgtggctcgggccggtgggggattcgcgatttcgcggcgtggtggacaggtgggacaggcgggatcagcgtcagttatgacggaacttccgttaagggcaaggtgttactgcctctaggctaaaatacagagtactccctctccctctgttaaaaaaatacctagtgctaaatgtaataaatccttataccataaatttagatatatctttatccagatttcacttcagttctaaatttgtttttttttggacggagggagtattaagtactacctttgttttgctatatagctacctaatactgtaatacatatccaatactatgaatttagacaagttacaatatggctcatatagtactatggataagctatagtgattgatagtatcagatgatatctcatatattgtattaggtacctccattttaagacgggtggtagttttggctcctttcaactgagtaaatttagtggaattttgtattaagtagtacttaagaaattaactatattctatgattctttttgtaaaattttctgtgtcctaatggaaccttttagtttcaccgatgaccatcgaaaattatcattggttttgagcatgataatgtggagctttgccacttgttttctttcttgatgtcattattttttgtgtatgtgtgcagcccttgggtcacttttataccacacagaaccaatgttggcgtttaccttcaagaccacactgtccattcgacgctaaaaatcaatggcatgtggacggttggaacggcatcatctgccatcgtaagaaaagaagaatatatatcaccacagtccctctcgaatctttggtttacaaatcaaaagagaagacaaacgttgcagggaggaacaaatccaaggacggtgcaagttcgtttaccaagttcgtcgtttaccgcggtgagaactgtgcatccccacgccagcagtagccagtaggacctctggagtctgcacctgagataaaagcagctgattatttttttttctaaagaaaaagggagctgattagcattctctaaaactccggaagcccgcctgtctagcattctctaaaaagagaaaatgcaggaatgcggcgatggttgtagaggagaagatgcagcaatgcacatggcgccatcacgcgcgtacagcggtacaggcaaggcagacaggcaggtaggggcagccttgtagaggaagagagtctgtgtcttggccaaactctgaagactgaagtcatcgtccatgccacccgtgttgccctgccggttgccgctacttcctttcagctacctgcctctcgtctctctccgccacgtccacgccctttgcgcattgcgcgtgggggatctggacccgttcctggttgactacttggctcgtgagaaacggatgtggcgtcgttggctcgttttgcggtttcggcttccctcccggtccctgtagaaactaacgcgggaagctgcgagcctgcgacgggagatgcatgaagtgcgaggacttcacgccgctagttattccggcttgctgttctgcaattgcccacggataacgcttttgctttaaggaactgaactttccagctctacaacaagtcgaaaacaatgggggccgaactttggtttttgtttatatccaaacaacatcaaaagtttcacaccgagtacacctgaattttctttatgcaactgaactttccagctcaagaagtcgaaaacaacgcgggctgaactctggttatttttgttttttgtcccaacaacatcaaaagctccacaagaagtacaccgaattcgaaattaaataacttgacaacaaaaatgtaatatgatggacacacggcatgaaaccaatttatttgcgagtcccccccacgctgcgcatcttgattcatcacttggtcgcgatgaacagcccccacctctgctcaccagcagaactcctttgaagttttgccttccatccattcacaatggcgtcgtagtcctcctgaaaataagtgaaacaaagaatttgatgtgcataccagcaacatggaaagaaggcagctactaaactcgcagttttgcctaaattacctggctgaaatcagagacgaactcgtttttgttcttttcaactttagcaagctccctctctagaacatcgaggaactgcaatacaagattgaatatgatcagtaccacagaaaatcatatctacatttcagttgaagagaatatgggaatgcagccagtgtagctccagagggggattacctgatcggtgcggtcttcagcaatgacatcatggaaaccagcattctcaagcatctggataatttaccaaacagatgttaccatagctctacactttcatgaaagaaacagtactattaatcatatagagtgtagctagcaaaagcacctgtccgtaagccctgacgtcgtgaaggtcataacccctttgcttaatgtaagctgcgaactcttctgaaggtttcccagggcacttgcagtaatcactaattaggaccttacccccaggtttgagccacttgaagaaacttttaaatagtgagggtttatcctgcaaagagcaaaaacagcactggtcaaaacacagttgttctggcatcaaagaaagggtaaaacatatttagtggcaggtaattcaaatagttccaagaatttatttttcccacaatcccactaacaattactacaaatgtatatacaggttctcagggcttgcctaaaacagtccatttcaagctgaaaatatttaaactgttgtaggctgtagagcaataaaccaggaagaaacaaaacatccaaatgggttgtaaataatgtgtaaaacgtacttgtatgtgaaggatagtatcacgactgtagatgacgtcaaacgtgttgtctgggtatgtctttttggtgcaatcagcgacttcaaactcaactgagcacttacgcccaatagcacgctcaagtgcaaaagaaaccatgtttatcgaaagatcaataccaacaacatgaacatcatacttgtcagccatataaaaatcaccgcccccaattccacatccaacatcaagaacgttctggccaggtttgagatccagcctgtccacaaattcttttgtagtttctggtgaacgaagataaaagaataggcatactacaaattagaacaaattagaatattactgatttaaaaatgacaaaaaatacatgcatttactaaccaattccaccagtgctcacaaagccttctccaaagatgcgttcatagcgtaatattccactggctttgtactgcacattgtccaaaaatctttgaaacccccgatcttctgttgaatcaaccttttgccatagccaacatatctgcatagtatggcatcaagtccatcagttcacttgatcacaggacatgagtgtgtatgtggatgtgcaaggacaaagaagtacctggttttgatttttcttgcttttcacgtaagctccaacacacttgcaagtaagtacagagagttcaaaggaattcccatcttgatcaagagcttgacactctttaaacacctatttttaaatcaatctgttagccttcaatcatcacaacttgttacaaagtagcgcaaataacattgctcagtgctgctataagcatactgtgtgtatagtttagattcagtaaagtgggtaacatttaacgaggcaagtctagtagaaaaccttgaactgtcaagcttgagattcaaatgatagaagggaaccagaaacaagatagttagcatactgaccttagtgtaaaaccttggctcccggtaatgtgtaggattcactttcctttttgaatctccagactgatggaaacaagattccctaaagaagatatagccgccaacctttagccatcttaccattctctttactagcttctcaacctacagtaacagtatgagttagcaaactcagaagacatagccaagacataccaagtttcaacacaaagtcgatttatatcatccagggttcatttcccaagacatattcagatgtgcaaagaaggatcgcaacagatcttaaatatgcttatttatttgaaatgagacacgatatgaggcctattaagtactatctgctcattacctcctcgtctgaaagatacatcagtaaccagtttgaaaatatcagatcaatggagttatcctcaatcatcaggtctggacatgtgacatccgcacacataaaggatgcattcttgtggtgaccgtttatgctttcattctacaagaaacgacacacaagactaaatgaatcaggcataacattcatgtagagataaaagaagccaatcatagttcagcgaagccaatcatagttcagctaccaaactggttttaaggttttaaatgagatgtgaatgttaaaccttcttaatcacactttcaatgaaatccattgcaagaacatgcccagctgttttcactagttctccagtgaagcgacctattccagcaccaagttccagtactgattttccttcgtaaggaggaagtaaagacaatatctgcagaagtgtcagaagagatacgttagaacataagtccaggaaaacattttccagcatccaaaaaacatgtctaatcaatgtgactatgctaattttaaaaaggttaataattactgtgacaattgagtgagagggaacaatctcattcacctgctaatggtagtattattgacagttacagtaacacattctcgtgcgagtacagtccccaaaaattcttaagtgggtatttttcttgtgaaaagagttttacttcgtacagtcagcaaacaggtctgtgatcattaaagtaaaaggtctagcatcatcttctagtctggaaaaaggaaacagcaaaacagaatttttcctttaagtaaaacagtgacaacaattcagctgtctacctaagaaacaccttatgtaatatggaccctatgtgatgctactatgtcaaggtctgctgtcatgtcaagtgttcactccattttgctaaggccttgtttagttcccaaaacaaaaacttttcacgcatcacatcgaatgtttgaacacatacatgaagtattaaatatggacaaataaaaccaattacataatttgcgtgtaaattgcgagaaaaatcttttaaacctaattgcgccatgatttgaccatgtggagctacagtaaacatttgctaatgacgaattaattaggcttaataaattcgtctcacactttcctgacggaatctgtaattttttttttgttattagactatgtttaatacttcaaatgtgtgtccgtatatccgatatctgatgtgacaaccaaacacaaaaagtttccctaactaaacaaggcctaagaaaaatcacttttgactcaaggattacccaaaaacatacgagtcaacatcagtcactctctcaaaagaaaaacgaacaccaggctctccaacctccgttctcctttgagtacatctgtgttgaacaattctagaaaagcaatgcacgaaatgccgaccagtttgtcccggttcatcatttaccacgcgccacttactaccacgtaggaactgtatttggttgggaaaagtaccaaaaagtgcatgcacgcgccccagatctagtaagcggataagaaaatgaccagtacatttcacagaaattactgctaagcaccagtaaatcactggacagcggagaaggaattaggcaggtggcactgtggtatcacctcggggcgctcctccttgtcgagatcggcggcgcgggagtcgagcatcatggcctcgacggtgaggtccttggagtgctcctcccagtagctcttctgcgccttcctctcctccacctcaagcactcctgcgaacacaaacgcagacgcgtcagaacatcaccccgcaaaaacaacgccctccgcacgaacgagatccgcaaaatccaacacaccaacaccaacacccccacgcccccatccatccccaaaccagatcaagcagaacgagaacaaaacgcagggcaaaacagaacagatcaggcccgatccgatccgtgggggggaggagacgtccttctgcttaccattaacagcggtggcggccgcggcgtccatctcggcgggatcgttcgaccgttcgttcagtgcgattttagaggggagggtttagcgactgagagtctgagagaagggaggaggccggcgagattaagacccctcgatggcgaggcgggcgcgggagaagctccgggagcggcggttgaaggatcgcccacgaggctgcatccaccaccggatcacggcggaggttttgaggggggaggggaggaggtgcgggcgtgcgtgcgacgatgagaggtgagtgcgcagcgaaggggaggagggagggactcttataggcgggagaggggagagggggagaagaaggatccaggggaggagcggctgagcgcgcgatcagatcgaccgcgagatccgagcagatcagattttttttttcttttcgtcgttttgcctgagatgaggtggtgcgcttggcttcattcgggtcccgcgcagattcaaagcggccgaatcacaggagtatttctgcagaaatctttaggcaatgtttagttcccaaaaattttttctcaaaaacatcacatcaaatctttgacacatgtatgaagtattaaatataaattaaaagaaaaactaattacacagttagggagtaaatcatgagacaaatcttttaagtctaattagtccatgattagccataagtgccacagtaatccatatttgctaatggcggattaattaggctcaaaagattcgtctcgcggtttccagacgagttatgaaattagttttctcattcgtgtccgaaaactctttccgacatccaatcaaacgtccgatgtgacactcaaaaatttttatttcgcgaactaaacaggccctatactccctccctctcaattctaagtacggatataagttttcgtgtctaatatttcactctccatcttatttaaaaattttagaaaaaagtttaaaaataaataacacataagtgctattcatattttatcattaatataataaaaatataattataaaaatattttaaataagacggacgatgaaacattgaacacaaaatccacgaccgtggctaaaataggatggagggagtatgtgaaatggtgcagaatcgaagcgctcgaataaagaaattttcctgtgttgtgatgcagcagagagaaaatatgcctttcgttccagacggcgctaatgcgcgctgcctcgtgtactcatgtgctgatatacgacactctatcgtgtctcgccacgtcgaaatcatctcgacaacatggtactactccccaagcaaaaggaaaaggatcggaccacgtgcagctcctcgctgatcgtcgcgtgtaaccaagcgaacgaagcagaaaagttgagagttgcatcccccgaccttgcacgctgctcgttgtggcactagtataaaactgaatcgtagaggaatagccatgttcggttggcaaaagggtgaaaactttgtgaagatcaaagcgagaactcaaagcagtactgccatcgattttggcattttgcccacacgcacgagcgcaatacgagtaagagatttgcttcagttaaaaaaaaaacacctcgaggtaccggtactatcaaagtatcttcgatcgtttaatctaaccatgtccatcctacctagatagattcaacgttcaacgataaaaaacgatttggtactatgagataccgatatgtcacgtcctatgagccaggcttcaggcactgggctttgatccaggcaaacagggtgcatgcctttaaaagagaaggaagagcaacagatgaggcatcgatgaagaaatcaacagaactgaagccaaggcttcttcctcctccaatttcctctcatctctctgttcttccaatcctaggctctgttctcttattcccagtcccctgcttctcttcccaatctacattgctaattcctcttaattgtatccaaattacttgagtgattactgctgtgaattatcggttgcttccggtgttgggcattgatcggtgggtgggttgaggatcgtgacaatatggtatcagagcagtcaattcgtgggattccaagcaaggaggcgtgttgggcgacacacagttgcaatggtgacctttggaggcggaatttgagccgtggaggggttagtgctggtggtgcccgccaggtgttcggtgaaatgccgagctggctaggagatggcgcaggcgctgctcttcgtgtccaagtgagccaagtcctttacccggtgaccagcgaggtgctgcatcaagtttacaacacctatggagctgtggcggtgcaagtcctcaccacgagtcctttgggtgttgaggccttcgtgtggttccggtcaagctgtgatgcagagagggctcgatctgtcaccaatgggcgcaatatctatgatgggtgttgtctacttgatgtccagcacgtgcatcctttcaacgggaacggtgtcaacatgacgcccaccaagtgttcgacgccggtaccaagctgcgccaacatcaagtctgatgccaagagcacttctactactctagaacatgtgttcccggccaccatgagtccatccacgccctcagacgaatcagcagttgtggtgccaccgatttccctcaccgcgaccaaggagaattgggctgacatgggcaaggcggaggataaatcagaaaagaccttccatgatttgtgtgttgagataaaggacatgatcaatcagatactcgtgacatgccgcgacatcaaggttgagtcaactacgagcgttgatatcaccagagttgtggcagctacaagcaccaacaccaaatcagtccccaacacattggaggttagtaatgaggccaattcaatcagcttggttgatactaatgagttgtgcatggtgacagccaccaagtgtttgacggaaggcaatgaacaaatgatcaatgatgatgacgatgacatggccaccgaggatttagttgagctcactgaagtgaactccaagttcacactacagaaaacaggtagctctccaccagtaccaccttggaaagcggcaattccatggtacaaggctgagatgaccttaggttctcggcctttaccatggcctgatccgtggttgagtcaagacagctgaggcgtggtgatgacgaagctcttacatccccggcaaccaccttctcaagcagaagctaaagctgaagttggagcactacaattatttggctgtgtactcaattccattgaggttgattgtcaaggtgaggcttcaaaaacactgatttcagagaggacgtgttctattgagttgaggccttggccaccaccttattttctgttaaatgaggtgatcaaggaagtattggagatatgtcatcaagtaaatatgaattggatttccagctatgtatgggagaatattcaaggactattagtgctggatgatcaagtctttcaaagctcgacacagtggcaatctgctatatacaaggaaatgaactgcttggaattgttgattggattggagctattgcgtggaaaaatacattcttgttggagggagatggctcagctgaaaataccatggacacctcctcttaatgcatgtgctgttacattacttgcgcatgctagagagagtttttcatgcaaatgcaagattaaaggaagtcatactatcgtggggttatggaagcatgagtactggcaggtaatcaggtgtcaacagaagagtgcaattcctctcttagctggcaaagtgcataattggcacaacctcaagtgttcttggtcgggtggaacttttatagaggttcaggtttcagttttcactctctggtctgcagagtataatgagctccaactaacaatgcatgcactcaatccatccttttgccccagttcagtagttgtgccaatggtgtgtttgtgtagcagatcccttgaaaaatggatggcttcccatgacaaccgacatttcttattggtgaagactatggcattgtttggagatgctacaaattggacattacagtgtgagtttctctctagtgcagtactgcaatgtctacagcctactatgaagactagtgactggtatacaaagagttgcacatattcatgggtatcactgaactccaagttaattaatctgaatgaagtgattccagttgacatgttacagctaccaacttcagatgaggagtttgtaatatggcccagacccattggatggtttgcaacaagtgatcagtttgtcgatctcgggttgggctattcttcttatcatctagtcagggtaataactacggttgtttcactgaagaaatcctggttgcgggaaattattgaggagctttccgaaccaggacctcaaggacaaacattgcaaaggcaggataacaagctttgggagtcactattgcttaatgatcatgatacactatgctccttgcaactaatatggaatcctggaggcatcaaaggcatcggcttggggacaagccgaaactaaaggaagggagaatgccacgtcctatgggccgggcttcaggcacggggctttgatccagacaaacagggtgcatgcctttaaaagagaaggaacagcaacatatgaggcatcgatgaagaaatcaacagaactgaagccaaggcttcttcctcctccaatttcctctcatctctatgttcttccaatcctaggctctccaatttcctctcatctctctgttcttccaatcctaggctctgttctcttattcccagtcccccgcttctcttcccaatctacattgctaattcctctcaattgtatccaaattacttgagtgattactgctgtgaattatcggttgcttccggtgctgggcattgatcagtgggtgggttgaggattgtgacacgatacctcaagatatttttttataggaccggagtaaaatctctaggagtaaagttgaatcgatgagaagaattactcgtaccacgtcgatggatgaggtagcgaacccggtgtcccacgtgattacactcacgagcgacagggagtatccctctactgtcgtttcgtcggcgtgcttctgaccatataagacatataacttgggggtaaaacaaaagaatagctgtaacatatgccacgatatggatccgcgagcattccaagctatcatagcagaattgccattgctactcctacagttcgatgcacaaagtctaaactgaaaatatctttagttacaaaagtatatatactctggtagctatcaccagttttacgaccttttttttttgacatgtaactatgaatcagagaaaataaatttctttacaaggagaatcgtcccagaccagccgccgtcacaaatggtgaaaaaaaaaaacaaatactactgcacaggaggtttacaggcttgaactacaaaaaatcaagatcgccaagcggccacacagcccaagagaagccaatacaaagtatgtataccattgcgacatctgcaaatctcacttctgaatatgcaatatgcaactcaatagacttgaatttgcactgcccaagtgcccatctcgtgtgttaactgtgaccctacaaaagttgggcggttccaaacgggttggcttgcgggtgcatcccatttgatgctgggaaagggccgaacccagcatcgaggaaggggttgggtgcctgagcaatgcctgcatgctgcggctgtagtggtggcccgaagggatttggctgcatcatcataggcatctgctggggctgctgagtcatgctagccatttgaactgatggtgggggagctacttgattcgacatagcgaaaggatcactcgccatgaaagggttgggggcagctgaaccatacagctgctgctgctgcatctgctgcctgtaggttccctcgtcgtataggctgtccagaatgagtttgtcaaatccaccaccctgcagacaaaaacaagagaataaattttggcctgatcagctagaccaataatggcaaatatggagtaaaaaatcacatggttactgaacccaacccgaatcactcaacagttcaaaattttaaatattaccattatgagatcataagtataaaagtagaacaaattgtaaagatgccaactatcagctcagtcattaaaatttagaagcaaatccaaagactgtgtctatgaaaagcgtgattttcacctgaaagttgagtttggggacacttttgcccaaataaattgaaaacgcaaaaggaaaagtccaagctcaaagttaatcactattaggatgagatattgcagaatttgctagcataatgaactttttctttgagaagcagagcatgtcagcaggtctttcatggacttaaccttaaccaagtttgttacaaccactttctagattagcccaagactccatgaggtccattaattctaggaaataaatcatttacttgcaattcacaccaattacaaagttatcattttttctcacttaaatgctttctgataaacagatatatatgagtagttgtgctccctgttttcaccaacaatgaaccagcaaagcttttccagccagattgatttgggagctatggctaaaaccccgtccgatccaaaaccaagacaagctggcaggagccactaacagcagaataacagtttccaaatccaaagcgggacattatactaaccataaatatcctcagagaaagagtaagaaaacccaccaaattactgtccatggccattgagtttgtgttggtgctcggggtagtaacaagagcaagttcccatcctgtagggtcaaatcctttatcttgcagtgtagctgtgccacttgttgacgtctcaccacctgttatattgcacacaattttcagaattatctaacacaaggttcatgataggcatcactggattgaaggatgacaaaatacctgtaggaataatagccaaggccaaagcattgctttcctctattgctgatacactaggggttggatcgcttaatccctaggagcatacatatcattaaattgtgataaatgaaccagtgcagcatgcagtaaatggtttcttctacttaccaataaatcaccggtgtctacgacctcaggtttaggaggtggtggtggaactacttcagtagatggcactgcaacagcaggttcttcaatttgtggtttttcctcctcagcagaaacaggctcaggaatctcttctgattcttctggtttgtatgtcaggaggagtctctcaggaaactcctggtgaaataacaattattaagagtttaagaatccgttttatagatcgaatgattattttagtacaaatcaacatgtgattattttactgtggtgacacaacacatgtgattcttcttttgctatggtttcaaatttcaattgaagataaatattgcacaaacatcatcatcagggctgctgcttgattattataatataaaggaggcatatcgaaacgtagaaggcatttttaaaagaaatagcaggtcattttaactaagaactgaccaaaggttccttaattggaaccatgcgtggagcctctctcacatactcctccatggtcgaaaggaatgattgtggtggctggaacaaatatagaaaaagaaagtgatgacaatgatttatctgattctgatttacaatacaagaagttgcacagttagcacaaaaatacttgcctccctcagagtaggaaactggaaatttcttgcaagttctaatccccgacagttttcatagaagtccgataggcttccagcctagagcataacagtgttatttctaccattatcatcatctttgaaataccacaaatttcagataaccatccttcagaatcttagaatcacctgctgtccagctctcctgtaaatttcaagggctttgagtgcttcgtgccttggcatctcaaaaaactgcatcattttcgagcaacaaaagaaaatattagtatgcacaacttgccagaacaaaaataaacagtatagtgctgtcaatataaaaacaaattaccttgtcaacaaggttgataattccatcgtttattgcacaatagattttgaagctttctttaagaacctgtgcaaagcaaggagattcactcaacttaccaagttaaactaatataaaattaaattactaaaactatcaagaaatttaattcataacactaactggaaatttaattcataaaaggacagtgatcgtttttgttttcttatgaccagaatgttattacaaaaaacaccaaagaaacttttatttccttatatgactaaggatatcaacacaaaatagaatgccccaaaagatttaaattctgaaaaaagaactgtccaaatgtcctaagatagtatatagatataaaaccattttaacaaaggaaaatttctaggaatgtactctactaaggcatcaccacctgatcatagtttgctctacaaaatattgcaaaagatctgtacaagcaagcaatgacatgagcaaaaagatagcacagatacaatgttgcacaaaagatgcccttattctaagaatagactctagtccagagaaggaactgctcaattatatcagtaatagcaggatatggctcttcatcctgacaaattatgaagtgccaaggcaaccaagatgtttgcaatggagcgattgggtaataaaaagaaacacatctgcatccacaagaagaaaaacactggtgtaaaagaaaaaacatagcttaccagagctagagcatactgcaccaaataattgctatttgcagctccttctggctgcataagaagaaagaaagctgtcaggttatcttcacaaaaaacagactggaaaattagattttagaatgtttatttcccccattagtccaaactggcaaaagagaaaatcacccgacatccaataagtcgatagagtaactgctgcagtgctggtaattgctccagcaagtccggagaatctaattctctggttctactgtggccctgaaaaagtcacaatatgaagaattcagcaagatagaaaccaataattgacaaaatgttgtaactctaattataatcatggtagctaatttgactacaataaccaaatgagattgataataaccaaaccttttcaggcccttgaccctgcttcgacaaacgctcagcttcaatatcgtactttaagaccctgaagcattccagtctttcctccaaaaacaaaccgtatgtacgaacccatgaagaatagtcccaagctggataaaaagttgtattagaaacaatgggaatttaggaggtgatactaaagaaaattgatgtgctctactaaccaacaggggtggagtcatccttgaagtttgataattgcaaaatccgcactctttgtgtgaaagtaagaaactcttcacggaatgtaggatcaccatcccggagaagcctgtggatcaccacaagtgtcttcagtgcaacctacatagtgcatgaaatgaatgttacattaattggctccagatgtggaccagcgaatacttgcaaatagaacagaacactgaagagtgtctgaagtattgctgatctgctgttgaagtggtggcacgaaaaccataaatcagaaaaacttgtttgggaccaagccgatttactccctccgtttcacaat

SEQ ID NO: 69572 - DNA, 2397 bp, Oryza sativa
gaaggtacagatatcttaagctagttattgttttcaatttgttcccttattaatactacacttttcatatatgtaggatctgctgttgaattaggatgtgttgattaacctgcaattttgttcatagatttaatcggatgcagctattcctttgcttttatgtgtgtaatagtttttttttacattggcttttgaagttctgatactccatattcttgaacaatacatttctgatggataaaataaggtgtgtgtgtatatatatatatatatatatatatatatatatatctttgttacactgaaaaaggttatgtggccttgaccagttttgaactttacttgattcgaattattcaggagaatgatatcatatgacttgacattgctattttgaaactcttcactaggaagatgtttatggaagtaaggtgttgcctactgtaggagtaagatgtattagtgattagtggatggtatctatgtaaagtagataacacatgtaccaaccatttcaagtttttaatacttcccgtcagtccttttatttttccagggcatcccagtatttgccattggtgttggacagagtacatatgacaaagcttcggtaattgctcatatacttcttattgctttctgccctgtagttaatgaaatacagacttatgagttcctatagcttgtcagatttcatccttgaaatgtctttctagtgaattgataagtagatcgcacctcatacctttctctctaagtacattattaatgatcacgcgttcatttacaggttcattactatgtgcaatctcatattcaaatcaatgagtaccgtgaccgtattgttttggtgagtgcactactaatatttcttgctcaattaatagattgtttatatgagttttcttcacacgtatatttgctttcttatgttccatctagcctatggcatcaaagaagtttgggcggcctattagcacctgtataaaggttctagatatgactggattgaaattgtcagcactcaaccaaatgaaggtactgcatacatggacgtggcatattcaaatgtttaatttctgtataagatctgcatatcatgaacaattatccattatttgtgctgctagtgattagataccattgatggatgacagattttgactgcaatatctactgttgacgatctgaattaccctgaaaaggcagagacctattatatagttaatgctccatatatattctcggcatgttggaaggtacagtacctaatattattttccctagtttttcattagttctttattttgaaacataaaacagttcatttggtttcgctactaggttgtgaagcctctcttgcaagagaggacacggaagaaggttcacgttttgcatggttgtgggagagatgagcttctaaaggtaagattgcttgcaattactaatattcttttcaaattgctatagttatgtttactctggtaattcattgctgggcattatattatcgcattcctatttaaaagtcactcacttaggagaaccttttgttccatggaacttgatcataatattcctatcattttattcttttgcattcgcaatactatgatgatcaacgcacgcatttctgtcaaaactacgcagattatggaccactcctcccttccccatttctgtcagcgggaaggctcaggatcatctaaaaattcgtcgaacgacgtcaacaattgcttctctctcgatcatcctttccaccaagagctctaccactacattgacgagcaggcattgaaccaggagctcatcaagcagggctccctgcatgtgaatatccctgaccaagatcctgaggatgccaagatcgtcgaggtcatcgaagccgagttccataagctcggcgagcagaacggttctgtcaatggcgaacacaaagaatgaacaggtggtcgttgaagatgatcagctgccatagcttacctacaacacctttggtggtttgcttctgacgattcttttctgtgtcgctgtgttggcatggccacccctgttgttttcctgggctataggtgttacagatttacaatagcacattcctgcagttgtccatgatgcaaactgaggaaagaacttggtcacggtataccagttgaaatagtcagacataatcacctgtaaacttgcaatgcactatccaatatctctatatatgtatgctaatcttatctgataccagggaaatcatatctgaattctgaaatcatcttcagagaaaatgtagtactgagtcggtaacaaacgatacattaccagttcactatcaatctgtcacctaaattctcatatgattttgtctggttctctgctagaaacttgtggtatttatatattttt

SEQ ID NO: 69573 - DNA, 925 bp, Oryza sativa
ggttagagcccgttggatgcatgatcggacggctcacaccccatgcaatttctgcatgtgaaacctacctagaacgcctattcgggaaactcttctcatcacggtaaattcagcaagttcaggcaacaattgagcatttgggccagtgacagcacaccattcgcctgcgtgctagtattagccagtcaatgtacagcgatggccaaaaaaaagaaagaaacgggagagatttttttttctttttagcaactgctgtgtgctgcttaaaaatggggctgcgaaaaacctctcgcggttagcagcagcacgcacgattcaggaaggaaacggccgcgtttgctttgctgctccccataactccctgcagtttaagcccctccaaaacggcgctttcctgctcctttttcttcttgtttcttctccttctcctcgtcggcatcctggtcatcgtcctccttttgctttggagactcctccccctttccttgttgtctctcttgcgggatctctacgtcagagctctcgcacctctctcttaagcttttcttctctggccgatccttgaagcaagacgccggtccatggtcggataaggatttcagactgctgccctggtgccgcgatcctacaagcttgtgtgagttatctttcagtggcatctttcatgtgcatgttttttttttaatcttctttgtttcgatttcatcttttggtttcttgtttcctacagtatgttttttgtgtttgatggattgaatagttttttagtttatttcgttgaattatttggtgtttgaatatgttccgttcagatgaaaagtactgaattgtgcagtgttgatgaagttttgttttgctgattcgatgcttctcggttcacaccaaaatgttcctaaaatggttggaggctggaagaaacagatgg

SEQ ID NO: 69574 - DNA, 667 bp, Oryza sativa
cattgtgggtagagacaataactgctactgggctattgtgctactgccggtaccaaaataaagaacaatatttttttagatatgtgaatctttttgtgctagcatggttagaagagatagtttaacaatgattctttttaagatggaccccaccttaacttgcataagagcaagtttaatagtataataacccactactatctccaattcatctatagccaatctaatagccaataattgcttactacactattagtatatggttccacctgtcatacacacattgtgtcttggagtccatgctgcagctggctacagatctgtagcccgctgctcttctctctcatcttttatctcattaaaatatatttgtagccagctaataatttgctattgtacctgctctaataggcatagcacattgtgagctttgtaataactgttaccacctaaacccttggcccacattattattagtttagtaggatacattacggttgcttgagaggtactaccaagaagtattaatatctgtagtgcaaattttggtattttttaataccaaagataataagagatactaaattttacgctataaaatgtggtatcttttggtaccttctaaaaactgtaaaaatcattcattagtaatacgtttgtctataat

SEQ ID NO: 69575 - DNA, 510 bp, Oryza sativa
tagtccatggcaattagaatagcatacagattaaatttagtgaagagcaaatggctaattcaaagaccctgtcagaaagaaaattgtagcctgtaaaactaccaagagagcaccttcaaagaccctattgatgagtcagtaatcagtacatatatgagaaaggaaacaatagaacttctatgttgtaaaaaagcacaaatgcattaaggatctgatttgcaactagtagagatactgccttcggagttagtaaatctgaaagatgttttaggctacaagcattggttatcctttctaacaaaacaataccaattgttcagcttataaagtgcacactaactattgggtatatatcatgatgatggatatagatgcaaggcatggcaaattaagtcagagaggcaatatatacacaaaaacatgttgcatcatgtacaaattaagtacctgctcgctggttagtctttgctgtcttcttgtgtaccttcttttgtagctgtacattattaa

SEQ ID NO: 69576 - DNA, 2706 bp, Oryza sativa
tgcttctcgggccagcggccggatccgcagcccacgataccttcgccctccgcatccggaagacaactcccatattcccaagccgatgtgattatcggcgcaaaaatctagtagtgagctttggtgctggacaaagcaccagtgagtgtgagttgtgcgatacagctagcgttgcttgcgtccattcacttactctctgcctcttttgctcatttgcatcaccatccagtatcccttagtataggctcggtgattttggtactcgcctgcaggcatgcatgcatgcatcctacttgggtattttcctctctacaagttcaacgaaagatctaaagagaaccaatgatcctagggaagacactgcttgattttctttgctgaaaatatctcaacacgtgccttaatttagcaccaattgcaggtaattttaaccagttctttggtgttctaaatggaaggagtataaataaaggacacgagagggtggttcgccgcggcgtcatcggccgtgacgcgcaggtggcggaggatccggcaggccaccactcactcgcacacgccgcctcctctcctcctccgctagttagcgcccctcccttctcctgatccgggccgatggccagtgccgtccctcttctttctccccgggttcaatggatctggcaagtctgtattggcacgggcgttctcgagggtgactcctgtcggtgagatagaagcgttgaggaagggcggcagcatggcggcgggaagcacaggggagggcgaggtggccaggcgaatgtgaagaagacgagcccaacgccgttgagggagaacatgaagcgggtggtcggccgcaacgcgcgggtggcggaggagccagtggattagggtcgagcaattctgcaaataaaaaatacagtaactccgtagttttacgatgaggtccaccgcaacgaactttagccgtcgatacttaatcaaacggtgcaaaaggagtgccaaggagacacgtggccaggtgttactggtttcgggccctacaatcggtatataagatttgtcactcttaggagtgatgataaatgatttgccactggacccatatgtcatagatacgtgagggctcacatgttatagacagcgagtggcagataattaattgccacatcttaaaagtgacgaaaagttaaatatccctctaatttcacaatcatataaacttttttccaaaaaaaaaatattacagttccttacaagtggttgttggtttggacacttttccaagcttctaccgctatataaacggtgtgttttcttaaaataaatatataaaatttgttttaagggtgtgtttagttatttgggtgtaaagtttttaagtatacggacacatgtttgaagtattaaacgtagactaataataaaacaaattatagattccgcctgtaaactgcgaggcgaatttattaaacctaattaatccgtcattagcaaatgtttacagtagcatcacattgtcagatcatggcgtaattaggctcaaaagattcgtctcgcaatttacatgcaaactgcgcaattagtttttccccacattttgtcagggttatggataccacatacctaatacatacctaatagtagttgactaaatctcggcaggatccaccacataccatgtcttatacggaaactgacctcgaaggagttccagataaggaaagacaaccagagttctacatggaaacgacaagtactactcgaattatatccatattggtttccctagttctacttggacaaggggacacctatgggtataaatacaagcccccctaggaggacagggggacagacatccaccatgaagggatcaacacccaacacaatcgacatagaagccacaacatagaagcctacatatgccaagacacgccgccggatatcgacttcagggataagcacggtctgacgctgtctgttatacaatatcaatttttatacaatatcaattatgcgagtgtttccgatgttaaatcgactacggtctgacgctgtctgttatcttctgtataaatcatgcttgtttacggtttacataatgcctgatatttacatctgctcattatatcctgataattctagaagatccatgcagtttttcgaatacatactcgatattctctgctatatatcctgccttctagaaaatatttttcaggaataattgagcactcgagtaggtcgtggtcgagtacaccgcattatcgagaacgatctcgacaaatgcagaatcgtcgcgcccaacctaccaacgaagaccgacaacctatctcatagcaccggccatcgctggattactcgagaaaaggttgttaacggataattcctcgcgaacgccgtcggcttgatcacccgacatgattgcgaacggacatccggatatgctacaagttgtgtgtgagagtcatgctggccacatgatatgcacatgtaataaaccaactttagcgcccctataggtgattaagagactcctactcctggttctcgaaccagtaagacgcagtgatctctctcgcctcactttaagtggtcgagttacgactactgcctggtcctcgaccaacgatgtagcgtttctcccactacttccacgttaagtggtcgagttacgactactgcctggtcctcgaccagcgatgtagcgtttctcccact

SEQ ID NO: 69577 - DNA, 1678 bp, Oryza sativa
cccgccgggccgcagccgcctccacaccgccgttgttcggggagagggcgccgcgccgttggttgtgggggagggcgccgccgccgccgctcgcgggaagagaggcgccgtcgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaattataagttattgaatgtgtttatttcgaagcaaacctaaaaggaaggattttctttctttttccaagtaaataattgttaaatgacgtttgtattaataaaattaacaattaagctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcaacgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtggtcttataagtacatctattttctctatctatttaatgcttgaaattatggaaatttacccttttattcatatattaattgaaagcagcaagacattgagatgatggacataagttggaagacgaatatgtgcgtacaaattctaaattccaaccaaccaatgtaatgaaactacttattttccctccacatgttccacatgtgtataagaatcgaggaaatccttttttcaaaaaaaataattttatcttcttattccttaaatataacgttctaagtgcataacattaaaaagttcaagttacacagtaaaggaaactaatgaattgattatttgtttgaaaatttggtactcaaggagcataacgtttgcatcaagcgggagcaaaagatgtcggtagcattcttttcccaaaattttaccttaattttcgttagtacacttttcaaacatcggtgtgtttcatgtaataaaaaatctatgtggaagttgctttaaaatatcaaatatatcaatttttcaagtttgtaataattaaaacttaattaattatatgctaatagttatctcgttttgcatgtccgcatttaatctaaatcttcgtcagattcgaacacagtaatctcatttgctagttcattctatcctgaataaaagattgcaaagaggcctggcttttttttattattgtccttcccagtccgcagtccccactcttgagtctcgactcctccgctgctctccactcatcaatctgctcctcgctcg

SEQ ID NO: 69578 - DNA, 993 bp, Oryza sativa
tggctgcggtctgtcacaggatcaccttatctgtgatgggccaaaagacaaagctgtcataggtgaggcagtgacgggttttccctccaacccatcactggtatcacctcacctgtgacgggccgcgtaattataagccgtcacaggtgatgggccgccacctgtgacggatttgttttctggccagtcacaggtaggtcgatacttgtgacgggcaactcaatttaagcccgtttgaggtatgaacaacacctttcacgggctttgtgtacctaacccgtttgaggtgtgttgggcctataaatactccccaaactgccaactgctttccatctcgaccagtttactgtgcacaaatcggttgggagggtagggggggcgaatttttgctaaattgaaggtaaaaaacatattattctcccttcattctcagtcgatcatcatatatttttcttcctatgttgttgatttcagatggaccgtagtacttgaacatcactacaatgaaactcaacgacacgcatactcgttctgctgggagaactttctgcactgggctgcataaaccatgtatgagacccgcatatgggagcgacacaacaaccacgctcctcgccgttctcccccttctctatgccgctgctgtctgtggcatgttggatggagaggtcaagagccatggcggaggcagtgtaacacgcttcagtggacagaggaggaagaagattattgggggaacgattgtgagccgctagatgagattggacggtggatgtgcaggaaccaatgttttaaatagcgggctaagccatttagcggttagcttcttaaacagctatagcgggctaaatggagctatagctgttaaattgtacatgagagcgaatagttagaacccttttcaaacaactatagcgggagatagcggcagctatagcgggagatttaaaaccctgcgaggaactgcacgcctctgacgttgctcttgcacgt

SEQ ID NO: 69579 - DNA, 4946 bp, Oryza sativa
tcaccacccctccggtcgtcgtcggccctccggtcacctacccgacgccgccggtgacatacccgacgccgccggtgacgtacccgacgccgccgacgacgacgccgtgcccgccgccgccgccggcgacgcagaggtgcccggtggactcgctgaagatcggggcgtgcgtggacctgctgggggggctggtgcacgtggggatcggcgacccggtggtgaacaagtgctgcccgctgctggaggggctcgtggagctggaggccgccgtgtgcctctgcaccaccatcaggctcaagctcctcaacatcaacatctacctgcccctcgcgctccagctcctcctcacctgcggcaagaaccctccccccggctacacctgctccatctagttcagccgccattcccctgcctcgccatggatggcgcccaagctcaagctcttgtttgtaagtgtgttactctcttctcccatcgcaaataagcgtcagaaataattttgctatgtgtatctacttgtggatttagaggcaggatttctatccattatttaataaaaaacgtcagaaataattactctctctcgaaaaaaaacagataacttttatacgtgaatcttgaaatggcaaagggtatgtctagattcgtgtgtaaaagtttttttttttgagagaggaggtatatatgttgtctttgatttgatactgatatagtgtgtttttttgatggaatatgcaggttggctactcgatctcggcttattgatgtgttaatgatgagtacgaggtgtattaatttattgttggttttaatttgttagtgtgtggaaacatgagaggatgtcgtctgctagctagctagaggaacggatcaatctgctaacgatagattgatgttcgtattgctgtgttttttttttaatttgtttcaatgtttcagcttaattgcatgcttcctcttcttgattgtgtggtgtgatcaataagacagcaactgttcagaaattgtttccgtcaagatcgtatcctatcaagaaattaattaataatgcctgcagcctgacttaagcgtgtaatcctacatacttccatgtgcggacagtgcatgcaatctgatgtaataatgtgtcggatctaagcataatatgtctgagattaatttaattaacctgttttcttcagacagatttatttgtggttgattttggcactgatattgggagagaacacacgtactccctccgtcccattttaaacgtaactatagatttccgtatctaactttaatcgtcggtcttatttgagaaaatctaaaatctttaaaaaaattaaaaaaaacataagtcacttatagagtactattcatgttttatcatctaataacaacaaaaaatactaattataaaaaaaattttaaataagatggacgatcaaaattgaactcgaaaacttacggttgtgtttaaaatgaaacggacgagtatcactcatagaatagttgtcggagctactccctccgtaaaaaaaacaatcatgagtttaaacctgaacacaatgagttgggttcaggtttaaactcaagattaggttgtgtccagttttaaatttaaaattggggttttttttttctttggaacggaaggagtagctaggagagctagctagcccttggatcgaaaaaatctcacatgcatgacattgtgagctgtgacatattactagcaaggagatctagtatagtcaagtacggtcggatagcgagagaaaactatactgtagagaatactttgacgactgcataggagccggaatgctcgatcgatattctgcattctctggagggtaaccgagaggcatgattggtgcaaaagtgagggcaaagcatgtgcagactccgttggcagtatgccgcccgtgagcgaatactgagcagtaactgagttgatgtgatggacatgtaaccccgtgtcattcttgtcttctgtttgtagtagctctgggctgtgcatgaaacacggcaaatgggcaatggccatatgtgatcttaccttggattttatactgaacagactttgaaaaggctgctcgtgagtgtactggccaatatataaagatagccaactgtgtaaatacaagtggcttgaaatattttgcaactaaatttccatataaaatggtacttggttcttctcacatgatcactagtactcactagtgtgctgcttgcagaaaggcaaggatggaactgcacagttatgagtgcagacatgacacaagtgactaattgagttaaatctatggattactctctgtccccaagagactcaaatcttaagaatgatagacaagcatgtgtgtatacattcatccttacttcttccgtcttaaaaaaaaataaaaaaagataacctaggtggtggtttgacacgagcaacatagcctagatatgtcattgttcatgttgcacaggagaagcatatgttttgcccagtatggaacgattacaccttccaatttccaagagggcatctttgaataatctggtacagtagcgcacaagacacagagaaaagaactcactaatcaaggctacaaggatttcaccaatatggccatcggagagcatctaaagctaaagctatacacacaccaaaatgatctttgcgaacatcagcgagtctcttcatctcttgctatctttcttttaatttatttacctggcggggtttcgatgcggtccttgatgatcttctcaccggatctgccttctcgcccttgctactggtgctaactttgtttggttcagcagtctcaccatcatcttcactatagtcactacctggtttctccttgccaccaccatttttccttgtctttctggaaagggcacctatggcatctctcttttgctttcccctggcaaccctagaagttgctcctcgcttctttgtattcaaattatcagcatcttctggatctgtgtctatttccttcgcatcatcgttctctgccacttgttctgggttagcaatgactactttgctagattgcattccagtcagcttctgcagttgtggcacgtatgctgtagtctaaatagtgagagtacaaatcagagggtagatgcatgaatgttcgtagcactagaaagtgtagtagtactgaagcagataagagcttaccctgccaccagctgttatgaactcaattttctgtcctgcaagacatttaaagtagtgggtaataattaacatgttcgattatacaccatcatatatcagcaaaactacaagcgaacgctttgctcaattttattcaagacaataacgagttcatgataaaacttgaggacaatctcaccattgactttaccaggcttcttgccccatcggtgatggaataaccattccacaggaaagcagtcacaatcagcatcaacttcaacagcatatttcacaacctgaaatatgctttatttcaggcataagttctccgtgattgtacatcagtagaatacactaaaattatttaaaataatgtcaaattacacaacctcttggatgctttggtgtagtgcttcacaactctccctggatagacttgaagcaatctgtaatggatgggttctcgactgaaaaaacaacatgaattcataattaaaatttatgcatttcattcaagctctaataatatttgtattaatacctggtaaagcacctcatctgcaatccaattaccaattcctgatatgaagctctgttcaataaaaaaaaaatcaagtcttctgtttgtataggagatacaaggacctaatcccgtatattgtagaaacaattttgtggagctaaaaactcatattggttttatggtaataaaatcacctgatcgagtagaagagcttttattccaatcttctttctgctcagcgagtccgcaaaactgtcagaagacatcggctcaaagagagcatctggtcctaactcagaaatcgggggtacagtttcgggctgcaaatcgttatttgattagggacatcattagaaaataacatgaaaggaagactctgaagatttagattcaactagtcaaagcacatacatcttcaaacaaccgaactcttgcaaaccgcctcttatcagtgaaggaaaactctaagccatcatcaagctggaacaagttaaatgcattagaaacaaccaacattaaaagagccaacctatgatatcataaaaggacataaacaataagaggagatcaaattttgactaaacaacaatgcctaggcatgcattgcgtgttctattactattcaataaaccttatatagcagaagtaatattgacgtgtttatatgatagcatgttaaccctgagacatggcacgtcttcctttctggctttctggagatcacaaaagcactactgtttgtggcgatttgtcttccgcattttggattagctagtccgctagaggctcagccaaaacatgttttctgagctatatagcctaacaaatcgatcttgtgtcccagctaaacgatgacagttactacctatccatctctctctttataagacccaaccaaagtagtacagtacagtactgatgaacaacaattccatatcccctttagcttataaactgttaattttgatctcacatagcagcaatgtactgaaaaaagatgctgtgacagctaggagatcttacttgaacaaaaaatttggagtacttggagggccactcgtctgtagaactgacaactgatctgcaataattttttgaatcagcatgtagtccattactgtataacaaattccccagcatacaaattacacatgcctcttgtacttggtcacaggaactcccttaatgtagatcgcgcctgccatccctgcaacacacacagcaatttgtcactccaatttaccagtagcaaaaagcaat

SEQ ID NO: 69580 - DNA, 1516 bp, Oryza sativa
ttgcctaaatggtgaagatatgattattagatatcgatccgtaaacaactgagaaatatatagattatcgagcattagaatcaacatttggataaggcctgctttctaaattaaaattcatttactttggaacaaatggaatggtagtaagggcttttacaatgcatatagatgtcattcaacatcaacttgccacataaaagatttcacgtcattcaacatcaacttgccacataaaagatttcacatcacatctgcttctcccattaccaagtgaagaatggaaatcccaaatgagacacgagttccttattaatattcatgagggatttttcagggagggggagaggaacagcgagcgttgtacgttgggagaagtgttgccccatgcgatgccctcataacccgttggagccagcgacgatgagctgattcgaggtggtggcggtcgtcccgagttgctccactcgtggttgtcactgatcgaggcaagcccaatgcctgatctagcgagctcgacgaggcagcgacgatagcctagtgagagacgtgcgcgggtgaggagaagggaagatggaaatggtggacgaagaggaggcggcggatctagcgtttaggacctcattgttgtccccattccgtactgtcaagctcgttgttgcccctcgaaccaaccgatgttatcgtcgtgatcgacctatgaagaagcagctcgacgacgaccgcctcgacctgtccgtagccgctccgtcggagctgccttgacctcctcgtcgcttcttttcgtcgtcgtgtcaatctcctcgatgttcacccggttcaaggcgatggcactagggagctcgttgttggagatgggggagggacatcaacagcaattttaggaaaggaaaaagcgactatacctcccactctctgccgctgagctcatagtagtccacccttcccacatcaccgagctcgtcgacgcgccgattagagtaggagagccaccgaacagtcgtgggccatgggaggacgagataagagctgagatgcggtcactgccgtgggaggagtcgaggagagaatcgagagagtgacggaagaggggaaagaggggattttattttttttctagattctggtattcattgttaaattgtgtacttccacacaaattgaaataaatatgagagctagaatagatagtagcaaggtctgaaataaaaaaaacaatgccattcctagagccacttacattataaaaagaataattttagacttatgaccctagctagacttcgtggtacagacgtacagtactccaaggctcaaatgaagatcctgcactgtgagtgacggtcactcacgttgccacacacacatgcataatttccgagctactagcactctagcagctgcaaaccctagagttcacgggccacaacggcgagctcgccactctatataaccacaccgccataaaccctagatcgatcgcacaaacacttctagctcctcttcttctcccccc

SEQ ID NO: 69581 - DNA, 74573 bp, Oryza sativa
  unsure (1)..(74573): unsure at all n locations
tagggcatgcacagtgtgatgacccggcaagtgcccccagcccggtgccacgtcgagagcctctatagtacaagagtgagcagtactatacatatacataaggtactacagatgaccgacctgcatccatctgtgtcgcagcacgatcctaaatgaaaccatgcccccacagagccacttgtgcctgtagaggacactcgcgcctcgtcaaggcgagggtggggggcacgtctcgcgctggtgttaactggctctctgttgtcctgcatgtggtcccccccccctacccccaaccccctcacatggagctcgagcaagaatgtggtagtggcgcggcaagatctcgagcagggaggtgaccatggtgatgatggctaagagggacgtaccaggaagatggtgaggacaaggaagaacatgacagcgatgatgacctcgagcttgccaatcccaagtcttcgcctcactcgcgttgccgggagctcgtcgccggcaatggctgccctgatttgcatcttttcgatttgttcgtcgttgtctcgatcttctcatcgtctaccatttgtgcccgccttgatctactcgtcagcaccccacttgtcagcgtcctgtcaacaccttgatctgctcatcgtcagcttgcttcgccccaaccctactcaaaatcgaagacaatggccgacagagctgaatcggggttcgtcaccgaatcttggttgttagctactctacaatctactccctctatttctagatacatggcataaagacttttatcctattgagcaaagtttaaggacaaagtaaaatattctctttcagttgtctcgtttatcaaattgtaaatttttgaattgcctgaattccctacataaatatctgattagctgacaatgcttggatctattttttattttttttctcgaatgcaatgtttggatttatgtgtattggaatcagtgttccataaatgtttatacagtacataaatttaactctcataaatacttatatttgaggacaaatgaagtaaaagcctaaaaccatttaaccctggtttgtccttccattttgttgttttgcttgtaaaacatgaacagatgatgtgagttggccgtttctcttgcagtgaatactttttgtaacgaatcggcgagtcgtcaatttcatttaatagagaagaagaaaactgtacatatcaaaaaagaaaggaaaaaaatgtacagcctcaagacctttggtccaagctaactaaaatgtaagcattgcaccgagctttttcacacccgtcaggacccacgttttggtctcctccttgattttggccagaagactgggcgccaagagctccttatgtgggaaggtcctacgattcctttcgtttcatatctctcaggcaattagcagtgttagtgtgtgtagtgcctttctttggtgcttcttttatgcttgaagtattctctcaccactctagcactatcgatgcttgctgccactgggtagggtctagctgaccgtatgttgtccaatccgctagagccgcctaagttcttgtgtatatgcaccctgcaaggaggtggagggccatctcctgggtctgtcaacgtagggggcagatagagccatttggctatcctcaagttgccaacctgtctgaggtctagactttattttggatggccagcctggtgtagtttgcacttatgcggtgcccaggctggtcattcctgggcaatctcatcccagcctggtgaagtttcaaatcagagacgtaaagaaacatatggcaaacaccatctatataactgttctgtactctataaaaagtagtgatggtggtaagtggtgatgaattggacaccatccccatcactaacactctatccttttaaaatgaagaaatggcatgtagagtcagagaatccgcatgtcagctatccctactacctactctctaattattatgggaagaaaaaagactgaggagctagatggcttacatatttgtaacaaatataaagatgtaaacgcaaaataatgatgggttgatgatacattttattaattaaaatttcattgcaacggacgagcaatatgctaacgtagaaagcaggagacatttcctgcgacccggctaaaaagagaaagcaggagaactacacactaactgttcacgagttagctggagttgtcatagttccagtcattttcaggcaagaattatctttacgctcgcgcgaactttattcttgaagaagcaaataaacacataatttcatatactgatacacaagaaagcctaaaccctttacattaggtaggctttatgttaatcacacagtgaaaatctgtggactaacatcatatcaggaaaagtaaattctgagaaccaacaagaatcttgtctgcacttatgaaaagcaaggacaaacaatgtaaaaaatactataacttggctagcttttacagttgaagtttagcaaaggcatttacacaagtactgacatagactagacaaaagaaattccagacatataggcttagctaaatagctaataggcatcttccttttgtatttcaggtaaagcagaacaagcaaaatgcgaattctggcctagcaaatgcgttacaacggccacatacattactgcaagtgtctaatgccctttaatttgacaacacattttaaattctagatatggccgatatattccacaatttttgtctctagatacaatatttaaggtatcaatgcataacactttgtccactcaggacactgcgtatgacctctgaaagttgcaaagtgtcagctactcagcttaccaagctgaaaacaagaccggttttactcatcttttcctttttttaaagcacaaagtacaactgctttattcccttgaaatggggaaaatttacagtagttcagaaggcactgctgcatataagagatgcagttgacaacacttaatcagattatcttgaaaacatataagaaaataacatcgcacttgcttgcaatagagaagaaacattgaagattttgttgacataaactttcattggccagttaactcaaaaaatcacagcacctcgttatgttatgtgctctgcgattctgagaacaagattgtcaagactgaaagcaagcccctttttttttgcggggaaaagcaagccctttgatagtccagcctttttctttagaaattttatggttgttgaggaagtacctaaattttatattagaaattttggtatctgaaagtaccaagttttataacatttctgtaccttcttaaaaatgataatattaccctttccgagagcaaatatctacattcaaactgtcggcattatttgttttgtcgaattgtcgttattagtgccgatttttttcttctaaactcgcatgaagatgatagcgtgtgaatgcaaattggtaggcgtcattgtaaacaacccggccgactaataggaatcggttcggtgcaggtaatatattagtaccaagttggcacgaaaaagcagatactgaaatggtaggaactgtacgcgaagcatatgctggtgctggtgatagaagaggtggtggttctttttggattctcattgaggcctttcccctgtagtggcgcatggtagggctcagggtcaattgggccggtgtggttgtttgtagtgttcaccaggtgaaaagcttcttcgttagctaggtagccattgcatgcgcactatatatgcctagtactgtactgatcagtgttataacatgattgccatttgaaaagcgtcattcatgcttactctgttctaaaatataggtatttccaggttgtttctatttagttatctcagtggtcaaattttgaattttagtttgcttaaataacccctttccaaacacctgattagctataattttttgtgcattgaaatcagagaagaacacttgtattgtgataaaaaaataaattctaaacatatttatattttgaaacgaatgaattatagtatggaaatgcagtagcagcaagtagctaagctgctctactccaagcttctttttgacactagcatagcgacccttcaggctagccgctctgatagagttgcgtgaatctggttagtcatcgatgaggcgagggccctggtttttgtagtttccacacattcattctgttggctcacaatcgcagagaatattaagactttatgctcgtgcacagtataatatgtatgtagcttatatagggcattcggtccatcgtcttttacagttctctgatgtaacggacgaatacatgctgttgcaaggaataaggtaaggtaggggaaattctgagaataaagtgtcactctctagagaggcttattttctaaggcacaaaagagatgcatatgacttaggccgcgttctaaactgagtttgagctgagctaatctctcattgaacattagcatgtttctcaaactgctaaactatatattttatgctaaaacggtatataaaaaagtttctctaaaaaatcaaataaatcaatttttaaagtatacaatagataataattaattaattattactacctccgttttttaatagatgacgccgttgactttttttcacatgtttgatcattcgtcttattcaaaaaatttacttaattataatttattttgttatgagttgttttatcacttatagtattttaagtgtgatttatatcttatatatttgtataaaatttttgaataagacgaatggttaaatatgtgagaaaaagttaatggcgtcatctattaaaaaactaaaggattatatgctaatgacttaggagtacatcgcttttcatgcagctaactagctaatcctaacagctatatagaacgcaccctaaacagccttttggaacaactagtttcttgttctctgttagcacttcttaaactttgaaatagtatgtttcgtgtaaaaaatttctataaaaaagtttcttgaaaaacaaataaattattttataagattacaataattacttaatttatcatgtgctgaggcttgtatcgtttcacctgccgtcgaaaattttagcctaaacacttaaacgaacttagccttaccaatacaacacatccactacagcatatacacctccagactcctgtgcacgggaaagggtcgtttcacttaacgtgcacgcatataactctatgtcgcgttcaaactaattgtttcacaagagtatctacgagataaaacccaattacctacccacgccccaacacaaacacaaactcgatcatctgactatatattcggcttttctataaatatatttatgcaaatatataaacataccagggatataatagtattgttttcactttcattagctaagtgaataaatgttatttgttgaagtttgagaaaaaaagacatcatacattaaaaacagaactagtattaaattataaatgatgaggagatttttgtttatgtttagctagcttctcaaataaccatagaaacatagagaaaccaataaattaattagttttttaaagtgaagtggggaaaggaaagtgaagagagtttttttagactgttcggattgttgttgtttttttttaggaagtaggcccggggaagtaagaacaagtttaatagtacagtccactactagctacaaattagctatagccaatataataactaatttatacaatagttgcttactatactattaataactggtcccacctgtcatacacacattacgtttttggagtccgtgctgcagctgactacagatctgtagcccactgctcttctttctcttcatttatctctttaaaatatatttgtagccagcttatagcctgctattgctctaattgacaaaaaaaaatgcaatagtttgtccaagtacattcacccttatgtggataccaattcatcattgaagctacaccgaattttgcatattttgtaaattgggagcaatacattcctaaattcattttttatgttattcctgacgtcatgaaactctacaggtatagctttgcatcctacgggctcttctacagggttataggcgtttgccacttgaaaagaatcggaatataagatttcagttgttttgtgaccctttgttcagttaagttggaccatcaatacaaccaccgaatttacaacgtcactccactaaatcctaaaacaagacatagatcagcttcggtgccattgtccgtcgccagaatctgaatctagggggggcatccctgattcagtcctcagtgttgtgaatatgcagtgtcgcattccagcttgggtcttcgcagtctcttcactgcattgtcgtcgaacagaagtaagtggctacagccaagggcactataaatggatggtttttagtatgtatctctttttccttagtatgtcacgttaattcccaagttggcaagaaatttgcaagatgcaccaataatagccgttgaaactttgttgtttgaccacaaaaggccagcctaagcaaacgaaaacaggaatggttataaaaaaacaatactatgtgagtatgtgtatatgtatatcacgattaaaaacaatatagtcaattaccgaggatgattattaggtcgaaaggcatatctttcaatagaaacacatattccctccgtactcgtaaaggaagtcattttggacagcgacatggtcttcaaaacacaactttgatttttttttctataaaaatatttattgaaaagtgatatatgtatacttttatgaaagtatttttcaagacaaatctattcatataatttttacattttcaaactcaacaacttgagagttattcatgatttatattatcaaggtttgacttaaacattgtcctaaatgacttcctttacgagtacggagggagcaaaagggtaaatatcctctatgttgaatgtgtgtcttgtgctaccgcataaaaattctgagcatcggttgtcgagcgggccccatcaaatcatgccggctaacacaagccgacatggaggaggatccatgtcattcttcatttaatgtttgtagacttgaggtttgtacgcaccgggaactctgtcctgggcgctgcgcctcccgtcatcttgatgggacagggcatacctactgcactccgcctgagacccgagcggaccgcacgtggctttgccaccgtcccgtccgtcggtcaagattcggtcaagcgagcggcaggccacatttaatgtggcgaggcacgctcgttctgcccgcttcgcccgcactaaatgcgattaggtgggcgtggagggggcgtccacgaatcgtctttgcatggtggccatgtggtgaccagcccgagggttcggggccgacccctcaggttaggtacggacggcttccactcgttcacaggcgcgacccctcggggtgagtgccacgtggatgccaagggcgactcctcccttgtaagttcggtactcccggtaaccccgggcacatatcaccgacaaccgtcttatcttttaagacaccaaatttatatatacctatatacttataaaaaaatacgtaaggcttccgtttaggtttttgttagtcgtcgttcgtcactccgactctatccgcatcacgttccatcctcacataattcttttgtgtgtagccaacacccttgtcgacagccaatacgaaacagatactcccaccgtcatattttaagtgtagctgttggtttctctgcttaatgtttgaccgtccatcttatttaaaaaatataaaaaattaaaaaaataagtcactaataaaaaactactaattatgaaaaattttaaataagacgaatgatcaaacgttaaatatagaagctcatagctgcacttaaaaatacgatagagagagtacaaaataggatcagattctggttccaaaccaggactgtgggctatttccatggattctgctttgttgatcgagcccacgaggactagacccaccacggtccccgtttggaaactaaaaggctgatgagaggagaaaaaaatggggaagaaacgcaatcaaagcaaagatttatttactaagtacagtcccaaccctccacctaaaatagtttctatggcattaactatattaccatgtagaacttttagtttatgtggcactatattaattaagagagagagtgaagagaggaagaaactgggtctcatgtaagacccagcttcaacacaagaacctatgcactaaacactatcaagttttgcattggaaaagagtagtgtcttcataatagatgaagaattaatatgattgatagaaaagagagatgatgtatttattaatggcccactttaagaaatcatgggttgtggagtgtggtttctattgtgatgtcttattgatatggcaccatagacactgcttatagacactatgggttgggactgccctaatgagtaacaaatccatacacctgcagtctcctctgccacatcttttgacctcctaatccaccttctatccgtattccaggccagcattctaccacattagattgagtgattaggtagagaagaaaagtgaagaaagacgatgagccacccctaaatcaagaggcaacctccacataaatttcaagaaaagtgtgagagcattagagatattggtatttgtgtactagagatgatatattgtatggattgtctcttactttcttcgtttcacaatgtaagtcattctaacatttctcacattcatattgatgctaatgaatctagatagatatatatatgtctagattcattagcatcaatataaatgtaaaaaatgttaaaatgacttacattgtaaaacggagggagcagttcatgagtaaataaaatagataaatttgaaggtaatggtcatatctaccatagcacttaccattagtctcttccttcactaccatgcagtccatgctcactgagacaggagaaaaaatgataatttttggggattagagcgcggaggagggaagtgaaaggataatgacaccacgctagacatggccaatcgccactgatggaattatcgcggatgacacgaacagtcactctgccaaatcaccaacacctctcttgctcggtccaaaggagtcagaggacggtttagaggttagactgggggataatttgtctaaagtcactagctattatgactgatcaaatggatctgatggctctcagcgcaccgatgccgactcgggctatcacctgccactgggagtgctcgtagcatgtgaatgagagagatgggccacgctcatgtgtgtaaacaagctggctcgttttcacggcacatattttcaattacgagccgttttcttcatttcccagccatgttaaattggttttttatttattaaattagttttagcactctttgagtcattaaaaattactgaaaatcgaaataaaatttaaggctaaatttagttaaatattttttacggtgcagaattatttttctaaacaaagttgagttttcatgacattatgtttaatgacacaaatgtaaataaggtgtataaatttccaacatggtccttagcataatcacaaaaatatattttttcaaattcatgcaacctttaacgtaagcttatatttttcccgttacaatgcacgggcactattttctagtcaacataaagaattgaaaatccttgaaaaaattagacgtgatataacaagtaacttttgtaacatttgcggtatatttttcatacttcgaccgaaagatatggctgcctaatatccttcaattatccacgtgttacttgtatgcatgtaaatttggtcgtacatgtagcattcctcaccggaacccattcggtgccctagtccacttgttgctgacgatcgtgatgttccatgacgaaacaaaaaccatgacgggaaaagggcacagcaagctcgatttggaagcgtcgaatgtggaagcagcagtacgttggtgcaacaatttgggtgaagaatgggagattctagcggtcagatcctacaagctatacgtacgagtcgatcaatcaagtctaatcacccacttcaactagatgggcagatggtcgtgtggctcttgcacgttgcacgtctgcttgattggttggtctgacgccataagcgcatgatgatgtccccaaacatcaaaactgcgtgccaagaaaaaagaccgcgtacatgccgaggtatcacgagaagaatatgcatcagaaattcccattccgtggtggtgtttggattcgagtactaaagttactttagtacatgtcacattaaatttttgaaaactaatttagagtattaaacatagactatttataaaactaattatataaatgagagctaattcatgagataaattttttaagcctaattaatccataattagataatgtttactgtagcatcacatagactaatcatgggttaattaggctcaatagattcgtctcgcgaattagtccagagttatagaataggttttgtcaatagtctacgtttaatacttctaattagtgttcaaatatccgatgtgataaaggactaaaaatcctatcacatcggatgtttgatattaattagaagtattaagcgtagactaataataaaactaattgcataaataagagctaattcacgagacaaattttttaaacctaattaatccataattagcacatgtttactatagcatcatataggctaatcatgtattattaattagtctcaatagatttgtctcgcgaattagtccagggttacaaaatgggtttttgttattagtctatatttaatatttctaattagtgttaaacatccgataaagtactaaaattttagccctgatccaaacagcccctcaggggattagtattgcactggtttccgattgatcatagttgaaagtggattagtattgcactggtcggtaccatgtgctttcacacttatgttaagcgcttgtgtatatgtccctcgctacaaaaatatagttatctttaaattttaaatttatttcaaatataactacataggattataaaaagttgatttttttcacctactttcccatcctaccgctatcaatctacttttcgtagtattatgttatatccaatcctataatgagttataatgagttgttatattttaagataaaggtaatatattacacaaccgcctagccctagattataatgagggttatttttacattgcacagtactccctccgtttcataatgtaagactttctaccattgctcatatttatatagatttaataaatctatacatacatatatctagattcattaacatccatatgaatgtgagcaatgctagaaagacttacattatgaaacggaggtagtagtttttattagtccttccaagtatttccctaccatgtgttggttttcttatagtccctccaagtgcttccataccatatgttttgtttgggaatgaggtgagataggttggactcatatgggatggtatctatccatttgacatgagaaataagatgattctactttttaagagaagacccatatgctagcgagagaaaaagttgggttgattttgtccgttagttttttatggaatatgtcaacccagatcttaggaatatcccctatcagtaaccatcccattccatttgttcttaaaccaaacaccatgaaaaataggttcaacccaatctgatctataccaacccttcaaccaaacatatgcttagtagctactccatccttttcaaattgatcatcatataatagaattcaaaatttttcaaattgataatcatataaccgcatggacacgtatttcatcaaaatacaattaatgtagcatgagaaaatgtgtgcatactaaggtgtagtatttggcatagtgttttaaacgatacatgcattgtgtgaaaatgtgtgcatggtatcttaattgatgtgatttaaattattcttggttttggtgcataaacatatcccctccattccaaattgatctacatatttcataggtacaccaagaccaagaaaagttaataactctctcatactatatttactctagcaacaaactcgatgcatacaccatccccactattttctagccaatagtaaatcaagatattacatgtgggttataaatacttgtgtgcatggatgcatgcatcaatgttcatttactccaatgcacaaataacaaatagacttaatgaatgaatataaatatgtagattatttagaaataacctaaaaaaaactatacgtagatcaatttggaacggagagagtatatgatatgatcaatttaggaaggagtgagtatattttgacactgagaggatagtttttcttttaagtagatgaatagaaattcggcatctatatccacagccaaaagttacatggataaaaaaattcaggccccaaaactaagaagcaacagaatatagcaaagaaaagacgagaagactaagcttcgatctttagctgcctcacgaaccctgtcgcgctaaaaaaccgcccgcttcacgtaccctgctgcgccaaaaaaccgcaccgtcttgatcttgatacacaactctcatccatatttcattcgtcactatgtccctaaaatcggccgaatccccatcgattcagatctgacaatttccagtccctagtgtcttcgctcaccgacgctatccagtggagacagagaagaagcccctccaatatagttttgcactgaaagacctacttgggatacttctccaggctactagtttttacattttgtttatgaacgtttgactaatatatcataacatctcaatcgatcatgaaaacaagatatcaattctacatgttacaccctttatttctctgaactacacgccgcaccttgcaaaatttagaaatacacctaagcctattaagtcaaataggtggcaaagtgaccacccacctttctttctttctttaatattcagagatacacggctgaacaaaatattcacagttttaaaattggacaaagagtccaacttacaagtattcagttgacagaagaacacgaaaccttcgaggagaaaagcaagcaagccactctggtacttagaagcagaacctctttttctgcatataatggatgaacacatatgaattggctagctcagtgttatgagatattctttacattttttttcctaatactatatgatgttgttgacttttagatatatggttgaccattcatcttattaagaaaactatgcaagtattatttattttgttatgatttatttttttattaaagatacttcaagcataacttatattttttatatttacactttttttaataaaacgaatggttaacgtatgttaaacattaatggcgtcatatatttaaaaacagagggagtacgatagaacagggatgtgtgcgaaccaaatcatgaagttccctttgactcaatctagtttaacttaaaaaaacacacacttagcaacaaagaataaattcatttttatataaactagcgggtcaataggtacttctgggtgaactcactcacatccataactaaagagtagttggcatcaagaacaagcatttctcaaaaggaaagagtaattcataggaaaaatccacaacttacccgaaattgaatattcttttgctggtcggcgtatgcaagcagttcgtccagcctcatcaatgcatcataaagcatctgctcatgggagaaacaaaggtcaatatggaaaatcgcaattttttgttcagttcttagttcttactatagcgaacaatcaagaaattcggtgaactgccaattcttgggtgtaatagtataacatatagaaacattacctcagaacagtagttatatccttgataccactaagcaataagctatctaacgagagtacatcttccttgtcacacatgcacacccacagagtgcatatgatatgtcaagactcaacagtaccttctttgtagatattagctcggcttccaatgcatcaacacggtgaatggctccattgagcaattcctctctatccggtggcatttgagattgctttgcttcaagctcctgtaatttctcctccaattcaccaagacgtctcaatacagacgaatgtgtactgttttctgtgaatccgggagaagatggaggtcaaaactcttccaaaaactcaatttcttgagggaactcagcactatagttaccacgggaaatggcctggcttgatagacttgcagtcactctgcttgggacagaacgaagcacggcaacaaagctcacgattaagactatcaaccacgcagtaattcgatttcgaagtcctcccagttccatcgttatgtttctcaacgagaacgaatctgtgtaaaacatgcaacaaactcagtcaaaatcactccaataaactcttggtgggcttaccggtcaccactcactacatactataatgtaatggcatgtttggtttgaggaatgagatgaccacttgatcttatacaggtcgcttggtttgaggaatggaatggatttgtccatcatctctaaaaagtacatactaaatgagaaactgagaaatggagtcattccactagatttgagagatggtcccatgatggatcacccattctagatagtttgattcctcaaaccaaacggccaacaaaattcccagtatctcacatttccctagttgcatatgggggtacgaatgtttgaaatcagcaagtagacaacttctcaataagaggtacaagtatgaaggtgtcatataaagacctgaattaaaagccattgagctggttgatggaccggcgcatgtgtccacagccttgtcaacaacagggatgtcctctactctgggaggggcaccagatgtggaagtatttcccggcaatttggactgcagaaatataaaaagatgcatttatgatcatatttaccaacataaagattgattaaggaggaagaaaattaagaatgccacatcattgtttagagcgagtactaatcagtaatctgagctcagccttgtgcagttgaaaagaccaatagaacgagtactaatcattaatatcagcctcgtgcagttgaaaaaaccaaaaggtacaagatcttgcctcgtcaacgggtgtcaaatgagggtttatgatggggttaactgaagctataggagatgaaacatcttccatttcagaactagactcagcagaggcatcgctgcattttttctgcgaggggatagaatcaagcttctaacggatagttgttattttaagatgatgtatgagtaatctccattcaaagcatgcttacagttaagtgtctagggttaatataacatattttcttcccatcaacgcttgatatagcaagaattttccgtccatagtttgcttcaccattaaggaccctctgaaaatcatagacacattattttagtgtacaggatttcttttcaaaaaaaaaaaggtgtacaggatgaataagaagaagggtagggttcaggaagagtggaagacctttattatgtcaggatccttccaaggacctttatctgattttatgcaacctccatgttcttcacacctgcatttgccacccagaaaatctggaagttcactgaaaacatgaattaaacaaaattattaggataggaaccaaactacagtatttgtgacagtagaaaagacctaacctctcatcaatagtttcaagtagcttattttggtatttgcttccaaggacctaggtgaaaaaagacagataaggctattatcacatactagaagtaaatattattctgaataacaattttcaatacttacatgaatcttcgaagcagtttgtggatcaagaaatgattttattgtaccccataacatcttgaagccttggccagcatttataatgtacaatcggtgcaaggtctgcacgagcactagaaaggtattagataagtcctttgttatgaccccagataaaaacaagttctatagaaatgtatatagtgacaaaaaacgaagtgaaagggcaatagtgaaaaataacattaaaacataatggaatcacctacctctggatagttgtcattgttgatcttctgaagtcgcatgattagctctcttgcatcttttgagaagttcttcaaacccttcacataaaaaacaagttaactactaatctacccagaaattttggcgatagcaagattggctataaaataacataccactccttgcacatccaagatagtactgcacgaatctatgtgcctttttgcagcaatggagcaagctggaaacctcatctgcaagcacttctcggactccttgacatgatactttacatatctgtcaatagttgtgacttgtactaatttgttgggatcaacttttccaattagttctatgtagacaggccttccctctttatccacaccatggtaaaattgtggatagcactccagaacatcatctaattcgctatagtcaaattcctaaatgatccagatgtcaaacttccagaagttacatgaagaaagactatcactacctacgtactggagcatatggtccagtctctgctttacctctatgttgtcagccccgaactccttcctccatctaagcatttccgaccacatatgttttgctttatcaatatcaaattttcgcgctttcaggaacctacatgtgtaacatgtcataggcacatgaagaaattttaaatcaaataagcaacgctgaattttctgcaagagtaaggagaaatccaagtaactgtgactctgagatcagaaaaaaattgcacctcaacatcacgtgataatcatcatgacgttctggcaacaagccctcatcatgtaagcactggtgaaatctttggacagcttccagctccttgacatcccttatgtcctctatagaggctacatggtcgccgaccctccttcttctcttccttctcaaggaacgcctaaatttatttccagcactgatagctcggttcttgaaggagactgccttggcctttttgtcaccttctgagttgtcctcatcggatttccactctttcttatcatcatcatgcacaatgccttcaaaacctgcacctgctatatagtttcaacgaaatgcccctcctcctaatcaggttgaaatggtaacaactacattgaaaataatcaatacgagagcagagtacataggagttgcaattaactgaaagcagcgcaattacacgcacgttaaaaaaattagggaggtgtgattataatctctacaggtgctaaactactactattaaaatttcaatcccactcgaacatgaactatttgtctatttccgagtgatttgccatgttctccacttgccccaatgaaccccctcacagaatcaatctctctgcaaccgcaattttccggtgttcgcgaatgacaagcaggtaagcattgcataaacgagaacgggcaacgcatggcggcatggagaaacaacgaatcatcagggaacacgcagtcgaaggaagaagggaaacagttcgcactcacagggccgatcgatggaccccgccatcttcgccttccccacccgcggtccgacctcgattcctcgcagggtaatcgagtccccgagcctcgccgctcgccgatgaaccagggtttccggcggaggaatgcgcggagacaggaggggcacgagaatggagagagatggctcgtttgaaattgattgtttttcttttgatttaggaggaatattttgatgcttttgttttgggggagaggggaagagaagcttctgttttcttttcatcggtggaggaaggggacagggcaagaggggagggggtgttacacgtatcctctcgtggaccgggtccataggctcgcaacaaccgcgacgctgcatcagcctgcacgtaggcgtgccacgtgggcggctcacatcggctctggtccgtcgacctggcgagcgcgtgccacgcgtcgcgcatgggcgcacggtacgcccgtaatatgaggagatcgagccggtgtagagcggctagagcccactatggtgaaccagctccgtttgatctgcagatgccgatgcttatgagccgttgatttctccttggaggttctgattggcctgatcgggacacgctcgcaggctcgcagcagtggacggcgctggtgatttttttttccctttttttgagattcgctggtggggtttcacgtctatggagtatggacaaggttcaccgaaatttattctggacgtgacggttcgaggcttttgggccgggctggaacttgagagtacagttgttggttcgggccgaaacttagttcggagcaaaacaggtattcaccgcaaactaaataggcatacaaattcaaatcagaagcacgaggattcgtgtaaagcaatttgcttaacgttttgctaaaatcaatcgtgagtgacaaacatgggcaccttttgagtcaattttactaccaacgccaccacgaattgaaagcacccaaaatcatgttctagtatgtatatgtatctatgtataggttcttctgtaagtatttacaaagttcttcttgatgtttggctttatgcacttcaggcgggactagtatgtacacctcccttcaggaactgatcaagaaaagtgaattgtcatcctgtcagtttgatcgagctagtgtacgtgaaagttgacaaagaaattgactatatgaagatttcaagaatggcatgggcgactgttacctgttaaatcatgttctttttctttgcccggaacatgaaaagctgatctctgtattgagctgaaacagatgataccagatattagccgccatgaacattctgctgcatatatttgtgagtcgggaggcggataaaaaaaaacaaagacttcccatttagggcccattttgaacgcaggaattttgtacgaattagttgcaatttccacaaaagaaaaactataaaatttatctgttccagaggaggcaaaataatgcaatgcaacactgtcacaatgtatgactattttactatatgcattttaagccaacaagagcttaccagcatctttgtagcgttcctcaacagcagcgaccagcatattgcggaccaaatcaaactcttgggcctcaaagcaaggttgatcgtcaggccttcaaatggtacgggatgcattagcagtgctttaaaataaacctttctttactgaaacctatgaagctacttttgttacaaacctgtcaagtcttgtgtattggaattggtctgagcttacatagctctcagatggtgttggttgtacaactttcaatccattgttatacgctatacgcctattcacttgtataggaacctatgtaaagttagaataaattggaatgagtatcataaacatccatttagcagcaaaacaccaagaagatcaggatttttccacattctttgactgctgtactcaaatcattggttacgaaaatttcctcaaatgatttaaaaggaaataaaaaggagtacctctagaagtattgcatgcaaatcatatcatccacaaataacaaggttaagcaacagcaccaaaaaatagatcacttttctgacaggacaagggaatcctgtttgctggttttacagttttgtggctagcgctcaaacagatagatgcatgttataatccccaacatgcaactaagtcacagcacttccaatattctgggattagcagccttaaaggaaatatggccagcactcagcaattaatcagaagcacagctgcacaggagatgaatgcacaccttacaccggaaagcaatgttgatggcatctgatggcttgagatctaagctaatagtctcctcttcattgccaatctggatatcatgacaccatacttcagacaaaagtaaaatagatactccctccgtactcgtaaagaaaatcgtttagaacaatgtttaagtcaaaccttaggaatataaatcatgaataactctcaagttgttgagtttgaaaatgtaaaaattatatgaatagatttgtcttgaaaaatactttcataaaagtatacatatatcacttttcaataaatatttttatagaaacaagaagtcaaagttgtgttttggagaccgtgttgctgtccaaaacgacttcctttacgagtatggagggagtagttcatgtgaagtcattttaccttagcaagatacaatcgagaatagtatgcatcatggaccatttctgtaatccgcaccaaacgtacctaaagggaacagatctgaagtaatcaagtaactgataaatgaacatattatatgacatttaagagaacagatctgcagaccgtgaactctggaaaacagctttccactaggacactttagaaaagatgtatgtattgtccgagtgcatgataaccagcatacattaagtaataaaactaaaatagtaacacacataagcacacccatgaaacactaaacagaaaacctaaaccatgaagccacacgaaagttgcaaaagaaagtctgcttataagatctcatcttaaactcaccgcatatcccatcctttcggtcatctcctttaccacattataaatagttggccttggctggaaagacagaatagtcatgcaaatcagatatagtacatgaaaacaatttaaaaccagaatcatgtggatgcttaacatctaacatatatttattaaagctacatccaactcttacaattcgaatgttccgaagggcagccagcaacataatacttggtgtttccactggaaaaaagtaatgtgagtatatcacacaattagaaaagcatctgcataagtggaaagcatgcccaagcaagaattaatacgtactgacgataattggaagcaaaagatcacttccatcttccatcttcagaacaatagcatggtgaggtgcagaatcccgcaatcttaatacccgcgggttgttttggacacatctaaggtttttgccatcacgcattttaatcacaaatccatcagatacacttctgagctcaactgcaaggacagataaaaccacaagtttaatctcagaaatgtacaatggttgtttggcaatcggcataaatgatatactagtgatatgtaactaatactgcaacagtagcttggcataaacggtatgtagctgatcaaacaacagcaactgtttcaaaggctcacagcgaacttcccaactcccaacaaacagtgggccggacccggacattgctcgaacgactatgcatcaaaacccaatgaagttacaagttacagtgtaacagaagtaagcaattaccagcctccatcacgctggagttgacgaactcctcgccgctggcgtcgtaatccgcggcagcggcgccgtccccgtcggaagacgagccgtaactgcaacaaacaggccagacccagccgcttcgcgcatgccgctcggacgggaaaccgaagaacctgcgcgccgcccggtagtggtctccctgcaacccacaggctcgtctcctcaggtgcacgcgcctaagcagctgcccgctgatcttcgcgtcggaggtcagggcgccggtcgccggagcagcatagcgcgggagaaccggcccgttgatgatctccatccttgaatttttaccataaaccaaaccgtcataaacgaactcaaaggcaacagaaacatcagaactcaacttggagaaaggaatcgatgcgattttcaccgaacgagaggtccaattagcgaaatgagaccacagcgaattggcagaaaccaccaaattgaagagttggacgttctagagattgagggatgaactagcttaccaccgatcctggcggggagaagggcctgaatgcctgatccgagctgaaagacgcaggaatttcggaggattttggtaaagtttttggctcgaaaattttttagccaaatgttaaaacccttatcgctaaacccgacggcttttatggcggatgcggttgnnnnnnnnnnnnnnnnnnnnnnnccttagatatttatggcagcagcggacgctttttaagggtgttttggggaatacggatgaccggatggagtggccatttctgtccgtttgactgtaatggagagatcgctccatcaggatattttttctttggatagaaagcgtaagcgtgatgtggaaaggcggaagatatttcatactatacgaagaatatacttcctccgtttcatgatgtaagagtttctagcattacttatattcatatagatgttaataaatttagacatatatatgtatttagattcactaacatctatataaatataggcaatgctaaaaagtcttacaatatgaaatggatggagtagctatttaacccaacaggagttctattttactattgttataaaatgtaacatatgaaggttgtatttgccaagtcccaagttggccaagtaacatcaacaacatgctacaatttttagtgggaaaattggaaccatgccattataattttgcaaaatttgttatatgccatcctgatccacatgtcattgactcatctagcattacttatatttatatagatgttaataaatttagacatatatatgtatttagattcactaacatctatataaatataggcaatgctaaaaagtcttacaatatgaaatggatggagtagctatttaacccaacaggagttctattttactattgttataaaatgtaacatatgaaggttgtatttgccaagtcccaagttggccaagtaacatcaacaacatgctacaatttttagtgggaaaattggaaccatgccattataattttgcaaaatttgttatatgccatcctgatccacatgtcattgactcatgtgggtcttacatgtcattgagataccgataacatatctcaaactttacaaagttataatggcatggtaaagtttatttcggtccttgaatttggctcaaagttcatttttcaccctaggtgctaaaaaataattgattttatatatacgtggtgcaatcgatcgcccaaccaccaaaaaaaaaagatggcatgtagatcatcacatgtaattgtgacaagtttgtggtgtttgagttcaacaaacaaaatttacttatattctagtatcaagatattttcagtgaaaagtactctctccatctcaatttgatcatcccctaaggtttctaagatcttcctaaaatgatcatcatttaactagtgtcttttcgtttatttatgaaatgagtaaatgtacatcattgcatgtgttgcatgtaactaaaattgattaatttctattagtgcaatatcataatatttaaaataagagcagttcacgggatacgaagcgatggaacaccttagcattaatttaagaatgatggatatgttggtgtccttggtcttggtacgctttgcttagaggatggtcaaactgggatggatggatggaaggagcattgaggacattaaaacaaatggatatatactatctatatagttactgaaaggtgaagatgtagcttagagggtgtagacccccgattttggaaatcggaaatcttctgtgtttatccgtaccaatctctggatcagtagttggtacacacatacatagttggatcacaacatatcacgaatgaattcaggctaaaagagttaaatacttacattagggccaggtaggccaacaactatcagagaacatcagcggaagacaaaataatataagggcccggttaacatgccacaggcagtcgactggggaacgagacctagaacaagaccgcactccgatcatcttgttggatacgcaagcgtaccgacaagggcttctcttcaacactctcctaaaagatatataaacagcaagggtgagtaccaaccatactcagcaagccaccacagcaacgatgcatatgatagagggtatttcaaggaatggcttcaggttcctttgcgcaaagcaagttttacaaatcttttcacaagcctaagacctagcatagactgatcaagttttaataccagtgttcacattaaacaacgatggttctgtccaccatccattgtaatcccaaggatagcttcccgccattgagtcgtcatggttttctgaggacgtccaccttccctcctctcaggaagtggctccatcagcataaaattcatcatgcaatatcccatcccacacaagttaagaatttagagtctagcgaagtgtaatacatgtcccggtgctcaataaccgtgagcacggctattcgaatagattggtttactcacactgcagtggatgtacactttacccgcactccgcaactgcccaatacatgagcctcgtcccaacacatgagatgtgtcacggcaaagcttttcgataacctcgcattggcagtacccgctccatgaacttttacatcctcatgcactctaggcgtatacggtttctagcagtaagaggagttctggcgcaccttggaagggaagactcacacatgcattaagttataattatgtttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacggggggtcgtttcatacttaacttcatggctcggtccttaattgaccagggacggcactagccttttccggacaccacccaaatcctccagccgccccagtcgaaaacagttgtttcactttattttcctttcacaaatcatgtcatcaatatcatggcaatgtggcgctcatgtctccacatgccgcatttcaattaccttcccaaaggtaattgcccaagcatatagcatttgacaaatatgagtatacatgattctagagtggcatctctaagcatttgtcatagttgactagagactcatacgtaatcatggttacaagggaataaggttaaacaataatcaaggtatggcatattcacaaataggatgttcatcattgcatgcaatcttatttgtaaataaaaataatttcgcaattgggatcaacatgttcaaggaatagtgatgacttgcctgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaatcatgctaaggctaaagtttcttaatctttctattgtcatcgtggcctatttaggagttaaccaacatagcatttatgggatacatatatatttggctaatcggtggtttagtctatcaaatagctatggaaggattatggctacgtatgcatatatctaaatagcacggttacatatcagaggttctgttgttagatggatttaggatcaatcaaataattacagtgaatcatttgtattattattttattgatggaagctttactttaattatgaacatattttacttgccattataaattataaaagggctaataattatccatgctctatatgttaaattcgggaggtttataatattatagttacagattatctcttaatgaacaatccggagttacaattgaactatgaacatatgaggtcaagatttataattagtacttatctactatgcatgtttgttatatactccccagtttaatatatgaaaaagataaattaattgtataactataatgggatgtccaatatatgtgtgcaacaacgtataatgttttggtcgcctactgtacatgagcttatttagaaagtgtactacccaatgctccaagtgattcctgaatatattgtagtttaattatacattagctagtttctatgagtgatattgtatatgtgatgcgacaagtttaagcactggttctattgggttactaataagtggtaatcaatttaggcatatatatgctattctatatggtattgcatcgattaatttacttagtgattcctccacatttagctctattattattctcctaaacagattcatctatgtgtgtttatattttagttacataatcataaggctacacttgatttaaataacctataagccatggatttaattatatggccatcgaatattaaataagtactagtattttccaatacatccattcatttgagacatcacataaaattagtttgtgtggttgttacagtggcaagacatgttagagacaaatattattacatctactctaccgtacaatactaattttatttattaacatatttttaagttgactattatgcatcatcttgatattaattatttaatatttataaatatattttatcaaatagtgaattatatatcattggaaagcttatgaatttagatgaatttaggttcaagtttcactcaaatcggagctaaaatgaataagttatgctagtgtaaagattcaaatttgaataaatccgagaaattgtaaaaaggcactgttcctaattcatttatttataatacaaccttatccacaagctatagtgactgacaggtggggtcttcctattttctttttcttttcttttatttttcttcctaaaggaatttataggagcaaatgacaggtggggcccactctaccctctcttctcttttctccctctccctttctctgtcttctcctctctctctcacggccgagcggcgcgtcgcggctaccggcaacgaagggagggggcggaaggcttaccgacggcggcggcggcgacggtggcggcggcggcggcgacgcacggcgcggcacacggcgcggcgcggcggtactgagggcggcggcgcggtggagaggaaagaggggaggaagaggggaatggggaaatggtgtggggtggaaagggggtggccggggggactttatagggcgcagggagggggtggccgggcctaatggcgacgcgacggcacgcacggggctcggggcggcgacgtgacgcgcgcggcggcactgggctcaaggcgcggcggcggctcctggcttggcgacggcacgcggccgggcgggggcgcggggcgcgaggcggcaggcacgcgacacggcgacgggacggcggtgcggcgacggaacgggcgcgcggcgcggcgatgggacggtcatgcggcgtcaggcggcgatggcaacggcgcgcggcagcaggcggcgacagcggcgacgcgacggcgcggcgcggagctcggcgcggcgcggcacggggctcggcgtgacggcgacggcgatgcgatgacgacgcggcgcggggcgcgaggcggcggagcgacggaccagcggcgcgtgggcgcggggcgcgaggcgacgatgagacggacgagcggcgacgggacggccgacggcgacggcgcggcagcggcgacgcgacggcgggcggcgtggcgcggggcgcgaggcagccaggcgcgtgcggctgaggagggggaaaatagagccagggaccacgtcgagcacctagagtgcaatgaacagtgccattttctatttaacccgattttagtttatcccttgtataaatttcattctataaatcctaatttttacataaatgaggtttacccaatatatgttttaattttagatgaaagtttaccaaattttaatattacccatattttattcttatatatatttttctattgtattatttaaatgaggtctaattctaaaattagcctagataattttggaggctttgagggttctaaaatatcctagtgtggcccttattattacaatagcacattgaatgaacttatagcaatatattttacacggataggttgaatctatttattctataaatagtatattaagactcggtacaacattaatctaattttaaacactcacatattcttgtttatatataaggattaatttatttatatgaccattattttatatgagtgattttcatgtcatgagtaactcggcgacatgttgcaagtatcgatctatatattccggtgaattacttatttataaacacgatcactatagtggtgatcatcatttcatgtgttcttatatttcatgtgagattggattcaaatgaattggatttaatcttactatttctttagctaattgtgacatcaagctatcaatcatggttcgaatatttaatacctgatttgtaatttgtaatagaaattaatatttgactttactatcttttgcataattatttgtaggattaaatatattctcgtaaattatatctattgcttaaatatcgatcttttcttttctttctttgtgatcatttacggtttggcaagccatagcaatcataacaaccagcatgatgcaaaagttttaaaaagtttgaaattttagtgatttttattgttagggattttcaggatgttacagaggggggtgaataggctaacctgaaaatcactaaaaaaatcgtaacgatcaaatttaaacaggacccgcgaacttcctagtgatgaacaccggaacttcctggtagctataggcagctcggaacttccggagttcaagaacaggaacttccgggtactggaaatactgagaaaatacttcaaaagagagagaacaacaggtcctattaggtcaatatggttcacagtagactatagcagtatataaaacataggggcaagcacaaagcattcacggaagagataaagaggatttttttcccaaagttcggatgcacggatcctactctcctttgaggagcttcaaaaagctgggtctcaattaaacccttgcctctcttgtgcaaagatcctagaagaggtccacagccttcaatccaacacccctagatccttctctagaagttgagtgaccaccaagatccaactcaaccttctagagacaaccacaagtgaggtttgctctactaggactacctctaaaaactcggcacaatttctttactcacttaccttgtttccttgcggaggtgaggaatacattcacaaacttgcccgggtcaatccacaatcttgacggaaactcgcgggcgacacctaaccgtctatgagatgaatctccaagtgtcggtgacatgggaccgggggtatcttgactagaggtttggggcagctgcagtcacccacgtggcctgaccccctcgggggggggggggtcgggcccgagggtgatgtggccgcccctccctctgtctccccgaggggtcgggccgctcccgtttcggccccgagggctggggcgccccggccccctgtgggtttggcgccacgtgtgtgggttaggtgagcacagcggcgctcacctaaccgcgtttattgcgggttggacgagcgccccatgtcgcatttaatgcagcgcagcacactcgttcggtccgtgacaggtcacagtgtgtgaccggtcacagaccggtcagatcgtgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctatgactggtctgacgctggtcacgtcattggcagacaactgtgctcccgcgatgcatctgcctccggtggagtggaggtaggtatgacccatctcgtcggatggtcatttggaaagcagccatggcaaatctccgcccattaatgagggagtaacagggagatccccggtgtcaggcgagagacggcgctgagcctcactcaaggacaagttgtgatttagcttccaggcgaaggtgcaagccaagttttggtcaagatagggtaggtccccacccagaagaaaagtaggtagaagtggtgcatgtagtatccccttgagatataaaaggaggaccttgcccaccaaaaagagaggagggagggggagtgagaggggttctggagcctgaactctctggctctccggctctctgtaaatccttcacacacagatccaccagaacacaggactagggtattacgcttctcagcggcccgaacctgtctacatcgcccgtgtctcgtgcacttgctctctcgcgaacattctccagatagatcgagggcgaagaacctcacttagcgcccccggccgaaccggcaaaggggggcctgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaatctctctccgagcgctagcggtgaagacggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacggggagcgtcgtctcctcgtctacggtgatggcagcacgccccagggcgcgctccaggctgcgggcgcgctcctgcgtcacccgcccgtcatccctgatccagagactccaacccgacgttggctagatgacgtggccaatttggtcatgacggcgcagcagcgcctaggcgccggctggtggtcctccgccaccaaggccactggcgttgctactgctggctccgtgtcgtcgaggcggagggcgcggcgagcggcggccgctacccgccgttcgtccgccattccctcgtcaacgcctccaacccaagaagatgtgcgtagggggccagatgcccgcttcaatatcgagcgccggtgcaatgatcgccgtgctgcccacgcatcggagggcgcttcctcgtccggagcgccacttcggtccgggcacgggggccagccccctgtgtccccagttggcggtgccggctgtcgagcctttgtggcgagccttcggaacgtccgttggcccccaaggttccggcccaccatcaccgaaaaatacgacggaagcatcaacccctccgagtttctccagatctacacgactgggatcgaggccaccgggggtgacgacagggtcatggcgaatttcttccccatggccctgaaaggacaggcgcggggttggctaatgaacttgccacccgcgtcggtccactcttgggaggatttgtgccagcagttcactatgaacttccagggcacatatccgcgcccaggtgaagaagcggacttgcacgcggtacagcgaggggacgatgagtctcttcgctcatacattcagcggttttgtcaagtccgcaacaccataccgtgcatccctgcacacgcggtgatctacgcgttcagggggggcgtgcgccacaaccgcatgctcgagaagatcgcctccaaggagccccagaccaccgcggagctttttcagctcgcggaccgtgtggctcgcaaggaggaggcctggacctggaactcctccggttccggtgtggcagcttcggccgcccccggatccgccgctcggtcagggcgacgggacaggaggaggaagaagaggtcggcccattccgacgacgagggtcacgtcctcgccgtcgagggcgctttgcgggccacccgaaaggggaggcctgcgagcgacaaaaagaaggaggccggcgctcccagcagggagcgcccgaccagcaagtggtgcaccgtgcacaacacctccctccacgacctcgcggactgccgcgcggtcaaaagtttggctgagcggacgaggaagtgggaggaggagaggaggcaggagcgccgtgagggcaataccccggcggctcccgccggcaaccggcgaggtgaggccaagcagaaggcccccgccgaggacatcaacgatggcgacgatgacctagggttccaggagcctgaggccactgtcgccaccgttgatgggggagcgtgtgctcacgcttctcgccggagcctcaaggccatgaagcgagagcttctggccgtggcccctacccatgaggcgacgcggcgggcgcggtggtcggaggttgccctcaccttcgaccagaccgaccacccaccgtgcgttgcccggggaggacagatcgcgatggtggtttcccccaccgtttgcaatgtgaagttggggcgtgtcctcgttgacgggggtgcagccctcaacatcctttcccccgctgcctttgacgccatcaaggccccggggatggtgctccggtcgtcccagccaatcatcggtgtgacgccggggcacacttggccgctaggccatatcgacctcccggtcaccttcggtggttccgccaacttccgcacggagcgggtgaacttcgatgtggcggacctcagtctgccctacaacgcggtcctggggaggcccgcgttggtgaagttcatggtggcggtccactacgcatatctccagatgaagatgccgggccccggtggccccatcaccgtccatggcgacctcaaagtcgcgcttgcttgcatggagcagcgcgcggaccacctcgccgtggcatccaagcccgcgggtggcgacgagaggctcagcacctccgtcccagccgccccgaggcagcggatgatcacgtgcgacgaggtcccgatcaagcaggttgccctgggcgacggcccgtccaagaccacacgaatcggtggtcttctggacgacaaataggaagacgcgctcgtctccttcctgcgggcaaacgccgacgtcttcgcctggagaccagcggacatgcccggggtccccagggaggtgattgagcaccgtctcaccgtacggccgggcgcaaggccggtccggcagaaagtgcggcggcaggccccggaacgtcaagccttcatccgcgaggaggtggcgcgacttctggaggccggattcatccgagaggtcatccatccgaagtggctggcgaacccggtcgtcgttcccaaggcgaacggcaagcttcggatgtgcatcgactacaccgaccttaacaaggcatgtcctaaggacccttaccccctgccacgcataaatcagattgtcgactccaccgcggggtgcgaccttttgtgttttctagatgcatactctggttatcatcagattcgcatggctagggaggatgaggaaaaaactgcattcattacccccataggaacttattgttatacgacaatgcattttgggttaaagaatgcaggtcctacttttcaacgtactactcgaatttctttgggtagccaaataggacgtaatgttgaggcctatgttgatgacttggttgtgaaaacacgcaaccaggagaccttactcggatctagcggaaactttcgaaagtctccgcaccgcccgcataaagctgaaccccgacaagtgcgtgttcggcgtgcctgcgggcaagcttctcgggttcttgatctctgcccgaggcattgaggccaaccccgagaagatacgagctatagagcggatgcgcccccccagcaagcttagggatgtgcaatgcgtcactggctgtatggccgccctaagtcggttcatatcgaggctgggagagaaggcgctacccctatttaagctcctcaaacgctccgggccgtttatctggacggaggaggctgaacgggccctcactcagttgaaggcgtacctcagttctcccccagtcctggtcgccccggagccagatgagccgttgctactctacctggcggcaactccgcaggtggtcagcgcggcgttggtcatggagcgcgacgaggacgaccctcgctccgcgcatccccaccctgtgtcgactcgacccgggagagagcagggaggagaggcccccgagccgaacggcggcccgaggcccccgacgaccggagctggccctctgcccgcttgtccgacggtgccaggcgcccccgacccccaggatggccccggggccactgcgggaaggccgcgcctgtcgccttccgaccccgaggtcgtcgacacagaagccgagtgcgccccgcgcggcctctcggacgaaaagcgccctatagatgcggcccctggcgaagaggatcggccccgacaaaaggtgcagcggcccgtctactttgttagtgaggccttccgggacgccaagacccgataccctcaggcccagaagatgctttacgctattctgatggcttcgaggaagttgcgccattatttccaggcgcatcgggtcacggtggttacgtcctaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggacaccggctcccgagcccgtctccatccccgaggccagctcgggcccttcgcagctgcctcacaccgcctattgggtgatgcagttcgacggctccctgtctcttcagggcgccggtgcgggggtcacgttgacctcgccgagcggagatgtcctcaaatacctggtccgccttgactttcgggcaaccaacaatatggcagagtacgagggactccttgcgggactcagagtggcggctggactggggatccgccgcctcctggtgtgaggtgactctcagttggttgttaaccaggtctccaaggagtaccagtgctctgacccgcagatggatgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgagcctgaacggcccccgaggcccgtcggagtccaggcctcgggacccgaggggggcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcacgcggctaacggagtcctcctgaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcgatcgacctggtctggcggtgcagggcgtgccagttccatgccaagcaaacccatcagccggcccaggccctgcagaccatacctctttcatggccgtttgctgtctgggggctcgatatcctgggtccgtttagacgggccccgggcgggttcgagtatctgtatgtcgctttcgacaagttcactaagtggcccgaggcttatccggtcatcaagatcgataagcactccgcacttaaattcatcaggggtatcactgctcggtttggggtgcctaaccgtatcattacggataacggcacccagttcactagtgagctcttcggtgactactgcgaagacatgggcattaagctctgcttcgcctctcccgcccaccctagaagcaatggccaagtggagcgcgccaacgcagaaatcctcaagggcctcaaaaccaagaccttcaacatcctcaagaagcatggcgactcgtggatcgaggagctgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcatcgcagagatgacctcgacttcttggaagaacgaaggcggcgcgcggcccttcgagccgcgcgctaccagcagagcctgcggcgctaccatcagcgtcacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccatagaatatcgaacaccttcgtcgcttctacccctagtgggggtcgggtgtcaggtctcgggctcgggccaaccccgcacccccctcgggcgtgcagggttggccgggggctaccacatatgcatatacttatcttttttctcttccgtatttcaataaaagctttttcgattttctaaggattgtgtctgtgccattgtttccttttgaagagttttggcttgaattagcacgctcgtgctcgaccctgccctcggtggcccgggccggcggaaatcgccaaagggggcccagaaccgagccgtgccccggggcgtggtgaactccgggggggaatcggcaaaggcccacaatcgggtccccataaccctcggtcaccgcgctcccggcctagccagtctcgacatgtgcatctccccaggcactagccccgacccgcgccgtttgaggctgggacctgggcacgagcccttgttcaagccaagacacagaaggaccgcggcacagaccatcctcgtctcatacacacaacaaataaaattgacacagaaatttcttctttatttgattgcagattaaattagtttatacaagaaggaggcccgaaggcctcggaagaagaaaggaaaaactatttaagattggcgggggcctgggggctcacttcgaggctcccgggtcaccggcctcgtggtcgctgtcgtccacaccaccgtcgccgccctcctcgtcggagtcgagggcgaacgcgagctgaggggccgtaccctcgaagctgtggacgatgtggtcggcggcgtcccggacctgcgcgcgcgcgcgtcgtcctcggttccgggagggaactcgtccagcgctgcccacggggagaagtccgggtccctggcctggtagcttgccagtacaagctccactactccccgggcgaggtctctcgaggatgacttgatcgtctcctcgagctcctcggggagccgctggagagtcccggccatctctgagaggcgctgggcgaggcccccctggttggcggcgtacttcgcggtccgctcgccccagaggcccgcttgccgcccggcgcggtctagacgggagacggcgtcccgaagcatgccgggccctacctcgcccgccaagcggagggcctcgacctccccggcggacgagtccagcgcgccctgcagatcggcgatggtgtgttcggcagctacgaggcgggcggctagatcgctgtcgcccgcggccgccccaccgctgcgcgccctcgcgtccagctccttcgcccgcgcctcgagctcagcggcccgctgatccagtgcggccctctcggcgcgggcgccttccagattacggcgcgcctgctcctcccgcgctgcctcgcggagggacaggctgtccgccagccgctgcgccgcggcctcggcctcctcgagagctcgctcccgctcggtgagcgcatcctcgtggaggcggagtgcggactcctcttcggcgcaggcggcctcgtgcgccgccagcgttgcctcccggatagcgacggcggtctcgcggtccgccaggtccctctccctcgcgcgggcgcgctcttccagcgccgtggcgcgagcctcaagggccacttcgcgccgccgggacgccgcctcgttctccgtcgcccgccattcccgtgcagtggcggcgtcaaggactccccgggcggcgtcgagtttcttctctagctccgccacccggctcccgtattgaaggcggagatcgtcccgcgcctcgttgagcacggcggtggcgatgagggcagtctcccgctcctcctccacctccctggcgatctccgccagctccctccgacgggcctcgagctctgaggcgtgccggcggtatgccttgcggcccgcctccaccatggcctccaccgagcgccgcccctcttcgacgcgcgcccacgccgcgtcgagctccgcccgctctgcttgcaggacctccatctgggcacctaacccgtccagcaccgtcgtgttcgcggcggccagggcctgcaggaggggctctgtgttcaatggggcggcggaaggcagaggggagagccgcctcggtgtgggcgctgtgcggctcggcccgccaatcgacgtgccggactcaggggcgtcccccgaggctggctcgtcccgaacatcgcccgaagggtcgggtccgagcggtgcgcccgcggcctcgtcgtgggtggcctcggaagtcgtcgtcgcctcgggcggagtcgggtcgggggcttggcaggccgcctggcgtgcgcacgtcgcctctgcctcccgggctgacttcccggcccggtggagtctggcctcctcccgagcggcctcctcagcctggcaaacccggacggcttcctgggcagcctcctcagcttcccggaggcggtccgcggcttctcgccggatagcttcccgcctccgggcctccgcggtcgctgtctccttggcctcagaccggccggacttggaatggcgaggggggcgcgacggaatctcgctgaaagcggaagaaaaaccagaagacaaaaggaaacgggtaagtgaaaactcgccttgggagaatgaatacggccgcagtgggcgcggggacgaacctgcgaggaggtcggctaaacgaccaccttgggggggagatgaggtttccccggcatggttcggtcccccccatcttgcggagccgcttcttttttcgctccctctcgggctgcgacgtcggcacagcaccctccgggcgcctgctgctggcacgcaccgccccgccccctcggggaggagatggagagggggtatcctcctgtttcctcttcccccgggcgtcggcagggcggctgccccccgggcccccgtcacggggcccagaagcatgaccccctcccggggtagattgttcccccctgcggctcccgcccgtgccatcgtggcctcgaggagcccactcccctgacgccccgaccgcctgcatgatggtcaggatgttggcgcgctctggatcgctgcagagggggaggacaccttgggggatgagggatgcctccacggagctgagattcagcacccgttggaccaccatcttgaagtcctcaggggcccagtcccatctgcccccctggtgggtcctcatgtagtccttagacccggtgtactcccaggcgccccgggcgcgccgctggagtggcgcgatccggcgatgaaggtagtcaccgaacaccatggcccccgtgagcccctgggatcgcagacccgccaggcagtcaagaacggcgtcgtagccatctcccagatctaccggcgcccgccagctggaggcctgcgctgggggctggctcggaagtcggaggcgcgcttcgtcggcgagaggggtgtagaaccagtcgctcttccagtcgtcccacttcttgcgaaggacgcagggaatgtagcagttcagcaccggcccccgcggctggaagtagcagccaccgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaacggagagtcagagcacaagtggcaaaggcaaagggaagagtgacgagaggaaggaaacaaatcccttccttgatgtcttagtacccttgccaacgctatgcccggctcctcgatccccgcgcccactacctcgccccctcgtctctcgcgcccacgcctccactaatcccgctcgcccgtttgcggcgcacgaggcggatgtgcggccatggcagtcgagatgggacatatcgtgcgcgcgttaactacgctcgccgaccgatgcaccgtcatcacatctccaggcgaaacgaaccagctcgtcccggttcgcgcgctacttaagtaatgtagcggtcttgaaggaagccgctcattattgtcggtcggttttttccttgacgatgtgcgcgatttgcgaccgctgggtttctgccgcctgtggagaccggccccacctgtcaccaggtctaaggagtggcgtcacgcccgagcgcttccctcgggggggcgatcgccctagcgtaacgccgggggctactgtcggtgacatgggaccgggggtatcttgactagaggtttggggcagctgcagtcacccacgtggcctgaccccctcgggggggggtcgggcccgagggtgatgtggccgcccctccctctgtctccccgaggggtcgggccgctcccgtttcggccccgagggctggggcgccccggccccctgtgggtttggcgccacgtgtgtgggttaggtgagcacagcggcgctcacctaaccgcgtttattgcgggttggacgagcgccccatgtcgcatttaatgcagcgcagcacactcgttcggtccgtgacaggtcacagtgtgtgaccggtcacagaccggtcagatcgtgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctatgactggtctgacgctggtcacgtcattggcagacaactgtgctcccgcgatgcatctgcctccggtggagtggaggtaggtatgacccatctcgtcggatggtcatttggaaagcagccatggcaaatctccgcccattaatgagggagtaacagggagatccccggtgtcaggcgagagacggcgctgagcctcactcaaggacaagttgtgatttagcttccaggcgaaggtgcaagccaagttttggtcaagatagggtaggtccccacccagaagaaaagtaggtagaagtggtgcatgtagtatccccttgagatataaaaggaggaccttgcccaccaaaaagagaggagggaggggaagcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcaccaagagtaagtgctcaaaccatcctagccttcaaaaccttctccaatccttaccttcaccctcaaaatcactctcacacacaagaagggctcaagattggggtggagagagcaaaatcacattgcgaaaagctagaaaccactaaggaacagaagagcaaaagtgaaatggcaaaagagtgagttagggtcgagtttgatatatataacggctagatgatgtcatctagctgttactcacatttttgaaccggaatgttgcccggaagttccggtccttggtgccaggaactttcggtcatcatttaggaaattttcttcatttctcctcggcccggaagttccggacatgggggcctaaagcttccagacatgctttgctatcttgaggaggctatttccaaaaatagctcctaaaaatatttcaactgttggatatagctaagggcacttagagtatctcagaaccacacttgaaacccctcttaatagtaaggtttttcctaaactcaaagtgaaaaattaaactagcctaactcggctccaattcttttcaccactttgaatttgatgatttgggggctccaagcatcctagccacctcgtaagcaacctgggactaatacacctgcatttactcagtaaaatcataagtcccttaatcattttgtcattaatcaccaaaacccacataggaggggggttaggtgcacttttagttacaacccaccacattctaaaacttaacatgtaaagatgtcacatcatcattcactggcaattattgtatcttcaagttgtgtttgtttcctaaggttcccaacctccagtatctcgtttccgcacgcacagttatgttttttttaaaaaaaaatacagaaattgcttaaaaaatatattaatctattttttttaagtttgctatgttttccatgcatgggattagtctccactccgcactaaagaatacaggcatactacgttatttataatttgttgtattttagagatttaaaatattagcatgttaaatcatcattacacatcatctacatagcatttcaatatatatatcaattcattatatttctacgatatccagtatattgcatccccacttaattaattgtttatctcttctctcattaagccacgacactttaattgtttctatcccttggatgactactctatgctttaagttatctctcattttcttctctcatgaagtcacaccaccttacttttgcttttggtcaattattaatatatactagaaaatcggcacgccttgctagtataatccatgctaagatccttttcaaaaaaaatattgaagatattttgctagccttaatccaatttctgtaaaatcctttaatttgtttcaatcagtgtcaaacgaacgatgattgtataaagaaaatactccctccatctcattttgatcatctcctaagcaaatggtaccaaaaccaataacatcaacgcattcatcattctaaaattaatccgcatcgatgaatgtgctatatcccctcgtgtccaacataaattaattcacgctttaaatgttgcatgggttgaaccaatagaaattaatattggttgaccgaatgtgtatagttgcatgcatgcatgcagggcattccacgatgtgcatttactctttgtacaaataaataaagagacactttgttagatgatcatcattttgagaaaacctcaaaaacttaggcgatgatcaaactgggagagagggagtatgtttgactagctctgttacttgttcttacaaaaaaaaaactcgagttatgatttactaactcaattcaacctaatttttcaataaattcaattgaacccaagttgtgtgtcctcttaaactccacaactccttagatttgccattgcgcaacaatagctcgctgtccagcacaaggttagcgttgctgtgctctcagctatcaaccattggcattttgtctcattggtatatggaagtagcgagggcgtcaacgtgagcttgacaggggtttaccatcaccatcaaggcgacgatggtgtcgtagccgaaaggcaagtgagactttttttccacaatgtttgatttcttatagagtttttcttaacaatggatttatatttgatcgagaggttcaaggaatgcaaatttatttgattgctaatgagaagataattgttttgtttttcagcacaccaatgatccctagatttatcttaatgtctatgtgtgttgtgagcagggaagatactaaaagttgaaaccctgtttatctcgatttttaacttcacacacatcaggatctatctagatccttcacttcaagggtatctgtatccttttgtcgacggggatacccataaaccggataaatagagtattagggtatgttggtacgaggatctacacgatacaacatcaagcaaacgaaaagacaaggattatactggttcgggccctcgtaaggtaatagccctaatccagtttatatatatgagatagatatgaaaaaaccacatattacaatagaagaccaataatcctgggattatcggcgagacccttgtcgttggcgagacccttgtcgttggcgagacccttgtcgagatggtttcaacgagatctcatggcgagtaggcttcacgtcctccggattgtaggctatggtggtggtgctggcgctatgattcggtcatctaaacccctcagggggtatgccttttacaccgtgaatcaccttagtcttcaagtagaactcggagactacggaccccgcatgatatagtataaacccgattctctccaagtaggactctgctattcacttgctgtcacaccccaatctggcaccgccggacaacggcacctgataggagcgtgtcataggaaaaacggcgcgaactgcttcctacgaaactgcgatcacagtaccagtcccaggacttagcactggtacccacggtgacaaatatgaatcattgcaatccttaaatttaatagagaacttatttaccttaacttaggttgcagctcaggacagcctgagaatacaaccgacgacgcggacgaggaaacatcaacagcagcagcagcagcggaaccaatgaactaacacctaacaccacaggcgacggctgggaaccaggacgaaaccttaatcttcacttcacttcatcttgacttcaaggcagaggaactatatttatatagagcaagggtgagtactttcgcactcagcaagtcacgggaatttaggtgtctgatgcaagcttggaagagaggcaaggttgttttgcaaatcttttgttttggaaatcattttgaaatcactaagtgatttatttctttctaagtttgggccaaaaagagatttgtgtctcgattcgactttaagagatgtttttcaacagctcatttggtaatgtaccgacctcccggttcagatcattacttctcggctcccagagccatttcacttgattaatcggctcccaaagccttttcattttctcggactcccagagtccagctgcccagcagcacaacaatccgcttccactcaggaagcctagtctatgatgcccgtagacatcccgaatcacacagattcgtttcttgaccactcaggtcatccatctgccacataggctgattctggtaacgattcccaaaccacaacaacttttcacaaagcacaggcaaacaaatctacgctacaggaaacacctcacatccgcccatgaccgtgggcacggctgttcgaacagttagttaacctctgcagaggaggtacactttacccacacgacattactaacctggatcacccagccggagaccctaaggccgagataacgggccggccagcctaaggagacacggcccattagggcgcgcgggaggcgaggagagagggaaccgatggaccgggctcacctcgcgtggtcccgagtgggacccgcttgttagcggctcggctcaccgtgagcggggcgcacgcggagcgcgctagggtttgggagggggagtcgcagcgcacgtgcggtttgcggtggacgcggatgcggcgggcccacgagcagcctcatggctcgcggtggaccgcgcgcgcgcgagcgggggtgcaggggagcgttggaccagggtcagccttgaaccggtcgcagccgagatggcgccgacgtggcgccttcgtggcagccacgcgggccagcgggaggaggaagaaggggaaggccgagatggacggcggacggcggccgagttcaccggagctcgacaagacgactatggtcaagggggagcacaccggattggcgagcggcacaagagaggacgagccaatggctcggatcgcgccgggagaggtcaagggcggtggattgcgacggcggcggctggcggcgtgcaaaaggggaaaaactggcggggcggcgagggttcgattcaaggcgtcgggagcatctccgttgttcggggaactcattctcggggtcggatgggacggaggggcctcgagggaggccgacgagcggcggctccccggaacgggtggcaatggtggcgaggccatgccgggcggcggcggggcttcgtctacgcgcgttcaggagggctaccgagctaccacgcgagctaaaagagggagagggcaagcgagaagggagaacggagggaggcactaccgagccgagacgggcgctgtgacgagcggccgacggcgcggggcatgatcgctacggcctcgggccggggaagaggaagatgagggtgcccggagtccgcgttagctcctcgcgcgcacgccggcttcaccagcacacacggcggcggagggaggcaaggacagcggcagcaaggcggcgagggtggcaagaacagagagagagagcaggcgagcggcttggctgtggttttataggcgtggggtgtggagcttcgaggggaaggaaccgagcacgggcagtcaaggggagctcggttgggtcaaggtgggggcgacagtggaggtgacaatggcgctggtcagggaaaaagaagaaaaggggagagaaagggagctctgcccatgccattttgggagaaaggaggagggagagagcgcgagctctggctccgcgttttggaagcatgcggcatgggggcgtcgggactgggcgatgacagcggcgatgactgcaaaaaagcgagcggggttcggcggctgcacggcgtaggcgtggcagggctgacgcggcggcgactgggcggcagcgcgggcacgggcggcgaccgggcgacggttgccaccagggcgcgcgcgcgcgggggaaacggcggccgaccgaaaattgaatggcggagagcgggggatttgacgccggtggaggagctcgacgagagagagagagagaaacagagagggagagagagaaagaacgagagggcgagagctctctctctctcggctcggctcagctcggcgcgtgcaatgcacgtgcgaggctgagggaggagatgggccaagggaggaagaatcggcccaacgaccaagagggagtcaaaatagacttctgcttagaatttgaattggagagaattgcagcttggatttgaatctaaatttgatacttgtgcacaagggttcaaggagatgaggaaggaaacaaagcgggagtttgatacttttgggaacaattatttggagaggattcaaaggaggggattgactttaggaatttgatttcggagactcgaatcggaattggaaacttgaggtgggggattttgatgaggcgatttttgaattcgacgagagggatcaaggagatttatatcgagatccacggcacgacttagactcagcactcaaagaatgaaattttcgcatataggattttgccgaaatagtttttaacgcctcacgaaatgcggagcgttacacttgcccgcgagggtaatttccataatctcttgataattaccttatcgtatacggaaacatatcatacatacgaaaacatgccgtatccacatattccataagtcataggatatgagatatgccttatccgtaaccatgacagtagccccccgacttcaactcaaatgagtactcgttgtcatccgagacttcacagtcaacgttgtcatgctcactaggtcgttctcgatgaaaatcgagaaggacatggagtatgcggcatcattgaaagaaaatttattctaacccacagcacactgcatatctctagatacttctcttgatttattttgttttacagagcctagcaattttttacacttattaatttccaattatttctcaaacattgttgtgccacgtggaccaatcaacaataggcaaaactgccggcttgagaaggattgattgatattgtttaagttatcataaacaacatcaatttaatggtttatagctttttttcaatgatcgatcaaatatgatgattatataaacttatattatttagttatcttatacgctatttctactattatcataccaagctcccgtaatattgtgcgggatttcatgtagtttcgttaagaatgtgcccttgtcaagtaacatggcattgctagtattttgtgcatatcttgtgccgttcttgtaagggacacaaatgcaatatgttggaggaaataatcaagacttgaatcctgacaagttcttttagggggagaatcttgacaagttggaccatttgaattcatgcttctatgattttctaaacaactattgcccactccaatcaggagggcaaataatatattggtagggtagatctccatattcgatctgctgatttaaataaacttgagtcaatttccggcaaatataaagcccgtaagccagctatgttcttagggttctgtttttttacaaaagttcaggtatgatagctggccacgtccaactataaacagggattatctatagagctcaaaataaaatcccatccaatcacttttattctctctcaattttattattggttgctacacagagctggtttcttcgtaagaaatgatttcttcatcttttttttcatctcttctcattaactattttatcgcctctttttacttatgtgactgttttttttttaaatacgcgagagacgcatctttatattaagaaggaataaaagtatttacagagcgggccgaaaaatcaaaaacacgaaggggacaagatacaggagggggaggaggaagaaaataaaagtctaatctcccaacgaatgtgacgaacttccatccgacataggtgactgtatatttaacggtatgtaagctaggtgtgagaaagagggtttggactgctctaatgcctttgctctaatcctgagcactagctgttttgcatgctgcgcgcgcatgtggacggatccattatctgctgtctggtaattaagcagtactggtgacttaggagtagatgccaggttatccaacacgtgagctcgtgctcctcactacggacatactgatcagaaggttgaccttggcgtctataaattgcgggattatgtgaacagagtagacacgaagcagatcaaccaatcatcagaatgaggggacggtcccgagtttttctcctcgccttggtgctcttcctcgcgctgcaggcgccggcgtccgcaggcacaaaggcaatgctctttcttcacttctctctcttaccctctcgatctattcatcatacatgccctcaatattttttaaaaatatatccgccaaagtcattttgttctttaattgcatgtcctctcgtttctcttgtatgtcattcgaatatttatgaaaaatatttttttaaaaaaatgtatttaatggattttttaatcatacatggagattatatttttaaggggatgctcttttacttcttgccactcaaatagttttacaaaaaaaaatggcaacatatataacatattcatatgtgatttaaatttgatcaattataaatcaacaactaaattcaatgagaaaatcaaactaaactgtaacgtgtactacttaccgtcgtatttatttatttatttctaatttagagttacaaagagtgatatatcacatattaatttgtgttgttaaatttatttaatttttataactatttcgatgatatatgacagaaaacagggtatatattccttaaaactgcaaaaatgtttttccatcgtatattcgtcacgtacaatacaagcaagtcaacaaatataggactgcgattaaatgttctattgacgatctctaatccatgaagcggggtactttcgtgcatgcagacttatgtgatcgtctttgatggcttaccagcttctccttctggtttgcttgctacagtcgtcaccaggtcagaaaatactagtgtggccgttatggatgtcggtgctaccgtactaggctactagctatgtactcctacatcactaatgtgttcattttgtgccgtaaaaataaacagctttcagttactgtacgtcttgagccccatccaagtgatcgtggtgcagatcgatgagagtttcgtaggagtcatcaagcgtacgccacatatatcatcatgttatagtgtgttccccccttggagtttgcagttcatacctgtcactgacgagcgcgttctttttttcgcgtactttggactcagagctgcccggcgtgctggccgtgatccccgacgtcctgcacaaggtccacacgacgcgttcctgggatttcctcgagctagagcgaaatggcgcggcgaccggtgcgtggaaggacgccgcgaagtacggggtggacgctatcatcggcaacgtcgacacaggtaccactacttgaaaaatgatattcgagacgatcaaaatggatttcacgagcgactggtacaaccgctagcaaccaaaaactaatgaaaatcgaattttttaaattaatttttcaatggatttttttttaaaaaaaacgcactaagagcacccacaatagtaaagtaaggtgctctctataaaaatgtacatctcagcaatagactagattgatagtaaaccacctcaatagtatgtctacatgggtatctgtagctctctcatccattgcctcgtttttctctataaactatctccagtttagtagatagatttactctctctctcttcatttaatctgttccaagtagaaaaatatgctgacatggatctcttgtagagagtctatagataaccattgcgggtgccctagaatatgaggaagtgaaattgagaaacacagccccaaataatgaacacagaacgatcggagcgaatcagttattccgtgcatcggtacatgcttcccgatgagatacatgcgcgagataacttaaaataatcaccccaagatgacatgaggttaacagaatcaaatcccaagaatacgggaactaaaaagtcaattcaaacctcgcaaaatggtagcgtcgccatgggcgcagtgcgcctgtgcctctgttggattacgggatccctggtggcctggttcagatgtgctgtcgtcctatctgctgtactgaagtgctgtgcagttagccatagccggaacctgttctgattcctgaactcctgattcttattttctgtgcgtgcacgtactccctacaaatgaaggtgtatggccggaatccgcgagcttcaaagacgacggctattcagtcccgtcgaggtggcgcggcaagtgcatcactggcaacgacacgaccttcaaatgcaacaagtaactccactgtccacagctgctcatcaagctgcatgcaactaatgcagtaaattttctggcgagaaactaacatgtcgtacatgcagcaagctgatcggcgcggggttcttcaacctcggcttcctagcgtcgggcttgctgcaggggaagccgccaagccaggctgcagagctgtacacgccacgggactacatcgggcacggcacgcacacgctgtccaccgccggcggcgggttcgtgccggacgccagcgtgttcggccatgggaagggcacggccaagggcggctcgccgctggcgcgggtcgccgcctacaaggcgtgctacgccgagggctgctccagctcggacatcctcgcggccatggtcacggcggtggaagacggcgtgaacgtgctctcgctctccgtcggcgggccggcggacgactacctgtcggacccgatcgccatcggcgcgttctacgccgtccagaagggcgtcatcgtcgtctgctccgccagcaactccggcccgcagccgggctcggtcaccaacgtggcaccatggatacttacggtcggcgcgagcaccatggacagggacttcccggcttatgtcaccttcggcggcgtcacgagcagcatgaccatcaaggtttgacaatacgaccgaccaaatcacactgtagtttgcgcacatgagaatacggcgtacttttgctcatgccattgggatttgggcaatttgcaggggcaaagtctgtcaaacagcactctgcctcaagggcaacggtacgcgatgatcaacgcgaagaacgccaacgccgcaaacgtaccgagcgagaactcgtaagaaatcaaaaactcagatatcatctcgacttgcaccgatcgaatcgaaccgacgtcgatttgcttgcactgctgcgtgcgtgcaggacgttgtgcttccctggctccctggacagcgacaaggtgcgcggcaagatagttgtctgcaccagaggggtgaacgccagagttgagaaggggctggtggtgaagcaggccggcggcgttggcatggtgctctgcaactacgccggcaacggggaggatgtcatcgcggacccgcacctcatcgcggcggctcacgtctcctactcccagtgcatcaacctctttaactacctcgggtcaacagagtaagcatcgctcatcagcacatagtactacttttcaggtgcaacacatcacagcatggttatatactatactaattaacgttactgctctggttcatgtagcaacccggtcggttacatcactgcatcggatgccaggcttggcgtaaagccagcgcctgtgatggcagccttctcttcccgtgggccaaacccgataactccccagattctcaaggttggcacattgctcatcgtattcctacagatactcgagagagaaagcttgccccttccaaataggaccagcagctgtgtgtgtatgctaacctggtggtgattttgcagcctgacatcaccgcgccaggagtcagcgtcatcgcggcttacagcgaggcggtttcgccgacggaactctctttcgacgaccgccgtgtcccctacaacataatgtccggcacctccatgtcgtgccctcacgtgtcgggcatcgtcggcctgatcaagaccaagtaccccgactggacccccgcgatgatcaagtcggcgatcatgaccacaggtgagcgagaaatgcagatcgcgatcaatcgagccagcgcaaacatcacataaactctgatcgatctcacgtccttaatatgcctgtgcattgcagcgatcaccggggacaacgacagcggcaagatccgggacgagaccggcgcggccgcgacgccgttcgcctacgggtcggggcacgtgaggtccgtgcaggcgctggacccgggcctcgtgtacgacaccacgtcggccgactacgccgacttcctctgcgccctgaggcccacccagaaccctctcccgctcccggtgttcggcgacgacggcaagccgcgcgcgtgcagccagggcgcgcagtacggccgccccgaggacctcaactacccgtccatcgccgtgccgtgcctgtccggctccgcgacggtgcggcgccgggtgaagaacgtcggcgcggcgccgtgccggtacgcggtcagcgtcaccgaggcgctggcgggggtgaaggtcacggtgtatccgcccgagctcagcttcgagtcctacggggaggagagggagttcacggtgaggctggaggtgcaagacgccgcggcggccgccaactacgtgttcggaagcatcgagtggtcggaggagtcggagtcggacccggaccggaagcatcgcgtgcggagccccatcgttgccaagacgacctgcgggtagcacggacggggtcgattcttttcgagtcagaactggaaactgaataactgttggtgttgtcacgccaaggtccacaagtcgttagggctaactgcctaaatcctaatggcaggagacttggttagagaggagaggatcgatttcgttttatctggcagatagatgtgagctatcgaatccagatatttgttctgattccgacggtcaagttgtttttgtgctactcgaatagtgtaatgcatcaatcttcatcttgttacgataattatatacttctcgtcgggccggcgaagcgccggccgaaatatataattacgataattatatacttgttcgttcttttctgccagagatgtgtcgctacatttctccatggaaatcagtcaaactttgaactgtataatttatactgtgttttatgctgtagtgttgcttggtttctcttttttgcctcttcacggaggagtgtaatttattttcctaccataaactgtgacgaacacatgcaacccctgaagctagtgatacatgctgacgtcttatttgatatgccataaatattaaagtgtaaatgagaaatttaaaggtgtaagatttgaataatttaaaatcgactgctttttagtacaaatgggctgtttggttaggtgccacatattgccacacaacatgttaggcatgccacagattgttagcttagcgtttggttacttgcttcagttgtggcaagccacactttcttgttccatggatatacatgtcatatacttattttctagccaaacattgtcacacttgtggctaacaaattgttggccacactatatttgccgtgccatacctatgataaattaagttgtggcaatgttaggcaacaaccaaacagacccaaaaattgtagcgctatgatatagtactcccatactttcttctagtttcggctgggactatttggtgggattcgtggcccaatctcgcgcgatggaaggattgtttttttttttttttgaacttgatggaaggattgttaggagttaagaagaaatggaaactatggaacgattggaaaaggaaacgatggaacgattggcccagactcccattcgaaagctggcaactgggccggcctaaatcacggaaaaccaattgggcctccgaacatacaacaatgggcggaaggcggcttgagggctgaggcgacatagggcggaggaggacagcacgcgctccgctcgcccgccgccccacgccccccgcacgccgcggcccttcgctcggctgccggttgctgccgcgcccctccgctcgtccgctccactccgcgtcgcagcaccggggtgggagccggcgcggcgagtccggccggcctcggggaagcgctgccgcgctcttcccgactccggcgactgcaacggctgctccacctccgcctaacgtttcccatcgtcagcctcctccctcttatactcctgcagttttagctctccgccactattcattcctttcctttcctagggcttagctgaaatttctccgtagcgaagaggaattgggtggtgggggattaaacccgatccatctgcagtgaggattttcccccatgtgtcaaacaagcatgctgtggacttacatataggatgatagaacttagacgaggtgcaggtgcagtcagtggctcaactgaacccccttgtcccgcgttaatttccgcctggttttgttgtgagtgccatggcttcgcattaccaggctgccaccttgatcgcgtcgccgtcgtacccaaatgcaatcgcttggtcgactgagaacctggtggctgttgcctctggtcaccttatcactatcctggtatgtgtggtttcattgcattagtgtattcgaaccatgttgtcctcctcaggagttatgactgttcatcttgtgtttttgattctagaacccatctgcactggaggggcctcgggaactggttgttcttcgtcctagcgacccatttcccataggagtggttaacagagaaggtacggtttccagtgaaacacatgaatttgtgctgcattccttttgcttttcacgtgttatcagtttagacggataatatgattgccgaagtggagtggaagagatgctcggtgttaagtttctttatgttagcactgcatagtaagaaaaaatgattgggacagcttgagtttagcagttactttagagttctgtcaacaacttaaatgttatgggtggctgttgtgcttgagatcacggtggacaactccaaatgatgataaatatcatcaatatgtacactttgctttctttaaaaattattaagcaatgccttaggctaattgcatgtgaagatgcaattcaacaatatgcatccagaagttacgctttcttaaacatcaattcagcagtgtggatttgagttcctacaaaaataaaattgtaattttaatatgtaattatcttgattacatgaaatttttggcagtcaacttctcttgtgacaaactgaaaagtaacactggacatcgatagaaggtgcgcaccaggaatcagtttttattgcttattttgcagatctctttgaaccatgtataatgcccacttccttagcacgtgaaactgaattatgcgctcgatctatttcatggtctcaacaagggttttctcctaactccgggtatgtctttttttaagtcgtttcatcacatcatttttgtctctctctagatttattcttcagcactactaggttcatttgcttatctggcctctgtacttttttttccctatatggattcagttgtctgttggctgtttgtactgttgatggtcatgtaaagctttatcggtcaccattttgtgaattctgtgatgaatgggttgaggtaagcatgttcacctaatgtattattaatttagtttattgactaacttaatttgtataaacattgatagctgggcagcttgattggcctgccaaattcctgttatgcaacagtaatttgttccatgtaggtccaatttgccatgtcccatgcaaccatgcagccccctacattattttttcactatctaagaatttgaaaacatattggacaggcaatgcagttaaaataagcttaacaatcactgcaccacctagtagacattcaaccgtttgttcagtactacttctgacttcgattacagacaaaagaagatattctttttggcagttttgtttgtatttctctgtgtttttcttgctgtttgtcatgtcccttccttttccttttgccattagataaaatatttattttcattcaccacttgtaatcatttgaacctatcagttacatatgcttaggatatctcagggtgtatgtgttctttagttttctcatattctgcctgtcaacttaaatctattggtctaggttgcagatatatctcgattgctgtttaagttttacaaaggtatagaatttggggaaaatgatggtcctagttcacttcctcaggtattctcccatccatccactctatcaccagtgtctccctttcattggttgcctcagaaaattttttttttgtgaggcagaaatatatgttattgagttaacttacagaaagtttgtcttctgtgtcaggaaaaagaaaatactgaacaaaaccagcaagtcatgtgtattggtaaactgcaagagcctcttctgagcatgggtacagaacggagaaaaaggaaaccagcaaggtgagtcacactcttctgtttgctggccatcaaagtttaagataacaagatggtccaaaggggttagttcaagaaataagatgatgggttctatgcttacaatttgatgtatgataatgagtgcctagagtcgttcaaaaaaagataatgagtgcctagaagtataaaatgtatttaccagagaaagatctatgcttaacactggcagactggcctagtgcacttacttggtttctctggtggtacattgtcaatgggtaaatattctgcatgtgctatttgaatcaggtttaattttagccagggaaaattgaagataatctccaacaaactgaaaatggcaatgatagcaactcagtttcccctttcctgacagtctttgacttagacgagcagacaaatgtgtcaaggattgcaaaaaggccattttattttctatcattaggtggcgagaggctgcttataatgtggttgtataaagtaattcttttttcgtttggcacgacacacttgccatgtgtggttttggaataagattgataatttagaggctcttgtttgctaatttttacagttgaagtactgaattactgacgattactggtagaaaaactgtagtaagtatttgctatgggttgttgctaagcttattataggatgccaattgttcatatgtcaacctatccgccactgattaatgccttccttttcgcactaactttattttgcaagaagctatttttggcctataatcgtatgttaggtctgaattattttgtttcattttttagatttgaaggttttgtttatcatgaggataatggtggcgtagatgctccaatggatgcggactttttattggatccaatctctaatttaaagaaaaaaacattgaagaagcgcagtgtagatgctccaaaggatgtggactttatatcggatccatctaatttaaagaaaaaaacatcggagaaggacgatgtagatgatccaaaggatgcagacttttcattggatccaatctctaatttaaagaaaaatacactgaagaaggtaggatttacatgttcacatttaggttaaagtccccagtgtatgcccattagttgttaacattaaaagctaaaccttgtttcataactaaggagagaactatttgtgctgttaaatcacactcgcacatagcctattttatatgatttttttttctttggcatcctgtatcttttacctggttgtgattgtaggtcacgagacctggacttgacgatgctgtcagaaatggtcagggcaacactcaaaatattcagacaccatcatactgcaatggagaagacaaatctctcccacttattacggcaaaacagtattcatgtcgtgaagcacttttgtcttctctcgtagttgcatggtctccagttctaccatcacctgacagaagttcttatttcacgggacattggtgcattcttgctgttggttgcaagtctgggagtgtttccttttggaaaatacacaaacctgaatactacacaatagacatcggcatggttactagagatccaatgctgatcggggttgttcaagctcatttatcatgggtcactgccataagttgggaacttttttcctcaggctcttcaaaacctttgttgcttttggcaactggatgctcagatggaaggtcagtacaacttccgtcaccactgtaaaggattttacatttttgtcatactatgtgacagctaactcttgaatttgctcttccatggttccatctctctctctttctctctctctctcgacaatttaagcataaaccactaaaattgtgatgcttccttaatcctcccaaatacctgttttactcaaaacctttcaaattcgttttctggggttttttcagctcaaagatatggctgggtgatattgaagggttaaatcaatgtacatgcgcaaaagaagtgcccttgacattagtggctgaggtacataattaccattaccctgtgttgtctattgatatacatatttgattcgatatatgactaatatccaatattctattaataaaactagctgggtaacccgcgcaattgcgcaggtatctagttgtcttaagattttgaaaaccaaaccttattgtccccttgtttctatattatttttatagttttttaaaatcacaccagttgccacccttacttgtgtcatccccttctttatttgcttgctcgatctaccactatttctattcattctctcagaacctttaaaaattaagccttataatttctagagtttattgtctcattggttccatttttataattttagaagtcccgttaaatgctgccattatactattctgcggcccgtccgttgcctccgcttttattgtcattgggatttttaaaaatcaaacataattattgtttgggtttattttttttactttatagaagtccagccaaaccgccagcggctatgtcacagtactcctctacggctcgcccgctgcctctcctctttattgtgattgagattttaaatcgaacattatcatcattgttttttttttactttttagaagttccgaacctactttttagagtttattatctcgttgggttttatttttataatttttaaagtcccgtcaaatactgacactatactcctccgcagcctgtccgctgctttctctctttattgtcacattgggatattaaaaatagaacataattatcatttggattcttttacattctagaaattctgtcaaaccataagtgactttgccactataatactttcctttacggctcgcctacagcctcccctctttattgtcgttaagattttaaaatcaaacatggttatcattgggtttattttttaccttttagaagtcccgccaacagtcgtgatcatgttgtttaacggtatgtccgtcatctctccttttaatattcagtaggattctatttggggttttattaatagtttttagatgtcccattaaccgtcaccactctacttctttacaaacatgttacttctcccatatttattgacatttgtcatctgtgttctagattttatttttttaaaaaaattccatatttttcattccgatattttttatttacaacattatactcctatttgaactcttataattatttttctattttcagaatttattttatttgttatttggaattttaattaatcttgtcatgtgttctagatgtctcttcttccaatagtatttattttttattacgaattttagttatttataaattgtatttctagttgaattcttatttttcgttttgtcatttcagaaattattttttattttgaattttaatttaatcttgcattgtgatatatatggactattctccgattgatatggaaatttctaatccccacaacgtttgtctgtgttaattaaaccgacggaccatgataaaaaacgaaatccttgcgtatttttttattaggtatagatataggttttagaacggaacaacatgtgtccaaagtgaggactaatagtagtactcggattgtttgctttgctgtatgcatatactatcgtttatgtttttctctgcagcatgcaaactctctctgttggtatgtgtttctgacacccagtgtggaaagtgctacttctaaatagagttatgccagagtttagttggcttaagaataaacactaataagagtctgattattagaggtgactgcttatttttctttgatatttagctgggaattaggcagtcatccatgggaatcggacacaaattcgtacttatgtagctaaagctagttttctatttttgtgtttgtttccaacacttacatatggtaatatgcaaattatatcagattccaaataacaaaacaaatcaagtcaaacttacatatggactgtcattaaatctctaccattaaaatctagtcatatcacaatacaacggttaatatttttctctttttctccgattaatgtgggaatttctagcccccacagcgaacgtgatgcctcctttcaaagctatcttaataatataatagattgaaatgcccatcttgcactttctagttccagctaatgcctttctgttattaaatatactgctccaaacgttgtactgtcaggtcactactgattcattagcaccagtctcgtcaatctcattatctgcaccagctcagcatcaagactcagttaatctggcaattggaagagcatctgggtcactagaagcatggtcgtggaacatatctggtaacaaaattcagaagattcatgcatgtgacgctcatgatcaagtggtaaaatttcattttaccttagtatgtttacatcttgataaaagaaaaaaaatatctaacatcaccataggtgacaggtctgtcatggggttttcatgggcattgtttatacagctgcagtcaggtgtgtttatgtcctcgttgcactttgtaattaattctgattttgtttttaaataaaaccaaagttccgttgacagtatgttaacttttctattaaagtgtaaactattttctatgttctcagtgtattcacgatctctgtctttgcaatattactagctgctgattacaaaacgtgcataaataactgatggcagattgacgggagacattgatttctgtagtattttggagttgtgttagttaagacttggaaagctgaagttttctgaaagttatattttatgttctgctgctggatcataaaatcctatgcactgtgttgacttattttcttgaaccttcaaaaaatcctgcgcactgtgttaacttattttcttgaaccttttgttacttgcttatgcataaagccttgctactttgtcaggataattctgcacattgttggatgttcaacgaaaaacatctagaagaaattcctctgcacacagatggtccggagctgaaagagtccgtagatgtaaaacatatactcaataaccctttatcctgaacatgcaagttttttcttctggttgacatctgaaatgtgcatgcagctcacagaagtatccgatcgatgttatggccttgcactagcacctggagaactaatgattgctgtggtatgctttaggctatctcttatatctgacgcatattgcttaactgtgcaacatttgtacttgagctttcatatataataagctaaaacaatttatgaatgttatctccttcaggtgcgcagcttggactcaaacttgttaaatcagatgtatcaggccaggtaattttgtttgggagttcggtatgggaagtagtgaggtctgcttggatctaattaatgatttcttttatctaacatttagaaaatccactgtcatcacaataattttgtgaataaaaacaacaggacacaaaaggcagtggttgagttcatttggattggtggtcagttccttggtattccattggacaatagcgttatcctcagtcttcagtctgccgccttatctgagactaatttcttgtggtggggatccaacattttttggtcactgaagaaatatgagaattgtgaaacagtgcttgtcttatgggatctcattgctgcactacaagggtttaagaaatctgcacctacctttcttgagacattgatgcataaatgggtgtcaggtttgttttcagatgatccacattgtgcttctatcgacatcccatcacattcaattcacaacatgtccaaagtcagctcgcggaagttgcacttgctgaatatcgtatgtaggaaagtaatgcttagtgatcaaccgcagtattctcctggtgcagaaaaaggtaatgatgtaatggctgatttgtggaacaatcttctggtaagaagtgaaagggagctgcaagagaggcttgtggctttcacttttgctgctgtcctcaaccgaacagcatatttgctcaagggtgcccctgctgaaaacagctggtttcctgttggagttgcccagatggactcttgggcatccatgaacgatggagaagtgagggatgagctcaaatttcttagaacgaggatcaatgatctaggagacaggtaaaccatttttctaacatcatttcacttgtgaaacggcatagagcatatgccacatgatagttcagtagaattgccttgaaatggcttcactgaaagtaaaattggatgttgaacctgttcagtaactgttttgcgccatgcaggatcaactcagtgtgcgagtactcagttgaagaatactgcacctactgcaatgcaccagtccccttcgagtccgcagatgttgccatgtgcagtggtagcaatcctgctactcccccagctgaagctcacaaattgtcaagatgcacagcgtcgatgcggctgtgccctgttcttcaaccaacatggcactgcgcgtgttgcgggaggacggtcgacaagctgctgccggaaatattcttcaccatgcccacatcattttgggatgtcactcatggtaacgaatcgcttgatttatcagcgccggccgtcccattttgccccttctgcggcatactgctgcagaggataaagccggagttccttctctctgtctcaccggtatagaagctagtgacactaggcagcttccagctgtaagttgtaatactgaatacgtcactaatgcactttgaatttgttgttggtggggggctgcttctaaaaacatgtgcttaaaataagcatggctggtttgcgctaggtgtggtggtgccatcataatgtaacaacccgtgtaacatgtgacatctgtaactcttggcaataaagcgggcaatatatactacttgatgtgagaatatgagatacagggtgtagagcataatgtggcaggccagatgttgtttgctgcatgtacacatgacccacaccagggaggctggaaagagcaaacagacagacaccgatgcttcccttgcaggttgcagccaacgggagcagcctcgaaagcgaagcacttgcgagagattgtggaggacgaggcagtgggtggggtccgacccaggaacctttcccggatttgaccacatgatcgatcgcatcaactgactcccatcatctccgggctcaactcctccctcctggccaggtcagatgatgaccactctcctcggcatttccgattcttgactggcttgttctctctctctcccagtaaccgatcttctcgtcgggctccgacgatcagttgcagcacgatccaggaagaggcggcgtaagccatggtggtggacagcgcgtactacgacgtcttgggggtcagcacagacgcctccgcggcagagatcaagaaggcgtattacctcaaggtgcgtggttcttggcccgagatcgagaacgctggcatatttgtttttcttgtgtttttttttctttcgtgcaatgtttgttgttgggttcatggtttcagctgttcttgcaatgtttgggtttctgtaggccaagttggtgcaccctgacaagaatcccaataaccctgatgcggagcggaggttcaaggtagattttcgcttctgttttgcgctgtgtgcgtcacagttcgatgttctaggaaaggaaacagtataggtaatggctttagacgataagacgactgaaccaaagagatggtggtagctctggtcacttctgttctcttgtgaacttttctgttctaccttttttttttcgagggaaacctccgaaaagggcaggcatgagctcatgcgattcactattagaagagagttatccagtttataaacaaaaattggacacaaaaatcttacaacggttaattagggaaaccggtgaaaactcttaatgccttatgttggtgcattcttaatgtcagtaggtagggatgcaaaccggccaacccgtgaacctactaatatgttaaataaaaggtaatccgtgggtattcatgtcatggctcggcttgccgcgtcgtaaagatataagtggatcaatccataaagctatttataggtcaaattagtaggtaacccgcgggttactcactaacagtggcggaggcagtgtgggggctggggttctttagaccccccctaaaatttaaatccatatatctattgcaagggggctaaaataaactttgtctgagattgttataaggctcaaaagactaaggagcccccactatattttatcctggctccgccactgctcactaattttgcctataagcgggttcatgggtcggcccgcttgcatccctatcagtaggccttattaattcacccactacctttataggaggattactaactaaaattggttacttctgcaaggaactgggtgaggcctatcaaatactcagtgatcctgtaagaaaggattcttatgacaagcatggaaaagaaggccttccacagtaagtcttgaatatttctgtcactattctatcaacctagatagaaattaagctccaaattctttgtttctatagaattggatcggccaaattgtaaaacaaaattcaattgcacaagcgatttgaagttttagctgcatgctgcatgtacattgtattagttattatcaacataaagctattgaacttttaaaatggcttttttagggataacatgattgatccaactgctgtctttggaatgctttttgggagcgactattttgaagattatgttggtcagtttgcactggcatctgtagcttcagtagagattgaggaagaatcagataatacagaggcaagggcaaggattcaagataagataaaagtatgatgctccagtaatgctctgtaaattgcacaacagatgttatctagtagtgctcccagccttctagtatccatctcctcaaggttggcagttcataattcatgcttaggccttaataatatctctggattacaggagttgcaaaccgaaagagagcaaaagcttgttcaaagccttaaggatcgacttcaaccatatgttgatggaatgcaggatgaatttggtgattgggcaggtgctgaagctcagcgtctttctcaagcgggtattgccctccatcttcatactcatttgcactgttgtattttttgataagcatggacatttcattcaacttttgctgctgtatgtacagtatatacactcataccactgaattttctattatgccttatactgaattgctgattgcatttgttttaattccttggtgtctgttatgaattgatttttcagctttcggtgaggctatgctccacactattggctacatttatgctcgtcaagcagcaagagagcttggaaaaagcaaaatgtatatgggtgtgccgttcatagctgaatgggtaagagataagggccaccacgtaaagtcacaggttaatgcggccgcaggtacatcataggatgctgtactaccttttcctacatcacctataatacttcttaatgagtctgaccctcggtgttctacatccctcttttgttaaagatgagtctgatcttttactgtaggtgcaatttctctgatacagctacaagaaggtataaaaaagattgagggcgacgacaaggaaggccagcttatgaagagtattgaggagaaaaaagacgcaatgttgaattctctgtggaaaatcaatgtagtcgatattgaatcaacgctttctcgtgtttgccaagcagtaagcattgtccacctcagtttttacctcatgttttgcagtactgtaccgatatgcttgaattttgagatatcttagaaataacatacaaatatggatgatcgtggcaaccattttgacttcaggttttgagggagaatactgtttccaaagatgttctgaaggtgcgagctagaggactgaaaaagctggggacaatattccaagtaagttttgcttcatctttctatcttctccagctactatggtaggtcaaaggaggattgctctaatcaccaggacttgataccgatcattctggcaaatcttgtttgcaaaccgtaaaacattgaagtttgtgttgaaactaatttggaacaaatatgtttccgtggcctgtttctgtggagaaattttgtaaagccgttgtaaatcgtcacagaggtggcaatttatataggaaactagttcagagaactactcggagtttttgtttggagggtgagagatgatgattggcatatgtaacatgtcggaggttacgaactatatgaatggtttcatacgcgtcttctctcttttcttgatgtccttttctattttgcttacctttcagactcagtgcgcgttctgctttcatgtagtcttttgtatcttcatgtcaagcactcaagctaattgctaatgctatattgccatgttgatttgaaaaacatcctcgtatttttccattggttaaccaggttgcaaaatcataatgagatttggatcccgttttccatgtgaaaccagggtgcaaaatcgcattgccggcgcgagaacagcctgcgtgttgaggctcgcgatgcagaagcaacaccgtcggattgatcaggactcaggagcagcacggcagcatcgctacaagggacaccactccgccgaggcttcattttgtgattctttttgcttttctgtaggagcatttgatattcgttgcgtccagcattccagcaaagatgttacgatgtggatagtgtgttgcaagaccgatgtttggtccatgtagccacgcaatattcttcgatattttcgagcctttgatgctttagaggtaatttggatagttataatcaggtcttgagatcttcgatggctatctgcccgggcaaagtgtacccttttactgttcacccggaaccttccagagatcaggccgcaacgtggcgcgcccggcgcttacgtgcccttctccggtcacgcgcgccgtccttacgagggcacacgtggcttgcctgcagggctgcagataccgcctgtcgcctcctgtttcctcgtacaaatacgagtccgcttccgcttcatcatcatccaatttcccatcagctcgatcgctcgtatcactcatggctcaaagagggtaaccgagttagaaactgaggaggaagcaactcgacgacaccaaccaatggcggagcacgccacgggagtgtacgggcacccgtacccgcgcgtcgaccagtacgggaaccctgtgccgccggtcgaccagtacggcaaccccgtcccggacgagccggcgccgcgcgacacggccgcggggtacgtggcgccgccggaccccgcggtgtcgactggcgactacggcctcgccggcgcggaggcgccgcacccgcacgagagcgcggtgatgagcggcgcagccgccgctgccgtcgcaccaggaggcgaggcgtacacgcgcgacggcggcggcgtagttcccccggccggcgagaagacgttcgcctacgagggcacggtcagcgccgccggcgtcacgggcgcctccgggcagctccagcccaccaccagggaggaggggcacacgacgctcggcgagacgttgcgccgctccggcaaatccagctccagctccagctcggtaacttctctttctagtcgttgtgttcttgattaattttgtcgatgggctgactgacttgatgagcgcgtgcccagtcgtcggaggatgacgggcaaggtgggcggaggaagaagaagagcatcaaggagaagataaaggagaagcttcccggcagccacaagcaggaggagcagaagcaagctggccacacggctccggcggccgggacggggacggggacggggacgcatgcagcggggaagcacgagaagaagggcatcgtggagaagatcaaggagaagctccccggccacggccaccactgagcgagagctcgcgcgcacgcactttcatcggttgacgttcgtgcaactgtccatgcatgtatgtataataccagtcgtgtttcagttcgttaattttacggtcgatgtgtggtctcggtaaaactaggtggtgtacagtgcgtctatgcatgtacggtgtatccaataatccagagtcagatctcttttaattatcctttataacgagtcacgagtgctttacgtttcgcaccaaaaaattgtcacctggcgaatcgaattcctctgagacaaccgtgcgcataactgatgatggtgtgagacaaaacgaatgtactatatgatacgtttaggcaggaccgccgattgatcggttttggtcgatcccgacgcttcacaccatggacggtcactgcgtcaagtggtcaagccgaaacaggagccgcggcggtggcgcggtgcgacggacgggaggcgaatcaaaacaactactggccgcagccgcagcccgcaagtcggagtcaagacgaactggtgggccgtaaactgaacaaccaaacaaaccgccaggaacgaaacacagagtgcgccaaccacattgcgcgcgcaacaagagactgagcggccccggcccaggagaatttgacacggcattcactcacaacttcacgccttccgctgtttcccagcgttggctttcggtagacaagtagtggctttccgtgatccgcgtcgtccatggcgacctctgtccggtggacggcaacatcgttctcggtcacagggtaagctcatgcagaccactcatggacaggttaatacccggcgtcaggcgtgcaaggaccaaggagtaatggagtatacagcgatgcactgaccgcagtatgcaatgccacaagtgtgtacggtcaaatgtttgtcacggaacgttgtcatgtttttgtgttggtactcactcccgtaaggagtacatgagccggccatgagtgtaggtgggaacacctaatttgcctcgtcttataccgtatttgttttgactgacgtgcgttaggtcgcgagaatctatccctggaaatccgttgtgtggaatttattttagagaagtatctcattctcaatatttgcttggtttacgtagagcatggaggacgcgagtggagcacacggaattaatgtgctgtaaagtatgtgaatcagaagcagcatacagttgagttacacttgatagtaatccctccgtgctcgtactcgtaaaggaagttgttttgaacagcgatacggtctccaaaacatactttgacttcttatttctataaaaatatttatttaaaagtgatatatgtatatttttatgaaaggattttcacgacaaatctattcatataatatttatattttcaaacttaacaactcaagagttattcataatttatattcccaaggtttaacttaaacattgtcctataaatataaatataagaccccctataaagggattgatcgaatcacaattcataaccagagccacattgagagataatccaaagaaaaccaaagcctagttgtcgtattctactcatctagacgtactcgatggattctatttggcatgttagagtagcctacagatcaccggttgtaacatgtgcgatatctttcccagtaatacatataaactagagtagggttattactcatctcaatgacccgaaccagtataaatcattgtcccttgttctcttaatatgatatcgtgtatattctagtaccaacgacccctatactctagtacggataccattgttgtatagcccctcgagataacaaaaaatagtacaaaaatttccacctttcaaccaggagaacatgccactagtttgtcttcgatccgtagcggctatggtgcagacggctaccggaactatggccgatgcaacggcgtgccccggcagccagctacgatcaagccgatagccagggcgcgcggtgcggttgcgcgcgacgtgacgatcaggattgcgaccgacgttgtggccaacgcggtgacacaacagtcaactttacggtccacttggtacccacaacgcgtggtccgattacacttagcatgttggctaggacggcagccggcgctacggccagcgcgtgcagtgcaactactcaacaacgacgggacggttcagcggcagtgcggcaacacagcgactgtcttggcttttggtgtcccggtagcttgtggcctatagcctcatcggccaccacctccataggccgcacccccccccctcccccaccgtcactgtcacctcagccagccgttgcacccaccccactcgtgcctccgccctttgggattgagctgagccaaatagccaagaaacccactttcatgtttggttagaataaaggacaaatttctaccatctaacaatatagattatacgtttctttaggggaaaatacttttttttcataggaatttaacgatcaagtaatgaaaagggtatggaagagattcgaattaaatttaaatttaaggatatatatggaaataagaaaaaacagggatatatggaaaaggaattaggtaaatatacacgcgtatggattttgtagtcgaataccaatccaacgcaaagattcgcgagcgcgcacgtgtttgcctcgtggcggcggaggcaaggatccaatccaagggccaccagcccagagcccagcgccccagatacgtcgccctgctacatagccgccgctgttccggttcaatccccaacagcatcacaccaatcagatcgacaatcgccgccccaccccccggccaccccacagcacggagcccttgccagtgccacctccagtgcagcttctgttcaaggaccatccccgaccacgtcgcggcaacgacaacgccgtacgcgcggcggcctctatcgtccctcccgctgctgcgcgccagggctgcgcttcaatgcgccacaggggcagcatgcatatccgtcggccgccgcgacgccatctttattcccccgttctctcgtcgcgcgcgcgcacttgttcactgtgatacgtcgcaccgtgctgttcactgttcagtcgtcgtgatcaatcaatcgatcggtcgaccccagcaagtggacgctacggtgcacgtagcgcatgcaggcgcgtatacgttatgcgagatctcgccgaactgtgcccccatttatgagtcaggtccactcgctgtctggtccttttttttctgactgctgatcagccggtgcaagacgccaagacggatcagacgtgatcagatcgatcggatgtttgcagggttcgaagctgggccaccagaaaggggggaaaaaatcgaggccgccaacgtgctgcgcacaagaaacggcggataagttttgtaagttttgcctgagccgcatgcaggtaggtgtgcaaaagcttgatcgaaggttcaaatcggatcgaactcattcatagtcataacgagctaaaccatgttagaattatagttcgtgaaattaacgagtcagatcgtgtctagctcacttgtaataaaaaaaacgtaaaatacgtaggtgatactacatacaacttataagatacacgaaatttagtcagtcatctcgtaaaattctcaaacaagttttagtcaaaaaaaaattctcaaacaaatcactcatcttgttttttttttcaaatcacataagcacagtggtggagtcaggataaaattatagcggggctaaactaaagtggaaaataaaaattgaaatatgtctcatataaattggctatatttctaatacaaaatataaatatatggattagaattttataaggtattatgggggctctaatggtacattagggtagagagtctaaagaccccagcccccaagttgtcactgccgctgcataagtacatgtgtcaagttcgctattaaattggatacatgttgatttatttttgtaagcatgaccacactcaatgaaaaaacaagccaacttcaatatgattgatactaaaatccaatttaagatgattttgttattgcttgctaagtttattgaaagcatacaagtagcaactaacataaatgaaaatacgggtgctaatatttaattttattgcttgcctataaacatgtcaacttgtcctgcccatatcactactagaaaaagtatttttactaacgtgagggccttatttttgcaggctgatatgacccttagagccaaatgaccgtctacaaaaatataaatcggggtaaaatttgatgcccgcttgcgaaaatagattttcgcagacggaccacttaagtggcgccgcttaagtggtccgcctacgaaaatagacttgaatataaatagacttgcgggccctattttttttttaagtcctcacacctctcagtcctcccctcgctccacacctctcctcccttcctcaccggcctctcccctcccctcccctctc

SEQ ID NO: 69582 - DNA, 897 bp, Oryza sativa
tacagcagctagctgaaagactgaatcactgaaacaagaggctttacctaacattgaaagacaccagtcaatgcactgttcattgaatcgttgactgactagaaggtggggccgtctcaattaaagacagaaagaaaaaggaaaggatgagaagaagaagccaataaagataagtattggtgcatctcccctcctatagtcctagggagtctatgttgctagttggatcctacaataacatgcatttctgatcatttcaaagatcaactcagaaaggggaggcaaccatggatgcacactctgctttcatgtttctcctcactttgatccatcttcttttgcagatatcagctcgtgatttcctctcacctggttcctctctctcagtagagcgcagttctgatgtgctctactcaccagatggtactttcgcctgcgggttctacaacatctcccccaattcctccatcttcgcagtttggttctccaactcagctgaaaagacagttgtgtggagtgcaaatcttggtcgtcctgtgtacacctggggatccaagatcaagttaaacatcgacggaaatatggttttacaagactacggtggtcagattgtgtggacaaacaatgtgagctcttcaaatgtccaagaggctcggttattggagagaggaaacctcatcgtgaaaggccaaggtgatacaattctatggcaaagctttgcttctccaactgatactttgctacccaatcagattattaatggtactataaaactggtatctagtactagtagtaatagattacttgttcctggccactacagctttcattttgatgatcaacatttgcttacattgtttgatgacgagaaggatatctcttttatctattggccaa

SEQ ID NO: 69583 - DNA, 21449 bp, Oryza sativa
taggggtattttggtcatttcgacaaatttgtacagtactaacggagactaaccggacggcgatggtaaattgtagaagttaagcaaaagtcgatggcatattgtagaacatgacaaagtcagtggcaaatcgtagacgtgcgacaaagtcagtggcatataatggattatctctaaaaaaattttatggtgagttggaactgaatcaaaatccaatatataaaacttcagtgtaccaccttatactctgtttggataatgggttaagaggggtgagattgtgatagggatataagtggagggttgagagaaatgagatatgaagaataaacggctaggattaaaagttatccttttagaaggtaggataagatttccccattccattatccaaatatagtattagggttaaaaaaaagaacaatgcatacaaatgaccatttaataccgtagaaaaacaaaagtcacatgtgtcaacgtttatttttaggattggatttattttgggatagagagtaccaaatatgttgatattctttaataatattaaataatataatgatcatttgagaatggagggagtactaattaattaccagttgggatatctgttcgtttaatagtttaggtgcacgattaatccagatctgttgtctgcctaaccaaccacacatctctcagctatactgcatcaacttcacctggcttatcaacggcagaatcgtccgtattagtattccgtgtagaatggtcatgttgatgagttatcccttcgttctaaattaatctacatatagttgttttgaggttatttctaaatgatctacatttttatgtttatttgttaagtgtattcgttatttgcgcattagagtaaatggacattgatacatgcatccatgtacataagtatttataacccacgtgcaatatcttgatttgctattggctaggaaatagtggaaatagtgcatgcatcaagtttgttgttagagtaaatataatatgatagagttattagatttttttttttgtcttggtgtatctagtatatcaatttggaatggatgagtactttggtgtttactccgtacctatcaacagcaactggacaattaatccttaaaaaaacagcaacttgacattttcttatctgcttcctttcacgagagttcggaaaatgtgtgggcccagttgcacgaatagatgacaaatggacggtagatcttggttgttgtctctagtttaatcatgcttagaaattcgagccgtcaaatgcagaattcttggatcatctgagagtgattggcatgtgctacttcgtgctgctccactcgtttgttttgagattctaccacgaggtaagaccgtaggaaaattcagtaatgtgttgttttgtactcctctttttgtccatagattcatggcactattcaaaagcatgcggtgtgaatagttttcactgaatcctgtcaactgcacatgcattaaaatacaacttgtttttttcatgtcgttatttgcaaattatactaatcaaaacaaacggataaacttttagattgaaccatatttgaacgagatgataaggtgggatattcattctcatatgtattagtgctgcagaatcacctttatacgaaatgcataaaacaaacacaaaatacttgaaattcttttcaataaaaggttatcaaaacttataagtgtcatacgaatttttggctgtgttcgtttgggcatgttcccaacccatctccctcgttttccgcgcgcacacttttcaaactactaaacggtgcgattttttttttcaaaaagttgctatacaaaagttgcttaaaaaatcaaattaatccatttttttaaaaaatagctaatgtttaattagtcacgtgttaattaactactccgtttttcgtgcgaaggagatgggttcccaaccctaactaccgaacacccctgggacctcagatataattcaatatcataactttaacaacttcactaagatgagacattatcaaaccgataataatactaattctcttgaactatgattcaaacatggcacgaccgaatttgtcacgaaatagacgattattgctctccaacacgtcgatcctcaaacatggcgtttatccccctgtttgcattttcgattttgattaaaattttggtgatttcaattgtactaaaatttacgatttttttgtgattttaggtatttttggaccgttctttttttgaaattttaactgaatttaaataaactttgatcaaatttaacaaacattcgagaaaatccaaaaattctaatcccacagaacagaacagaatgtcacgtttgattcgatgaaattgccgggttccaaaccgctccggggtaggacagaagaacacacgagaggcaactgggaacgtcgtccacagcagagcagagaccaccctgacgcccgagcccgaggaccatcgcttccgctggccgaaagctgagagcaagtttaatagtacagcttccaaatcatatatagctaatataatagtcaatttatataatactaattgtttagtatattattaatacatgatcctacctgtaatatacatattacgtcttttaagtccgtgctgtagctagctacagatctatagcctgctactattttcttttcctttatttttttaaaattttctgtagctgacttatagcctgattgatgcgctgccgcgcgacgtgtgccgttgtacggatctcggggggcgagacgagacgagacgaccagtgaggagtcgccacggccgcggcctcaggcatggacagaaattctccgtatttcttctccttttcctttgtgatttgatctgtcccctcttctaggtccttctttctcgttgggttttggttgttcttctagcatcaggttctgctggtggtaccacgcatccttgcaacaactttcgcgcacggtcaaccgactgcaggatgagtcgccgggcgagctgcctgatttttttcttcacattttgatctttttaaattttattctataaatagaccttaaaaaatacttatcacaagactagattagttttcttgacgctaaaatcattggcaccattgttcaatatctcaccgtcgagacatcgacacactatcaccgtacgtagtagctaagttacacatgtgaaggggtcagtatcaaaagagattgacattgagaacttatttgtaaaaaaataaaaagggttgcaatgtaaatattttattacaaataggtctttatgtgtattttttggtgaggatctatttgtaataaaaatatttacattttaatcatttttgaattttttatatagatctttgtcttcagactctttgacactgacccctacatatcacgatggctagggtggtgagggtatcgggggcaacgttgttagcgccgaaacattggaccttagcgtcaaggtcactattaccgagaaaggggttcatttctataataagattttcaaaatctatttataaaataagttttcaaaagtgcgaaaacataaaatccaggtgacttgctccttgagctttgctggctaaagaaattgctgagcacacgtatagtcttgtctccacgttcgcaaaattaaaatttaatttataattcataattaattgtttttttctattttccagccttaccctataatctttttcgttgcatggagtccatattgtcctcaactatcgcgtttctaaaagaaagattcaaattaacgtttgaaaccatttattgaccgccaggcgggttcacaaaactgatcagcattttaaaaaccgttgatggttaatttgtcaaaaccggtcggttttagctagttttaatacgatgttatccgaaagtcatcggttttcggcaactctgtgagtatgttttttctagaacaaaaaagtaaaccctgctgccaggtcgtcatacttcaataataaaaatgttattaaaaaatcaggacccacttaccatatctccccttcttataagattcaatggtatgtaaacagttttggtggtaaaaccagtgaggtggtgcctatagtttgctgtttgcttttgacgtgccaatagtttgatgtttgctttggacgtaacgaaacgcgtccgtaggtgcaacttcggagttccccgagcaccataaccgtatcactgatctttagttaattgctggatcactgtccggacagtcggcgtgtggtgtaagcaaaagtgcgatttggtcactgattgcctctcgccccttgctcctgccgatcgtggatcgccgatgcagacgacgcgtgtgccgcttacaataatggagtggagtggggcaaagcttttttttctttttctgaaaagagacaaaaaaatattttttagaaaaaaaaagtagcaaagcaatttattactgtggatttatgatacacgtcatctactgtaataacactatcattataaatatgatgtgtgaaatgataaaaaataaaatccatatatcaatggttgtagtggtagtaccattactacgacagaggatcttcatccggttttagctaatgatgattcagcagcaattgttgtggtgtcaatccttgccggtgaacatgtgtaatgcacgacaacgcggtggttctgcagcgcacaaaagttgcttaactgccattacttcattcaccgttggaaaaatgatcttggctgggtcgactgttttccacaataattccagttctaataagaaccaggactgaagattgtttttagtcccggttataaaaattttgatctttaatcccgattggtactaaagatcatttttttgtcccggttcatggcctatcagagacatctcaggaggtcgaggatctttagttccggttgataagatctttagtcccggttgggagtaaagattatttagatctttaatcctggttgataataccaaccggactaaaaatctatcttcttggttggactccaaccgggagtaaatatttctctcccatatctgattggttaagtcccatacgagacttcctcctcaccaagatatttagataagatcggatcatcccctctcctcttactctttagatctccttcctccttcttccctcccctctcctcgccttcctccccttcctccttctcccctctcctcctcacatccggcgctcggcgtcggcgggcaggctgcgggcggcggggccgcgcacggggcggcaggcgccggccgtggcgagcggcagccacagcggttctctccggctttttttttgataatttgtgattgagagatgtataatttctttcttttagaatttgtgattcattgcatggatctgagatgtataaacgatctgtgatgtatttgatttgtgtgtaatttttttaagatttgtgatgtatttaatttgtgtgtaagtaacttaggatttgtgatgtgaatgatttgggatgttattttggtttggggatttgggtatatgcatggcactcaatttggggatttgatgttcgattttggtatatacatggcactcgatttgggagaaaataaaaagaaaatggaaaatggaccagccgggactgcggactgcccctaccctctctttagtcccggttggtgttactcccggttggtaacactaaccgggactaatctttagtaccggattcgtagtatagggggttacaaaccgagactacaaggggttacaaatcgggagttaagacgatttctccaacagtcccggttggtgttactcccggttggtaacactaaccgagactaatctttagtaccggattcgtagtacagggggttacaacccgagactacaggggttacataccgggagttaagacggtttctccaacagtgattgcttgatgcataggagcgttgtcgaggagtgatcctctctagcgggagatcgtgagacacccctttcgtgagttcggccgggggcagcgggtgagattcgaggatttggtgagcgaaactgtgtgtgtgatcttgatctcggaggctcctccaagacgatgagacaaaagaggtttatacaggttcgggccgctatgaagcgtaacaccctactcctgtgtgtatgattcttctgtgcttagaaagtccctgaatccttggtatgcaagctagggttagacaagctttggctcagggatcctcactccgatcccacttcctcgctaggcatggtcctccttttatactctaaggggataccacatgtgatgcgagtgctacctagggagaagggaaaatattttctatattaattacatgtcttgtgccttagcccagaagctatctgcacgtcggttgctgcgcggggcccatcaaatcatgcagggcgcccttgtcattcgccatttaatagatgaggacttccgggttctcattcacaccaggaaacgggaacccgggtcagttcagagtggttggaccagctctgaccggggtaagaggctttgaagcccctcatcattatgatgagatgggacagagcacaccgctcgccgcctgacacactgacagagcgggggtacacagtcgccgtcccatcggtcattcaaccggtcacagaccggtcagatgcacagcacgccgcataaaatacggcatggcacggttgcatagaccgctttaaatgcagttaggtgggcgttaggcgcgcccacctaaccctgtacacgtgggctgatacgtggagggggtcgaggcaactcgaccctaagcgagggcggcctcctccctctagcttggagggagtagccccgcgccaccccgggctcgacccccctcggggtgagccacgtgggtttaggggcggcccgaccccaagctgggaaggggcagccgccgcaacccccgggctcgacccccctcggggagagccacgtgggtttgagggcggcctcctccctctagctgggagggggtagccaccgctccacctcgggcttgatccccctcgcggggagccacgtgggtttgggggcggcccgaccccaagctgggagggggcagccgccacaacaccccgggctcgacccccctcggggagagccacatgggtttgagggcggcctcctccctctagctgggtgggggtagccaccactccaccccgggcttgatcccccctcgcggggagccacgtgggtttgagggcggcctcctccctctagatgtgatacccccgggcccatatcaccgacagtagcccccggcgttagccctgaccaaaaccttcccccggtggccatggttgacgccactctcctagtctaacgatgtgggcccggtctcttctccattctttgttggcactagggcccatgcgtctttttcgccccaacttgagggcgactcgccggcccgtaccttaggttgtgaacttattttctgtatatattcagcaaacgctgttagattctctcgggcccgcgacttcatgctgcgcacctcgcttgctcctgccttttgttaacctctgttcatgttctacttcatctattcaaacgattattttcgcgtgagtgtgaggactgaactttccatagccagcaatcctcacctgcaatcaagccaagctgtgtgccatagccagtcggcggggccaaagccaactgctacgggagagccagcacagggggccccgggcgtcgacggcgtccaaagctcgacgcagggctaggatagagctaggaatcgtagcccccacacttttagcaaagaatcatttgaatgggtgaagtgaatacaaactttttgttaccaaggggggcaaacgagcgtgcgacacgtgggaatcgtgggaccgcgaggaagagatgggtgagagataaatataagccatgataattttgctgataagcatgaataaagaagatatatacttaaaggaagtattacaaatgctatgctcaaaaagagtccccggccaacgctgagctttcccatagaggtctgctttggtccgggtattgtaacacctcctttgttacctttgtttatccttgtttacacgtcgcgagctttcaaacctttggctcgaagagggctccccaccctgggcttcgaaccctttagggaagcctgcgaccacttaacaaacgaggtcaagctcccatgaacctgcgccccaacgctacacattttgttcgctctttcctttcggtggcttccttccaatctctcttccttcttcatggacgattactttcgcacgagtgtgggagccgaaaaattctagagccagcaatccccgtccacagttgagccggaccgggcaccgtagtcagccggcgggtccaaagccagccgctacggaagagccagcacagggggtcccgggcttcgacggcacccggagctcaactaaaggctaggataaggctagaagacttagcccccacacttagcgaagaatcgttcatgtagatgggagagaggttgggctcttaccaccgaggggccaaacaaatgcgcaacacgcgagcgtcgcagggccatgagaatagaatggggggaaattaaatataagattttaagctaatgaattgaaaaattgaaaatatttgaaacttgaaaggacgatcagttgagccgggccgggcaccgtagccagccggcgggaccaaagccagccgctacagaagagccagcagagggggtcccgggcttcgacggcacccggagctcaaaactgcaagagtcctcccaggagtgaaccgatgcggcagcaggttcatgggccaaccccgcgcttggcccctgagggccatggggaagaggttcaccatgacccagtcgccacccccacccagccgccgcaacccccgggctcgacccccctcggggagagccatgtgggtttgagggcggcctcctccctctagctgggagggggtagccaccgctccaccccgggcttgatcccccctcgtggggagccacgtgggtttggggatggcccgaccccaagctgggagggggcagccgccacaacacctcgggctcgacccccctcggggagagccacgtgggtttgagggcggcctcctccctctagctgggtgggggtagccaccgctccaccccgggcttgatcccccctcgcggggagccacgtgggtttgaggacagcctcctccctctagacgtgatacccccgggcccatatcaccgacaagcgtagatcaaaatcatatctggcagttgttatggcctttaacaaatgattaacagataaagtcagttaaaactgcactacctctatcccaaatataaaaagtaaacattttatatttagaagcggaagtgtaaggtggtgtttggatgcaataacgggactaattttagtctctatcacatcagaagttggaacactaattagaaatattaaacatagactaatgacaaaacccattccataaccttggactaattcgcgagacaaatctattaagcctaattaattcatgattagcctatgtgatgctacagtaaacatgtgctaattatggattaattaggcttaaaaattcacgaattagctctcatttatgcaattagctttattattagtctatgtttaatactcctaactagcgcctaaacatatacggactaaaattagtccctcccatccaaactctccctaactctcttggcatgaaatatttaaagttttctccatgggtacaaatggaagggagttgcagaagagaaatataagaataaccggtgataagcccacacattgctgtggcttcttcatatatagaaaacattactgtacttcttatctgaaaaccgactttaggaaggtttaggtcattttatgatagatttgagcctatctatagtagaactttcaggtagactttttatatttttgctccttttaaaaacttattttacaagtagatcctaaaaaacttattccatagatagacctttttcttaatgctagtaaccttacaccgaggtccaacgtctcggtgtgaacgacgctagcactgacaccctcactccctagcaaccgagatgtagaggggttggcgccaaagaaactagcgttgaggacctatttataaaatattttttaaaatggttaaatgtaaatactcagcgccaaaaagctaccgatgacctatttgtaaagaaaaatatgtttgttttgttcttttggaaattattttataaataggttctcggtactagtcgatccccttcacctcagcgacttaatgtgtgtttggctctctagcccagctagccaagctcggcagcactaaaccatctctttgccagcttgctaaccttgcagtggcttctatgtttggatggttttgcttcatgtataagtattagtggctagctgatgcagatgaattattgttgctgagttcttccgtgaatcatttttccttttagatccagactgattgttcgctgtatttatgagttgatggagagaacaattttcaacaaagcctaagcgagagttcgcaacaaagaaatggaagaagaggctggtaagattgtgcgagtcattgaaaaaatcgctaattttggagaagtatgtgttgccctcgttctaacattttcgcgcaagcagagtttgccatcaaaggagagccgatttggctctccttggctagctagatttttcttaccccacaaagccagattattttaccggttgcaaacgcgtagctttgcttggcgaggctaggatgacacttgcccaggatccaaacatgcccgtagctaccatagaggacaagggtattagcgtcagtgtctttgtcgctgagacattaaacctcgtcgccttgaccctgatctgagaaaaagattgcattcttagaataaatttttctagggtctatttgtaaactatttttaaaaaaggctaaaatataaatatccagaaactttatgtatctctttaggtcgagtgccattgtaacttacatgcggggtactcgatataacgtgaatctatttttcacctcaactaaccaacgtaaaaaagaaaaacaaaaaacggagagagaggaaaaaaaaaacctggttatccgtgtctgtctaatgcccaatgtacacccctacggctcatatcaggatcctctgcagttgaagtcacgtgactttatcactgacatgtggacctaatgaccactagacccatatatcagtgacataggtaccgcgcatttaattgcagactatctcaatccttgtggctcgcctatgccgttgctcctgtgttgccttgctatctgacagcaaagagttattaccatcgtacctacgattagatggaatatttcttagtactacaaatttaaacaagctcagtacttcgaatctggatagactccatatagaaacaatataatactatgaatccagacatgctccttattcagattcgtaaaattaggaactctctgtccaaattcgtagtattgaaaaatgtcacatccaatcctagccttatattctaatacggaggaagtaggttacagtcgctacacgaatcttgaagcaatccaaaaccatcaaaaatcggtccaaacaaaagagaagaaaaagggactgtctaacaatcattcgacagattttctttagaaaatcagtcgaattttcaagccatcaccatgtgctgctcaaatgaaaacgtatcaatgtacgtcagtcactggacattaatcacgtcagtgatgctgctaaaaagaaaaggaaaaataagcaacttacatcaacttacgcatgtaattttttggggttacatatgtaattttgaaacttacgctataaatatattaaaattacatatgtaattttaaaacttacagcgtaaatatattaaaattacatatataattttgaagatttacgatgtaaatacatgccgattattttttttatgaaaaatatgacggcatatatatagtccgaaaatatcaaatcacacctcaaacaattaggttaactacagtacaacaaaacaaccatgagtaaaaaaattaccatccatgtaaaacaaaaattacacctgcatctattaaaaattacactgtaaatgtagtgtacttaactatgaaactgcggtgaaagttttaaaaacgttaggtatagcagcaaagtaatcagtcgcttcttgcacagttggtacgatgcacgtcatgttatcctgacatcatgtggtcgattccatgctctagcggcatttttttttcactcgaaggcacgcgcacaaatctcaaagtaaatcatacggtgaagaaatcgacagatttttaaccaaaaatctgtcgacagatatacagcaattccggaagaaaaaacagtcaacagacaaaaaacgacggcaacataaaaagatataaaaaaaaagaagagaaggaaatattttgagtccaaacaattccaaacccacacaccccacccttcattttcttccccctttcatatcctctttttccctttttccaccctccacagccgcctccttctatcgcccctctgcttcttctgccggagccgccgccgcgccctcctcctcgcctcctcgcgcgcgccgccgccgccgagcgagcgagcccggagggtgcgtggacggcctcctcttcctccgtcctagccttctccgctccctcgcgcgcgggcgcggcgcggcgcggcacggcacggccggcgagcaaagttcggagaggcggcgaggtcggccggcccagccagccagccagcctcgttccgccacctcgggttttttaaggtattccttctccgctactcagtgtccctcttccacctcgtagctagtatcccctcctccttcccaccgcccccgcttcgtagcagtagcatccctcctggtctcctcctaagcggcacctcgtgcggcgtagattggagattcatccggattgggattggtttcgtctcctctgattaatcttattttcctgtgtggtgctgtagtatagcagcttgtttccagtgaaaaaaaagaaaagaaaataaactcttcttttttctaggtttatctcaaccccatgcccccatgttaggtctgcccatgccttgaagggttctttggactttattacagtttgccattgctaattgcttacctagattctttgtttcttccttgcttgatgtatgcttcaaagtaactttagattttgccttttgtaatacatagcgatttctggagagggcgggtaggttcactgaatctgccccatgtttatggtcaagtagtgaaaatgtttaattggtccataaagttgtgattccattgtgctagaattgtggtagtggagatggtagggcacttgatgtattcttcttcgtttccaacttttgggattggtggctgagaatgcggttcttgttgtggctgtcaatgcagtgcagtcgcccgccttcactgtgtgctgtagattgaggcaaaaacattttccaggagatggcagcgacgatggtggcgatgtcggccaagagcaagaacagcgtgctgacattggagaagaagcagggctggtctgtcccacaacttccggagctccggttcccttgggatttgcatgaagacaagggcttctctttgagcttacatggctctgcctcccctcatggtgggctgtttgctagcgtcggtctcaaagtgtccacagctgcaccagcagtggcacccagtcctgccgagcatgacttcaagattccgttcgctgatcattgcataaagtatgtctcctcagcagtggggtaccaagttcctgggactgaggctgaatctgtcaatgaggaagaggtggtggatggcaaggctgtgaagaaagccaagaaacgtgggctgaagctgaaaattaagattgggaacccacatttgaggcggctggttagcggagccgttgcgggagctgtctcgaggacttgtgtggcacctctggagacgattaggacccatttgatggttgggagcaatggggactctatgacagaggtattccagtcaatcatgaagaccgaggggtggacagggctgttccgtgggaactttgtcaatgtcatccgagttgcaccaagcaaggctattgaggtaagttataaatgttggcttatgttgatcctttacaaagtccaaagtcctattgcctaactttattataagaactaatacattttttgtttgaacaaagatgtaactaatgtatattagttgtattggatccaagttgtaactggtgttggcttatgtgagccagacgtccttttaaattttgagcaaactatagtttttttttgaccttccattgagatgctaatgttagatggatgcttaggaaaagacaatttgtattaactactaacttataaccacttcaattttgtggatggcctatcaaaagcagtaaaacaccctatggaaaatggattttccgctattctcaataatatttccgctattctcaataataaggcaatgccacactgtagtcaattttatatgacaatcagccttctatcaataaagtaggtatgcaactaggaaatacacttctaacaaaggagtctgggttcaccacaatggtattttaatgttctccattttttcatggttgactctaatcttcatgactacaaacatctatatgtgtagtgatctcgagactttaagcaagtcaaagtatggactatgtagctttcttatattttttattgtttcattctgatattttgagctcactcgctttatttaagtgtatgctttgttaggcactggctatatgccaaaacatgaatagtaagatgtttaacttctgggaaatgctgacttagtgcgtccaaaataaacttgtgaaaaacagttttgcttttgttaatcttcacttccatggtcttacattgctaaagacatttattttggttttatgaggcggtggatggatacttgttacacttgactttgactgagattatgtgaccacttttttcttatgaattttaggatgtcagaagtacctaggattcgtagcaactaatcagtctctctttgattcacctattaagacatagcaataccttaattcaactgatttttgtcttttgcccaaatgcagctatttgctttcgatacagccaagaaattcttaactccaaaggctgatgagtcccctaagacacccttccctccatcgcttattgctggagcacttgctggggttagctcaacattgtgcacataccccttggaattgatcaagacccgattgactattgaggtgaataaaactccgttaacttacacaagtgcatttctctgtgtacacccacctaaccctacttttttctgcagaaagatgtctataacaacttcctccatgctttcgtcaagatactacgagaggaaggcccctcagagctctaccgcgggctgacaccgagtctgatcggcgtggtgccatacgctgcaaccaattactatgcctacgacaccctgaagaagctctacaggaagacattcaagcaggaggagatcagcaacatcgcgactcttctcatcggttcagccgcgggtgccatctcgagcaccgccaccttccctctcgaggtagctcgcaagcaaatgcaggtcggagcggtaggcggcaggcaggtctacaagaatgtcttccatgctctgtattgcataatggagaatgaagggattggcggcctttacaaggggcttgggccgagctgcatcaagctgatgcctgcggctggaatctcattcatgtgctatgaagcttgcaagaagatactggttgaagatgatcaggatagtgagtgaagcatgtgctcttgaaggaagatgagtcccctagttctttttctttcgttgagaaatgcaagttggatgattaacaatcaaaagtttaggactaagatatttgagatatctgttagatcaaagttttggctttggcttcatgtcaaaggattatttggcttcttttgtgctcgagttcaaatctatgaacaacaatgtcatcctgagcggaagcagttttgtcgtgattttgttctagattatatgcgtattaatgtcgtcgtgtcaagaatattttcgtatcacattgcacgggcatgactagaacatacgatacagaattcaagagaaataaccaagaattattaatatgccatgaactaccattcaaacggatcaaattggcagagcctcacaatgtatgtctcttgtcggccatatttaactgaaacataaacctgctgctaatcaacagttttgagttttgtcacgattttgttcggtcttttatatgcttcccctgctccatcagagcaacctgtttttgtcttcagaaaaactacactctttcttgggtttatctgggaaggattattttcatcttttaaagagaaaaccgagaagctaaaagctttaagcacaacaacattgcaatacacaaaaaataacaaaaataggcaccatgaactatcattcaaacgaatcaaataagcagagctttttgattacacaagataagtctcttgctgaccacaataaacggaaacttaaacctagcaggagtactaaattaaactcaacagccaacttaaaatagtttatttagctagccttgttcctcgccctcagcagcagccgcggcttccctctcctcggcagcagctgccatcagctcatcaaacttctccgtcttcccaagcaaaatttcaatctggacatcgcaacaggatcagaataaggaaatcgttgtcctggtaatgaaacaggcatggaatagaggaaaataaacgaaccttcgccttctgcataggacggctccttgagtcgtctttgacatcaacagttgatgtcatgatctctgcaagaatttgatcgagtagttaagagacattgacttcttagtacaaaaggattccggcgtcgaccaacaggataataaggcagcatgaacttactcttttcaacagcaaggccattattttttagaatttccgcaacagtcaccacagtggcaatggctgaaataataaataagaggtttagctgtttgaaaacatcataacgacaagcatgagcagtggcagctagaagaaacatcagcagattttaacatacaaaatgaaataaaaaactcaatcatggtagaaaatccactaaaattcagatggatgactagaatgaaacaacagcagaaaatacaatgccaattgccaagttacacaggaaattgatgattgtgaagccatgtctatggtcattagtcaatacacgcatattagttgtacattccactgctgacctttcataaagaagttgcacaaggaatcaataaatgatcgtgagatggggcatttgacatgaattgcaaatcaaaattatataatggctattctgtcaccaaacattgacactagagtaggcatataaacagttgtaagtttattccttgcataacagatccatcgcatcaatttgacaacaactacagattgcaactatcaatacaacagatgcatatatactccgaaaggattaataactaagggcgaaagtgcttacccatgccgagcgccgagagctccacctcattatgctgctgcatgtatctctgcaatcatcagaaaaacaacattagctccaactccaaagtatcgtagacatttattgtaatgcgacacaaacatttgctttaccaatacattcataaaagcaaatcacgaacaagaaaacaaaatcgacacttgattcaaaagctaggtctttgaagattaaaatagaaatagatcgatcaaagggcagctttttagggttttagacgaaaaaccccccgacggatcgaagcaccaaaaaggatcttctttgttaggcgggataaggggacaaacaagaatcggtcaaatcaaatcgacgaaacagcagcagcatccactcgctattgcctcatcacaaaccgccacacaaaatccggtaacaaaaaaaaaaaatcgaacagcaacaaggaacagggggaggaatcctgaccttggcgaggttgacgtagaagaagagcggcttcttggtgttggagacctggatccggttcttcttgtgcggctccgtgatggacaggttgctcaccgcctccgtcacctcctccatccccgcccgaaaccctaacgaaacctctccctacctccgaaacaagaaaaccccacgacctagccgccaagaacaaccacaacccggcgcagcgcaacggcgacgagcacgcgaggggagcgaatccggcggcggcgcaagaggaatcgcgagggggagcaaatccggcggcggcagcgagattggggaagaagccctatcgggtggtggccgcttatattgggggaggaagaatacaaggggggtacgggtcgggttcgagttcgagtccggctcggtcggaactcggaagcggtgcggttgcaactctggctcgggagaggccacgcgggtcggagacggactgtgcaggcccagtcgtagctgggcggggtcgttgggcccattgtcgaccaggatattagagagcaattgggttgggtgtagtctggcccaacttggctactttctgatggactgaggtcctgactcctgagcgtttgcccatatttcttcgtaagctaaaacgatttattagaaaataaaattaatttataggtgaaatttttatatatgtattcgtagcgacttaaaactcaatattaaaaaaaatgctacattggaaatatattaaaatcaacttacaagttaagtttgaaaatttaaatttggatactgagaacgaaggagtagcaaaacacagaagatcacatgcactgaaccaaaatctcattacaaggatcctctacagggatcgcgcaagcgacaaccatgaaaaacttgaacggcatgtttggctgctaggtctactgcagccgcagccggcatcaataatgtcgcacacacgctgcagcgctcgcctgccgtacatatgcaaaatcgagacttgtagtgtcctcttcgtaatttatttatataactaatagcttatctaaaagaatttgacatttttttccaggttgcccctgaggcgtgataaacttcatttggacaacagtaccaaattagaatcagtttaatcattgatgtacgttctgtcttgctcggttgtgttataaaaacttttctacatctccttgttttcgtacgtcataattttcttatatattctctgctaaaaaaatgctcgtgcgttgcaacgggtaaatacattttcctagtgatacaacatctattatgaaatgatcaataatttgaaacatcatgattgctttacactataattgaaaaggttaataaaaaaaatttcttggttttgagccaaaagcccattactttttttttccttttcaccccaagcacggtctgatgtctcctacctctctccgctcggactgtctctcttccgtccggttcggtccacaagtggaaccttagacccagctagcacaaccgccccatttagcagcgtcttaaaccttcggaagaaaaatccttttgtgccccgtacgatgacggatccgatcctcccatcaaaaatccagtcgagtcttttttggtctcccaacattggttcagagcttttgattcactcgatctcccccgtacgatgacggggccgatcctccccattaaaatctagttgggtcttttttttatctcccaacattggttgagagcttttgatccactcgatctcctcttttcgtttgctccaaatcggagcaaatccgcaaaactcgggacaaaaagggattggggaagctcgtcggtcggtcatcattgctgaccattaaacgaagattaaatccggcgaagtaaagccaaattgaaaggggaaatcatggaggaaacaatgagagaggagtggggaatcgatttttgcaatcaacggaaagagaaaacgtatggggaggtagatcgatgtggcggcggcgttaggggtcggcctaggcggcggctggagattaaatccgggaaaattaaagccaaatcaaaagaggtagggaatcgattttttaatcaattgaagcaggaaacgtatcaaggtggtggatcgggcaatatacaaagtgacaaaaaaatatagtgcgtagcacgcgtgtggaaaaattggatgagatccaaaaaaagggttgtgggaaacaccggaaaaaaaatcaaagcgggatagaaaaagaaaacagcgaaaaaaatggaccaaaaatattacgagaagccttacttattttttaaataggtatataggtatagatatagatttagcaaacaacgttgaaaatatattaagaacaacttcaaaattaaaatttaaaaatcaaaattttcttattaaggcaatcaattctaaaaattcagaattttcttactaaggcaatcaatgagactccttgtgccatgatcgaagcttaagggtacgaacaaaaacaaaaacgaagagtccttatgtatacgttgtaatcctattaccaatctcttgtttagtgagttcacaataaaaaaaacgattgctttgggtggccttcagttgtaacgggttgggttttagattctacagtcaggaggacgtgtcattccgtgtctggttctactactttttgttgtgccatacatgcatggtggccatggaccaaaatcgtgcacttagtgtccgacgacgatggatcacggattaaggcttttacgtgggcatcatgctgcttcatgcgtgatcgaatcggacacaggcgacgacgtacgaagccatggcaaaaacatcttaaactcttataatagataaagataagcatgataataaaaattgccctggctccttagtttctttcacttgtctattccaaaaaaaaatacagtattagtaaattttgtggtatagaattatagatggctagagatatagattttatatacatataaatatcacacatatatcatcattatattaaccggaacaaaacgctagtataggtgtccctgaatgtgttaactcattactccaactccacggttcaacgtaatcgtgcggggcaaagaaaaactggtgatcatatatcgcacacttaataacaatcaaaacatgactaaataagtcttcctataacttcaacttcaagaaaaagaaaattgaaacgagcttcaagaaaattaaaacatgataagttgagttcaacttcaaggctgtaacaacaagtaatcacgtttcaattgatattttttgtttgacttctggacatcatatatgtggatctcatgcagggaaaaatcagatattttt

SEQ ID NO: 69584 - DNA, 19364 bp, Oryza sativa
aatagattagaaaacaacataatacaacaattagattttccacataccttggaacttggaagagtgagaaacagagaatcatccttctgtacagtgtgcatattgaactgaagaatagcaaggagttcggaggaggaagaaacaaatggagagggtgactgtgacgaagtgctaaaaaatgtaactgaggtaactttcggtgctataaacctaaaatcgtaaactttcagtgctaaaactgaacataatactgcctaggatcctgattgatccgcttttagctaacgtggcagagtgggacccacatgttagtgaataacacttctcttcctcctctcctctctcttcccctctcccttccatatggtcgacgtcgaccaccgcctgccagtgccgcatggcctcctgcactcaccctcccatgccaccggcctccatcgcctcaccacccatggctctgctatcaccaccctgcgcgtgtcacccgccacagcgtctccctcctcctaccccacagtcgctcccttaccgtccactgtcctcgctcacctcgccaccgctagggtctctgtcctcccaggcctctctgaccccgagctcttccgcgtggcctctagcttcctcctgacctccgtgacctcttcacgatcgacatgccatctggatgggttcccgaactaccgctcctctgctgggctccgccttttccgcttcaccaaggaggaggtccccaccaccatcgccacagcgctgctggtgctccccggtagcctggtggggcgttgctccccgccttcccctcctctcatcccgctctatggttgacggtgctctgcctcactgggaacccggtgttccatgtctccgaatcccttcttactatatagttgtaatccactacaagcattaacttctctaaagcagcctccacgtgaagccacgtcatcaacatcttgcaaccatcggatcaagtgccatcttcgttggttcagcacccatgcagaaaactcttgttgattgacccaacccaacgttttcctccgccgagggtatcaggaccgtcgtgggactgctcgcctcctcaacgtgctgcactggcacaacatcaggaaactgccggcggcgtctcccttttcaccgcaatagcatttattttcattccaatgatgcaaacactgaaacacatcaacttatttgatcaagctcgaaaagggcaattgatcgccattcgcaacagtgcacatgtattgtctatttgactattagcttatttataacatttgttgaagaaacatctgtcttccgaatgttctcaaaattggcctgacaaaattgaccttaccaatccattcatatgtctcaaagttgaccttctatcttcatatcacttataatttgttataaagatttaaatatattctttttgttcaacataacatttagaaagcaacttttacaggtcgatattatgtatatggcaaacaacttcagctggagaaaaaacatgccaatgacaaggtttgcaattattcctctatcattttggccattaaattactattgtccatattaattgttctatcactaacccatctggcctaacatactgacagttgttttttcatatattttttttgacttgaagttgttttttcatatattgtattatgacacctttgtattatcattaaacttgaaacgtcaaccttttagtaaccctattttatcagaattggtcacttttcattcatacaaactatcgtaagcaatctttagttcatcacttagaatccccgccgcaacgcgcggggtatcacctagtatataaggtgatgaggccggatatctcttgaagtttttttttggttgtggtggtagttggggggggggggggtaatacgtaagggaaattcgacaaactattgttcaatatcttccttgtggttttcgaattatggaccaaggttgtgctcgatcgacgagcgaaatctcagatgattcaacattttccgtgtggtttccgaattagctagcttgcactatacgtgctatttttatcacgtttgtaataaaatgcaccggtccagctcacaacaaagtcatttattttcaatagacagggagacccaactctacagctcaattataatttcaaaataaatgatttaaagtccaaatagcatgtcaaaagcattaatcaaatagaactttcgaaaataaagaaatccaacgaaaagcatatggtttaaatgaaaggatggaaaatgaagcaacaaaatgtgcagctcacgaaaagttaaatttttaaaaagaaaatcagagagattgatgggtaaccttttgagctaccctaaaggaactaagattttatccatctagattgggctacacaaattcgacaaccaggttacctactgtttttaggttgggactatgcagtgttttatgaatttttagaccatgatgcaaagactcaaaaaatttagccaaaattcgtggagtctgctgggtatgtctacaagctactgttaaaagatagcatgattatcttttacggtttggactacataaaaagaagaacgccgctgtctaaagatttcagaacacggttatgcacactaattgagtttttaccctatgatacaaaggtccaaaaatcacaccaaaattcatgatgcctattctacatgttccttgtaaaaattctcaggtctatcgtctacggtttagcctaggcaaaattaacagactgactcgaaattccaaaacacgatcaaccgacacagaaagaaacttcattcatgttttaagttacctaaattcctcatcttttgtttacattaggttagggtggtacagaggctatgtgaattttgggtggtccatctaagcaacaatctacaggtttaagcacaacaattttatccttcacaaactacccattctagaccatgtcagtaaaatttgaaatgtcggaagagaggagttcaaaatctaccaaattcattttttttggtgcagagataacataaggagatggaaaccatatcatgtctttcaagatttaaattttatccatccattttcaaatcctataactagaggctatttttaacccgatattttgcaaatccgtactagtacataggtgattgcaaatggatttcaaaacttttcaaaacactttggaactgattttttatgattaataagtgttttcaaactcattttcactttagtacaagctttcaaaaggtctcggtcctatagagcaagataagagttttcaaaatcaaaatagagacctagaggaaagtaatctctagagagggatgatatataaggttgaatatgattttcgcaaaataatttgtagctgagagcaaaaccctcaaaataattttaagaaaccattctaaacgaccaacttaaggggttcctatagttggtattagctctggtaccatgcctgtggaggacacctgaactttacattatatctgccaattgaagtgaacaattcaaatcaagtagcaggcataatgtaaaatccgaagcctcaagtaaaggatataggagacattgctgggactttagcttgccagttaacttcagcctgagatgtgtccgtcaaaccacacgaaggcagtgactagatgtgttacacattcaggaaacttgacgaaaatagctaaagctctacgacatcccaaatatcctaaacccttactcatgtggaactagttcctaggatatccactagcttcacactttcatcttaagcaatgatacacagaagaaaatacaagacaaacaaaattcaattacaactactttagttatacataggccaactagccaaataatcagagattcgcgcaagcttgcctacccaaacaacaagcaaaccgactagggggttgaccccaattagaatctaattcctagaagaaacggttgaaacccgcatcactcaataaacactaagcatacaacctacaaaaatggatactctagtataacaagagtcagtacatcattagaaataatgtactgccaagcctaaagcaattctaacatattacatgcagggcatatattcaaggaaggctatatgtagttaaattttagcgtaaagcaagttttggttcacaattcctttcaaaggagttgatgattcaattaacaaaacaaattctgtaattatatcataaagaacatcatagtaccatcataagcatagctgccttccttggcaaggcataatatcatcatcacacgcgcacacacactcaacacaacacatttcaagagagaaaactagaaatgtttgatacacgcaaaccatgattttcataaaggcttggatgtgcaacaaaatgcatggatgagaaatgaagcgtaacgaagaaaccaataaatcgttagggacaagcaaactatgatttgcataaaatcagtaagctgcaatcaaatgtagacgtctagctcgcaaccaagatattcttcgataaacagggtaacataactataaaaattaaattagttataagtctactattaaaacgtcggagcacaaaaaagccgcaaggattaaatacaagcaaatattttcttttcacaaactagtaagcataagtttatacaaaatttcacaaactaaaataaagctttaaagtccaaagagaagttccaaaaagagaaaaattgtaactgaagaaatcaaacttaaagtaccaagttgaaatttaatgttgaaaaaaaaaccgttacgcgagaaacaaaagtaagattcaacgaaaggacggaaaatgaaacatcaaggaagaaacctagaatcatttgatacaaaaaagccgcaaggtttaaatgcaagcatatattttcctttcacaaacaagtaagcatatgttcgaacaaaattttcgaaagcgtcaacggagaaaccaataaattgttcggacaagcatactacgattttcataaaaccaaatagcatgtcaaaaacattaatacaatagaactttcgaaaataaagaaatccaacaaaaataatatggtttaaacgaaaggatggaaaatgaagcatcaagggagaaaactagaaatgtttgataaaatgaaaccatgattttcataaaggcatagatatgcaacaaaatgcaagggtgcagctcacgaaaagttatggattaaaaatgaagcgtcaacggagaaaccaataaatcgttccgaacaagcaaattacggttctcataaaatcaataggatgcaaccaaatgtagatgtctagcatgtaaccaatatattattttccgataaataggaacacgaaactcttgaacttagtctaaagtctacgattaaaacgccagagcacaaaaaagccgcaaggtttaaatgcatgcaactatttccttttcgaatatgggtcagcctacttaggaattcatattatttatgtggctcttacgatgattttgtctttggtgggggtggtatgagaacctatccttgtttggttggtggaatacgatctaaggtgtcatggctatgttgttttctaataacattacgatattattgattttaaatgtttataaaacttttcaagaatactagatttagaatctctaaccattaggatgtaacaaggttcaagtcttcatggtctacagtcatgatctaaccttgttgatctcacattcgataaatttaagttttaggacagcaagtaaggcggttgggaaaataaggataaattgaacaaaactttgggttacatcttaggggttggcaatatttgttctccgggtgctaattagtcatatgcaatctaatccaaggtgttctaggaatatttgtcgagtcatattggatgcatcaggacggtctcattatgtgcatccataaacttgggtcgtggtagaaaacgggatgctatatggcatgtatagcaataacttttctttttctcaaaaaggcaaggatgtatgtatgatgtcatgatgaatgaaatgatgcgatgcatgtatgatatgatacaatgcttatggagatattttgtattgcatacatgccatagaacaatcctttcgggaaaattgttcttgagactattgatcctactcatggtttttcatgggcattggaatggttgtaactctttatacgctataggctaggataaggtgacaaaattaaacatttttttacctagactcgtaacaaagttctccttatctaggaaagagatggtaattttaaaacaaatggattatcttagagaagttttcaaaacctaaaagtgaagttcctaaaccatgttgtgagttgctacgatgtacaaatcttgcatccgaccgtaaagggtcacaaaatttgcacactgagccatctcatcttaaattacatagtttgcttacgacttgttcctagtatgatatttccatttaggcttgtgggggcttgcaaaggttacatgttgtctctgggtttgtaagttcatggcactctatcccccttaaaataaaataaaattttgcaatggggtttatcaagaaatttaaatggaagagctaaataggtctatgtgccatatgctgtactatccagtcccgaggcgcaaactgaagcaaaagactatgctagatgggtgataaattagaaaaaaattatatccatgatcctaacaaagttttctcctatctgggaaggaatgttgattttttggacaaatagattattttagagaaattgggcaagacaagtgatgcagtgctggaatttatcggtctactatctttacctaatttttaggtaagttctaaaggttcataagaaatttttaaaaagaaaatcagagagattgatgggtaaccttttgagctaccctgaaagaaccaagattttatcccttctagattgggctacacaaattcgataaacaaagtatttttttttcgataaacaaggtaacgtaacaacaaaaattaaattagttataagtctactattaaaatgccggaacacaaaaaagccgcaaggtttaaatgcaagcaaatattttcttttcacaaactagtaagcataagtttatactacaaaatttaggaaattgagatttcaaaacgaaaataaagctttatagtccaaagagaagttccaaaaagagaaaatttgtaattgaagaaatcaaacttaaagtaccgagttgaaacctaatgttgaaagaaaaacccgttacgcaagtaagattcaacgaaaggacggaaaatgagttataagtcgaaaatgaaaatggtagagaacaaaaaagcccaagatttaaatgcaaggaaatattttcttttcactaactagtaagcataagttcaatcaaaatttaggaaatctgatatttcaaaactgaattaaagctttaacgtccaaagagaatatcaaaagcattagtaggagagaaagttcgaaaacaaagaaatccaactaaaagcgttcagtttgaatgaaaggacggaacattgaagcgtgaagggacaaacctaaaaacgatccatacaaggaaatcaagatttttatagaagcttcaaggtgcaacagaatgtatgggtccagtttacaacgatgttatttgttttcaataaacaagaagacgaatccaaataactcaattaataagttcaaaattaacgtcagagcaaaataaaacggtcaggcttcaatgcaaaagaatattttgcttttataaaacagaaaaaaaaagttcaaacaaacttaaggaagattaaccgtgacaacgaaaaaaattgcaaactccaaaaaggatatttgaagaatcaatgcaagaagaacattacaaaatcaaggaatccaactaaaagtacaaaattttaaacttatggataaaaaataaagcgtcaacgaagaacccataaatcgtttggaacaagtaaactacggttttcataaaatcaaaatgatgctaccaaatgtagaagtctagcccgcaaccaagatattttttcgataaacagggaaacgtaactctagaacttagttataagtctacgattaaaacaccagagcacaaaaaagccgcaaggattaaatgcaagcaatattttcacgaaccggtaagcataagtagatacaaaatttaggaaattgagatttcagaactaaaataaagttttaaagtccaaagagaagttccgaaaagagagtacctagttgaaattcaagtgtgaaaaacaaccgtcacttgagaaaccaaaataaagttttaaagtgcagttagcgtgtcaaaagcattaatacaagagaactttcgaaaataaataaatccaacgaaaagcataatgtttaaaggataggttggaaaatgaagcatcaagggagaaaactagaaatgtttgatacaaagaaactgtgacttttataaaggattagatgtgcaacaaaatgcatcggtccagctcacaaaaggttatttgttttcaataaacagggagacccgactctacaactcaattataagttcaaaattaacgtcggagcaaaataaaacggttaggcctcaatgtaaaatgaatattttgttttgttaaaccagaaaacaaagttcaatcaaactttacgaagacgaaccgtgacaaccaaaaaaaaaaggaaactccaaaaaagatatttgaagaatggatgcaagaagaacgttacaaaatctagaagcgtcaacgaagaaaacaataaattgttagggacaagcaaactacgattttcataaaatcagtaagatgcaaccaaatataacgtaaacccgcaacaaagatattttttctcgataaacagggtaacgtaactatagaaattaaattagttataagtctactattagatcatcagagcaaaaaaaaagccgcaaggtttaaatgcaagcaaatattttcttttcaaaaaactagtaagcataagtttatacaaaatttaggaaattgggatttcagaactaaaataaagctttagagtgcaaatagaagttcaaaaaaagagaaaatttgtaattgaagaaatcaaatttaaagtaccaagttgaaacttaatgatgaaaaaaatcgttacacgagaaagaacaggaaatatttaaagtccaaatagcagaacgttaaaaaaaaagcaatccaactaaaagcataaagtttaaatgagaagacggaaatgaagcgtcaagggagaaacccataaacgtttggtacaaggaaaccatgatttttcatgaacttaaggaagatgaactgggacaacgaaaaaaaaaatggaaacaccaaaaaggacatttgaagaatagatgcaagaaaaacgttacaaaatcaaggaatccaactaaaagtaaaaaacttaaacttatggatgaaaaataaagcgtcaacgaagaaccgataaatcgttcgaaacaagcaaactaccgtcatcataaaatcattaggatgcaaccaaatgtagacaaaaaataccaagttgaaacccatggagtaatataaaaaaaaggtcacacgagaaaccaaaataaagtattaaattccaaatagcagatcaaaagtattaatagaggagattgttcgaagataaagaaatccaactaaaaacataaagtttaaacgagaggacggaaaatgaagcgtcaagggcgaaacctagaagcgtttgatacaaggaaaacgtgattttcaaaaaccttcaaggtgcaaaaaaaaaaaaatgcatgggtccagctctcaataaagttatttgttttcgataaacatggagacccaactatacagctcaagtattcaagttatttgttttcaataaacggggagacaaaactctacaaatcaactaaaagatcaaaattaacgacaaatcaaaataaatcggtcagagcttaatgcaaaagaatattttgtttttataaaccagaaaacaaagttcaaacaaacttaaggaagacgaaccgtgacaacaaaaataattggaaactccaaaaggatatttggagaattgatgcaagaagaatgtttcaaaatcaaggaatccaactaaaagtacaaaatataaatttctcgatgataaatgaagcatcaacggagaaaccaagaaatcgtttggtacaaccaaactacgattttcataaaatcaattagatgtgaccgaataaagacatccagctcgcaactaaatatttttttgataaaaaaaggagacgtaactctagagtttaaatataaggcgaaaattaaaacgtcagagcacaaaaaagccgcaaggtttaaatgcgagcaactattttttttcacaaactagtaagcaaaagttcatacagaatttaggaaataaagctttaaagtctgaagagaagttccaaaaagagaatctttataattgaagaaatcgaactaaaagtaccaagttagaacttaatgatgaaaaaaatagatcgtcacgcgagaaaccaaagtaaagttttcataaaccaggtatcaaagttcaaaccaacttaaggaagacgaacggtgataaccgaaaaatttggaaactccaaaaaggatatctgaagaatgaatgcaagaagaacgtttgaaaataaaggaatccacttaaaagtacaaaatttaaaacttacggatgaaaaatgaagtgccaatggagaaaccaataaatcgatcggacaagcatactacgattttcataaaaccaaatagcatgtcaaaagcattaatacaatagaactttcgaaaacaaagaaatacaacgaaaataatatggtttaaacgaaaggatggaaaatgaagcatcaagggagaaaactagaaatgtttgataaaatgaaaccatgattttcataaaggcatagatgtgcaacaaaatgcaagggtgcagctcacgaaaagttatggattaaaaatgaagcgtcaacggagaaaccaataaatcgttccgaacaagcaaactacggttctcataaaatcaataggatgcaaccaaatgtagatgtctagcctgtaaccaagatattgtttttcgataaatagggacacgaaactcttgaacttagttctaagtctacgattaaaacgccagagcacagaaaagccgcaaggtttaaatgcatgcaagtatttccttttcgaatctgggtcagcctacttaggaattcatattatttatgtggctcttacgatgattttgtctttggtgagggtgttatgagaacctatccttgtttggttggtggaatacgatctaaggtgtcatggctatgctgttttctgataacattacgatattattgattttaaatgtttataaaacttttcaagaatactagatttagaatctctaaccatcaggatgtaacaaggttcaagtcttcatggtctaaggtcatgatctaaccttgttgatctcacattcgataaatttaagttttaggacaacaaggcgattgagaaaataaggataaattgaacaaaactttgggttacatcttaggggttggcaatatttgttctcctggtgctaattagtcatatgtaattctaggaatatttgtcgagtcatactggatgcaacaggacggtctcattatgtgcatccataaacttgggtcgtggtagaaaacgggatgctagatggcatgtatagcaataacttttctttttctcaaaaaggcaacgatgtatgctatgatatcaagatgaatgaaatgatgcgatgcatgtatgaaatgacacaatgcttatgaagatattttgtattgcacacatttttttttgatggaaggcaaaagctcatgccatacatgccatagaacaatcctttcggaaaaattgttcttgagactatttgtcctactcatggtttatcatgggcatgggaatggttgctactctttataggctttaggctaggataaggtgacaaaattactttttttttactcagactcgtaacaaagttctccttatcaaggaaagagatggtaattttaaaacaaatggatcatcttagagaagtttgcaaaacctaaaagtcaagttcccaaaccatgtttgtgagttgctacgatgtacaaatcttgcatccaaccgtaaaggggcacaaaatttgcacactgagccatctcaacttaaattacatagtttgcttatgacttgttcctagtatgatatttccatttaggcttgtgggggcttgcaaaggttacatgttttgtctctggtttgtaaggtcatggcactctattccccttaaaataaaataaaataaaattttgcaatggggtttatcaagaattttaatggaagagctaaataggtctatgtgcccatatgctatactatccagtcccgaggcgcaaactgaagcaaaagactatgctagatgggtgataaattagaaaaaaaactatattcatgatcctaacaaagttttctccaatctgggtaggaaaggtaattttttggacaaatagattattttagagaaattggtcaagacaagtgatgcagtgctagaatttaccggtccactatctttacgtaatttttaggtcaagttctaaaggttcaaaagaaatttttaaaaagaaaattagagagattgatgggtaacctttttgagctaccctaaacgaaccaagattttatcccttctagattgggctacacagattcgataaacaaggtatgtttttcgataagcagggtaacgtaactatagaaattaaattagttattaccctactattaaaacgtcggagcacaaaaaaagccacaaggtttaaatgcaagcaaatattttcttttcacaaacaagtaagcatgcgttcaaacaaaattacagaaattaccattttagaagtaaaataaagctttcaattctaaagagaagtttcaaaaagagaaactttgtaattgaagaagtcaaacttaaagtatcaagttgaaacttatttttaaaaaaaacccgttacgcgagaaacaaaagtaaagattcaacgaaaggacgaaaaacgaaacataagggagaaacccaaaaacgtttgatacaaaaaagccacaaggttaacatgcaagcaaatattttcttttcacaaataagtaagcatagattcaaacaaaattttggtaatttacattttagaattaaaataaagatttaaagtgcaaagagaagttccaaaaagagaaactttgtaatcgaagaaatcaaactaaaagtaccaagttgaatctgaacaatgaaaaaagaaccgtcccgcaggaaaccatagtaaagttttaaagtccaaatacacatcaaaagcatgaatacaaaaggctaataaatcgttcagaacaagcaaaaactgcggttttcataaaatcgaaaggatgcaaccaaatatatacgtctagcccgcagcaaagatattttttcgataagcagggaaacgtaactctagaacttagttataagtctacgattaaaacgtcatagcacacaaaagagccgcaaggtttaaatgctagaaatattttcacaaaccagtaagcacagtacatacaaaatttaggaaattgagatttcagaactaaaataaagttttaaagttcaaagagaagttccaaaaagagagtaccaagttaaaattcaagtgtgaaaaaacaaccgtccctcgagaaaccaaaataaagttttaaagtgcagttggcgtgtcaaaagtattaatacaagagaactttcgaaaataaataaatccaacgaaaagcataatgtttaaacgatagaacagaaaatgaatcgtcaagggagaaacctagaaatatttgatacaaggaaaacatgattttcataaaagctttaaggtgcaacaaaatgcatgggcccagctcataacaaagttatttgttttcaatacacagggagacccaactatacacacaactataagctcaaaattaacgtcagaataaaataaaatggttggtcatagcacaaaaaagccacaaggtttaaatgcaagcaaatattttcttttcacaattaagtaagcataagttcaaacaaaattacaaaaattgccatttcagaagtaaaataaagctttcaactctaaagagaagttccaaaaagagaaactttgtaattgaagaaatgattcaacgaaaggacgggaaatgaaacgtcaagggagaaacctagtaacgtttgataaaaaaagccgcaaggtttagatgcaagcaaatattttcttttcacaaacaagcatagattcaaacaaaattttggtaatttacatttcagaactaaaatagcatgtcaaaagttttaaagtccaaatagcatgtcaaaagcatgaatacaagagaacattcgaaaataaagaaatccagcagaaagcatacagtaaaatgaaaggatgtaaaataaagcgtcaagagagaagcctagaaatgttttatacaaggaaactgtaattttcagaaaagattgaacgtgcaacaaactataagggtccagctcacaaaaaagttagttgttttcaataaactgggagactcaactctagaactaacggcagagcaaaacaaatcggtacggcttaaagcaaaagaatattttgtttttataaaccagaaaacaaagtccaaacaaacttcagaagatgaaccgtgacaacaaaaataattggaaactcaaaaaaagatatttgaagaatgtttcaaaatcaaggaatccaattaaaagtacaaaatataaatttctcgatgaaaaatgatgcctcaacggagaaaccaagaaattgtttggtacaaccaaactacgattttcataaaatcaataagatgcaaccgaatgtagacatccagctcgcaaccaaaatattttttttttgataaaaaggaggcgtaactctagaatttaattataaggccaaaattaaagcgacatagcacaaaaaaaccccacaaggtttaaatgcacacaaatatgttcttgtgaaaaattattaatcataagttcaaacaaaatttcagaaactgagatttcagaactaaaataaagatttaatgtccaaagagaagataaagaaagagaaactttgtaattgaagaaatcaaactagcagaactaaaccgaaactcaaggatgaaaaaacaaccatcactcgagaaaccaaaataaagttttaaagaccaaatagcatgtcaaaagcattaatacaagagaacgctcgaaaataaagaaatccaactaaatgcagtaggtttaaacgaaaggacaaaaaatgaatcgtcaagggagaatcctagaaatgttcgacacaaggaaaccttgattttcataaaagcttcaaggtgcaacaaaatgcatgggcccagctcacaacaaagttatttgttttcgataaacagggagactcaactctacaactcaattataagagcaaaataaatcaattaggcttcaatgcaaaagaatattttgtttttataaaccagaaaacaatgttcaaacaaccttaagatgaaccatgacaacagaaaaaaattggaaactccaaaaaggttatttgaagaatcgatgcaagaagaacattacagaatcaaggaatccaactaaatgtaaaaaaattaaacttatggatgaaaaatgaagcgtcaacgaagaaacctataaatcgttcggaacaagcaaactacggttatcataaaatcaacaggatgcaaccaaatgtagacgtctagaccgcaaccaagatattttttcgataaacagggaaacataactctagaacttagttataagtctacgattaaaacatcagagcacaaaaaagccgcaaggactaaatgcaagcaatattttcacgaaccagtaagcataagtacataaaaaatttaggaaattgagattacagaactaaaatatagttttaaagtccaaagagaagttccaaaaagggagtacctagttgaaattcaagtgtgaaaaacaacgtcactcaagaaaccaaaataaagttttaaagtgcagttagcgtgtcaaaagcattaatacaagagaactttctaaaataaataatcgaacgaaaagcataatgtttaaacgataggttggaaaaggaatcgtcaaagggagaaaactagaaatgtttgatacaaggaaaacgtgacttttataaaggattagatgtgcagcaaaatgcatcattccagctcacaaaaggttatttgttttcaataaatagggagacccgactctacaactcaattataagttcaaaattaacgtcagagcaaaataaatttgttaggcctcaatgcaaaatgaatattttgttttattaaaccagaaaacaaagttcaaacaaactttatgaagaagaaccgtgacaaccaaaaaaaaaattggaaaccccaaaaaagatatttgaagaatggatgccagatgaacgttaaaaaatctagaagcgtcaacgaagaaaacaaaaaatcttgagggataagcaaactgtgattttcataaaatcagtaagatgcaaccaaatatagcataaacccgcaaaaaagatatttttttcgataaacaggataacgtaactatagaaattaaattagttataagtctactattagatcatcagagaaaaaaaagccgcaaggtttaaatgcaagcaaatattttcttttcaaaaaccagtaagcataagtttatacaaaatttaggaaattgggatttcagaactaaaataaagctttaagtgcaaagagaagttcaaaaaggagaaaatttgcaattgtagaaatcaaacttaaagtaccgagttgaaacttaatgatgaaaaaaaatcgttacgtgagaaagaataggaatgatttaaagtccaaatagcaaaacgttcacaaaaagaagtaatccaactaaaagtataaagtttaaatgagaagacggaaatgaagcgtcaagggagaaacccataaacgtttggtacaaggagcgatttttcatgaacttaaggaagacgaaccgtgacaacgaaaaaaaattggaaactccaaaaatgacatttgaagaatagatgcaagaagaacgttacaaatcaaggaatccaactaaaagtacaaaatttaaacttatggatgaaaaataaagcatcaacaaagaaccgataggataaatcattcggaacaagcaaactacagtcatcataaaatcaataggatgcaaccaaatgtagacagaaaataccaagttgaaacccatggataaaaaaaaaggtcacacgagaaaccaaagtaaagtattaaagtccaaatagcaaaccaaaagtattaatagaggagatcgttcgaagataaagaaatccaactaaaaacataaagtttaaacgagaggggcaaaacctagaagagtttgatacatggaaaccatgatttttcaaaaaccttcaaggtgcaacaaaatgcattggtccagctctcaataaagttatttgttttcgataaacatggagacccaactatacagctcaagtattcaagttatttgttttcaataaacggggagacaaaactctacaaatcaactaaaagatcaatattaacgacaaatcaaaataaatcggtcagagcttaatgcaaaagaatattttgtctttataaaccagaaaacaaagttcaaacaaacataaggaagatgaactgcgacaacaaaaataattggaaactccaaaaaggatatttggagaattgatgcaagaagaatgtttcaaaatcaaggaatccaattaaaagtacaaaatataaatttctcgatgataaatgaagcatcaacggataaaccaagaaatcgtttagtacaaccaaacatcataaaatcaattagatgtgaccgaataaagacaaccagctcgcatccaaaatattttttcgataaaaaagaaggcgtaactctagaatttaaatataaggccaaaattaaaacgtcatagcacaaaagccgcaaggtttaaatgcgagcaactatttatttttcacaaactagtaagcaaaagtccatacaaaatttaggaaatggagacttcagaactaaaataaagctttaaagtccaaagagaagttccaaaaagagaaacaatataattgaagaaatcgaactaaaagtaccaagttgaaacttaatgatgaaaaaaaagaccgtcacgcgagaatccaaagtaaagttttcataaaccagttatcaaagttcagaccaacttaaggaagacgaacagtgataaccgaaaaatttggaaactccaaaaaggatatttgaagaatcaatgcaagaagaacgtttgaaaataaaggaatccaactaaaagtacaaaatttaaacttatggatgaaaaatgaagcgccaataaagaaaccaataaatcgttcggacaagcatactacgattttcataaaaccaaatagcatgtaaaaagcattaatacaatagaactaaaaataatatggtttaaaaaaggatggaaaatgaagcatcaagggagaaaactagaaatgtttgataaaatgaaaccatgattttcatcaaggcatagatgtgcaacaaaatggaagggtgcagctcacgaaaagttatggattaaaaatgaagcgtcaatggagaaaccaataaatcgttcggagcaagcaaactacggttctcataaaatcaataggatgcaaccaaatgtatatgtctagcccgtaaccaagatatttttttcgataaacagtgacacgaaactattgaacttagttctaagtctacgattaaaatgccagagcacagaaaagccgcaaggtttaaatgcatgcaactatgtccttttcgaagatgggtcagcctacttaggaattcatattatctatgtggctcttacgatgattttgtctttggtgggggtggtatgagaacctatccttgtttggttggtgcaatacgatctaaggtgtaatggctatgttgttttccaataacaatacgatattattgattttaaatgtctataaaacttttcaagaatacttgatttagaatctctcaccattaggatgtaacaaggttcaagtcttcatggtctacagtcatgatctaaccgtgttgatctcacattcgataaatttaagttttagtacagcaagtaaggcggttgggtaattaagaataaattgagcaaaactctgggttacatcttaggggttgacaatatttgttctccagttgctaattagtcatatgctatctaatccaaggtgttctaggaatatttgtcgagtcatactggatgcatcaggacggtctcatta

SEQ ID NO: 69585 - DNA, 3951 bp, Oryza sativa
tttcctctgtgactctgtgctgtccaacaagcaattgtcgaacctcatcttgaccttttgcatcacttctgggtttctgatgagttcagccataatccattgcagtgttatggccggtggctcactgcccccaatgaacatgtcctacacgatacaaagccaaaatttcattacttgtaagcatatattcatggaaaatgcaatggcaacaattttttcaatctattatattattaaaacagttttgaagtgaggcatcacgtctgttgtaaatgctagaaacttcctcattaataaaaaaaatgatcttaactacccgattttgttggtttcagattaattataatggtatagtttgactgatatagttgtatacaaaatataattacatctatagaaatataagttaagggttgtatatgaaatttaagcctatagaaatagaatgtaagagttgtatggtacgccatccgtgtatgagtctgtttttaactttgtttgcttttgaaaatacatatccgcatttgagtcatttttaagatcattcacttttgataatacagaaggaatcatataagaaatctgtttaaaaaaactcacatgctaacctgagacgatcggactcctaaccaggggtggatccaggaacaaaaagttgggggactcaacataccgtgtacaccgatataaacacataatctcagtattaaactatgctaaaatgttattaagagacctttagcacctcctatcttatcaaccacgacgaaaaaattttaggaggaactcaggggggtatccatgggtctggtgggtgttgggggactcaagtccccctgcacccatgttggatcctcccctgctcctacctgcagctcatgattttctatatatatatatatatatatatatatatatatatatatatccaagcaaactctcataacgaattttatcttaactaaaccatataacaataataagattaaaatagacttcacccgttacaacgcacgggtattttttctagtatatatagaaataaaatttcagagctatatattatatctaactctacgtgaattatctagattcgtgcaaactgcagagcaataccctagtttaattaattgacatcactgttaaaaaaaacacatgaagtcgcgaaattccattatttgtgtctatttgcaacacttgaaatttatatatgtttgcaacacttgaaattttcttaaacgctttatttatggattcagggtacttactccgatcgttgatctgatgctttctctggatacctccaggtcaccttctctctggatcctgagaagcacgtcgagcaagtcctcgtcgtcttcccgggacgctctgctctcttggtgctcctcgatgatggcgtccaggtaggccgtcattctctcgcggtgccgtttcatccggcgaggcattgtgctgaggagcacggcgaggcgcgatgacgggtacaggttcggcaagctctgctcgccgaacagcttgatcccgcgctccaccatcgccaagaacgtgtccctgtccttgagcccccgcccgatcatggcgcgcgccgacgagtcggcggcgtaggccgacatcagctcgctgaggttcaccgtcgtctgcgccgccgccgacgccaccgcccggagcatccggccagcctccttctcgcggacggaccggaaggaatggacgcgcctggcgctgagaagctcggcggtgcagatcttgcggagctgcctccacgtctcgccgtagggcgcgaagatgaccccctcggatccctccgggaagacgacccggatcatccggttgacggggcgcgccgcgaaggcgacgtcgtgcgtcttcatgacgtcgcgcgcggcgtccgcggaggaggcgacgacgacggggagctcgccgagccggagcagcacgagtgggccgtggcgccgcgcaatgtcgcgcatggcgcggtgcgggagcgccccggctaggtggtggaggtggccgatcaccgggagtgcccatggcgacggtggtagccggccgcaggcgccacgccggcggcgcgacgaacggaggaggaggaaggggaggatgaacagcggcagaagcaagatgaggtggtggagctgtacaacctccgccatggctggtgggttagcttggatcaaatcaaagctcaaacgattttgtatctaagcaatggagtttaaatgtttgcattttgcttgctgttgctgctcaatagctggctgattgttgggccctgtttaggggagccgcagatttcatattttactggttggtaaccaactttagaaaatcgaaactgctaaatgactgtcgacaaatttttaggccgtcgatttcgctttaagatttgtgctgagatattttgctaccggatctaaaccctcttttcataagctagccacatcatcacatgtatatggtaaatttgttcatgttacatctaaattgcatttcagttatatgctagttacattgtagttacactataattacattgtaattatattgtaactatagtgtaactacactataactatattgttatctctatataaattagatataaagttgtatatattattttaatacatatatgtaccagttattattatagtatagttctagtgaaattatatactatagttagatttaaaagttttcccctcaaaaaacactcgacagttttttaagctagtcccttagaaaatttagagatgctgggtttttcagcttttggattcttcattttctgaattctaaaaaaaaaatttgagtaataatatggactgtttgaggaactgaagattctgggtgtatttagatctcaaaatatttggccaaaaatattacatcaaatatttaaacacatgcatggagcattaaatgtccgatctacatccgccgcccaccagtgccgatggctatggtggaggcggagcagatcggatgaggaggcgggctagggctagggagcctccccacgcaaggcaacccaagaggccatcttttctatttttttcttaaatgattctaactacttgatcgcccattggatcgtaatgtttggagaatcgaacgatatatctttcccgagattatttcatgaattcagtagggtgacttttataccttgtactggacgagattagttgaccaacttgttggtaattaaacgaattataagaacaagtgatcaattaactaagactgtagctagcctcgattaatggtcagatcgatctgcatcaactaatggattattttttgaatactccatccaatctgcatcaacaatcttagcctcaattaactaagactgtagctagtctttgtgcatagaacatcgtgatcactaagcatctaagcccccaaagttaatataagaagtacgctgctaatattctcgcatcccccgccaggtgttaactgccaataccctcatttatacaaatccagctaagcaacgtactacacgtgactagcactaggtgcgacaacagtacgtagcaacgtttttctagtttgagaaaatccgcggaacggtcaggggttttatagctagctccataagatgataggctagccggtctagtttcaaagtctaactccttttatttatttgataactagaaaaaaatatttgtgcgttgcaacgggtgaagattattttaataataatattattatacggtttagttaaggtgaaattcgccataggaattcgattggacatattttttttagaaaatcatgagctgcaattaggaatccgatcgtctcaagctagcatgtaatttttttaaatagatttcttatacgactccttctatattttaaaaaataaacgaactttaaaaactgactcaaatacggatatgtattttcaaaagagaacgaacttaaaaccgg

SEQ ID NO: 69586 - DNA, 3297 bp, Oryza sativa
ttccccataggaattcgatggacatattttttttagaaaatcatgagctgcaattaggaatccgatcgtctcaagctagcatgtaatttttttaaatagatttcttatacgactccttctatattttaaaaaataaacgaactttaaaaactgactcaaatacggatatgtattttcaaaagagaacgaacttaaaaccgactcatatacggatgacgtacctgtcatagttacgaataaggcatacttactatcctatgacatatgaaatatacagatacgacataccttcgtatgtacgatatacttccatatacaacaaggaaaatgacaagagactatgaaaattatcctcatggacaagtgaatagtagagccctaccttgaggattgggtttatattatatcgtgcagggtccgtagtctccgagttctacttggagactaaggtgattcacggtataaaagatacatcccctgagggatccagatcatcgaatcatagcgccaataccaccaccatagcctacaatccggaggacgtgaagcctactcaccgggagatctcgtcgaaatcatctcgacgaggggtctcgccgccaatcttgggattgattgttctctattctaatatgtagttttccatatcaatctcatataaactggactagagctattaccttatgaggggcctgagccagtataatacttgtcttcttgttttcttgatgtcgtatcgtgtaaattctcataccaacttaccacaataccctattcatccggtttatgagatttctcgttgacagtgctaaagtactggcaaaaagatattcaatttttataatagtagagataagttctttctctaattttcgccttttttaaaaaaaaatcgttgtgtacctccttttaggtccttgatattttttttgtacgttgccaatccctttactttaggttaggatcaagaagacattattttaggttaagaatcaagaagacataagcttcgctgcaaatcctgtaacgccccaatttccgtatacccttaaaaactatttaataaaattctatgttcaaaagtttggttatttgagtgtatctaggtttgagtaccaaagatctcaattaattcattcctttgtgaactcaaaatcttgaccaaaatattctatcctaaattaaatttctaagattcaaatttcgaggttcgagtcccctcctaaaccattcaaaaattcatacaagaactcatataaagtcgtagaatcattagagttccaaggtcctaagcaaagtccctcgaaatttcatttcctaaaattcctggaaattggaaaatattactattccggcacaactaacggaggaggaggaggaaggggaggatgaagagcggcagaagcaagatgaggtggtagagctgtacaacctccgccatggctggtgggttagcttggatcaaatcaaagcataaaggattttgtatctaagcaatggagtttaaatgcttgcattttgcttgctgtttttgctcaataggtggctgattgttgggccttgtttaggggagccgcagatttgatattcttctgcttggtaaccaacttctgaaaatttagagacgctgggtttttcagcttttagatttttcattttctggattctacaactatggatttttagaaaaatttgggtaacaatatggaccgtttgaggagctgaagattccgggtgtgtttagatcctaaaatattttggctaaaaatatcacatcaaatgtttggacacatgcatggagcattaaatgtggacgaaaaaaaccaattgcacagtttgcatgtaaattgtgagataaatcttttgagcctaattacgccatgatttgacaatgtgatgctacagtaaacatttgctaatgatggattaattaggcttaataaatttgtctcacagtttacagacgaaatctataatttgttttgttattagtctatgtttaatacttcaaatgtgtgtccgtatactttaaaaaaatttggccaaagaactaaacacggcctctgtgagaagctatagctgctaaaagctcttccaaacaatcccttgttcttagtcagctctgcattctgcacccagctagttttttgaattagaaattattgccaaaaggaattatgaaaattaatggaatctttgtgtattctatccagtgtttcataaaaaaaacaatttgttgctagcgtttcgttggttatcagaaatttagaaacaatttaatgaaatttcgaatttaatttgttttaatttatccagattactcagcggtttcttgataggaaccggctaagataactgatggccacagtaaccaggtgatattttaactacttgatcattggatcgttattttgaggaatctaattatttactatgatagatggatgatactcattaattcggtatatggtgacttttatatccctcattgcactaacgagatggttgactaacctatatcggttcctgatttcctacaattaaacgaattgtaagaacaagtgatcaattaactaaggctatagctatagcctcgattattggtcagatctgcatcaacctaatgaattactttcaaagaaaactaatgtcatctctgtgtataataacagcctgatcactaagcatctaagccgccaaagtaaatagaaaaggcatgctgctaacattcgcatcccacgccatactcgcatcccgctaagctacgagctcatatatgatatatacaactagccaggcaactgcacgtacatgataaggattttctatacatggatgtcatgaaacccatcatttacgcgcgacttagatagttataggaaaaagtaacattaattgtgatgttataaatcgatacacaaacgtacaagattagattgatatacaactagagaaataacactactacacgaatgatttttcatggacgccgggcccttttgggcgggccatgagtggaaccgcacgggataatcgagcgaccggcatcgggcggacgcccacacgggaaaatcaattatcccgtgctggcatcttaatccaaccgcacgggataatcctcattatcccgtgcggtcaacttaagtggaccacatagaaaaatcgattttcgcgtgcgggctttttaagtggaccgcacaggaaaataaaatatcccttcctattttctctctcacccacttcaattttttttgacaccctctcttctttttccctattatattcctctcctcccct

SEQ ID NO: 69587 - DNA, 2437 bp, Oryza sativa
agcaaaagctatctagacatctagacatgtccgcaatttccaaaaaaaattgatactaaatataaaaaatcgtcaatatgtacgtttcatgggtgatagttattgatattataaatattaagttctaatcatattttaaatatattgattaatatttttatttataagttgcttaaattaatagggaattcactagtaaaagacgatttttgcatatggccaaaaaccgatttccgtagtcagctgggtggctcgatgcaccttggtgtctgcgaaaatcaaaatttatatatgagcaaaacaaccgcatgcaaaaataagattttcatgcgaaaataattttagccaaaaaacaaaaattccaaaaatcaaatttgaaacccctagctcctcgattcatccctgagccctagcctgccaccggcagaaaccatagcccgccgctagcccaatccctagctctttgtcgccgccaccaatgctgtcgtcgtgctcacaagccgtagtctgtcgtcgctatagcagtcaacgagcttcgcctcgccaccctaccaccaatgtcaccctctgtcaccggatccgcgccagggaggacggtggagggccggatccttgtgggggagggcggccgccgtcggatcggtgcgggggagcgcagccgccgctagatccgcgtggaggagggccgccgctggatctgccacaaacgtgcagttatcgctgccgacgtagtagttctatatggctccttaattttcgcatgggcgcaccgcacggtggtctcgttggtccatggagaccaagatttacagcccaaagtttttgggcctgcacaggattgggccaacggggcagcactgcggcagattttagtctcggggatgtagtgagtgatttgaggcatcagaattcagagactgggcatgacatgtctgatcgaattcatgtttcagttctgaaactatggaagacgcccagatctgtttttggagtatcttccagcttgcatccgtaattggtgcatatacgctttcacccagtattctcggagaattgttctgcatagcagaacacttaaaaacgtgaccgtttttattgcaaaattttgcaggctgcaatttaaatgtgactagggacaaatccaaaaaaaaatagtgagctagggatttgaataagctagacaatgttaaatttttggcacactttggcgttctcaaattttgactatatatgatggatgtgttcttactaaactagtgtttgtatgagaagaagttttaggaaatgccaaattttagtaaagtgatgatggcaagagtttgtttagtttgttaccttaccaaattttagtaacaaaagaaatggtagggctgaaagtgatggtggcaaagtgaacagaccctatgataaaaaaaaattagtgagggttttatgggagctctcatggttttattgccagtaggagtctcgagcccccaccgtcccacgctagatccgctcttgactgattgaaatttgcaaatctaccatcgatgtggtgactttatttaccaagttgaaatcctaccgaaatatggctgtgtgtattcttggttgatgcatagaccgaaagttatacttccatttgtaataataataataataataatgataataataataataataataataataataataataataataataataataataatgaaaaccgttgtttgggttctcagtccatttgactgtggatgtatgcatgatcaattacattctaccattaaaatatgcaaacctgaacgcttcaagtaatttcttgatgctccatctaccatccactagcaatccctccatttctgccattccattcactaaccaaagtttaggggactccagagttcagagttccttcaaacttcgcgacaaagtttagcggacttatgtcttttttttacgcgttaagatacaaattttatcttgattttttatcactctttttaaactgataaaacaatatatttcatacaaaaactttctatataaatttttttttaaaatatcagataaatctatttttaggttttaaataaaaagctcaattaatcatgagctaatgcatttatcgttttgtatgctcgtacttaatgttcattcatcgcaagttcgaacggaacgtttagacagatctaagatctgtggttagcagctcaaccgaactacatgatcccctgcatgtatcagctagctatttgggctccgcaaattacacacaaggcgatagaaactaccacattaattagaaggaagtataattatgaattgcatatgtagattgatttgttgtatgtattagatagtttttcgaaacattacaaccgtatgaaaaatataagtgcactcgaaaagagtcccaaaccattagaaccgtatggaaaagagacga

SEQ ID NO: 69588 - DNA, 1441 bp, Oryza sativa
ccggtgggctcaagggtgcggcggaggctgccgacgacgatgacgacgacgaggcaacgcggcggccgttgccgccgacgacgacgaggaggcggtggccgggagcagcaccgccgctgcctccacttgaccactcttcccctcctcccaacgctcgcgcaaggcgtccgggagcggcgccgccctccccactcccggatccggtggcggcggctaccccacgccggatccagtggcggtgggagccggcgcggcagtggcggcagggtgccccgatctatggttaggatttcaattttttgaaattttatttttttttcagatttttatttttccgtgcgggtgacataagcacccgcacgagaaaatcacgattttcccagacagcccgctccaaacgggcgaatctaccgcacgcaaaaatcaaaacaaccacacgcaaaaatatctattgtagtagtgtaaaaataatagaaactgatagtaaatagaacctgtataacgcagataaaatttattattttttcttcatgtgtagatcaaatttagacttcatatttatatagagtcttatatcgtcatagtttatcttatcaaattttatgaattttttatataactatttgaactacatgcatacacttaaatgttatggcacctgggtgtagaaaatacttgcccacgtagactagcatcatgtgcaaacacagtagcaacagttctttagctagcttgagaaaattcattgcaatggcaacctctggctacacaactgcctccctaggctcccatcggatggcctaataagaaaaaaaaccaaattttaaattttcaaacttaattttgagaatgactttgagatattttcaacgtagatttttttagcattggcttttaaatcacaaagaacacatatataaaagttttacctacaaattcaatttttattttctaataagccgttttggcttattagaaaaaaagcgaaacgatggcgcccctaaagtccctatggtggagctttagctcgtgcttgtcgcagggtgactgtgaggcagagagaagttggggaaagaaagagagtggtgctaacaggtggcactcatattttggtggtgtttgtatctcctgaagattaagataaagataaagtgtttcaggtaaaataaggtgataataacgtatgattaattgagttttaattattataaacttaaaaaaatagattaatctattattttagaacaactttcgcatagaaagttttcgcacgaaacacatcgtttaacagtttgaaaagcgtgccacgaatattcaaaactttatccactctttgtggtggaaacgagacctttattttattttactgacagatgggcagtgcagatgttttctataattcagcatgaaaccagcaggggcggatcgaaatagtgctaaa

SEQ ID NO: 69589 - DNA, 579 bp, Oryza sativa
ttttattaaattctgaaatgtttgctaaatgctgtttatgcaaatggaaccctattatgccatcctttggtatccttgtgcacttgcatatttgctgcgtggcttgctgagtatgtcatatactcaccttgcaatcattcatcagaggaagagttctacaatgatgctgatggtgtggaggattaggtgtagccttggtcaagctgcctgtggagtggagccgtctgcgccgtttatcttattttccgttgcttagatctttattgattgagaggaactatctacctctgtaatgacattttattcgcctattaattagagtaataattgtactctattatcaatttgttattgtgtgcctcggctgattcctggacgagggttcacacacatgtaagcgtttggaattttggatagaaattccgggcgtgacaggcgagcccaactccaccgttcaaccacgaagccaccgcacgccccctttgtcaaggggtgggcaaggcgggagccggcccacggagaggactacccaagccttgatcactcggggtagttctttcttcactccgaggtggtgaa

SEQ ID NO: 69590 - DNA, 512 bp, Oryza sativa
agctcggtaccccatttaaagcggtctatgcaaccgcatcatgtcacatttaatgcggcgtgctgcgcatttgaccggtctgtgaccggttgaatgaccgatgggacggcgactgtgtacccccgtcctgtcagtgtgtcaggcggtgagcggcgtgctccgtcccgtcccatcataatgatgaggggctttacagcctcttaccccagtcagagctggtccaaccactctgaactgacccgggttcccgttttctggtgtgaacgagaacctggaagttctcatccattaaatgacgaatgacaagggcgccatgcatgatttgatgggccccgcgtagcaaccgacgtgcagatagcttctaggctaaggcagaagacatgtaattaatatagagaatattttcccttctccctaggtagcactcgcagcacatgtagtatcctcttagagtataaaaggaggaccatgcctagcgaggaggggggatcggactgaggatccctgagcca

SEQ ID NO: 69591 - DNA, 528 bp, Oryza sativa
ggccacgtggcgtttggggcagccctctccctctaatctcgaccagggagtggccggcggccttacctcggcacgactccccttaaggaaggccacgttgcattgggaggcaacctcctccgactagtcttttggaaagagtggccgccaccccacctcgggcatgacttccttgggaaagggccacgtggcattggggggcagcctcctccctctaaacatgatacccccgggaccatatcaccgacagtttttcattcgtgtccgaaaaccccttccgacatccggtcaaacgttagatgtgacatccaaaaattttcatttcaccaattaaacaagccttaaacggacaaatcttcttcagggaaaaaaaaaagaaaagagaaaaacggtcacattagagcatctccaagagtattgccaaatgccactccaagctaaattatagcccacatatgaaaaaaaaaagaccttaactctctggccaagccatcccactggccaaatcctgctagcagctggccaaat

SEQ ID NO: 69592 - DNA, 603 bp, Oryza sativa
tccagacctgtgatgacatcagacagcctctgagctactgcagagactttcctatacctatggaccacttgatcggtgacattctcaaaatatatccaaaatctgactatttctcaccacccccagcactggcatgtgccccaggccaccacctcctctccccacagggctccccgctgctgctgcggcccctaccaggctattctccacatggtagccaaagtgaacttctatgaacttctacaaacagatcatgcaactcctgccccagaaacccccaagccttctcttcccactctgtgaaatggccaaagcctttaccacatggatgaagtcctctaagacctgggcctggccgacttcactgacctcaccttgcaccactcccattgcctggaagcccctcaaagacacagagcacactcccttccgtgggatttgcacttgaagttccctctgcctggaacttgcctgtcttcctcctttgcttacttcagggctctgctcacatgtcatgctattatcaaggacgtgcctgacaccctgtatgacagcactgtcctgcagaaccatctatgatatggaaatgcgttataacctgag

SEQ ID NO: 69593 - DNA, 3052 bp, Oryza sativa
tttttttaatgactcattcattagaggacgtaagtagcttttggtctccccgcgaaaaaaaaaagtagcttttggtcagttctacgaactaattaaagctctaatttttttattaagaaccaggtttgcctcggtctccattaacatgttattcaaactttttaacggtatatttcgtgcgaaaactttatacatagaagttactttataataacaaataaattcatttttcaagtttaaaataattaaaactcaatcaatcatgcactaatgactttttttttcactgtatacgtactaaatgttcatatatatttttagtgaacttaaatggggcctaattccattcgtgtagtagctcgggaagacatgttgactgttgagacatcagtaattcgctactcctgtaatcctgttctatgagctagctcgaagcccagccggacggtgttgccatacatgcaatcgaaaccgcacacgcgcagttggttggcgagacggttgctcccaacatggaactcgatccagcttagctggggaccgcgcttaatttggttggtttctagccatggccatataggttgtgtttagttcagcgcaaagtttagattttggttgaaattaaagatgatgtgactgaaaagttgtgtgtgtatgacaggttgatgtgatggaaaataactgaagtttggatccaaactttagatatatataaacacagtcatagcttaattagatcgaatgctcatgcatgaacacacatatgttggatcctactcctgcatacgcgaacagtcaatctctctgtagtacacagtggcatatactctacggatgcacgaacggttttatcatcgtatgtgcgcgcaaacagcactcattataagttcataacagtgacggatgcaggtgatcaatcgatggctgatgtcgttgtactatatggtatagtagcaagtacagtaatgtgtatacgtgcttgcatgtgatatgatggagagatcgatcgacgtacgtgccacggtgcagatcgacagtgttgacgaccaaagtttcagaccagcctcagcatgcatgatttggtgtttaattatcccttctttgttgtgtttgtgtagctgttctatcttctctatcaatgaaatgaggcaaacctttatttttgtcccattttatcagatgagaaaaatgtacttgcattgcatgtgtgtgcccttgatgcgtgtgaaagaaaaaggaataaagggtagtactgtagtaaaactactgcggagaaaaggaaagaattgttgctgcttgctgctgctgtgacttgtgactcttcaggttcagggggttgatgcgttacagcaccctgtaaggccctgcagtcatatggatggtcacccatcaggaggagggatgtgtacatgtactcctacgagatcgagagccatgcatccatatatgcatggtagtactggctatctactgccaacctagtgcatcacatctctttgctacaagctcacgcaacgagagagagagaaagaaaaaggagagagagatctttgtgatcttgtagatgtcagtgtggtgatgggaaagaactaaaggaggcccccaagtttggggagagggggtactagatgtgagggtgggttgcctgcattttgacttgcacctttttggcaacttaggtttacaaaagttacaaacgtacagcgccaacagcaagctactccagctgcaaactgcaagtaaatgcgagttgctgcgatcgtcgatctcttttccctcctccttggctactacgctgccctctgctagctatcatgagagccactgagccccctcttcaatgcccctgtaaccgcttagcatttacacactctctcgcacacatattcatacagtctcagactctctctctctctctctctctcattctctctctctctcacacactcacacacaccacacatacagaaatgcagacacagtgccagccatatgtatggcaagttgaagcttaactctctcattgtctgcctgccaatatgttgaattttcagaggtgcatgagacttcctcttcagtgcacggggacctatagtgttgtgagagtcatgtactccctccataacagaatataatatattttgagttgttgcttgcaacgtttgatcactcgtcttattcaatttttttttgcaaatataaaaaacgaaaagttgagcttaaagtactgtggataataaactaagtcacgaacaaaataaataataatttcaattttttttaataaaacgagtggtcaaacgttgcaagaaaaactcaaaatcccttataataatattatgggacggagggagtagcactgaaaatgtactaaacacggcaattgaatgctgaatgtccaaaacatgcattagctagcttagagggagaggcactatggataccaacttgttcatattaatgtgtggccccatctattaattcgatctgtaaatcctatatacttatataccattaagtatagttaatgccatttctcttttatctcattaagccacattaccccaattatttttagcctttgtatgatagatctatggttcaaattatctcttctttcttctccgataacaccatgcattatttttaggctcaaaattcacaagtatcaatttgttagttttaataatcatattacatcttatttgtacatactatacaacttaatttcccacattaatgcggcggggtatttatctagttaactatattgtgaagctccactactagttgaactcagtgcacaaaaagcttctatattgttcacttccataaattaaatccgtaatgatatacagtacttatccccactaattagcaccaagaaaaggtactactggagaaactatttttgatcggtcggccaaatttcacaatagtcctggttctaataaaaacctgagtcccggtttaaaagctcaggggtactttttgatctttagtctcgattggtaacatcaaccgggactaaagatcatttttagtcccggtt

SEQ ID NO: 69594 - DNA, 1310 bp, Oryza sativa
gcggccaccgcaccggccggccggccgccggcatgcatgccgcgtccgggtgctcttatcatcgtatgccccaggtactcctcgggctcgatccgtgatcctgcaaaattttttgggcggttgccgtacgcggccggatctacaacgacggtgagtcggtgacgcacgcacgcgcgtgtgtacttgctgtacggattccctcttgctttgtacgaagagtcctttgatttgtcctgctaattttgttcgtcttttccaagggatcccaactcccaactgccttttcctttcttgggattacaaaatactaactgtatttactgtgacattgactgattttgattggttccaagagatggatcttggaaataaccgacataaaatttgcatggatctactgatttcccctcagatctgcgcgcatctctcgttcaattccttttcttactgtagctctcaagattggaatgttcgttgcatcagcttaattagaggaggtgacgggaagaggaaagaaatttccctcagatctgctaattactccttccatctcactaaccaccagatcgatcaggtcagtagctagctattgctgccacagatttcttgtgtgtcctctacttgttcagttctacacgtgtcgctgctgcttgaagtaattgcgtgatagaacccctgtctcctgaatcctgatagctccagaaatagtagggactaggtcactgtccacttactgttctattggtgacgtctcgtacttatctctacaatgcaagccgccgtacttatctgcagtgccactgtccccccccccccctccctctctctctctctctctctcaaaggaaaacttcccaaatcaaaacaaattttgcgcaaacctgcaactatgtacatacattagcttcaaccattttggtttaggggagatctagctggatgtggaatcttgttagtcttaatcttttaagaaaaaaagaactctcttcggtttttgtttcattttcagcttactagaaacaaatggtccggttgtttctcttattctgtttaaccagataaagtaaattcagaggttttattatggtgctaaacatatctatcaattgatggttcctgcgcccgaagtaaagttcgctttttatttcattcgtcactttgactgtgaatgccatgttctctcttgatcagtttattttcaggagtactagactactggttgatatatgtaaatatccatatctagtagagaggagatctagctagctaatgcaacatcttcatgtcttttaattcttttaacacagtta

SEQ ID NO: 69595 - DNA, 1943 bp, Oryza sativa
ctgcacccccgccgccctcgcggaggaggatggcggcggcgtggagcgtgttggccaccatggtcgggccccggtaggtgacgaggttggcgcgggtgaccaccttgacgttgcggaaccgcgagtagaccgggtcggcgcgcaccgcggcggcgagctcggcgcgctcggtggcgggggcctcgaggtcgaggtggacgacgtacatgttcgacgggtggtagagcgccctgagcgtgcggcgcagcgcggcgccgtcgccggcggagccggacacgaggtaggcgatcctcggcacggcgccgcggccgcgcccgcccgacgccgccgcgccgcgcatctgctgctgctggcgcagcttggcctcgacgaagagcggctcggcggatgccgcggaggggagcggggagaaggagaggaggagcgcccgcgacgaagagaagaagagggacgccgcgatgaggagcgacgagagcagcacggacgccagcagcggcgccgcccacctccgatggtacccaccccctgccacccccgccgcccccgccgtccccggcgacggcggcttcgtctccagcatccttccttccttccttccaccgccaccaccggcggcgtggatcgcggcgaggcgaggcgtggattgggatcgggtgcggccgcgcgaggaggaggaggaggcggtggtggtgggattaaatgtggccgttcggttggtgatggatgcgtgtgggggagaaagagaggaagagaagggaaaggaaaaacgcccaaggaaatctgtctctcgtgtgcgctttggtgttgggtgcggggatggatgacgatgagtcgatggtgatgatgaccatgcgtctccgcctgctgctgctgccggtcgcgttgggttggggttggcctgtggccaactcaggattgggacggcaaatctcccttcttttttcccttttttttggaggacgccaagtctctcttctttctggtattttggtcgtggagtatagcgaggggtttggaatatttggagtggatttggtattttgggtgcaatttattttgacttcacgggtatttggttgcgattgaaattttgaaaggagaataatataaaacggtatcctgtttggacggaatgatacatgtaagatatctaatgcatcccgtccgaacgcgataccgttacgtagcatttcccttttgaaaagtaatataaataccattgtgatttgaagggtagtgttatcgaggctaatatttgtatttagactcatgtattgctactttaaataaaaggagttatctgtttgtttctctctcatgtctcatacgccaccacccctccctttaagaaataaccatgatttatgcaatatccatgcaccatacttctaatctatttccagtcacatgggccaatactcctggttaatcctagccatatggccatgaaaaaagaaagttgttgcagtaatgtcatcgagactcgtgttctcaaaatctttcatatattgtgtttgatttgtagtcttgtgttcaatgacaaatatttctaaaattccatggtgtccctaaatacttcactatgtcactcctgatgctcctgaattttgttcgatcttctatatgcatcacccctccctttgttactttaccatcagttcacatccatcattaatttcttaaaacatttgcgttatcccttacctttatcaagataagatccaaattaagagtcaaataactgatcatgctgcattgatgcatggtgcggctgaaacaaacccactaactcgtatagaaaatcattcataccactttctcctgattgacttcaaaaataaaatatcctggtgctattgaggtacacttgttcaataaggattaaataaagcatgcgcaaccgcataatcttgctatgccctaaacaaatcagtgttggggga

SEQ ID NO: 69596 - DNA, 4292 bp, Oryza sativa
aagacatctcggctggtgggttgtaagtgtaactaatgcataacatgtttccttgcaaaagttgagttcttctactggcaaaatatgacatccagatttcacatcgatcaatccaactaattaaagctaatttagatatactgtattccaggtagctatatttctatataccactacatggagaccaaatttagatgtaaagttatgaatgtataaaatagatgggcgctatttctgcaagtgttgcaattttatttggaattttctatggctaattttcatcatgtataaatgtttggaggttcactatatatccagacttatgatatatatatgcgcccttgtttgtttaaacaactaaattggtttcttattttctcgaaattcatcatgtatgtgatacattgtggcaactaatcaaactattacagtatcattttttgtatctccatgtaagcttattttgaatgagtatcaatagttccaaacttatatatgcagtatttttttggacaccaaaagtgtctatatatggatatgtaatgttagattgaattgtgtgttgtgtccaaaaagatatcttagaatatcatgcttactctagttaaagtgatgatatagccaatttttgttcaaccaagtttggatatatagtttatgactagcgctagctagttcgtagtaccttcattcaaaagttgcgtacacatttttctgctcgagttccctcacactgatatgtctgccgctatatgcatgtttgaaccaattgttgtactatggtttctcactttcttgtatatatgctataccatctataggaaggaaatttcaattaaaaaaattacttctatggtccctcgcttcaatcgtatttttcttgcaagaaagtagatgattttttggtatatgattttgtatgttcatcattctttttgtcccctcttggagaaaacttgttgtttatcagaaaataaaacaattttatgcaaatatgaaacaaaatatgattctccaaaaaatgtatacatatgctgctatagaacaaacaaaaaaagaaatatggagtaccttacatgcatactgattcgatattgtataacatttgttatatttggatcactagctaacaaaacataacctataaaattggagatgtgtaaatataactaattttgcaaccactatataatagtatatcagtctcagtatgtactgaaataaaaaaaggacgcgtctacaacgagatcgctctctgtatggtcataactagctacctcaatctcatatctagttgctactagtatactcaaaagtgcatgtatttttttcttatggaattttctcttagattactcatccgatttacgaccccattacaccattgtgtttataacaattaaatctttataacaagatctcacatgactatattttcatgaaaaaaatacaaattaattttataatatatctaaattacttttagatttcattaaattacttcttagtcataaaagtaatttagtaaagcctgaaagtaatttagatatattatagaagtaacttaaaacaaaagtaaagtaacttgttacgacattaaaagaaatctatacattcataatgttattcataatattgtgagttgtttattttataatcatttctagtcagtgatgtaatttgtgttgattaaatgtaatttctatatagactcatgtttttacctctataatggatttacttttgatgttgtaataaagttactttcttttttttaagttactttactaatctatgtaaattacttttagactttactaaatttacttttatatgtctaagaagtaatttagtgaaatctaaaagtaatttagatatattataaaattaatttataatttttcatcaaaatataatcatgtgagatcttgttataaagatttaattgttaagagcacaacggcgcaatcggatcatagatcagataagtagtttaagagaaaatttagtttgaagtataggtggtttctatttgcttgaaacatagggataaactactctctctctctagcgtaacagagtgcgtcacgtggcttccgattcggtctgttctggccttctcggacagcacgtgttcaaattatgaattttactggagtattccaatctataccttttatatagttgatacccattagcaattattacaagccaaaactcaacatacaaatataagcatgtaagtattatgatagagtaagacccatcatctagaatgttatatcatagagttcaattacatacaagtatatgatcttcctagcatcattattatatattttaatatttattgttcctataatatttaacgtatagtcagccataaatatctcgtcacaaaacactgggtatcaccaagttgatattaaagttatgttcaaatggcacatgcctacggtttttcgctttgctgttaattacacgataatgtgaacgtcgtaatcttgattttttacataacactgcaaatatttggatccacttcattatgcaacaaaaggaaatttctgtatgatttcttattctataatgacctttgagtatacactgttcgatagaagcgtatgcatctaaaaaagaaaagggttaatagtaagtaatcaaggcgaatattacaattgtgtatctagtttgatgatatatatattggtcctatatatatatccatatcgtcacctacttgttctcctattcagatcatcatgaatttgttatactattcagatcatcacctacttgttcttatctctttgcagattaatgaatatggatcagatcatatcagattaatgtggcatatttattctttgttggtcttgaagtgcatcattaaattataaatataaatatacacagtatgttcattagcttagtttgctttaaggttctcccaatacccgtttgctttgagattcataaagcaagaaactagaagaaaatggacgatggaacattttattttatttcaccgactttgtataccacactaaaatcattttttttctattaataatatgaagttcgattaggggtgaaaaaacgaagctcgtgactcggattgagtcaaactcgtagtattaacgagtcgagccaaactgatgagcaactagagataaaaatggagcctctgagttgccatgggtttggatggactggtttcatcagttgttaagtgtgcgcgctacacgaaatcggtggatttctcaggacagtagatatgtgatgactgcactatcgtcatatttgaaaacggaagtagtaatcggcccttgcttctgtgcatttatataaatacaaatatatatctttttatgcatagcaaatatagttatcaaagtggtattataatctgactaacatgattaaatagttcaaatctcttttttcttctttaattaacgtgttaatttcattctctaccttatgagagtggtattacgttccttttctacgtctcctaaaccttgcaggcttgcagcctgatcatttctagctcaagtaataagtgatggatatcaaattaatgtgacattttcgtgagttggtttgaatggcaaatactccgtcagaaaataaacccaacctggctgacaactctatcggcacatcacggcgatacaatgatcgaatttggaattttttttcggttttagattttttttaaatatttacagaaataatctatcggcaaaaaaattacaaaaataggccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggccattttgcaggcggccccttgccgccctctggccgggcggcaggcctcgctgcctataaaaggcctgccgcccagcccctagccctcattcctccctcctcaattccagtgaaaaaaaaagagaggggaggagaagagaagaaggggcgaagccctgccggattcagacgccgatttcaggtaatattcatagatcctatatgtgactattgagttaaatagtgtgtattttttaaaattttgtttgaataaatgcattatatttttagggttttagttgtactaatctagaagtgcgtattgtagatatcggtaactacgtagatctgctagtttgaaatcaatacattaccgttgcatgggctgcaggaa

SEQ ID NO: 69597 - DNA, 12788 bp, Oryza sativa
tggttgaaattagaaagatgtgacggaaaagttggaaatttgtatgtgtaggaaagttttgggccatgtttggttgcaaaaattttcttcaaacttctaacttttccatcacatccaaactttcctacacatataaatttttcaacttttccgtcacatcgatccaattttaaccaaattttcaattttaacgtgaactaaacacacccttgatgtgatagaaaagttaaaagtttgaagaaaaagtttggaactaaactcggctttattgggaaaaaaaacggagatagtaatgtattttgttttgaaaacaagaacactggatgcatggttgttgcagacatgctagctgcagtcaatgagaagttgaaaacaatgcagggaacggaagagaggaggagcatgcagcagctgctacagcagggggcctcaaaattgaaaacgtttgccggccggcgcgcgccatggcattctgtctctcccataaaactcgaacagtgccagtacacagtcgatcagtcgtcgcggcgcgcgcttagcttagctgtattcctctccgcggccggccggccgatcggtcgatcgacgcatgcagcgccgcggcgcgagcggcgagagagagagagagagcgcgcagctagcggcgcggttttgaaagagcgggtttgttgccggagctcataaatgggcactgcttcatcgcatcaggcctttctgttccacctttatgctaccacatcaagtcccatgtggaaaaggaccacagctgctagctatagctgcatcgccagccaatgcaacatggcatgcattcatgcatgcgtatcagcatatgcaattgatgtttcgttccttctagctagcttaggtgaaaggacgaccaaatgctcgtaaagccattctgttccatccttcctctctctctctctctctctctctctctctaaaaaagtctgctactagctcttagtactacagtaaacatccctagttacaaaatttgctagctaataattaacatttgagaccaaggaattaatgagtactataccaatttgctgtttgccatattatatgaaagctaggccgctcgatcgccaatgataaagggagagaacaaatgcttttcaagttttttttccctgacatgaaatttggttgctggatgttgctagcattatttaatttgtgcgcctgcttcctccgttttgcctcccgacccgtttattgtgaccctcgggcactgcccattgtcgcgctatataaagacagcaccacccttcttcaccacacttctcagctctcaccactcgctaccccccttttcttcttcttcctctagccaccaccatgcgtgacgactcaagcggcagcatcgtccaccattgctgctgcttcctccatggccgcgcaagcttccggccatcagctggttcttcctcgcttgcctccttggggcgccattggatcaggaagaggaggctgaagacttgcagcaagcggtgcgcccttatgtgatggccctatccccaccgagcttttcttccaccgcccctcctctcgttctattctcggatgcttcttgcattagaggcattcttttcgtttcgatgaatgatagttaagcggtgtcttcttgaccttgcaagacttttcatcgaaaaacactcttcttcacttttctcgtaatatccttgccaacatttctcgtcctctcgcgtctatcactcctcccatcttctttgtccccgtctatccctcttgagcttgtgacttgtgtgctaaggtactttagatgtactacttttgttattatagatggctatgtagtgagttggtctatgtttctgatatatcttttgagttatgaatcaattagttgtatggtcgtcactcgtcagtagttccttgcgtggtgattgatctctctctatatatatatgctccttgttttattgatcctaactaacagggaaagaagatatgccatgctagtaagcaaagggcaacgcttgtggtgtttaataccttgtgcttgtgatatgtcctctctctctctctctctctctctctctctctctctctctctctctctctctctctttaacccttgttcctgtgtattcacagtgtgtacatcagtacatgttggtgtttctgattctctctttattttttgttgatgccgtcacgcgcttggacagttggacgtgcaaaatctcttgctatatatattatgctgtgtgttgtttcgtccgtgagactgtgagagtgatgttaatttgttctccggatcctctctgatctgttcgcatttgctgcgtcgaaaatgcgagacggaccatgcatgaaccgcgaacacagccgtcgtttcaacacacaaaaaaaatgaacgaattttcactggtcgcgctggctctgcagtctgcacggacactatttacgtgcactgaaacatccaggaccctccatcgagtatatatgcacgtacacgtacgtgggtgtggtcctacgatcgaactgcatacatctaccggtcgtatatatatacggtagatgcggggtagtagcgttatattaccgcgtctgcccacacaaattaacatataccggcccgacaccgatcgcgaattaaccccgcattcaaatccccgcgcgtcgtaccacgctacgtacgtgcgatttcatcgcggatgcgcaggcgcgcgggcgccgcgcgacacccacaactgaacgcagaacgcacgtacgtacgcgcgcgacacggcgccagcagcagccatcccttcccgggcgcgccgccggctgatcgatcggtggcgcgcggcaggccgggggcgatcggatccatccgaaacgctctcgcgcggctcgccgcgcgcccggccctcctgctccctgcccggccgacacaccgtacgtgcgcgcgacacagatcgatcgatcgatcgatcctgcgtatagctaagctgaccaatatcgattatcgtcgcgccgcggcgcgcgcgcgcggcgacgagccgacgacgtcatcaccagtccggccgtacgcctcgcggccacttgcatatcgatagctcgatcgatgatcaacaggggccgatctgtcgtggggatgcccggggtgctcgagcccccactacccgtgatggcgggatcatgggactgggctcttttaaaattttcgagggcttgtagctttatatagtttattcagatcaccgttactattttgcttaggttcgatatattctggtggtcaagcgtctttatatagtttgttcagttctcttgctcttttttttcttggattcgattctggcgatcgagcgcatttatatagtttgttcagttctcttactactttttcttgggttggattcgattctcgcaatcgagcgtcttcattatacagtttgttcagtcctcttctactatttcttcttggatccgctcccatatgatagatcgtccgatacgctgccatggccccccgggcggcatgcatgcgcgcgcggcgacggcacgcacatggtgacaagcttagtcgtcgacgcgcggcgcgccacttgccactcgagagggcccgttgtctgtgtgtggccggtgcgtttaggttagcaacgcactataacagtaggattgacgattgttgacaagctagctagccggcctgcatgcatgcaccatcgctgcggcatatgcatgagatgaaaaagagagaaaccgggggatgtcaccctgctacagcctacagcgtttgcaccggacggacggcccgacggctagctagcaacgaaagattcggtatcctacagttccctccagcgatagatcatagatgaacagggtatctcatctcatcgcattggatttcgaacaattggggtactccctccgtcctataataggtgacgtttttgactttttatttgtaacgtttgaccattcgttttatttgaaaaattagtgtaaatataaaaaaagataagtcatatataaagtacttttgataataaagcaaatgataaacaaaataaataataattctaaaattttttgaataagacgaatgatcaaacattgacaaacaaaaattcaaaaagacaagttatatgggacggaggtagtacgtagcatatgccgacaaataaatgcacctgcttgagaatgccttggtcaacatatagggtttctgtaaagtgccttctactgctccagtgctccttgctcttccgcacgaggataatcattctcaaaataaattgaggtccttctcattctaaactttacatcatgtcacatcaatcgtttgaacacctatatataatattaaattaaagctaaaaaattaactaattgtaaagattgcgactaatttgcgaaccgaatcttttaaatctaattgctttatgatttgacaatgttgcgctagtaaacatttgctaatgatgtattaattaggcttaatatatttatcttgtggtttactgacggattatgtaattagttttcttattagtgcccaaacaccccatgcgatatgctatataatattcgatgtgacacgccaaaactttacacccctagatctagataacccctaagttatggcaaattttgctacaagacatcgcgactttgcggttttagccacggacaccgcacgaagtcacttttgggggaagacactcttaaaatgtggttatttgccgatggacaccgcatacattaaaatattaatttttgggtcaataggagagatgaacactgtaaaaggtctaaaatacccctgggcccacttgtcatattctttctccctcaacaaactccctctcacactctagccaaagcgccaccttcgctgcgaaggcgacgaggagtaacgcgtgcggggatggccgccgcgttgcccgagcggaggccgcggcgaggaggaacgcgtgcagggacgccgcagcgacacctgctgtgtcgcccgagcggacggaaaccccccactgctccgccttggagagagccacgggtgcggtcctgccagtctgggtgcacggcgagcagcacaatggcccgggtgttgaagccgttgtcctgcttgtctttgagctcagtggtggtctcgtcttcctcgccgctgtcgccgccactgcgtcggccgatgagccggaccaggccgcgcttgatctccctgtccatgccccatgacatcctgttcttggttggcaggaacctgttcgattgaattccggcgccaaccacgagctcaatttcggcgagaatggctaatcgtttggaagtttttgggttgttcgtggagtttacctatatcccgggatgagcaccttgcggaaggcctcggaggcgaacgccatgaggcgggcctgcatgcggaacacgacgcggctggagtagtagcagcggccgtacgtggcgtgcgtgatggcctcctccgccgtcggcgccacggccgttccctgttgctactgtctgagaaagaggaatagcagatctgacatgtgggcccaagggcacttttgacatttcacgcgatttctctctcctcctcacctgaaaattattattttaatgggtgcggtgtccaccagcaaatatccaacttttgagaatgtctttcccaaaagtcacttcgtgcggtgtccgtgggctaaaaccgcaaagtcgtgatgtcctgtagcaaaatttgccgtaagttatctatccatacatgaattgatcgagaagataaattaaagctaacacatgaccaccgcccaaaaacatactttctccattctaaaatagttatctttctaacattcaagatttattttaaaatacttcttatccaatcatcttccattcaaatttctcactattatacctctaactaccacaccacttctaataaccatatactgtattatcatttaatgagggagactatgttattttttcttaaactttaatacatgctaaactgcctaaaatgacaagtatttcaagatagagaaagtagcatattggtttgtacatcaaatatgaatcaacacatgagttgtaacatttgagattattcagattatggtgctctacaccatcttgaaatgtgaaatcaaaatccaaagtatgtttaaagaaactaatgataaattttctgtgagttgtaacatttgtccttaaaacttctactccttcatttttacgtgcatgcttctcaaactgctaaatagtaagttttatacaaaattttctaaaatgggtaaaaggaaaaaaaatagtggagattttaatatatgtgtccaatatataatgtctatgccatgtgatcaaactcatccaatttatccaatttatatgcaaattagataaaaaccactatgcaaaaccatcttaattaggaggttatataaatggtacaatattgtaaaatttagggggttgaatgtccggtttcaaagtccaaagtgctaaataaactttcatctaaaatgtagggtgtatttggactttttcaaaatcatattaatccatttttaagtttttagctaacacttaattaattatgtgctaatctatcgtttcgttttaagtgctgagaaggaagagttcccaacgtccccctcaaaggaaaacaaccttaatattccctattgatttgccaggtgtttctcaatcagcaacgtcttaatttgaagttgtaatttaaatgtaagcagataattaagtttcagatatactccatactagttgacaaggctctttagtttaacaggatataacactttggtagctgacattgctcatatgttatcgtggaagggaaaatattttccatactgttgactacacaaactaaaagattgtgcatatatgcaccaaaagatagatagatatcttcacctataactacgagacatttgtataaattcataactctcagctcattgaattggagaacagcatgaagtgattattaattacaaacaccatatataggcctggtttagttcccactttttcttcaaactttcaacttttccatcacatcaaaactttcttactcacacaaacttccaacttttctgtcacatcgttttaatttcaaccaaacttctaattttgacgtgaactaaacacacccatagaaatctgctatatctaaacactatatatagatggttctggccatctcgtgttcaaaatcatagaacacccaagaagtgcgcacggtaaatcaatgaagccgctgtatgtttgttaccgtgtgtgttttttgcatgttaccaggtgtttctggcacacgggagccttctcatccctagtcgtgaatccgtaaactttctatatatattggagacgtacgactctttctttcaagaaaatctatacttacagcaagcaagaagctcgttttcaaaactcaccatgatgaatacaatggtgcactactacattcatactcactccgtcccaaaaaaaaacaaaccctggtttccgtgtctaacgtttgaacgttcgtcttatttgaaaaaattataaaaaaaattaaaaagataagtcacgcataaagtattaatcatgttttatcatctaacaacaatgaaaatactaattataaaatttttttatataaaacggacagtcaaactttggcacggaaactcagagtttgccttttttgggacggagagagtagacaatacgtaatcattgtcctacaattcccaacaattacagtacagtgcttcttgatgacataaagggttatagtacaggatgaaacagttgcacgcttgaaataatgcaaatgcaattcagcaatatgcgaataaagtgaggtccaaagaaaaccacatgtgaagtaactgtagccaattattaggccaacataaaggaaagcatcactaacagttttgcagcgactctatgaagaacacaggacaaaagcatcgacgcactaaatccagaatggaacagtgtagcttgatcaacgagttgattatgcagggagggtaaggtttacagcggtccgggaaagggacacgtccttttctacctttattcatcccattcctcgacctcctccagtaaacagtcaaattctttacaaaccaaattgaaagttcagagatattgcttccagttttaataacacagtcagaagcacaccagatcaacaaaacatgattttctcaggctagactgttatatgtttttttaagtgaaaacaggtcatgtcaaaaatttcagtgttcatgctggaaagtgaaacacttggtcaaagttaatacaatttcctgagcatgttcgaatcttttccaatatttatcatgtcaacattgtttaaatgagtttctataaatggacacaaacaaacgtttcaccattacctcgtattagcttctggaataaaagcaaaaagattcattactagccttcaaacattttctttttctcccatcatcaaaccgctgtttgattaccaattaattgcagactgctcagcagcaaagttgttaacttgattttcctctatgtgttaactgttatcggcatggatgatgcccagcaattttttcttttggggtgaactcaataatgcattggaggataaaaaaggtcgcgagtactagtgaatcaactgcaatcaagaaatctggaggacggatgtgtggcatcttggtttattcaaatgatcaaatcgtaatattctaggagaatgacattacattacatagttttaatgtgcatggggaagaaaataaaaggacaggaatgcgtaggtcaataataaaggaagagagggtaaatgtgtacactgtaagtgcctatattagatgtgcatgctcaagccactattcgcatgtgcaagtacatacccgcacattgactattaaaggtgcaaagacacagtcaccgaggagaatattttcaaggagataaaaatagctgacgatgataaactaattgcagaaaactgtccgggccaggtcaatgaatgctgattgcagaaaactaatggctggtttggtttgaggacctgctaaaatttttagtagtgcaaagcccaatgcttgggcaagtttgggactaccaaatttttggtagaggaaagttgagaagagtagaattgatttgatgccaaaatgtgactatgagagacaactatgtgaacaaaaccccaacgttttggtagtgcagtacttgatttatttttttttaaaactaaacagtacttgatttgttaccctaccaaattttggtagggcaaaatttggtatggtagcaaaccaaagtagccctaagccaccggacaccagcaaactattcatccagtgaggtttaatcaacaaagagttttgagaagacactaatacatccgctcttaagcatcacactaactgaataacatgaagatcaacagaaggaaacaccattattttttaacaaatttctgatatcaagtcatgtgttaattggtaagtggaaacaactatgcttgttagttttacatggccttatcattggtattgtgtacccaagtcgatatctgacatgttttgcattcagaaataatgcatgtgaaaaaaaagagattatcctgatactagctgaataagttgtcgtttgccacaacagtttaaaatggcaagtggtagcagtgtactcacccattctccatggtaaagtgatctgtagtacttcacaaatttctcagaggcaccagtgtatcgtcccctttggcactcaaaacacttgaagccaacaaacttcattatagaaaagaaagtaaggacatatattattttcaaataaaaaaagttgaagtacgaaacacagagaaactgctaaggcctcactgtggcaaactatacatgtggtactcaatatagccagtaaaacagtgcctggttttagtttgttgtcagaaagcagaggtcagcaggtgctgttttcagttaaatctgaagattttaaaaaagaaggaacttattagcaatattgagaatagataatacaacagaataagatgttgtatgaatgagaacatggtcatgaagggtgatgtaaaaagtgggggaaatgaaatgaagtgtttatatgtgccagtaaagtttcagaaagagtaaatgggtcatcaatggaatgtattaggattggtttgtttaattaagcacacttggataccagattcctgttcattaaaaagacataggcccaatgtattaggataggcctatcaaattaaccacactaaaaaatagacaccagatttcaattcactaatcaatttatcataggtaaatttatttttccactggtgtgaattaggaaagacatgcagtggtaaatattgaagtgcactgtaggcagtaatcatgatgacactaaactgccataaccagaaattacctgcaaccggaaacattgagaagaacaaactgaactgataagcaagacataggccctgtttgggggagcttctcccagctgcagcttttcccaaaagctacttctgttagaagctgccccaaacagtccacagcttctgagaatctgtagttacagggcctatgtcttgcttatcagttacagcttctgagaatctgtagttacagattctgaaaaatgaactaagatgccagaagctggagaagctgggtttcagagcttttccagattctcagaagctggctaccaaacagctgcttctcagaatctaaagctcccccaaacaggccctaagaaacgcaattcagtctgaaatgttaaaacagatagagaacaaagcatagagcatttgcaatttcatttcgaaatacttcaaaagcttcagactactcttaaataataaactgccatgacatataatgcgaatcagaataatcaacttagtgaaggaattatcattgttctattatgtcaataccaaaagagaactattaccaactagtgaaaatttctaaagaactgaaagaatacctataaggctatataacatgtgaaactttcagctagtaagctgagcttgcaaaacaaactttaacactttaaactgagcattcaaactattaaatatccctatttcaacttaggaagcagaatattcactaatttagccaaccgatggatttccgtatctaaaaatagcttctagcacaaacttcaaaactttcaacttgaatattccaattttcaactgaaaccttccaacttagacccattcatagagagattacactatagttaataaactagatcagaagcttcactgccatatcaatctaaatagattattgcttcttccttgcacccaacgacatggaattttactatagcttttccctgacaagatttgtgcgcaggcacttgagtgtaaaatgagagaggcgcaaaattcccagcctcccagggggcaatgatgcaaccacaggatgaggcaatccaatttcctagtactaaatttaacctacttaccgccgcagatcgataaaccgcacacgaccacaccctcctgcaataatcatccccctcttcgcagcctccgcgtcgctgatgacccctgacaacgcaggaccaagacttccagaatgatccccccggttctcggatttagttaggggcaacaatggcggcgagccggcgggtaccaaatgggatggagcgggcggtgtgggactccacagatggaacggaagcttctggaaaggatcgcgtacgcacctcggccatcatctccggggaggcggggcgcccggttacccgccggcgtcgcgcggcgcaacggcgggacgccgaggaggcggccgcggccgcggcggtgcttggtgggcgaaactggcgtgggccgcggccagcctccatggctttaggcctatgggggttggattcttgtagctgatgggcttacagaccagaagagcccattgggtatagcccaataagcccagaaggagcgatggtccatcccgctatgttggtgggcttttttcttggatacgtgtgttggtgggcttgatatgccattggacttgttaggcggaataagttcactttatgctcctcatctgaatgtcgagtttaaatcacattctttaaccgcaatatcataaatcttgaccacccaacttacaaaaccgggttgaattagttccttcagaggtatagatggatggttttgatgatgtggtagtgaaagggtcaattaggcctagaggggggggggggtgaataggataatttaaaactttatgcggaagctaaaactgagttagggtcggaaagtctgatccacagtcagactatccgaaaatatcagatagtctgatgttggatcagactgtctgatccactaaaagaacactacaagaagatctagtgcacaaacaagagtatggcgcaaacagtgactagatctatagcagcacaaaagcaaagctaaataatgggagaagagatatcaccaacaatgaaattcaccgagttgttcccggagttcaaatccttgaggggattctactctccgttgaggagctcactaagagccgggtctttgctaaccctttcctcaagaggttgcactaagcactcctccttccactaaagggtatctctttccttgtggaggcgagatccggccttcacaaacttctcccggccaaccacacgtagatcggtggctcgggagtgacacctagccgtctaggagtcctcaacatccaagagtaacaaacaccacacaactcttggtcaaccctagtgctcaagatcgagtgaaacacacacta

SEQ ID NO: 69598 - DNA, 658 bp, Oryza sativa
tgactaccaaattgtgataatattactcgtattcaccaagtcatcataattgaatgtgtaaactgtaacctagttaaccatttttttttaatttttttacagctgtcaaatgcagaaaaaccttgtattcgttctagtcataaaaacataacacgcatgctgtcataagaagactgaaaagaaatggtgtgtcagcactcagcagtaggaatttgaaagatatatccacaaaaggtagctattaacataaatcagtcataagactgtaaaagaattagtgtgtacctcctctgcagctcggccacctaatgtcatgcatgtcatatcaaaaagctgttcttttgtcatcaaaagattttcatttggaacatactgtgcaaatcctaaagcagctgttccacggggaacaattgtaactttcagaagaggctctgcatgctctaaaaaccatccagcaacagcatgaccagattcatggtaagcaacagtgcggcgctccagtttgctgatgacctgcaatttgattaacaggctaagaggtaagaaaaataaatggggaaacatgactatcacatgttgagaacaagtcatttcatataaaagaaagttactaagttactaagcattgatctgtgcattactcccttactgaaagtag

SEQ ID NO: 69599 - DNA, 27406 bp, Oryza sativa
gcggcgcgggaggaggatgcggatgatgaccggagcaacgaggccgaggcggcgtcgtggcttctccccgagcccgacgacaatagccacgaggatagcgccgcagccgccgacgcgttcttcgccgacaccggcgcgtacctcggcgtcgacctggacttcgcccggtccatggacggaatcaaggccatcggggtaccggtcgcgccgcccgagctggacctcaccgccggcagccttttctaccccgaacactccatggcccacagcgtaagcctcactaccacacagctagctctcgtcgatgctcatggcgcggcgttatgacatggtttcctacgcgttccgcagttgtcgtcgtcggaggtcgcgatcgtaccggacgcgctgtcggcgggctcggcggcgccgcccatggtggtggtggtggcgagcaaggggaaggagagggaggcgcggctgatgcggtacagggagaagcgcaagaaccggcggttcgacaagaccatccggtacgcgtcccgcaaggcgtacgccgagacgcggccgcgcatcaagggccggttcgccaagcgcaccgccgacgccgacgacgacgacgaggcgccatgctcgccggcgttctccgccctcgccgcgtcggacggcgtcgtgccgtcgttctgaggaaggacgtacgcacggtacggcgagtcggcgacgtgcgccgtcgtaattttggcgcgccccgtgcgcgcgtgcatgcgtgcgtgtgtgcgacgcatggccccgtgtgacatgaataatatgtacagtagtttttcatccatggacgtagtattctattgtactccttgtactcctactactcctcttctgcctaaccaaggcttgtacattaccatgggagtagctgtttttgcaaccgtgaccatggttcagtgcttcaagttcaagggcgttaatgttactgtccattctacttttggaaaggctagtactcctcctacttgctactagaagcttgccgaaaaatggtaaagaaaaatgtgcaagaacgaactgcagtactcatatctccatcaaccaggaggttcgagcatcatactactctattatacgagtgtaatcatcaaccaataactcccctaacctcacagtttttctcctgattttggtttttttttggatatctgactgttttacacgtctccttttactgttctgtgcacctcggcctaatttgcatgcttatgcgttgccggtgcgccggttgattacgtaattattcatgtatttggggtttggatgccggtcattgtgacggttgtttccggttggctggtgcgttgagtgccgcgtgccatgctgccattttttgttttgatctaattgtttcttctgttatttcagatcggtctatccgttctgtattctgtgtctttgtgactttttgtttaggtccttggtatttttgaaaattgaatgtgaagaagacaaaattctgtttttgggtgtgtttgtggtttgttcttctgctgggtatggaggtgcgattttccccacctgccgtcctccctgctggtcacaccaaatgcctcatgctccgccgccatcgcgcatcttcgtgctctccggtgagagcgacatgggcggccgcggtggcgtccaccaccggcgctgggatggcgtcgtgccgacctagtggtacatattcaaagcaccctttacacagctttccgttcgtgctagtttctgttacgtcttttatttacctgtgaggtgaaaccgtgcaacaacttccgtattgggggacacggacatgtactgaaccacgtaaaaagggttggaatcattgaagccttttctgttgcagatgccatggaagtttgatggctgcagccgcgtagtgcaaccatgtgacctcggtactagcgtacaccgctttggcacaaagccatgtgaagcgccgtatcggtgtgcccgtgccgggtgtgggggtggtacacatgtagcgcatgtgatcatggcaatggtgacgcgatgcatgatacagtgaatgttgtaggagtatatgtgagctgctccagaagagctgtgaacctggaaagtggcgcagcacggtgaccacagcgcatccagatgcagtggagacatccagaagcatgtgtaatcctctgatattacggcatccgcaacaagcaaaaagagcagcacctacaaaagacattaattaataatactagtatttagcacaaatattccagcaatgtgaaaaatctaatggtacaaaacttagtcttacggactacatggggtctcaaagtcatacagtcgaccaaaacgctaggctcctgcttcaacaattgtatcagcagcggcggggtttttcccgaagggtacacaaatgcttccgaagaacatactcaatccctatagcttttcaagactccataacacaagcgcttacaaaaacacaccgagcccccctaacatttccagcaaattggaactaggcgggttacgcgttatttgcgtagggggactcctcgcggttggctggctgtgctggtgatctgctgtagcttcgctcacgaggaggtggaggtgatcggctgtagcttcgtgcacgagctggtggtggcgacctgctgtagctgcgcctctttggagaacgatcccgtgggctgtaactcctaaaacaaagaaaggttttaaaaacaaacaaacttgcggttatcacagaaaatagttgcttaagggcatgtatgtggcaacacaacaacagtagcatgatattccgcttcaagtaaaatgagacaatctcaactacaaaatccttcaaccgagttgttaccatgtttgccttaatctactgtcatcttatctgtatgatcaatccacaatatgctataatgcagtaacaaataacaaactaaaaaaaataaacactagttatcttaatagttattagtgatcatggtaacagtatatgcatcttagtaacatagccctgaatttgaaattgaacccaaatgtaagtgcggacaaagctgatcagtgccattgagcaaatattttagtgagggagaaagttacaagtttattggaatacttatatatcttgtacttcaagcttcttatgtaagcacaccttttagtttctccattttcacaatcttgaatatggggtagcgcagctatataagttggtatataaaactgcaaatgtaacaacgatttggctggccaacaagaaagaatctagggatgccaagatatcattttgtcattactcatatctacagagcctgtttgaagacaataactttacattaccttctaccatagcttgggctcctccggtatcttgggctgcggctgcgactacgaccgcggtaccttggactccggctacggctgcggctgcggcgtcttccactgccaaggcctccagaaccaatccgtaagcggcattcacgtgcaaaatgaccaggttcgccacattcatagcacttcatgtcagaaccaccggaacgatctcggccacgaccactaccagctttggttgacagctcaaccctccatccattcttgcctataagcacatcacatatcagcaggatgattgtaagcggaattcatggactgtttaaatttgtgagtaaccctataataatatgttaagtaatagctaaagcatagaagtaggttggaaaaatacaacacatcaattgaaagggtaaaagaatatcttggtcaagtaacaaatcatatgatgatatcacaattttaatgtacaaagctacatgcacaactgaagtcacagagaaaaaagaaagtaggcatgtaccaatatctatcaagtttcttaacttggaacaacatgggcctaatgtgcttgcaacaatatatgtatatcacaatatatcagatcaatataaatgtagagtgtcaaattttgacctcgatttactaatatcaccactctagaaataaataacaaggcccggttaggttaaaagacggacctcttagttgatatcatgtaaaggttcaatttagaattctactagtgaacaggaattgagattcagaatttatgaaactatggatttgcccctgtctattattttcaaaacgtccttctaagaccgaacagtttacaggagatagcaagatgcattcatgatggtaagctaaaactatatgtttggacacaacatattttatctataaattcagtgtctattgtttatccaaattaaatttataagttgcttgaatcatgattcagacagagttatttatactataaccaagataaaaattgatggggactcacttgactaaagaaataatgtaatagccattttaatggcaaaactatgtaatgccagaagttgaaatagataactcattagagaagtgcataacatgaaactatcttgcatgaactacaaagacaaatatctacgcttattaccatctaaatcacgaattgcatcttctgcatccctgcggtcatcaaagtcaataaaggcaaaacctggtggttttctagcaacccatacactgcatagaagaaacaactcagttgaaagtggaagaatcagataatctcatttgcagacataattaagaaatcattactgctccatatagactatgaattcattaccattcttagtattgagtaacaacctaaatatctcttccatggttgtcgatacaaaaatcatctttaatgttgtgacagaaatcagcaataaagaaactaatacacacacacacacaaagaaaaacctatggcatacaaaccatgactactccatgtgaacatcaacagccttcaacataaccctttggcatgcagatacaaacatgccactgagtggttcaactaatgagtaagtgataaactctttagaccagcagacaagaaattcagaatattgagatatcgccagtctattaagaaaggaattcaggcgtacactgacagaccaagagataacatgactttatttcatatacttcacagttaacgctgcgtcacattgttaaacatcataactttacttgatctgcctcttcatatcttattgttcactgcaaactcaattactcttcaagttcacctgatactttctagcatatacgttgcatcccacagtatgaggcatgacatacaaaccagaccgatcctaatactcaaattagatatattttcccaatcccaccagtagaacagagcacttaggtgcccaacaataagtgaccaagtaaggcagattacttgtttatataaaaaggaattaattatatccagcaaaattgcattgcaccgagctctccacctcacatatgtcaatgaactaattttaccccaataaaagcacagtacaagacaatcatcccctgctatcattactaatttgagagctaatacccaccatttaaaacttaaattgtaaagctgcagcattccaatttcaaaatcacacgcttgactaacatccatacaagtggctaagcaagtcaaacgaacaagcaggcacattaaacaagtatacgcaacacagggagtaaaatatatatatatagtgattcttagctcagagtcagcagaatctcacacctcctcagaaccccaaacacgcggaactcgtcctcgatctcccgcgccgtcacgcgcggatccaggttccccacgtacacgcgagccatgagcgcgctcgaccctgcaggtattcaacacaaatcactcccaccacgctgaggaaagcaacaagcaccaccaccaatctctaccaaaccaaaagtagaagaacacaatcacacacacacaaaaaaaaaaagaggaagtaaatccggaaattcctcgcgtttccgaccggaaaaggggggcgcaaaagcagaagcagcgggggatctggagagtacttgcctttgcgggcgcgtccgccttgggggggatttgggtttcggggtaggcgaggaggaggaggaggagcggctctagggttttaagctcgagccgtcgagcgagcggaagaggaggggcggaggggcaggggggagtgtaatatcaggcggagggggttgacggattggggacaggggcatttacgggattcgagttaaaatttttgtctctgtttggattacaacgggttcccctgcccggtgggtcccggaccagccgtaaaccattctccctcagcatttgaattttgtctaaattttatctaagaatataagaatttttatgttcgtttcttattttaaaaatattaacacatgattaattaagttttaattactataacttaaagaaagatttatctcaacttctatataaaaattttcgtacaaaatacaccgtttagcagtttgaaaaacgtgctaatgaataaagtctttatcttgatataaatataaaaaaggcggggcctaataattatcacatcaattatttcttatttaaatttctttatatcttatctctaatcccctccactccaaccttatttaattttctttctatcttatccccaatctcgttcacctcaaccgatcgggatttatactataggctatagcaaaccatattattttatacatcttttagcagcaaaatatggaccaccaaatcaaaaatatgtatgacttccaaatcgtacatgatctcaatctacccacgataatctcttattaaatgaggagcattaaagtcttttcttctccaacttttaactaaacaactaaatgttggatgtttggagtacatacttaatgcagttctccggtgctcgagaagggatgaagtggtggtgtagcatggcgacgaggccagggcaaaacgaggacgtcaagcgctgtgttcgctcgggcgtcgcgccatcgccttgtgcggtcggggttaagtagagttcgcgcttgtaggatgtcataaagaacctgaaccatcatagaagatagatattgggaagccaaaataagatgatgaggaagaaatgggtaaggagagagagatgttgcggctattcagtgggaaaacaacatagactatgacacatgtgtgaaaaatataataggagtatagcggttttcatcgctcgctggttagctatcatcttcagccaaatttaaatttcaaaactggactttagagttagttttatttttcttattgtactccactttccaacattagctttcaaatagctaataataaatatataaaagttttactcatatatttatttttgttgtttcttcttttttttttacagcttaccaaccgatcaaagccaactagaggataaacaaaactttacatccacaataccaaaatccatgccgaatcagtgacaagagaagccaaatttatgcttgagctgccaaaattatagtgtcgacttcgagcaacattattacaactttcactacttctcccagacttcatagcaaataaacataaccttccagctccgattcaaagccacttattcttttttagggcattcaaagccatttctccattccaagctcgaaggtttagatacaaaagaacagaaaataaagaaaataaagaaaaagcttgtgatttatatcttgtcatatacttcctccgtttcacaatgtaagactttctagcattgcccatattcatatagatactaatgaatctatatatatattaatgtctagattctttagcatctatatgaatgtggacaatcctagaaagtcttacattgtgaaacggagggagtatgaatgatcaattgaactactcttcagttgctttacactgtcataataagctgttgagtacatggaaaagaatatgaatacaaagcattgatttttttttttgcgggagaatacaatgttttaacttgatacaccgtgtatgaattttcaggacaggcgccagatcaatacaattaattggatcactagcctgcaaatctgcatgtcattgcaaatatggacaggattaaccataaacaaattggttggatccagcaaatgagattcagacaaaagctttcctggttgaggaagttaaaagcaaaaaaaggaactcatgaatcatgatctgctattgcccgaataaactagacaaagccgtgagatatccagccagctgcaggaatgaaagtgcagatgattataaatgtgctgtactttatggtagataggtaacaatggtatattttttacagtatcatagctattcgttgtgggctctgattactaagatggtatgccttctttatattcagatgaaatacctgtgccaagataccctttcctgtctgaccttccagtaccaatcctacagtcagtcctatcattgccaatgcaccattaatagcttctgctcgacgacgtctctgcgtagcaggcaactatgatatggcataatgttgaaaggatgttcataaagcattagcaccaacatagagcattttgattttaatcagagaggaatacaaacaggcgagttctccagcaggaaacatggagtaatctacggtaatgactgaggaaactatttctggtttacatagatgtgtttttaggtgcagtacttattttctccctgataaggattttacagactagccatgatagcttttatgcatggtcatggaatgccatgacaagcaactgaataatcgaaaataaatttgagcaaagaaaccttgcagatttcaaaagcaactttcgtccacatgaacatcatcacagttaaagcttcctcaataattagtttaggataactgaattatgcaacacagaacacactgccacattttgatcaataaacagtagaagataaagatctggtccagcaaaaagtagatagggcagcacaagtcagtaaaaaggctaagagccttatatgactagggaaaagtcaatcactgcttccagctctaagaaagaaatttgctgataagtgtttataaaactgggggtgttgttattaattttggtttagaaaacaacaagaatattttgaactttagaggagacaggtctggtgggaactgtggaagtacatgacaaatatcaaatactgcaccttcagcttttctctggcctgaatttgttgcatttgttgagctgctaagcgcttagcttccagtggatcaaccattaccacattatcacctgaacttcttttgccttctgatgcctgattcatttgaactcagtgtcttagataccaaacgataatgacaaagttttgactaaagcaaaagaacattgtatattagtttcaaaagaagtattgaatccatttttagaggcaaaataatatctactctatagctaaaaataatgaatctctttctgcagaaattcttgagggatacagcacctgctcaagatccactactaaatatcatgctcctacaaaaacacttgaagttaccaataccatattcaataaattttgtaattttacattctgtagacctaccaaaccaaaagtacttttgaacccccaaaaatgaaatgatctacacagaaagcctgaatcatacatctgtgctagcaaaagccaagaagctttgcacatgggtccttcgatagaatgtatgtcctggctgcttgtattggacagtccatctaagcaaggaaaaaacatataattgggcatcagttaactcggtggaaatactacagatgataaactgaagcaaagaaatagccgttggcacataatagtaattccaatagtagtttgatcactcccaacccaaaaggtgaaggtgaattgtttaacactctagaaaaacgagtagtattcttctgctaccaaaagtaattgtgggtagtgccagacattatctctctttttttttcttctttttttttgggaaaatgagggctagtgctgtgccagactgatccagtgaagtgagccagcgacgatggccaccaaattcatcacaatgaaaagttctaaactagtcgtaccaaatatcatcaatatatggaacagctgatgctaaattcactcgaattgcagagcagttggaacaaaccaacaactgacagcgaatgattttcttgtgtactaaccaccacaacaatctccccaacttactggacaaacgaacgtagcatcacggagcacctttaccttcgaaccatgaattatgcatcggaaaaaaaaaagagatagaaatgggtggccaagaacacgagcaagaaggcaagcgcggatcaatggggacaccatatgaaagaaacgcttgcctggacgtggacggagccgaggacacatgccccgtggagaggaacggagacgaagaggaagcagcagcagatggaggaggaggagtagccgacgccgagaggaacacacgcggagagcacgccattcttgcttcccaccaccgcctctctctcctcccctctttctatggactcgagaagccgtcgtcttccacctctagtttttctctcctctttcttcattttttttttctcctcggtgtcgtggttatccaagtcgccgtggtcgtttgggcctacgtgggcttaggccggcccacgaaaaaaatacttggaagaaaagatctcctcgcgtgagccgacgccgcgagcgaagcccgcggcgacaccaccacccaccaacgttagcttctgcgtgtggccgtgggcgcgcgctccgcccgcgccatgacgaccgccaccgccatcgtcgccggccacggcctcgcgctgcgccggagcctgcacctctccaagcccagctgcgccaccttctccgcgcgcgcgcttccgcccgccgcccattgctgccgcaccgtcgtcgccgcggccgcgccgtcgtcgcggacatgccggtgccggtccgtctcctccgagagctccaccgccgccgcggccgacaccgccgacgacgaggaggaggtgaccaagagcgactcggaggaggaggagatggacccgctggcggaggtgtgctacctggacccggaggcggacgcggaggggatccgggagtgggagctggacttctgctcgcgcccaatcctggacgcgcgcgggaagaaggtgtgggagctggtggtgtgcgacgcgacgctgtccctccagttcacccgcttcttccccaacacctccatcaacagcgtcaccctccgcgacgcgctcgcctccgtcgccacctccctcggcgtgcccctccccgaccgcgcccgcttcttccgctcccagatgcagaccatcatctcccgcgcctgcaacgagctcggcgtcaaggccgtccccagccgccgctgcgtctccctcctcctctggctggaggagcgctacgagacggtgtacagccgccacccgggcttccagtccggcaccaagccgctgctcaccctcgacaaccccttccccaccagcttgccggagaatctcttcggcgacaagtgggcgttcgtgcagctccccttctccggtcagtgcagtattggcaaattcgctgatccattaattccatcaaaaaattggtgctgttttgtgtgcttgctagtgtgatccacatgttctcttgttgcgatcgagctgattgttttcagattgttgtgtgattgttcagctgtgagggaggaggtggagtcgctggagaggaggtatgcgtttggggcggggctcgacttggacctcctggggttcgagctcgatgagaacaccttgatacctggggttgccgtggaatcttcgcgagccaagcctctagctggtacgtttctcccatgaccaatgagatgtgtagtgtggtctaggggctaaattgaatgtcaagtgtatgatggatctttactttactgaaacctgaattcagcaagtgcaagttaatttgatgttgcagcacgctactcaaaattgaggatgcgtagggtatcttccgagttaatttttttgtacaatcatagttcatggttgtttacttgtgtatcgaaaaatgacactagtgtaagaatcatgttttcaactttggaaaaataaaatgaatgacagcttacaagaatcaaatgaatggctagtgcatatatgtttatgttatctttattagcgtattcagtatgatattccattctcctcattgttgctgctttttatggtagattgatccacgagattgtaggaattggggattgtatgaccaactgtctgcagtttaatttctgaaagtatcttccaaaagaaaaaaaaaatcatatcgagtacattctcgtgacagttaaataggttcattgtattcaagttgtccgtttgattctgtcatgtttgattgaccattctatattttcaagactggtgttaggactcaaagaggcttaatcagaaacatgtgttcttcaatccttgcagcttggatgaacggtctagagatctgctcaatggaggttgacacgggcagggcgaacctgatcctatcggcgggggtctcgaccaggtacgtctacgccgggtaccagaagagcgccgcgacgacgcaggaagccgaggcctgggaggcggcgaagaaggcctgtggcggcctgcacttcctggccatccaggagaacctcaactccgacgggtgcgttggtttctggctcctgctggaccttcccccgccgcctgtatgattgatcctgcagtccggagagtagcatctagcagcgtgtgtttccatcaaagatcactgtgtagtatgtgtagctccagtaacaaaattttcaatacaagatcccttccatctgtactacacactggtgtactaaggaggaaaaaaagaaaagaagaggagataagggctctgtgtgttttcatgtgagatatgagtttcttaagaaaaaaaaaggaataagttcacttagtccctcatgttatcattgagtttgaagcgcgttcttaaatggcaataccagatataacatgttcctcatcttataagaccggtgtaaatctaatactaaggcagtattggagacggttttggctaaggcggcaccaggaaaaaaaaacatgtggaacccacactggcatctccttcattcctatctctctatctccctttgttggttgcgactacgagagggacgaggaggaggaggtgaacgagaagcaccggcatgggagggtgcagcgggaggatgggcacaacgggaaggatggagagaagtgccacgaggagaagcggcaggagcgaggttgggcggagtggggggggagcagaggaggccaggtgaaagagcaatagtgggaggccggggggaggagcggcgggagcaaggccacaatgacactggttctgcttgtccatccgcaagtctaggcttggcggcggcattggtagcaatggcaatgtggtgtcctatgcaccaccacgagaggagggaggcgtgaatcaactccccgacatcttccttgtcaaaggttgcactggcaggaataagcacaatagtgtcagcacagtggcggcgagcaagtccagctactccacggacagggccaccccaatgacggtgaggtagcagcgcgccatgtcgccccggtgctccacgaagatctagcgcagaaagacgtggactctcgttgtgaggtcctgtaggcgtctacatctctacgcagcccgacggtggtggcggtggcctagatagtagggttgtggtggtccatggacgcccgccgcgcgcggaggtggtgagtggagtcgagaagacgaatcaacgctgttttgtgtggtggtgtgtggcgcgctttggcagagcagcgtcttggacgcctcgtgcacggattggaggtgcatcacaactcgttgcgcattgcgtcagctccctcgtctctttcctcttctcttcttctaccatagaccaccggtgcccccttgtcgccaatctcctgttgctgctaccacctcctgctaatgggctcatcagctgccgcccctctccccgccggtgagcttctgcggaggaaatgggagaagtggaagagagaggaaaggtggaaggcacttacatgcgggacctgtattttttttttgtgaataggatgccacgttatccaaaacaatcatttgtactgctttaggacctggttttgaaatatgaaagtttaacgtttctggttttatggtttgaggatgtaatttgaactcgacattacacaaggtacctaatgggaacttcttccaagaaaattcaaggtttgttacagtagtttcgtgggcttcccctctagtggctcttaagatcagcaacgtgcctactctgccagtccctctgtttaggccttttgtatgttcagctgagacgctcttagccccacgaggccagtctcccaggcccaacacggcgaacacgtcccacagccacaggccacacagtcccgcatgcacccacgcacacggcggccggccgagagatgatccccaccgtttgctgcccacgaggacgcctagctaggatcgcccgtgcgtcatcgagccaacgctcaccatgcgcccacggcccgctggccggctcagcacggcacggccacgagaccacgagcggacccattctctcgctcgcctcattggctccaccccatgctcgggttcccaggccccagccgggcctcgtcctagtcctccccactccccagccccagatccaggtgcaataacgaattaacgaccgagtctcacgaggccacgacaatccgcccccacacggtgctgaaattccactgaaatagtagcactgctagctcttctgtgctggactgctcgtacactgcacttcattcgtcctaaaaagaattaatctattattataaaatatcacatccaatactagctagtttattttttttagacagaggaattacatatcacataatagtattagatggaatcaccaatacataaatggaataatcactaatatacttttctttgctcctactctattaatattaaggaaaaagtacaaatttccttctcgaactatcgcggtcggctgaattttccccctaaatctgaaaaccagacattactcaccccgaactttcagtaccggacgaattacccccctcgacctaatccagagcagttttgtcctacgtggcgtacgcgtggcaacccagtcagcattttcattttttaaaacatggtggggcccacctgtcattctcttccatctccctttcctcttcccctcttcctctttctttctctctctccgtcaggcgcgcacggcgggtcaagcgcgagcgcgcggttgcagtcggcgatggcgtcggctgccttcccgaaggaacggaacacctcggcacggccgacgaggcaggcagtcgcgaacgggtacgggagcccgccacggcacgcgtcgagcaccttggagaaatggcgcacggcctcggcggggaggtccgcgtccagcgccgccaccgcggcggtgcgccggcggagcgggagcttgacgtgcgcgaggggagctgcgacacggactccgcctcgcttcccgccgtccctgacgctgcgccggacttggaggctcttcgcctcaccggcgcggagataccattggccgtcaggttggacggcagcggccgggtctagagcagcgcggcggcgtcctccattaattcaaggtggaagcgggagcttggcccaagtgtcggcgcaggtgttcttggagaagccggcgaggacgcggtgcttgtgctcggatatgtcgaagcttcagaggaagcgggaggcagcgtcagagtggtcacaggtaggcgagagcaggtcggtgcgggaggcgacagcgaggttgcttgagccggaggagcaacaggaggaggaggaggaggaggtggaagaggagggccaccgctgccctcgcgtgccgaccgcacgcgccaccgtggctcctcttagccgtcgcgcgtgtcccccgagccgccgcgcgtgtccccgcagtcgtcgcgcgtgtcctccgagctgccgcgcgtgtcccccgcagccgccgccgcgtcacccgccgccgccgctgcgtgtcgaggaggcgatgtcgaggaggaatcacgtgctggtggtggcgaggaggtggaggccgtggcggcgcaggaactggcgcgagaagaggcctcaggtctcgccgccgacgaccaccgtctcaccgtctcggcgtggcccacgctctcctcgatctgggtgtgcagcaccttggacatgtcggccaccgcctgcttcgtgttgcgggcgatgagcgccgtgtaccacgccgtctcgggcatcttcatccgccagtagtaggtgagcgccgccgggacggtgccaaacatgacgatgatgcgccacacgtagtcggcctgcgggatgagggacgcggcgtggttgtcggagtaggacgacaccgggtacgcgtgcggaaaccccgccgacaccgcgagcgcgacgatggcgtcgaagaggatcccggacccttgcatggcgaacacggcggcgatgaaggccccgcgcgtcctcttgttcgcgtactccgacatgatggtggcgctgagcgggtagtcgccgccaacgccgtgcgcgcggcgcgagcggcgagagagagaagagatagaggaagaaaagaagagtatggcaggcgggtcctctaattttttattaaaaaaacgctgattggattgccacgtatgcgccacgttggacaaaaccgctctgaattggtttgagggaggtaattcgtccggtttgcatagttgggagtgaagaatatccggttttgtggttcaggggtaattcggacaaccacgatagttcgggggggtaattcgtactttttcctaatactaatatatacgaagcaaggtttttattcttctttcaaaaaaacataagtttgtatagcagcatctcacataaaaacagattttcttttctaggaatatagtaaacttttacattgtcttgtttggatgaacacacgatcaatatcgaaagagctgatttgcaaatggttgtgctcgcgtgagcgggtttcgatttggattcaaaaaaatttatgtagaatgtttctatatccgtcaaaagtttctaacattaactttctatgcataaactttttgaaataacatcccacggtgggccatgcatgtgggttaattaggtcaaacatgttcatgtatctaggtcacatgtgaacactcaccaattagacatccccggtcaatatatttagtgacaatggcacccaagtacatttttatgtcttatcttgagaaacataatataaatgtaggcgctcacaacgggcacaaactcactcctatgaacgtacacatacacatcttacccctataaacatctccgaaagactaagctgatatatcttaagattgacgagatcatcacaatcgcttcgctgttgatggataggttgcttatcattgaaagaactagctggtggcccgtgcaattgcgcggctagcacccaaatgaaatcatattgtcagggttatggataccacatacctaatagtagttgactaaatctcggcaggatccaccacataccatatcttatacggaaactaacctcgagggagttccggataaggaaagacaaccagagttctacatggaaacgacaaggactactcggattgtatccatattggtttccctaattctacttggacaaggggacacatatgggtataaatacaagccccttaggaggacagggagacacccacgatgagaagatcaacacccaccagaagccacaacatacaagcctatatacgccaagacaagccgccggatatcgacattagagatacgcctggatcgaccctatccggtactttcaaaggccggccttagggatctagcactgtctctgattccatcgggcgcgagttcgaggaggagggctaccctgttgtcgactacgagtcggaccttcagaccgccatgtcgacaacagttagataggctacctcaaatattgtactggtgtgattaccatgaataagagcaataccggcttcgaccaacaggatgtagggttattacctgacaattcaggggcccgaacctgtataaaaatccctgtctccatctcttttaccttagtcttgcatatatcctagcaccgacgatccccataccatgcaaataccagaattgtgacatcaaacgtcgacagtggcgcgccaggtagggggattttggtgcttcaggatttcgacgagatgggttcaaaagatggattctccaacaacaagctactcgatgacttcggctgtggggaggtctaatccgaccggaatatatcctccgacgagatcgggaccatcgccgccgagaaggagacgccgacctccacccggtgcagctgctgtcccaagtgcgacgcccatccaaggaatgccaagcccgacttggtggcagatcaatctgtatttgcttcgttcttgtgtccggttaggactggaattaggcaaacggaatacgtgcatgcatgacaaccgtgccgaccaatcaggactcaggagatatccatccacaggcctacatgttgacgtacgtacatatgccgatcggtttccaaaacctattcggtatatgcacatcaacacatgtctacacagcacgactgcataatattcaaacaaatcaacaaaggtatttagtagattgatttttataattgatctactaattccgtagatacatccggcatgtatctacaaaggtacgcaatattttatacacaatttatcgtacctatatttccaatttatacagtattgtcagatcaataatttattatgtttatctagagcatgcttcttatacaatatccgttgtgcgagtacttccgacgataggccaactatggtctaacgctgggggctcactccgttctcttatgtataaatcatgcttgtttacggtttacataatgcctgataattacatctgctcgttatgtcctgataatactagaagatccatgcagttttttgaatacatactcgatattatctactatatatcttgccttctagaaaatatttttcaggaacaattgagcactcgagtaggttatagtcgagtacactccattatcgagaacattctcgacaaatgcggagttatcacacccaacctaccaacgaagatcgacgacctatctcatagcaccggccatcgctggactactcgagaaaaggttgttaacggataattcctcgcgaacgtcgtcagcttgatcaccccacatgattgcgagcggacatccggatatgctgtaagttgggtatgtgagtcatgctggccacatgatatgcatatataataaaccaactttaccgcccctataggtgattaagagactcctactcctggttctcgaaccagtaaaacatagtgatctctcttgcctcactttaagtggtcgagttgcgactactgcctggtcctcgaccagcgacgtgtttctccggctacttccacttcaagtggtcgagttacgactactgcctggtccttgaccagcgatgtagcgtttctcccactacttctactttaagtggtcgagttacgactactgcctggtcctcgaccagcgacgtagcgtttctccggctacttccacttcaagtggtcgagttacgactactgcctggtcctcgaccaacggtgtagcgatttctcctactacctctacctcaacaaagttgatagtaggtacataatatcgccaagtgttttacccagagatcccttaccacgacgacacctagcgttgaaacctatcctattgtccctttacgccgtcttgacaatgcctccgaggaacctaaaggatcttcggctggggacgcccagagccgataaggccttgtcggatcctgtagagacaaaagaccatgtaagatctggtagtgtaagagttctcgccgtgcgtattaaccaatccgtgtaatcggaaactgagctttccaacttcacggctgggggctaggatcagtgcttattcaaccaaggcaggtcaagggtccaagagccttatcctccgagaacgattctccgacgacaaggctgggggctagggagagtgtatgactctacaaactgactgatcgaagtcggtaagagagaagacgctcatacacaaaacattggtcggtaaatttaattcattttcaatttaccatacatattataacatgtcaccctttgagcattcgctcgggggctatttctatttgatattcttttctgagtattgatttcaggaaaattctattcgacattatcgaagactccatgtctctatggttctacaccaagatcgactaaggtgagtacgacaaatgtcgacaaagctccgtcgcagactctacgccttctcgatcgctcgagaacggttgctggatctcgacaaggaatacagaatgaagagatggtgcacccaccgagataaaatttcttgacttcaatctaaattctcgattacagcaagacgagagacttagtcgtacgctctgtactttctcggtcgacatcagagattgacttagacaaaccctttcggtgcccgcacgaggctgacaaaggaagtccaacgttatctctaaactccccgagaacggtcacatgagctcgataacagttactccaatgtctgcgcgcagttgagaatatgaattcgttcatttgcatcgaagtcgggggctactgtcagggttatggataccacatatctaatagtagttgactaaatctcggcaggatccaccacataccatatcttatacggaaactgacctcgagggagttccggataaggaaagacaaccagagttctacatggaaacgataaggaatactcggattgtatctatattggtttacctagttctacttggacaaggggacacctatgggtataaatacaagccccctaggaggacagggagacacccacgatgagaagatcaacacccaccagaagccacaacatacaagcctacatacgccaagacaagccgccggatatcgacatcagagatacgcctggatcgaccctatccggtaccttcagaggccggccatagggatctagtactgtctctgattccgtcgggcgcgagctcgaggaggagggctaccctgttgtcgactacgagtcggaccttcagaccgccatgtcgacaacagttagataggctaccccaaatattgtactggtataattatcaagaataagagcaataccggcttcggccaacaggatgtaaggttattacctgacaattcaggggcccgaatctatattaaaatctctgtctccatctcttttaccttagtctcgcatatatcctagcaccgacgatccccataccatgcaaataccagaattgtgacatcaaacgtcgacacatatatttttcaatatggttttacttaaaatttattaaaagctatctacggcctgtgcattgtcttttctctttattatcattgggattttaaaaatcgaacataattatcgttcaggttcatttttttattttctagaagttccgccaaaccatcagcggctttgccattgtactccattatggctcgcctgctgcctcccttctttattgtcattgagatttttgaaatctaacatgattatcattggtttttttttactttttagaagttccaaacctttaaaaattggacattgtaggttttagagtttatgtcttgttgggtttcatgttttataatttttagaagtcctttcaagtgatgccactatacgcctctacagcccatctgccacctactctttattgtcattgggattctaaaaatcgaacataactatcgttggagtttattttttattttatagaagtcccgctaaccgtcggcagctctgcaactatactcctattcaccccgcccgctgcttctcctttttattgtcgttgaaattttaaaaaatcaaatatgattatcaatggggtttattttttcactttctagaagtccccgcaaccgccttacccgtttgcttcatggcctgcctgtcgtccctccttttaatcgttattagaattctatttgatgttttattaacagtttttatatgtcgtatcaaccacgaccactctactcctttataaccctgttacttaatttatcttcgtcatgcgttttagatggtcttttcgaacaatagtctttattttttaccaccatatttggttatttataaattgtattcctaattgaattttttttcttttttaatttcagatttttttttcaaatttttattaataccgtatagtgttcttttaatatttttattttttatttttgaatttaagttgtttcaaaattgtattcctacttgaactctcttttagtttttctaattttggatattgttttattttttattctgaattttaactaatctcatatcgggttcttatatatctcatatcgggttcttatatgtattcttctttcaatattgattatttgtaattccgaattttagttaattttaaattttattcctacttgaactctttttttctttttgctaattttggattttattattatttttattccgaatattaactaatctcgtattgggttcttatatggactcttcttttaatattccttatttttaattacgaatttcaattatttttagattttatttctagttggactctccttttattttctaattttggattttattttatttttattccggattttcattaatctcgtattgggtttttatatggactcttatttcaatattgcctatttttaattccgaatttcagctatttttatattgtatttctacttggactctccttttctttttctccgattaatgtgggaatttctagcccccacagtgaacgtggtgcctcctttcaaagcagttttaataatataatagatagataattagctctaaatgcgagcaccatgtcaagtatagaatcgaatagacaggctccaccaccagaaactcaaccagttgagttcagggtttacgattctgacaggcccttccgtttcgagctctggcggaattcggaatttcgtgaaatccggtggaaatccggtaaattccgaacaaatttcataaaccaaaacttgaatacaaattccctgagtttaccgataagttcggttttggcgaaattccgatcgaaatcatcaaaaattcgatcagtaactgagcctagtacatgcaatctagcacatgtaagtgttttctttttattattattttttttattcttttctttcctgatataagtttgagttaatacacacaatacattattttttaaatttttgttatcccaataggttctatgaatatcatagtatttataagattttatttgatttttttctttttttattaattctattttgaatttggatgaaactcctcgaactctcagatggtttctactttcgagtctcgtcgagccgttgaaatttcacgaaatcggaattgtaaacccaggttgagttatgcttactttgcatcatgaaagcattgtctcccccatcgtcataggtaattttttttttcaaaaaaacatttgtggttgtttcttttttcttagcttgcacactactcattctggcactagcagctagtgtgcacaagttttttaaaagaaaaaggtataatacatattatttttggagaggatatccgtacgaagaacccaaatttatgaatcacaaatcgttaacaatcaattgcaataacatcttttgtgtttttaaacctttgtagggaagaacggattcgatgggggggggggggggggcgccggctactttctaccacaaactcgatagcgtgcgcgtaccgtccgtccccccaacggccgggcctgcctacataccggacctaaccaacaaaccaactgggctggtgcacgcacacgcccccacgaacgtacgcacgcacgcacgtgcagtaatgagacgcaacaacttttggttattgcaccggcgcacaagcaaagtccgtcgtcgcagcaccctacagccaccaccaaaaacgaagtactactactgctctctgctcgatctttctctggaagggcgtggcagggttttggatctatggacatggatgtgtcactactcgctgcggcaacgcgtagtagcagtaggagtactgcgcaagggtatgcacatgcgcagctcgataggcaatacagctaggaatagtcacctagtattagtagccttttgccgcccgcggtgcaaaatcctccttggtagccgcgtccgtgcatgcatgcgcctcccccgaatcaaatctcccaactcctcccgcgtccgtgccttcgcatcgcgtcgcatgcatctccatgcgtgcagctacctatagctagcgaagcacccgtccatccatccaccagaccgacccccgtgccgtacgtacgtcgcgagaggctgcgagcgtgtataggtagagtacccgatctttcgctggccgcgccgcgccgcgcgagcgcgcgtgtcgtcttgtcacctcttttggccggcgcgccgctgcggcgatttcgcccagcgcgcgagagaatgcatgtgcgcgatcgatcgatcgacgtaacgagcaatctcggcatctcgcggggcgcggcgcagctagctagctagcgctgtacacacgcgcgatcgtgcatggccgcggctactagctagcggcaaggaaactggcggactggcggtgtgagtacgggaggatctgcttccacgtgcatgctagctgcgagcatatggcaaaggccatttgggtgcccatgcatgcacggatacgcataaaatggctattcgagcatagaccatgcatggtagggggtggtggtgcagggcatatgcagatgcggcagatgattagcggtaccggagtagcctttttagctggctggccaagctctgtacgagtacgcacatcgcagtatacatgctgatagatcacaaagatgaggcgatgcgcctctcgatcaggtcacaaagatggaactacgtgccacacgcaggtcgcacgtgcctccctccctccttattactcctacacacttggtggcgcatgcatcgcatgagattctcattagtactttcagctactttctgtcttcctgcatgcatgcgcggcgttggaatctcatctgtctaccgtaccagctgcaaccctgcaaactgcaagcgccctaaattaacctgccctgatcaaaaccaaagctatcacagcaacagctataatgctgtcgagattactacacctactccgtacgtaggagtagcattccaatccacattaaaaatgagtgttccataatgaggactttatatctttttgagctcccagttactatacatgtaagaatatactgtactgtatttcatgcacttattttccaatcgttcacctaaaactctggccagatgagcctatatcggtatatatatctcgtcttgagcacgtacagttggggctctatcaaaccatcccagcgtacatataacgtacgccaaacagttcggccatgagcccatgatgaacgtacgtgcagctggtacctggctacaaaaagggagcaattaatttgtttcgcctggtatgtatgggactagtttggatcagctgactgcaacttaaacagctgcagtgagcatcattggatgcaaatcggacggtctagaatctctagattacacactgcacagtccatatatagcactgtagcaaaatactgcagtacggagtcctgttcatattgttactatatatcattgaatttgaaccgttgatataaaatcggatggccaaaattatgtgtagtagttactccgtaactcaatttgaaccgttgatataaaatcggatggccaaaattatgtgtagtagttactccgtaacttgtagtggatctataaatttgtacatatgtacagcactgttcataatcagctatactctattgatttattggactcacaatatatataccagtatatgcagatggcagaactgatgcatgagaagttgtaattgtaataaacacatatcactactagagaaaggggctttagtcccggttaggaacctcctatactcccgattatacaaccgggaccacgaattcaggactaaagatgcccatttttaatcctgggtaaaataaccgggagtaaaaatccatttttaagtcccggttggtgttactaaccgggactaacaccaactgagactaaaaatggagccaggataggtccgtttgctcctttatttttttttcttttcttcattgtttttgatatattgatttcactctatcccccatccccgaatcgtgaaatcccaaatcaacaatccccaaatcgtaaaatcccaaatcgattgtcacctccaaatcctcaaatcgatcatctccaaatacatcacaaaatcttaaaaaaattacctcacaagttctacaaaattcatcacaaatacatcacatattcacatcacacacaaatcaaatacatcttagatccgaatcacaaattctaaaaaaaataacaacccaaatccggcaaaggcacaaccggccactgtgcgccggccgccgccttcagcctgccacagccagccgcgctgccctccgtgctagccgctcggccgccgccgcctgccagagaagtgggagcaggggggagggggagggggaaggagaaggagaggaagagatagggctagtgaggagaggaggagatagaaaccacacgcgcatgcctcctcgatcggattcgcgcgcacgcctcgatctccgtatatgccgatcttttttcccactacaaatagatctttataaagaaaatataagggtctgacactggctgccgttttttgaaccgggactaaaaatgatctttagtcccggttgatgttaccaatcgagactaaagatcaaaaagtacccctgagcttttaaaccgggactcaggtttttattagaaccaggactattgtgaaatttggccgaccgatcaaaaatagtttctccagtagtaccttttcttggtgctaattagtggggataagtactgtatatcattacggatttaatttatggaagtgaacaatatagaagctttttgtgcactgagttcaactagtagtggagcttcacaatatagttaactagataaataccccgccgcattaatgtgggaaattaagttgtatagtatgtacaaataagatgtaatatgattattaaaactaacaaattgatacttgtgaattttgagcctaaaaataatgcatggtgttatcggagaagaaagaagaga

SEQ ID NO: 69600 - DNA, 671 bp, Oryza sativa
cccagcagaagaactcacgactcgtctggagtgactccgccgctacctcatcggcccctcccctattttcatctcctcgcgtcctcattggagacaaggagggatgaagatgtcccccatctggttgcatataaatgcatccgccctacccaaacagaaggaactcacaactcgactgttaggagtgactccgccgccacctcgtcccctcccctccatgtcatctccgtgcgttatcgccggagataaggaggaagagaacaagttcctcgttcgtcttcggtaggttttcaataaatcttgtacgaggttagatcgattagatgttgatgggactttggcttctctaaagtcttttgctttttatccctttggtggtgggtattccattcgtaaggctatatatggaaaatttgggaagacttctctattaggtcgtcgataattatatttgcggtgttgacttaggaccttggtttccgatttattcgataacatcgggtcaatgttgtatgggaagaataaaaatgttgacgggtgtttgttcatatgttttttgctgtgttgagattggttagctaccatgacagtggctgtatgcatgtttatcttgtgtcgttcaaagatgtagagcctcttatgctatattttgattggttctatattttaaa

SEQ ID NO: 69601 - DNA, 662 bp, Oryza sativa
  unsure (1)..(662): unsure at all n locations
attgtgatcccattactatgggcgaattcnagctcggtacccattaaaaggttggttgaaattgaaacgatgtgatgaaaaaattgaaattttatgtgtaaaaaagttttcacgggataagaaaattggagggttaaaaaaaagtttggaactaaactcggccaaacgaactttcgctagcttaaaacgaaagcttcctgagatttttcatgcacggtatagtgtccctttctagcctgtagaattttggatgctctggttgaacgtgcaccgactgttgctgttacagtgagatggattggatccctcagctacctatgaatccctgatcctctctgatcaatgagagatgcatatgattgagagccttttttccagacatcatcctgttcctggttggtgcatccgtaccaggggtggggtgccactgccatggtgttcatctctcattgtntntcccctgggnganannnaanacatccccccccccagagtttgagaggacgggggggttagntgcccagtcttggggggggggggggaaaaccctttttaagnttttnnnnnnttttttgttcccaaannnaaagaggagaggggggaaaagaatttntnnaatttnnccannnaaaggannnncgggggggtgccatgaaaaaaat

SEQ ID NO: 69602 - DNA, 671 bp, Oryza sativa
  unsure (1)..(671): unsure at all n locations
cgtgtgtgtnnnagtgagtaatcgcatctttataaggcgaattcnagctcggtacccgtattggtgacgttgcttacaatctgcttaaaattccttaaacttagattgggacagtacgtaaggtttggttgatttctgggtgggtggtactgtctcgatcgatataggttttaccaggtacttatgtcgaacgaacgggtacgaccacagtttctagaatggggatagacctagttattatgttaattaacaatatggcacctctgtatagtggttcttatttttaagtcctcgcgcaggaggcaactatagcagcgaaaggcaacttttaaccattaccatgtacaggtaaatggtttgtgatactcgagtataaattatatggtatatttctaaaccctaatcgagatgacgtggtgtcatacgattagttccccttaaatatctcgggaacgccagatgtccaatttnttataaggganaaanaancaaagacacacccctgagtttacagatattcacataaaaaatantttaccgcatagaaagggtcttggaattctaattcatgttgctcattnncagtttccnccnnnnccnttggtggggggggggggggtggtggatttttttnaaggtgtaagataaaanaaaaaataaattggacagaa

SEQ ID NO: 69603 - DNA, 681 bp, Oryza sativa
  unsure (1)..(681): unsure at all n locations
gtgtgtatnnagatagtaatcacatatctatataccgcaatacacctccttaccctgagcgagggagcttgggaccatttctatgtacccatctgataatactggtcaagtgtttcctaattaaacctagcacctcangtgcgtgaattgattctaggtctgcctcccttggtggccatatttgtagtcttttattgctgataagctttgatagatttggaaccaatggaacttcaatcttgaaaaatttataaacaatcaaagtgtacatgatatcctcaatagcagtctggcactcatgctccttcatttcagcaatcctcctatttgtagaagtcccaacaaatcaattaatattcagatgcaaatacaatataaagataaaaggagcaaacaatatagactttttagtgccgaatatagatcacctgcagtgacaattatgctcatattatnaaataaggncnnaatanaagggagggaggggatgtggccnnnnnnccagtaatttgtgtaagttggtttttttttgcctaccttnnnttgatncgatggcatgtggtccaatttaaattcgatatggnagcaaagaaatatgtnnaatttnnaaccgttataaaaacaaaaaaaaatattctgttaaataattttgtttgggtgtaaataaacaccataaaaaag

SEQ ID NO: 69604 - DNA, 3855 bp, Oryza sativa
  unsure (1)..(3855): unsure at all n locations
acgtacatttgaagttctcgtctttgaaggtccggccatatatgcttttccctccagtaccctgaaatattcattttttgaaacctactttatccacatgcagaagttgaaagctgaatgatttgatgtaagctaggtcaaaaattcataattcatgaaaccaggcagctgcatgatttaatttaagccatcaatttaaagaaaaaggatttggtgctaatctccttgtaatctagccatgaagtcaataatcactgcatacacattatgctgatcacaaactaccaattcatactcataatgtacatgatgcaaagcagtataatgatctaaaacaccatagggcaagcactgaagtgcataacacaaagttgtataatgatccaaaacacatatataggtcagctttctatccaaaacagcataaagcgctaacattgataaaacaaatcaaacttttttttttttggagaaatagttggctcaatggtgatagatagaaacaaacacatgagctcattcagtgttgtgagtaatgttacactatgtgactttttccaatagagtttgtcagatgaaacagaggaacaagtgcaacataggagtagattataaagaaagtaaataatgaagacatacgttgcccttgtcaaagtctcctnnnnnnnnnnnnnnnnnnnnnnnnnnnnnnnnnnnnnnnnaccccttgtaaccaaaccctttttctcctgaaaaggaaaagggcaatggtatgtgtatcatgcaccaaatctgggtaatcctgtaaagtagtagatgacagaagagaagaaaagcaagaagccctttgtaccagtgcaaagagcacggaagttctctgcggtctggggaacatcatccccgtataggccaataacgaccctcccaacgttcttcccaacagggtttccgatgcttatgtcaaagtacaccttgtttgtgattttggactggaggtccacttcctgcaatgtatgggagaagtttagcaaaactgaaagaataaatttgaagcgtggtatccagttctcccacatagggtaagaataatcgatacttgcgctgttcttttatgtatgatgttaattgaactaaccaacgtcatatattaaaggaaggaggtagtatatcgtaagttaacatctagtggaggaaaacatgaaagcgcatagtgcacatgggaaaggaaaacccagctttcagtagtacagaagggcacacgtgttttctcacaatggtgcaggcagtcactgatgatgaataacgtgtttacattcggtgcacatacaaggtaagacctgtaagtagcagaaccctatggtcgaggcaactaaaattattaatcagagcaggtgaatacataataaagcattggtgatgataagcctgaaactgcaattttggtagcataaatttcacctggtgatttaaaaatctgataacaaaatttgacatacaaaggcattactagtattagttttaatttaatggtgttggaaggtcgaggtcatctgtgctaacccaatatctcttccttcaaagaggcaacaaacaggggccggtattgcggaggctgattgcataataatagtccagtaaggtggagtagtaatttgactgatatactactagacaggattacaagaatggatgcggtgcggcaatagaaagatatatgtagggcagataaaagaagaagatccggggacacagtaccttggggtcagcggtggcggaggagacgaagcgcgcgcggctgtgagcagcggaaagcgcaggagtgaaacctccaaagacggccgatgaggggaggcgtgcggtgccggtgccggtgcggatggagaggagcggcgagggggttttggaggcgaggagggcccgctccgccgccggccgcgcgatggcctgcagtgcaaacacaagagaagaaagagcgacgataataagattgagagctcggtggggaagaagaggagagcagaggccatggatgagtgagcttacgagtgtggcgaaggaggttgcgaccgccattgttgatgttgaggaggagaccctttctctctctctcgctcaggtggattgggattggataggtagatagggcattgcactgggatgaatggatggcatttttgcatatgtgtgcacaggaaatacaataatcacacacaccttcttcattgggggaagtactatattttatttttgggaccaaaagcatctgttaaatcaactctatttgtcccaatccaactatttaaaaattatttatttacagcgtctctttctataatatatcnggaagttatcaattattatacaatataccatcggactatactattttcaaaaatacctaagatacaccatattagggttattatttgatttatcctaccataagtttcagaagaaaaaaaatgctagtttatgcactagttttaagattttacatttttatatttttttaaaaaacattatttatccattatatacggcaagaattttttttgtgctgtttttaatgtaacttttttcgagaacatacctcatttctaatgtaaattatcttttgcgtaagtaatttctctctcataaaaaactcaaaaatattttttttaaaaaagtgaaaacttgaaatttatatataaactttcatgttgggtaagtaagctacataaacaattcatatttttaaacccttagatgaataaattaattgttaaccttatatgtattttgagtattttttaaaactaggacctgagtaaatatttttcttgagttttaggttataagacttcacattcatatatgtctagatctattaacacatatataaatatggccaatgctaaaaaataagaataggaggtggtattattttttttttggtagagaggggaggggcccgcataggaggcaggaggtagtaaaatgggctgatgggcatagtattcacgggggcccatgtaatagatgggatgggcttgaacacacatgtaatgtaccaatagcctcggtcgaggtgaggtggaagaagcaaagcaatctccgtgagcggtgatggcgcaacagtggcgatctctcctcttcctcctcctcctcctcctcgtgcccttcgccgccgccgccgggcaggatgcgccgttcgtggtagcacagaagaaggttgcgctgtcccgcccgggtccaggcgtggagcgcctcgccgtcaccctcaacctctacaaccagggttccgcgtcagtcccctccccatctcatctccctcttcccccagatttagatccacatctctctctccctctcttcactttgttaacctattattgctctatccgcctttccttattgattaattcgcataggtcaaaaacaacgggaattcctactgttagctagacttgatagatagccgcgagcccatgtttccctttctctgtgtaataatgtcaagctgactcacttgttgataacacaaattatcacgctactattgtgcatatatactactcctacatgacatgacatgattgatagtcacatacacacacatcaatcgctaatccatttctccatctatctaaccacactgctattttagggaaggggaaccggaatcctcattatgggggtgtttacatccagggttgtaaagttttggcgtttccgggtattatataggatgtcgcattgggtgttcggacactaataaaaaaactaattacagaatccatcaataaaccgcgagacgaatttattaagcctaattaatccatcattagcaaatgtttactgtagcaccacattgtcaaatcatagagcaattag

SEQ ID NO: 69605 - DNA, 3896 bp, Oryza sativa
cgaatttcagcacggacgttgaggaaaacccagcaatcttgcagggtgtgtttcttagttttgtggataggacaccaagaccttgtggcttcggaagtcatctttgtcggctcgtggttcatatcggaaggacaaggtttggccgtatcagaatccttttgagcttggatgtcgtcaatattccgttctccgtctcgacgggaggatttttcgacatggaatcgccttggttcgtagccactgcgttctcgtctccggtcattggaggaccggttgagatcggcgtcgtggtgtaaatcgggaagatgatttcgccgacttgagtccataccagcattgttgaagcagggagtacttggctgaggctggtgctgacgttgttgtcaacgaagctggatgacatagtagtagaaccttgagtaccaaggccccctacctggcgcgccactgtcgacgggtgatacccgtagaccggatatagaaggtattagggtacgttggtacaaggatctacgtagtacgacatcaagcaaacaaaagataagaattatactagttcaggccccttgataggtaatagccctaatccagttgatgtgggattatatggtagaaaacacaggttacaaagagaacaagggaacttgtcggatccggcgagattgtagtcgagttgattcgactagctctcgatgagttggctcctcgtaagctccggcttcgtaggctgtggaggttgtgttggctttgagattcgatgtctaaaccccctctcggggggccccttttatatcgcagatgtggaggtctcctcatagaactcggaggtatcagaccctatacgatacgccaacgacccagttctgcccgagtaggattcttcccatctatagattccgtgaaaggtttccttagaatatacaggaaatatccgtatgcgcgtgggtatgccatatcaatatgtaacgtatatcgaagggcaaagggtatacctaacccgtaaccctgacaatatgtttttagtgttttaaaacctaaattgtaaaataaattacgatgagaaaaacatcaaacttatttttttaaaaattcaaattttggcaatagcgtaaaggctaatctctccgttcaaaaatatagcaaccaaatattcaatgggacataacctaatactatatatttgaatagtcttttttaaatgtattaataatataaaaaaaacaacaaatttgaatagtctgataattacatgcgccaaagagcaagttgggccagaatgacaagaatgaattggtgatatggatcgctgccaatcataatgggccaatcttttcctcggcctactaaaccagaccggccgtatttttctgggccagtggtaacgtgccctgccatttgtacagcttatccgtctccatctgggccgatgaaatcacatccaacggttcacataaaaaacaaagatgtcatctcccccgcttccggagctcgccggagctccgtcgcgcgcaaacgacgacgagaacacgaggtggtgagagacacccggttcagagacttcgcagcaaccgcgttttccggcgagcttgtcgcccgtcaaggacaaaaatcagtagctctgttttgatcaatgtacactcgaatcacaaattgataggtaaaataattcagaaacagcatatacagtgcagaaataaaacagtaatttgatatcaacccgctacaaaaacacactcattacttgcaccaagcaaacgactgcagattaaactggcagaacaagcaggcacccaacgttactcatctgcaccattgattacttgagtaccgcgaaacctccaagtccggcgacgacaacgattggcacgacggaggcccagacgtcgagcttcccaacgcctcgccgccggtcgctcggggaagcagagacccagcagccgacgcccacctcccgcgcgccgaacacggcaacggcgagcagcatcacgtaataggcgtcgaagagcgccttgctgcgaacgaacacgccgcccggcgacctgaaaagggcgaggacgagcgccgcggcgaccttgccagcgccgccgcccaccagcgcgcgccgcagcttcttatcggcgtcgatgatctgctcggtggccaatgcggtgggcatcgcgacggtgacgaaatcggccattgctcgatcgatcgactcgatggtgcgtgtggtgactgacaaagtgacaaaaaagaaggtgatgagcttggatatgaagtggatgcgatgcgacgaggacgaagaagagatcgccagtatttatacaagcgagccgcgtggcggtggaagtggcgttcagacatcaacagcccgagcccggttgagcccgagagcccgcgacgagccgacgactgatgcatgtgctggaaactggacgattcactcgtcagagtctcagcaaagatgactccaatataaaataactaacaagaaagacgacgcagagatgccgagttgctaacccccgagcccgagcccgagcccgcgttaactagtacgaaaagctggtcgtgagatcaagagaagaaagcattatcatttgtcaacgaaagggaaatttgcaaggaatcgtcgtcttggtagcagacatgggcccggagcccgaatcccaccatgggaagcaacgactggacataaactgcataatactatatgattaattataccacttcgccttgagaactgggatttagtttaattatcacggtgataagcgccaggtagttataatcaggcagaacctccgccggggacgatggaataagtagctagctctgaccatctccgaccatctgcagcctgcaattctgctatgatatcctcactgcaatcccactgtttctttatattattttttcgattaatatatggtccttcccttctctattgctcccagtttcatattataagtcgttcagctattttcttaatcacattgtctttaagttatttatagagaaatatagtaaaattttaacccataacaaatatattatcaaaacatatttaatattagatttagtaaagcttatttggtgtgtaaatgctgttagatttttttataaactaaataaaacttaaagaattttgattaagataaaagtcaaatcgacttacaatataaaacagagggagtgataagtgctacacagcaaagctttttttcttttctaaaaaagtaatataacattttttttatttattcttgtagcgccacgtatacgtcttatgagacgagtactaagtgaacatgttacataggtaaccgccgttcaaaccatagagggatatgatttcaacctccggggacatggtttgaacgggttttttgtaggtgtaggatgctctacatctaattttaggattaagggatatgagtgaatatgtaaaataagtttttcccagtccaaaacacaatggggccttcataggatgaatccttttcctccggtgaaataaccgagacactagtgccacattttgctgggcacatacggctgcgtcacaagcgattgggcatatggtcgtcgttgccgtggagcaggagcctcacaggcaacagtgcatggtgacgatggtttaacaatttttgacagaaatggaaaagtattagtttagcataaaattaaactattaccggtccaatgatcgagtagcagcggatcaagacggtgacgtcagaaaggcctaccacagggggaaatttttttatttatacatttttttattaaaatatttacaaaaataatttttttttgacaatttacaaatctaatcgcctcccgccctttggcagggtgattttccagagggcggcaagggacctaaatgtaaaatttttatttgtgttcaaacc

SEQ ID NO: 69606 - DNA, 866 bp, Oryza sativa
  unsure (1)..(866): unsure at all n locations
cgtcacttcatacaatcattatataacttatcaatttcncgctcttcttacctactcttcactttcttactttttaaatatgtttactcctattctctcccccccccccccccccgtgggaattgctnatacatcgtagaacccnnccncaacacggcaggnaanaggaaggcgcgccacacccaacgnggctagcaanncaaggcgaagcaccgcaggncccgactattactccaacaanngngcaagaacgccgagggggccaagccatgaccaatactggttgctttcagccaaagcgctttaactagaattggatcaagttgagttggggcggtcatcaaggcgggagttttcagtcaatactaacaggtgtgttatgctcggaggcggttgacaaccatattgtcttaccatactgcttctgatgaaacttcacttgacatgtttgttacccttgccatgtgtgtgatgtgatgggtgtttttgcagccggtctagggagagataccgtgaaagggataacggtaggggacagcaagaaggaaggagcctaggtggaggaggaggggtggaggccggtgggtctgcgacaagatcattttcaagcaaccttcccacaatactgcagcaaccttgagagcgtactacgagtgacgagcgtactagcacaggaggaaattattattaggagaatgctgagggaagtggtgacgcccagaggtccgagatccaaatcagcggtgggtttgtgagcttgcaccaagcatactccttttggtgcaacaagtcttcggcgtaaccttaacctcaacctctaagcagggtgtaatacaacgcagggagcgttaaaaaggaaatggacg

SEQ ID NO: 69607 - DNA, 1001 bp, Oryza sativa
cgggcttcaccttcagcttaaacgtgtctgcacagccaaaccaccacacattgtcacacattgtgacacgactaaattaaacaaaatcagtcactaattaatcaccttgggctgagcagttgtagagggggccagggaggccgttgagggtgtagggcgtcggagatgttgggcccgccgccggtctggagcgcctggctgatcaccgcctccgtgtcgttgttccaccactcgccgaacatgatgggcacctcctcatgcggcgccgggaacgggtacccgacgccggcagggggcaagatgaccatggggccatgcacggtggcgcgcagccaggagatgtgcgcgtgccaccacagcgtgccacgctgcccggtgatggtgaacctgtacacgtagcttcccccgggctggatcgggcactgcgtgatgtacgacggcccgtccgcccacccgctcagcagctgccggatcccgtgcctgcacgcacacgtacgtgagacacacacggtgaaaacactgggttttttggcgtcaaaacacggtggaaatcgcgaggcgtacgtaccagtggatgctcatgttgtagggggagtggttgacgaccgtgacctcgacgtggtcgccctcgcgggcgaacagcgtggggcccgggtactgcccgttcaccgtcacgatgctcttcgtgctgcacagccgcgtcacgctcgtcgtttgcacctgccatgcatgtcacggcaaattcgcgttggttttttttggcgaaacttgtgtatcgatgtgatacaccacaccgtggatatgcatgcacttacatcgaataggtactgccttgtgatggcttcagctcccattgcggacagcgtcatcagtgctgcgacgaggaggcagcaacgaagaacagaggaggctgccgccattgctaccttcactgacctctctgtctcgtatgttaatgaagctcgctcttagctagctcagcttgtgatggtatggccata

SEQ ID NO: 69608 - DNA, 26940 bp, Oryza sativa
taagaaaataggccattttaatagttaatttaggctattttggcttcaatccaaacacaattttacctttgccaaaattagccatgccaaaagttgccaaaatttaacattgacaaaaattggtaaggccaatttaggccacaaaccaaaccaaccctaccaaattttgtcaatgccaaattttgacaagttttggcataactaattttggtatggcaaagttgtgtttggattgaagctaaaacagcctaagttcactattgaaatggcctatttttttaggcatatcaaaatttggcttcaaaccaaatagatactaaacattattaaaattgccaaatattggtaagcctaatttaggcctcaaaccaaaccagccctgcaaaacctggacggggccactgggcggggccacggacgcttctacacttggccataacctttggtaggagggtacagcgcgctcggcccatatacttgatcagccgcagcagtgaactgctggttaggcgcatatccttgcggcggatatcccgtcacaaccggtgcggcgggggcctgctgcggctgcggctgctggccgtcgggcttaggctcgaccgccgcggcgacgcgaagcatgatgtaggacttgatcccgaacacggcggcggcgaggctcagcacggccgccctcctgaagacgccgtccttgaggtagtagcacagcggcgccgtgtcgcgcgtcaccggcgcgttccacgccgcgccttgcacgaaggacacacccgcgacgatcgccgcgatcctgtacacgaatattttgtgggggaagatcagatttgcatgcgcctcaacattgaactgtcgattgacaaagagacccgaaggccgaaggtacacacggttgttggcgagagggtgcaattacgtacgaactcgtggaactcaccatgagaagacagagcagacaatgccggtgacacgcctggactcggaagcgcccgcacgaggcctgcagcatccgcagcagccggcgacggaggagacgatgatctgagccaccggcagcaggagcaccgcgcatattcccagcacgaaggcggcgttcgccggatactcgcactcgccggtcgacacgatgatgtcttcgggctgcaacaacgaataaaattgctcatccacagatcacagaattcggaacactagtgcagcggagaatcaagatagatgtgagccatgtgatgtgacagtgtagcataataaaaatcgctgtgcttgttacggtgagttttttctcctcggcgatgaaccccaggacggcgctcgccaccgcgaacaatcctaccacggcggacacgacgaacactcccgtttccatctctcttcaaatgctgaaatgcctatgtctctccctgtcgtgtcgtcttctctctagcctctagctttgctctgagatgagaagcgatgctgccatacacagtatttatactgagcgtctcgtgctgaagctattatttctatgatcattttattctgaatttgtgctagctaatacctgtgcagacgtgcagttggtctgtttcgatgattgcgttgaccctagaaaacataagattcatgagacagctagtagtagcattctgaatgctagctagccagctcgttaacgctgccatctggcatctgccggcgcgatgatcgctcgagttctataagcatgctgcctaattaacctaggacaaacataaacattatgagctgaaaaagacacgcagatataaacgcatgaactatttctttggacaaaaaaaaagaagcaaactggggacaagcctgataacataaataactgctagaactgaacagcatggtgtttatcttataccaacttgagttgacactgacgaggtgacaactactggttaatcatgatctgattgcttggataatatagtgatatagtttatcagtttaaaattattccccgcaattcctgcccatgttcttgaagaaactgaccacaaagaacatcagttggaaacttggaatgtgcaggtagctagagcatcgcctgccgttgagtcaaagtcagctcgaaactcaagacgtgcatccgtcaactctgaggctgtatataggcgaggatggattctaatcttgcccgttcgtccgtttcttccacgtaactaaatggttatattttttttaaaaagtaataggatagattaatacataatatatcactctacaaacacttaaacttaaatttaaatttctataagttataataaaaacaataaattaaactttaattagtatatatatttacagacaatttgttttttttataatttataaaagttgaatttaaacttgtatgtttgtggagtgatatattacatactactaatctatcttgttattttttaaaaaatgtattttataactatatatttaacatgtaaaagataggtgaacgtctaccgagtgctaaaaaggggtccgaatgtttgcagttgcagagcgtcctgattagccggcggcttcctcgacaatcatctggggaagtcagtcaattagtgcctgatcagagagacgctttgcataatgaacacaaagaacaaaatggtcatctctaatggttaaacgatctgtttaagaaaaaaggtcagtgcttcggagatctgttatattctatcactgcctgttcacttagtgccaaatttgaaccggcataatactgctcatagttttttttttaggaaaagggattatattacccaactaaagagtcttcacaaacaaaatgtgagatgaaattagatttatcatccggccaaaactcaataagagcgaaatggcctataatctagtggttacaaaagtcttagtaacaccttagatcttaagtttgacttcctgtataaacgaatttttcaggatttaatactgcagagtatcctcactcgtctcatggaggcacgggaggttgagcgggatcctgacaacaacgacaccctcgaccggagcaactactgttggatctggcggcatgggcctcgagccctctggacacatatagccacgattgcctcaggtgcctggatgatgagttgatctgtaggcatatggtactacttgttctttaatttaatttgttcttgaatgttcttaaatttgtgataatcaattcggctgtgatccctcatgttttttccttctatttttcttgcaaagttgatttggcatacgatttacttgcaaatgttgcaaatgtgtgtaaacatatgaattgggcatcaatataaatcattttgactttcttttttttttctgaaaataggtatcagtgattgtagttgagcaacatggccgccagcctactgttggttaaaaaaccggcaacgtacgtacgatgccgtttttgaactgttagtgatggccttctgtttgttgatatatagtgtgatcacggttgactcacgtgatcttctgtaacataaccccaaacgaaaaccatacaacgatctattatattattaaaacagctatgaaaggagacaccacgtttgctgtgggggttagaaattcccgcattaatcggagaaaaagaaaacaagagtccaattagaaatacaattaaaattagctgaaattcagaattaaaaatacgcaatatggaaagaggagttcatataggaacccaatacgtgattaattaaaattcagaataataataaaataaatatcaaaattaggaaaagaaaaaaagaagaattcaagtaggaatacaatttataaataactgaaattcggagttaaaaataagaaatattaaaagaagaggacatccaaaaatccaatacgagattaattaaaattcagaataaaaaataaaaaaaatcgaaattagaaaaaaaaataagagttcaagtaggaatacaatttaaaattaacttaaattcggaattaaatataagcaatattgaaataagagtacatataagaacccaatagtagattacttaaaattcagaataataaataaataaaaatcagaaattaggcaaattaaaaagagagttaaagtaggaatacaattatgaaacaactaaaattgaaaataaaaatatcaaaagaacataataataaataaaataaattctgaaattagaaaaagaaaaaaaagatttcaactaggagtaaaatttataaataactaaaattggtgataaaaaaataagactattgaaagaaaagaccatctaaaacacatgacaaaattaattaagtaataggcctatagaggagcaaagtggtggcggttgatgagacatctaaaaactattaataaaacaccaaatagaatcctaatgacgattaaaaggaaggacgacgggcatgtcgtgaagcaatcagtcagggacttctagaaagtaaaaaaataaaccccaatgataatcatattttatttttaaaatctcaattacaataaaaaagagaggcagcgggtgggtcgtataggagtacgatggtagagccgccgatggttggtgggtcttctagaaagtaaaaaatgaattccaacgatagttatgttcgatttttataatcccaatgataataaagattacgcggcggatatgtcgtaaaggagtatagtggcagcgtttgacgagatttctaaaaattataaaaaaaacatggaacccaacgagacaataaaactctaaaaactataaggttcaattttaaaagttcaggcttctaaaaagtaaaaaaaataaaccctaatgataattatgtttgattttaagatctcaatgataataaagaaggacggcaacgggcgagtcgtagaggagtacagtaacaaagttgctgacgttttggcggaacttcaggaaagtaaaaaaaaagaaacttctagaaagtaaaaaaatgaacctaaaaaagaaacccaacaggacaataaactctataagtttttagatccaatttttaaaggttacaagaagaatgaatagaaacagtggtagatcgagcaagctaataaaaaaataatatgacagaagtaaggggtagcaactgatgtgtcttttaaaaactataaaattagaaacacgaggatgataaagtttggtcttttaaaatcttaagacaacgagataactatttaataaattttaagtaaaatcatattagaaaatatataattttatatgggtgctagccgtgcaattacgcgggccacccagctagttggattttaattaaactctcaaagaacatcccttgttatttgcatgtcactcaaatacttataaacaaattaaaaataatctaagaagatttcttaagatgtgatatatcctttcacaaacatgcaagttaaaattctatcctttgtaagttgtaataaagaaaaaactatagctagttaagatgtattcgtagttaaattcttcacgtttgtaaaatgatatatcacatattaatctattgggttaatcttttttaaaacttttttcataaccgtttaagtgacatacaaataacgatgacgatgagatatttcctcaagagtttagaatggtttcccaaatattcatgaagtgagatgctatttggaatatatacatatacgtgtattttacatgagagactctttacagcaagtcagcaaccgggcatatataataattatttaagtatatcacgcataggttcactgtcacgtactgacttacagtgctacacctgagcatcccctggaggaggatgaggaggcaacggctgatccggcgcgtgcgatccgacttgagcaggagcaggaaaagcggcagcgacctgcggctgcgggttcagtgctcgtccgtcccctccttgctgtggcggcgccggcggggcagaaacaggaggagacaactgggcggccgggtggcccatcgcgatcccggccgccggcgtcggctgctgctctcccggctttggcgtccgtactgcctcgttgcgttgcccgcggagcgtgacgtaggaggcgatcccgagcgccgtggcggcgagggccagcacggccgcgcccgcgaagatgccgtccttgaggacgtagcactagcacaccggcgccgtgtccctcgccacgttggcgttccacgccgcgcccaccacgaacagcacccacgcgacccccgccgctatcctgcacgtacacgtacggccccacgcgatcagctacgtacgcacgaggtgatcgatataaccaaacgggaagcggatcctctgactttggctccaaagtcacggttgtgcagttagcattgtatcaaccgttgaaacaatgagacgacgacggtgacacggtggccggcttgtgggatcggcggccggttgcatcatgtaccatgagacgacggcgcagacgatgccgacgatccgcttggtctcggacgggatggcgcgggacttgcagcagccgcagcagccgccgacggccgtcacggtgatctgcgccatcagaaggaagatggccgcgcagatccccagcgcgaacgacgggttctgtgggtacaggcactcgtcgccgatcagcaatacgtccgaaatctgcaacaaatcattccccgtttgtcacgcatgctcactggagtcactaatcactaattacgctcatcagtcatcacatgtatatcagagaacggagatatctaaagaacatgcatgcatcttagcgcagtatgctcacaatgatctttgtgccctcggcggagaaccccaggatggcgctcagcacccccaggggcccgacgatcgccgacacgatggccaccgtcttgtccatttttcccggccaccctcctccctcgtcttggtgcgtttatatacagagctttttagctagctcgggcacactactggagaagtgggactttagttccggtttgcaacccctttattcccgggttgcaaaccgggaccccgaatccggtactaaagatgtccaaaataatcgggactaaagatccatgaattgacatcacaaattcatctatgaattgacatcacaaaatcatccgcaacttgacagaaacattaaaaaatcatccacaaatttacatcacaaaatcatcaataaatacacagaaacatctaaaaatcattcacagaaacatctaaaaatcattcacaaatttacatcacaaaatcaacccaaaaatcaacacaaaatcatcacaaagtcatcgatcccctccggcttgcccgccacctgccacctcctctccgtgtgcgccgccgtcggctgcctcccttcggcgcgcccgctgcacgtgcgcatccgtgcgcgccgccgcccgtaccgccgccttccctcctgcctcccgcgcgcccccggccatctgccgctgcttgcgccgacaacgtcgaggggaagagggatcgatgaaagagagtggacgagaggagtggagggaggattggaggaagagtgtagaaagaagataaggaagagagagagcgcgagagatggggatgacgcaggaatagagatatttattcccgattggtatcatcaatcaggattaaagatctatctcccggttggtgttaccaaccaatctttagtcccggttggtgttactaaccgggactaaagatcaaaaaatacctatggctttaaaactgggactaaaaatgtttttacttcccattcctacttaaaccgggactaatgatgtttttacttcctgttcctactcgaattgggactaatattatttttacctgacccagcaaagataacttatgcagtagtggcacacgctgatcgctgatcgcatttcgatcgaggcatgcggccgtaatttctccgtggatatccgtttaagcaagtttggctgcagcctacaggcactatggacagctgcgtctttgtttacaggtttacaccgaccctgccggcacggtaacttgtatctatatggctgcatcgataatttgctgcgatgtgcttacaaacatactagactggagcaaatattgagatatcgacttggagctcaattatttctatttgaacatctacgttccgccttggtagtcggcagatcttgacatggtttttggatgtttggtcctattaattccatgttttctttgggggtactaattccatgctatattgttttccttagttcactactaaagccgttattgtcgcagctgctaccgccgtcgctgcagccaaagccaccatcaccaccgtcgctcccgccacttgatgccagccaccgccatctccgctcatgctgtccccaggcggactgagcggatctgccactcccgtggcatcgtggtagatccgcttggtatgaggccaccgccacttgccattcctgaattgggtggatctgctgccctcgtaagtgccagcggtggatccgcttagtccgaggccgccactgctgctcccgtcgtccagtccactgctcatcgtcgcaactgcctagcctgagcctgaggctggaccgaagtgggagggagagaggggaggggggaagtaggggagatgagtgggaaatgggaagagaagagaggagagaaaaggggagaggagagataaaggggaggtggggaggccagacgcgctgagagaaataaagagtggacgaggggttgttgccgaactgcacacggaggagagaaactcttgcttgtgaaaatccatttttgtagcgggacctcttaagcgaaaataggctatttacgaaaattgatttttgcaggcgggccttaaccaaaccgaacatcacccaaatatttttacatagatgtttctttagcttgtctaagataaaataagggatgcggcgtgtagtagtgagtcaagatgaccggttggtagacaggctgaggcacatattggtggcccaacgtatacatgctactagtgtgatatcgtcggaaaagaaggatttcatgttggttgtcctagccaaagcatggtcaacccgtcgccgaagcctccatggctgatgagaacatcacctcctttcaatacgcatgaggctaagagatggagacccacctcgttatctaggagcaggccgcattaaaatcgtctcctagcctcatttagactatgttttcaatgttctacatatgtatgaaaagctaacgagaacacctttccaatgggtctggtctcacgtcaagactccttataagtctatgggaatcatttaagcaagagagcgtccagaatctgcccaggtgctgcgtcaccgtctttaggctcattgggccgagtatcgtgtcggagtccattagggacgtatccagggggttctaggtcgatcctagaacctatttaatcaatagccgtcattgaattagggttaggttttgctttgattatatattctgtcattgtagtttcgctgctaaatcgtttcatggaatcctaacttgtgagattcatcttaaattcgcaatatattcagattgcatcttctactctcttacctatgttcttgattcgcttgcaagagatagtcttattggcgaggtcaacagttgtttgactcgggtgataaccaatggaggggtggtgtgctaattgcgagtggttcggtcatcctgattgaagccttttaatcattaacgtcgagtttccacaatcgatttattagcggaagatcgggaccctaatcctcatcaatggcttaatgggtagcagcctggctgacacaaaaaatatgagatatgtgtggacggcctgtgatgtaagatgtttacaatgaatttgacacctttatagagagtttaaatttgaaaacataatattatatcctttctaactttgatcatatttttagcaaaattatttagagataaaaacgagtgtaagagtatcaacaggttttattctaccacgcggtaggcccgtctaaatatacttggccaaaaggcccgcaacccgatggtatggttcacggcacgaagatttggcccgacctaggcacgacacgacccgactgttatctggctcgtgccagcccaacccgaccaatgggtcatgcctgggcctcttcctcggcatgataggccggcccggcacggtccagcccaacgattagggaggcaaaatatacttattacagccatgtaaggcacgactcaaagaaataagggacgcaaagtgcacttatttccaaccatataaaacacggcccaagagatgagggaggtaaaatagacttattctaaggcgagcacgatgagctgcttgtgcattcataccagcacggtacgacccgcgccttattgggtcatgtctaggctgcatttatagcctgtgggctgacccggcacgacataaaaagtatgccgggccgtgccagcaaccagcccgacatgctttgagccgtgccctaaagtatgccgggccgtgccctagatggggctgtgatcggaaacgatttggtatcgtgagatactgatacctcgagatactttttattgaactgaagcaaacctcgtacaaataatttcagattccgtggcctgtgcagcatgagaaaatcaaataaaacttaccgggagatcgtcccgccattgtcgacgaaagaatcaccatcgctagcagcagcagaatctggagcaagaaacttgtcgtgttcatcttaattaattatagctagctaatttaatttgtctaggaaatttgttgtgattcagctttcagaataacgaagcacaagtgcaggacaaagtcgattagaggaatttttgaagtccagggcatcgacagagatgggcaaaaccacaacatgctgcagttcagtgccattgtgccaataccagggatgtttcgagtcacttgtttatatgatggatgtatttttcagccggccaaactcagggtcaactggtggattctttggctttaatttgtggcgttcgttttccgtgcactaattaaacagttacggcgacttggcagcttaactattttcttcgttgtcattctaaaaaagggcatgtaatagtcggcgactaactgtactactactcccttcaacccaaatatttagagtgattataccgtacttaataaggtatcaagagtttcccccgtaatatttggtaactccggtattaacaggtactatcaaatttatactaaaaatttttatacatctcactactacataaagatttttctgtacgaaaagccctatctttcacacatcttttatgaaactttaggacatatcgggcagaaaaatctatatcaattattttgtactaatgagcactataaatataagggatttcttctataaacatagaagtagtaaacaaccaaacgtacgaagaatgccaatgatcacatacggggagtagacaactaaacatatgacgggtggcctaataactatccatctaagtgatatatataccacatagtgaatttttgactgacctgtgtactgaatcaagagcgcgttgcattgtggtggattatgactctacgctgacaatgacatcaacctgccacttcaaaatgcctctaaaagttgctttatggaaacagtcaaagtatatgagctgaacacacccacagtttacagagaaattttagtccaaacaaacaaagttgtgtcgtcactggtgaccaatataaccagggattgattctcttctgcatcatttggctgtctatacttgtgaatctggcggcggcgggaactgcggttggcccatcgcgaccccggccagcggcggctgcttggccggcgcctcgtcggcctgcctgcggagcatgacgtaggacgtgatcccggaagccgtggcagcgagtgccagcacggccgcgccagcaaagattccgtccttgacgacgtagcagtcgttgttcaccaccgcgcccatcccgaacagaaaccacgcgatccccgccgctatcctgcatatccgctcccacgcacgctcgatcagtttcggcatgaatcacggttcgtcgagtataaccacaccgtaccggcggtgatatcggcggtgactaaccatgacatgacagcgcagatgacgccgattatccgcttggtctccgacgggatggaccgggacttgcagcagccgcagcagccgccgacggccgacacggtgatctgcgctaacagcaggaagacggccgcgcagacccccagcgcggtcgcggggttctccgggtacaggcacttgccgccgaccagtatatcggtcacctgcaacaacatcgttggccgtcgtcatacacactgataccactactcgcgcatgcaccgcagcaagctcatttttgcacatgttgtacaaggaaagacatcggtagtgtgcttacagtgatctttgtgccctcggcggagaaccccaggatggcgctcagcaaccccagggacccgacaaccgcggagacgatgatcgtcgtcttgtccattttcccggccattcttctcccaagtcttcccaagccttgccttgtgtgcgtgactgcgtcggtctttataaacagcgaacgagctgccccacttctacgatgtcaccagatttacgccagcacgcgattgggaggaagctggtaacgaaacaggcttgcttaggcaaaagttggcaggggctgttgacagatgcgggtgtctttgtttacatcgagcatgcagccggcacggtaacttgtatcgaccaatcaaattgctgtgctgtgcttacaatttacaaaacggtacgttctattgttattcccaagaaaagcgatgttcacgaattcacaagccgacaatcggttttagcatcggaagagaattctcacagtaggagagctaagtgtgtatatcagggaaaactctattcatccaaaagatattccctcatttttacatgtcacttaaaagttatcaatttttttttaaaaaatagtatgatagattaatatgtgacatgtcacttcataaacatgcatatttaaattcaacttatacaagtagaaacaaaaataataaatttgactacgaataaaacacgtaattcatggtcatatttgttatttttgtttcgaattgtataagtcgaattttaacttgcatgtttgtgaaattgatatatcttcataattttttaaaattttttgattacttttttaatgctatgcacaaaacaaccggatgtcggacaaaaaatccacttccgcatatcggctcaaataatgggatggtttcacgttactcggcccagccgaagcatagttgggccctgtcgagccaccacaatatggactttgtttcggcccactaaacgaacattactttgtttcggatggttcattcctcatgattgatatcggacggtgcaaaagaattgtggtgatgtggaagtgtaggaaagcaggaaaataccattaaattacactaagtggggatgatttgtatagatttataggattacttgctaatctatgtgatttgtcttagcttttaatttcactaagtggcgatgatttgtataggtttataggattacttgctaatctatgtgatttgtcttagcttttaatttaggtgtgatcatcttcttagaggaggggtttatagattcacaaccccagatttactcaaaacacatactccgtaatcgtcgataggttttaattaagaccttaccaaattttaatggtgttaggtgagtggaaggttttaaatctatcaaaattttttggtagagatcgataaggttccatcttttctaatttatttacatactaaatttgaataatggtaattgttgatgggagcaagtactacttcaaagtgataattatttaagataaagtttaaatcgtactagaaaacaactattttaggatgatgaaagtacatgccaaatgcgttgtacgagaaacgcaacatcacaaatcacaaaccagctcgtaaaatgggtgtgtttagttcacactaaaattgaaagtttggttgaaattgaaacgatgtgacggaaaagttggaagtttgtgtatgtagtaaagtttagatgtggtggaaaagttaaaagtttgaaaaaaaagtttagaactaaactcggccatagtcacttaatttccaaacttaagaaagctagcatgtactactacacagtacgtgcatgtatctcatatacacagaaagcacgacacaaactttatgactacaccctttggttcgagtcacagggtgacaccatgacatatatactgaggtcacggtactacacctgtgcgcatgggaaacgttgctggttcggcgcctgccatccataatagccttgagcagaagcaggtgccgcgaattgctggttcggtgcttgcccgtaccacccaccttgtggcggcaaagtagccggatgagcgaacggcagctggttcggcggcggcgcttgactggcaccgattccctgagccggcacaggaaccagaagaggattaggatacaccggctggaacgcgatgaccatcgggaccacgatcgcggcgtgggctcatcatcatcgtactccggctctggcctcgtgcggagcatgaggtacgtaggaggtgaccccgagcaccatggagatgaggaccagcgtagacgccctcgtggatcttgtcgcaatccgaatcctcgaccgcggcgtgcaggagcaacacaaacacaatcaccggcactatcctgcacgcaacgcaaaaaacgcggcgcttgccgtgtatgcatgtgacgtagcaacgatgcatcccatgatcgatcagagcgcgtgtgacgatgggtcactcaccatgaggtgatggcgcagacgacctgcaccgtctcggagaggatgcagcagctgcggcagccatggcgacgtgtgttatcattaggaagatgaccgcgcagatgcccagcttgaccgctgctgatctcgacgagccgtggtcaacttaacactgatcactactaaaaaataatttttagcaacgttggtcttttatttttccagacgggtatgaccattagagccaaatagccgcctacaaaaatacaaatcagagtgaaacctgctgcctgcccgcgaaaatccattttcgcaaacggaccacttaaacggtccgcctgcaaaaatacatttcatttatgcaagcggatctcttatgtggtccacctgcgaaaatacatagcgaatataaatagaggctacataccctagattttttctaagtcctctttctctcgcctctctcccggacctctcccctcccctaacctctcctcctctccccggcgctgacggcagcgtagggtgcacggcggctaccgttgaaagcggcggcggaaggcggtggacggcggccggcggcgctcccctcccttgctccctcccagatctggcctgaggggggcggggggagggcggtggccacgcgtgcggcggcggcggaaggcaacggctaccggtggaggcggcggcgaaggccggcagctaccggcgggaggcggaaggtggtggcgggcagtggcgaaggtggccggcagcggctctcggtccctccctccctcccagatctggcctgaggggggtggggaaagggcggtggccggcgatgctcccctccctcgctccctcccagatttggcctgagagggggcgggaggagggcggtggccacgcgtgcggcggcggcggcagcgggaggttggcggcggcgggaggaagggggccatgacgatgtcagtagaggaggaaccgatggcctggtcagcgcgcaaggagaggagcagccggccaagaggagcaaacggccaagaggagcggcggcggctctgggcaccaacttccttccccccagacgccggcggcggaggagaagccgacagtggcggcagcgcagacagcaccggccgctccactcccaaagctggacggaagaggggaaccggccgacagtggcaaaggcagcgctcccctcgctctcgggcagcggcaccggacggaggtggagagccgtcggtcggagggggatgccggcgccggcggcgtcgccagcgggtagcaccggatttttttttgttcccctgctttatttttgcaggcgggccacggacccgcctacgaaaatcacctattttcacagacgatgggatagcggtggatgactcccccgcctacgaaaaccgttttttgccgcctgtgaaaactatttttctagtagtggatgccgccggtgtccagaaacatcacgaacgcgatcaccaccgcaatcctgtactatcacgcagtatggtgcacacacatacgtggcggagtggcgggcgagcggcggctcctggcgcagagagaagataaaaccgaaagggaagaagagaaaaaagagtagagaagaagattgctgactaggattgtttactccatatttttttttcttacttacatgtgggctctacatatttttttattttttctgattaggatgccacgtcagcgaaaccatgcatctatactacttggaacttttttttgacggttttatatagttaagggatacacatttctggtattgcagttaggagatctcagacagactcggcgtacaattgggggaccttaggtgaacttattcctttattctaccacgcgattgaaccatgtaaatatagttgtccaaaaaaggcccgcagcccgatggtatggcccacggcacaaagatttggcctggtctaggcacgacacgaccctgtcaggctcgtgccggcctgactcaaccaatgggttgtgcttgggcctctttctcggcacgacaggcttgcccagcacggcccaacccaacgagtagggaggcaaaacagatttattccagttatataaggtacgactcaaagaaataagggacacaaaatgcacttattttcaaccatataaacacggcccaaaaagatgagtgaagcaaaatagacttattctaaggcgagcacgatgggctaatcgtggtttcgtatcggcacgatacgacccgcaccttattgggttgtgtctgggctgcatttatagcctgtgggttgacccggcacgacacgaagagtatatcggccgtgccagcccgacatgctttgggccgtgccctagatgtgcctgggctgaggtcgtgctgggtggcccatttggctgtctatacatgtgaagcctgcggcggcaggaactgcggttggcccatcgcgaccccggccagcggcggcttcttggccggcgcctcgtcggcttgcgttcggagcatgacgtaggacgtgatcccgaacgccgtggcagcgagggccagcacggccgcgccagcaaagattccgcgcttgacgacgtagcagtccggcatggttgcccccttgccctctatgttcaccaccgcgcccaccccgaacagaaaccacgcgatcccgctatcctgcatatccgctcccacgcacgctcgatcagtttcggcatgaatcacggttcgccgagtataaccacaccgtacctgcggtgatatcggtggtgactaaccatgacatgacggcgcagacgacgccgatgatccgcttggtctccgacgggatggaccggccggacatgcagcagccgcagcagccgccgacggccgacacggtgatctgcactaacagcaggaagacggccgcgcagacccccagctcggctgcggggttctgcgggtacaggcactcgccgcgcgcgccgaccagtacatcggtcgcctgcaacaacatcgtttgccgtcgtcatacaccgataccactactcgcgcatgcaccgcagcaagctcattttcgcacatgttgtacaaggaaagacatcggtagtgtgcttacagtgatctttgtaacctcggcggagaaccccaggatggcgctcagcaaccccagggacccgacaaccgcggaggcgatgatcgtcgtcttgtccattttccccgccattcttctcccaagtcttcccaaggcttgccgtgtgtgcgtcactgcgtcggtcttcattaacagcgaatgagctgccgcactactactactgtcaccccatttacgaaaactagctgggtggcccgcgcaattacgcggctagcatctatataaaattatatattttttaagtatgattttacttaaaatttattaaatagttatctcgttgtcttaagattttgaaaaaccaaatcttatcatcgtcgtgtttctaattttgtagtttttaaaagacacatcagttgatacctcttacttatgtcatattattttttattagcttgctctatctatcgctgtttctatttattctccttggaacttttaaaaattggatctaaaaactattagagttcattttcctgttgggcttatttttaataatttctagaagtcccgtcaaacgctgctattatactcctctacaaccgtccactgcatcttctctttattatcattgctattttaaaaattaaacataagtatcgtttaggttcattttttttactttctagaagtttcgccaaaacgtcaacgctttgtcactgtactcctctacggctcgtccgctgtcgtccttctttattgtcattgagattttaaaatcaaacataattatcattggggattattttttttttaccttttagaagcccgtacctttaaaaattgaaccttatagtttttaaagttttgttgtctcgttgggttttatgtttttttataatttttagaaatcccatcaaacactaccatatactcctctacgacccgtccgccgcataatctttattgtcattgggattgtaaaaattaaacataactatcgttgaaattcattttttactttctataagaccgaccaaccatcagcggctctaccattgcactcctatacgacccgtccgttgcctctcatttttattgtaattgagattttaaaaatcaaatataattatcattgaagtttattttttttactttttagaagtcccgccaaccgccttgactgattacttcacgacatgcctgtcgtatttccttttaatcgtcaataggattctatttggtgttttattagtagtttttagatgtctcatcaaccgccaccactctcctcctctataggtatgttacttaattaatctcatcatgtgttttagatggtcttttcttttaatagtcttatttttttatcaccaatttcagttatttataaattgtattcctagttgaaatctttttttcctaatttcagaatttattttatttattattatgttcttttgattttttattttttattttcaattcagttgtttcaaaattatattcctatttttattccgaatattatttaatctactattgggttcttatatgtatttttatttcaatattgcttatatttaattcctaatttaagttaattttgaattgtattcctacgtgaactcttattttcttttcttttttctaatttcgattttttatttttttattacgaattttaattaatctcgtattggattcttatatggactcttctttcaatattccttatttttaattccgaattttaattatttataaattttattcctactcgaactcttcttttttctttttctaattttgaaatttattctattattatttcgaattttaattaggttcctatatggactcctctttccatattgcatatttttaattccgaatttcagctatttttagattgtatttctatttggactcttttttttctttttctccaattaatgtggaaatttctagcccccaagcgaacgtggtggctcctttcaaggctgttttaataatataacatagattgtttaagccggacgttcggcacttggaaaaaaaatcggctcaccatcccatctactccactcgttctctttcaactccaccagccacatgctagccttatctcttcaacttcccaatttttctctctctagctctccctaacttcctacctagcttatctctctctgcacaacctcaccagcgacggagaaggtacgatgacgacctcaccggcgctggcatgccccacaactagcttcgaggctacggaggaggtgcgaccactagtacaataatgatttttccgtgtggtcggaatcagttttctcatgcggatcttccaatggtctagaacgaggtatctgcgaaaatcatgattttcacgtgtgggcgcccgcacgggaaaataaaaaaatcaaaaccggaacactaatccagctaacgccgccgccaccaccgtcgtcgtcaccgccttgcccgaggcctgcagccgtcaccattgtcgtcgtcaccgccttgcccgacgcccgccgccgtcaccaccgccgttgtcgctgtcaccaccgccgtcgtcgccgcattgcccgaggcccgccgccgtcgtccccgtggtcgtcgacgatgaatccgacctcgccgcggtggcaggcgacggatctggcctccccacagtggtcggtgatagatccgctctgccgccaccaccctaggcaggggtggatctatagttatagggttggtgtcaggcgacaccgacgactttcggcaaaatctatagcgaaactgcttattcatatactataacaccatgatctaagtataattagcatactatggcactgatagacgcgttctgacaccaacgaatcgattttctggatccgctactgaccttaagcgatgccgatgctgataccaccgctgatgctgccgccgccatcgatgccgctgcctccgccgctctaaccgctctaaccgatgccgccgcctccgccgccatagccgaggccgatgccgtgacgccgtcgccggtgtttgatggtattttggtgatatgcaaggattactcgtatttgccaaagtaagcaaacaatgtgaaagttatatgcactagtggagctggctctagcttgtcattctgtacgtgatgcatggccatgcaaatacatgcacaggcagaagcatacaccatgccctatatatacttggttaattagtatgtatatgcgcgcacgtgtataaactaaaggaaatcaagagctagtcatatcccatatgataattggctggtgaagcaattacgtgcatgcatgcatagcaatgcacaaacatattatatatatggtcctcaattaatggccaggtgacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagttccggttggtagcaccaactgggactaaagatcttaactttagtcccggttggtaataccaaccgggactaaagatcccggtgatctttagctccggttggtgctactaaccgagactaaagatcttaactttagtcccggttggtaataccaaccgggactaatgatcccggtaatctttagccccggttggtgctaccaaccgggactaaagtcccacccctatatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacgggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcagaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattctgctaaggtgatgtggtatttccctataatacccggctaaggcgtttgttcaggacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaatagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttatatacatgggtcatcgtcgattccttgcagcaaaccacccggtacggaagaaaggcaagcacttcgaacataaggccgaccaccgtacgaagcctaaacatcgcagcgggaaaacaatgtttggtatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaagacagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcttcgatccggatagattagaagcccttcagaatgaagtggtgcaatgtctcgtcagttttgagttgatatttccaccttcatttttcaatataatgacacatctgctttgtcaccttgtgaaagagatccgtattctcgggcctatgtacctacacaacatgttttctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcttctcaaggttcctctgttccggtgccaatgggttagattgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttgatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatatatatatatattggaatttttattaattataagtcatatatttgcttattacgatttatccacttaatttattacagacaaaaattatttttcgaagtaattgtcatcaatctttgtactttaaataatgttaatgcattaacttctattttataaacacatatgtatgcgaaaatcatatgcagggctataatcttttgtcccgggtcttaaccctaaccgggtttaaaaataatttccaaatagcgggaaaagatatttactcccggttgttgagaacaaccgggagtaaagatccctgggttactaccggccgggggcgaccacggggtcttaagcaacactgcaaagtataggggcggtcgatctctttaagcctgagttactagacgacgctgactaggggaaaaacgcgcgctgacgcccgcgtatttcgccgaagtgtggagcgtggggtgctggccgacggcttcggcttcttcggtgccgacggatttttggagtgagaggccgcggatctcccttcatgcatgttgaactctcccatctaaatctctatcggccgtcgtcaacaccgggggctttgaacgccgacagatttggacggcgggcaatggcatcagcgtatggcaaacgcaacgccgccgacggcggtggcacgcctgcgctcgctttcgcgacgagcgcgccatggccgcggcggcacggccagccgcacccg

SEQ ID NO: 69609 - DNA, 572 bp, Oryza sativa
actctagaggatcccctgcctaaacttatcccgcggtcgctcgtccctaaaccaaaaaagggtaaaacactgctagatagaaaacaaaaagaaaagaataaacgtgagaccaaatgggctgggaaaaagaaaatttttcaatgggcccataggacggaagaattcttaatgggccgaggcctgagaagaatccgcttctggaagtctcgaggcctctctctctctctctctctctctctctctctctcttctcccccgagttgccgttcaacttccacctcttctctctctctctctctccacacgcgcagctttttgcttctgcaattctctctcctcccaaatcgcgagctcgtcggaagctagggcctaccgctccgatcagatcgccgcgccgccgctgctccaagtatggatggatggttccgttccttcacgagatcgtacgtgcgaatccccccccccctcctgttgctgttagtgttggggtatactcgtgttccgcggcagttttggatcgcgttgctggtagccctctcgatcgtgttagctagtttaaggttgctagattt

SEQ ID NO: 69610 - DNA, 1457 bp, Oryza sativa
tctcctctgagagcgtcttcaattggtcgaacaccctgcgtgcggcacggatgctgcgcccgactccacatatctccctcaccgcaagcagccgggccccagccgccgcggcgatggcggcggacacgtcctccacgccgccgaaatccagcggagcaggcagcagcgcggccgccgcagtctgttcgagcagccgctcgctctcctcccggctccgcccgacgggcacccgcccctctccgcaggcggcgcgccccgcggcggtggaggcgaacccggccagccgcgcgcacacgccgccccattccagggcggcctccgtctctacccgcatctgcttcgcctccggagtctccgccgcgacaggcgacgttagggcctgggaggcggcggcggcggcggcggcggccctgaagcgtggcggcgaagaccgtgcgctgcatacgaggccggtgggaagagaaaccctagaagaggggatagccacggagacttgggaaggaaaagggaaaaaggggggggtttttttggggggggggggcttcgcggcggcggcggcggcggcggccgccatggctgtgcccgtgggagaggcgggagagctcggcttggcttcccgccggaaagttcgccttatcctggtttgtccccatcgaataccgctttagtgtggacttgacgtattcttcttacgctttcatgttgctgcctccctattattattattatattattaagatagctttggaagaaaacaccgtgttcgccatcaaggatacaaattcctactttaatagaaaaaaaaagagagaaaaaaaatctaaaatattagatcatgatgagcctatattataacggttgaggttgattggatacctataagtattaaggttagacaaaatatagagagaaattaattctactcaaacttggtaaaaaaaattgctaccctaaaaaaaatagaaatcatgttggaatcatatccggacaccattcggacatgtctcacacctcactaccacgtactccatgtttttttagagtacatgtttttcttaataatactataaaaaaatatttatgcattgtaacgggtgaatgttattataatcttattattgttatataatttagttaagatgaaattcaatgtggaaattcacttgggtatatactttttagaaaatcataagctgcaattaagagcctgatcatctcaagttagcatgcgagttttttaaaaatatatcttatacgactccttccgtatttccaaaagcgaacctaaaacctggctcaaatatagatttgtatttttaaaatcaaacggatttaaaaccgactcatacattgtatgaataacgtatcaagatacactatacgcagcatcaacatatggcctcatatgtatagttatacatgtctatgaataaatatatatggtgggttgagaatat

SEQ ID NO: 69611 - DNA, 620 bp, Oryza sativa
tcagttaatccctcccacaagggaattgaaggggtgtggaattaatcccctccaattccctccgtcatggggattaaccaaacaagccctagaggagaaggttatacctatgggaactgatcaacagatgcaatgaataagtttagcatatctccttgatcagcagcatctttgttaagacaagacacaagtgtcgcagcattagccaggacagtacatgatgaagccgtatttattagccttctcaacaaaggagagtgcacagttctatgctgagaagacatggtgtctgtatcctcaagaacaagcttgtgcagttgctttccagccgtcaggatagcttggacgaccccaacaaactacaatacaaaactataggcaatcaggcgtcaagaacagaatgcaccagtcaactattggcataagaaccaagccataatttttcagcagcataacatttactccctccgggttgataatacttgttggtttggtcttttggacaagggcacggtctccaaaaaacaactttgaccattatttttcattataatatgtataaaaatgttaacaaatatatgattttattaaaggactttttaagacttatctatacatgt

SEQ ID NO: 69612 - DNA, 2943 bp, Oryza sativa
acacccaggccatcttctcatggccatccgaattccacaaatcttggggaagtacatattagccgtaacatacttagcctctgaaattagttctgcaatgtcagaaaacaggttcaacttactgcagacctcttttgctaatttccagtcatcatcatcaggagcacaaatatactgttcctctatttgccttaagtgatcaaagacttgcttgtagcttatggcaacatttaacatggataaggtagagtaccatctattattacaatcaagagtcaacttcttgtcgagattaacattcaaaccacgagcaacatcagcaaacactacatctctttcagttgttgctgccaaaaatcaacactggcgcggatcctatcaacagcacctcccatcacacccaggcaactattggcaattctacttagcacataggcgcagcatcttatgttcagcaaagacccacctaacaaaagttgttcggtatccagcctttgctttaagagccccgtaaccgtatcatctgtagaacaatcatcagccatcaccattgataccctccttccaagattccattcgttcaaacaagaagacagagtttcagaaattgcttgagctgtatgcgggcatggcacatgtataaagctgcatgtggcaatcaaagcacaataagtttttacattaaaatagtctgaatagaactttggaccgagaaaactgcaactatatttgaaaatatacatacacacatctatgcgctcgaaaaataatgaaaaaggaacacacctcagtagacggcactggaatgtccaggattggtcgataaaatgagctctgacagccacataacctctattttgatcatctgatgtccatatatctgctggtattgcaatccgacctttagcctcccacaaaatttccctggttctgaccctctccgtctcataaatgctgataacatccttcttaagactactgttgggaaccagctggaacaatggttgaagagccctaacaaacctttggaaaccgtaatgctccataatagacaaaggatattcatgcaagataatcattctcgcaagctccatcctggcaacatcctggctaaaggtggagctttctaaagaagcaacagtgggttcctgatcaatatcctttgtacatttggagggagttggcttgctgactttattactcctgcgacgaggacatttgctgagatgatcgtgcaaatgtttggtgccattcttagtgtcccctccgagcctcttatggcaccataggcactcggctttccacttgctgacgattttcttcctcttgaattctttccacacactcgatgtcagctttctcttactaacatattcttcttcaacagcatgactggaatcaggagcagcagttgagtttttggcagctccaagacccagagggatgtcatctttcataaccaactctgaattctgcaaagtagaacaggcaacaggggtagtgagaaacaaatggcagtagaaagatgataattctccctggattttctttttcacttgggctaatttctcatctctatctctactattataaaaattcaagatgtttttgcggtactttggtacgtcatccgtgtatgagtcggtttttaagttcgtttgcttttggaaatacatattcgtatttgaataggtttttaagttcgttcgcttttggaaatacagaaggagtcgtataagaaatccttttttttaaaaaaatcgcatgctaacttacacggttggactcctaactacagctcatgatttttgtaaaatacatatattcaagcgaatttctacagtgaatttcacctgacttaaaacatataataataataagattaaaatagtcttttcccgttgcaacgcacgggcattttttctagtcatcccttaattgaaaaactagatacaactcatagctcacactctcaaaacaggataaatcttgtccccgtttgacatggttttgagcagcataggaggtgaggtccacttgtcattgaggataaatggtgggcccacacgacaaacgatgatcaagcaggtcccatctccagtttgggtaaaacccctgttaaacaggttggaggtacatgtttttacccggtttcaagagttaagggactgatcatatatgtatattacgcctagtctaaaaggaaggagaaacataaattttcttataatcttattgagcaattgagcaaagctgatgaattttctactagctgtatcgaactagaatgaatacagggaggcgcgagaattcagaatgtgtaggggcggagaggaggagggaccttggacttggagttggagcgagcaagatagtcttggatggacttcattgttgaaaccctagctagctacatgcctctgccgccgcccatcaaacggacagaaagggagcgccgtagctagggggttggatctggccggaggagcgtcggcgtcggtcgatgggcgcggggcggcggcggcggcggcggcaagggaggccgggagggagggagaagcttcggtgcggtgcggtgcggatgaacaactcgatccggtcagttcagtgcaggtggggcggaatgggttgggctgcccggcccaccatgtaagcccataaaccgcattccggccctgtgctgtgtccctttcttttctctttatctttatctttatctttatccttaccaatctaatctaacctaacctatttaaaaaatacttaatttttcgccgcgctttcctccgcaggttcacaattccgacgaaaaccggtcgaattctatgaaatttcgacgtttcgacacggctcggaattaagtttcgattagaatttcaaaggttaaataatagatttggtcaaaatttatcgaaaaccgatcgaaatttatagaaaaccgtg

SEQ ID NO: 69613 - DNA, 2063 bp, Oryza sativa
  unsure (1)..(2063): unsure at all n locations
gttctttgaatgtttcacaataaagaaattttaccatataataaaaatagaaccccatatttagaaacacgtgatgccccgttttgacagtaatggatccccccaaatccactcacctccaacagttggttccccatctccatcatctgtggggagagagcccgagaaatttagggttgagaggtgagtggcgacggaaggaatccacaagttgcaagggtgtggaggcgaaggagtggcctcgattggggatcggaggtggtgaatctcggtggagaggcacaatccaaggcgataagcgtcgatttgcaagggtggttcgtgggcgaatggcgaatcaagggcatccaggcggagggtggcgtcggcgtccaccgtggtgagaaaggtcgccctcccgcagtggcgcaccaggggggctcctcgcaagctgggagtgagcaatccaccaaggctggaggtggagagatgaggggccagatgaacaaaggggggaagctgcagcaatatcgtccagttcagaaggagaagaatcaatctgaagagaagattgcgacatctgcagtgactcctcagactgcaacccagcaaccaactccaccacccaattctcgcattggtatgcaaactaacccacagagaattttctgccacagatgcaaaggttttggccacatggctagggattgtagcaatgttgtcttctgtataaattgtgccaaacccacacataggacagaggattgcatctatgacaagcagccgaggcctatggcaaagctagtagggtatggtgctccaggtttaggttgcatcttaattcaaaacactaagcctgacccacctaaggagcataataatcctctggctatgatctctactgtctttggtggagaattgacagaagctcaacttgagcaaggtttcacgcaacaatttaagtggaattgggtttggaaagctaaagcaatgcctaatggaagctttcagatgagatttcgtaacaagataaagtttgatgagcttgcaaactttgattatttcaatgtcaagggcactgatgtgcaagttaatgtgaaagaatggacccagaaatctgaagcagttggaagttgcatattgtctgggtcaaaatcactggaattcctgagnaaatgaagggttaccaagctttgtatgaaattgggtcaaatctagggcttgtcttgnaggttgatatggctactttcagagctagcaatgtgatcagggcaaaagtggaatgatggagctgggtgttctgcctttgaaactagtgttaacttctcccaagggacttttgttccaagctcatttcagtctagaggaggtggtggaactggggtggtttagtgatcagctagatgacacttttgagaaaattgagatacaagaaaatactctggagggtagcagtcagagagagggtaagcaagttgtggtggtggatcccatgacagaagatcccatgtcagtaagacgggtaacgggctattgaagtttgtcagaagcaagtcctggtgccagaattgatgctgggagaacataagatcaaatgtgcacagatcttgagagacatggagttggcaatgcaactgcagaaaggagactgtattctgactcagtgctgtgaagaaggaaagaggttgggaaaaaggaaatgtcacaggagcaggttgatactctgcagcaaccgatgaatcaaaagttggctgaagaattagaaagctcttagacagatgttccaggggataaggagaatagagtcagttttgatatgggtttgaatcaagaagacaaggacaaagtagatccgggggacagtgaagattacatggattctcaggagtctaagggaagttttgctaagaggttggggattaatctaactgaagaagctcttggaagtcaagatgaagagatgaggagaagcaagagactgaaagacaaggaagataagaggtcccaagagatggcaatggaaaggaaagaagcacaaaatgctttcatcaataaaaattccctccttcatacatgaatcaaat

SEQ ID NO: 69614 - DNA, 1034 bp, Oryza sativa
ttgatttgaattcggttagaattcaaataaaaatccaaataaattcaaatgaaagtcgaatgcgaaagtcgattattcgcgaactaaggcaaacccaatttcgagttttaatatcctaaactattttgcgggtataaatattttgttgtcctaagtttttaatttaatctacccgagcattatatccatataataggttagaaatttctatcgcgagctaaatgtcggacgaaatcctagaaatattatacgatttaatttagtctatgactaaatgattaaatataacacatggctaaaatccctagtaattaaatccgaatttctaccgtgaattgattacttatagggattacccaaaaataatctataataatctataagaattcatctatttgtttagttattaattacatctaaattactaccgcgaattgatttcttatagaaattacaaagaataattaaattttgcaattctaggaccatgattattctatacttaaattctaattattttaaattttctaaactattatcccccctaattttcttcctaatttttctatttatttttcctttttctctttctccctttttttttcttttctcttcttttctttttctttcttttctctctctgctctccctctcggctctcttttcctctctctctctttctctctctcggctctcttttcctctctctctcggctctcttttctctccctctctttctcggctctatcctacccgagcggcggcggtggacgcaaggggaaaggagggcggctcaccggcggcggcagcggcgacgacggcggtggcgacggtggcgcacggcggcacagaagcggcgacacggtggcacaggaacggcacggcagcgcgggaacggcggcgcggcggcacgagagcgacggcgcggcggcacgggaacggcggctcggcggcacgggagcggcggcgcagtggagaggggagaggggaggaagggtgagatgggatgggggagaatggagaggggggggtat

SEQ ID NO: 69615 - DNA, 619 bp, Oryza sativa
aacacaaatttccaaagcgagatagacgatgattccaaaagagaaaaggtagaggagatcccgaagattgtttcctctcaattgatttcaccggaaacggaaaggatcggccgaatttggaaggagacggcggcggcttgcgctagggtttcgggcggcggcggccggaggtagactacgacctgacaagcgggcctcacctgtcagcgagcgagggcgcgcgcgcggctgcggcggactgggccgacttgggccggggagagagaaagagggttttgggccgactttcggcccaaagccaaaagagacttttaaaaacatttttctatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttacgatttttagggtgagacatctcctcaacggggattaggaaaccggcaagtttccgaacctttgtgaaaa

SEQ ID NO: 69616 - DNA, 555 bp, Oryza sativa
  unsure (1)..(555): unsure at all n locations
agtgagtatcggcatttttatanggcgaattcnagctcngtacccactagaagacgctgggaacctcttctcgtgcgggtcgcccaacggcagcgtcagtttttattggtgttgagggaccaacctaaaccgggcctcggtcttnncctgggtgatgtggtggatcgtgagggaaacatanacgaaacccggacacgtcctcccgtttggggagcanaggatgctccaggtgtggccggccaccttgaactttgaggactcgacgaagttgcccaccatccgtgcatgttagcgatccccgtgtaaccgtcgatcttgagcatatggcatccggtggtcgccgtggtgctgaccgtctacacggtgacatcctcctccgttggcaccatgagatccatggcacctgggtcgtcacaannnntnggtagggggaggntaggagaggaggggggtgagnccccagggggggatggggggtgggggnncntgaggnggagggggggggggggggggggggcggccggcctgggcttgtgnnnttttttgtttttcttc

SEQ ID NO: 69617 - DNA, 683 bp, Oryza sativa
atacaacaacaatagatatcataaataacatcacagagtttcacaaatggtacatgaatcatgatgcaatcgactgcatacatacgcagtccaaataaggttcatccaaaagatacaacgaactaatcatcaaactactcgtcaatctaggtaagggagggggtgtctcgcatattatccaaaaaccatctgatacgagatcgaagcttcaaggagtccgtcagtctagtcctccagccatccgcaggatcccggggcaggtagagggtggtcactggcacgcgcaaacctgagtccccacggctcagaggtagtggcccctggatctggcttgggcctcttgcccggaggtcgtgtgctcttgcgagcagtgctaagggtgcgagggcctccaaggaaggtgatgcggggaacaggggtctcatcctctaaaggatcagtgatgtctggctcgatctctggctcggtgtcggttccctctgtctcggagtcgacctggatcggagtctccaaactggaacccagctgtggagaaggtgtagggatcagtggagtgtgcaccaactccggaacaggtggctgtgccgctgtcgggtccactaggtagggcgttgactcggtagctagcatactagcctctcccagaagagcgtggaacgccggtgggtacggcggggtgagga

SEQ ID NO: 69618 - DNA, 775 bp, Oryza sativa
ttaaaaaaatttacacaaatatataaaatataaatcatgcttaaagtattttgagtgataaaacaactcacagcaaaataaattataattacgtattttttaaataagataaatgatcaaacatgtgataaaaggtcagcggcgtcatctattaaaaaacggaggtagtaataagctagtgctcaagtgctttttgataaaaaaaaatggtgcttttagattgcagattaataggaaactgaaatgtcattttctgtttgagagccttatctcaaagcgttatattttgatttcactagtcgaatcattcaccccttttaaatgtattttgtggtaaatcatgatattcattttgggtcattttgacagtatattagtataaccccttcatagagagataagatgttatacatcctaaatggacaatgaggtttatcttttttggataatatgtggctctcctggtcactgttttctacgaatgatgtttttgtttactgcaggatgatatagaagaaaaaataagttgtgctttctgcccttcgagagtagtagcatgcaacccatgtttggagtatataaaatctgttgtccttccttggtttgggaagtttgaggtcgttcagaaggaagggaatggtagcaacaagtactgttcttttaactcaactaaaatcttctgaaaatttcttctatctatttcttgtgagacatctattttgtaactcacgttggctaaagagttgtgtgctaaccaaatataagtactataagt

SEQ ID NO: 69619 - DNA, 551 bp, Oryza sativa
ttcaatgagacgcctactcatgtatctggagtagcagttgattcatgtctttagctgtgacatcgtactgtactcagtagatatgtcgaagtttcttatttggctgattttccagtacttgttgcttttcctttctgttggaaaaaatggtatcatgaaagtgtgggagtggaactagctcccaggtgctaaacaagttggcgttggtgaccaatgcacaccaattttctagacttggaactggagagttttaatggggattacactaaatctagactccatgggtatataatacagtctgggaaactgatggatctttcatctcggtttaattgtttttttcaagatgtgcctactttgcccgcatgttaaaagtctaattcatttcattgtcttagtgttatttttctgtgtccattttaattggtagactgccttgtgtgacagatgttgggtttgttcaaaggaagcctgggcgtggtgacactacattattaatgagttgttttgacaaaataactcgctggagtgttgttggaattcaaggtttg

SEQ ID NO: 69620 - DNA, 634 bp, Oryza sativa
tgcacatgacatttactacaacatttgtcatccaacccaataagtccagcagtcagaaagttaacaaacacacctcagcgcaactttgattatgatggggacgagctttaaggttcctcctggccgcatggtgcagaatgacttcaattaggtgcttgcgtgcactagatacggcatgcttaatctttatagattcttcaacctcttctctggtgcatggggagaaattgctgttgtagtactttgaatcaatgcatatacctgagatgattcttgatgtagctgccagaagcagagatatgaaaccaagcaacatcatttttacagcaaagtcagagcaaatcattagtccacgttgcacagcagtccaacaaaacaagctagcaaagagaaataaataacggaaggcctaacctctttcatcttctccattgctttgtggagtggatttcggtgggttttcttcaaccactgaacatgtacaagattactatgagttctatttcaacataacccgtgaccgaataatcgattaaaagaaaaggaagagaggctttcatataatgtacaataacttccacagaaaagaaaagctatcccttcattgcttattgttccaaaactttgaaagatg

SEQ ID NO: 69621 - DNA, 594 bp, Oryza sativa
agaaatttaagccatgtaagctacctattgggatcatatctggaaaagataaaagggaaaggaaagaactgtgcgccgcaagaatgagtagataaaattagggtttgaattgttcgatacatccttcagattcagaagcggcttatattcttacgccattacaagcacacacaaaaaatgacgtagcacagtacggcaacggacagctacagctactacttcgatcagtgtgatcccttggatcttcattaacttctcctgtgaaccggtatcgtgtaatatgggccgtccatctccttatctcctcttcttctcagaacttaacttcaactgaacaatttcttttcaaaactctgcattctcagttcctgtcacgcttgctatgggaggccatgcggtggaccggtggtgagcggcgcggcgcaggagacagagatggtgtggaagaagatgcaagaggagagacgagagatctaccttggggaagagccccattataaaggcacgtacgtacgtatacgctgccctgtatacgaagtacagtatgctacattacactgtacgtgagcttcttgaggcttatgaaatctactc

SEQ ID NO: 69622 - DNA, 527 bp, Oryza sativa
gacgagagcccatgattaggcgtccaattaccaaattctaagcccacaattgggaatatttttaccaaaatttctataaacgaaaagcgcaaggggccctcgacaaaatatcacccaagtcctcttctctcttctcttctccgccgccgcctccatccgcggcgcatcccatctcgccccggcgactcgtcggcgtcggcgtcggccatgggcggcgactggcagagcttgcccaggcgggggtaatcggcctcctcttcgccttcctcgtcgccaagctcatcttcacggtcatcgtcttcaaggaggacaacctccgaatcacccgctccacgccgacctccccctccgccgcggacacccccgccgccccggccccacctccggcctccctcgacggcggccatggggacaccagcgacggcagcggcagcgacagcgacagcgactgggagggcgtggagagcacggagctcgacgaggagttcagcgccgcctccgcgttcgtcgccgcctccgctgcgtct

SEQ ID NO: 69623 - DNA, 595 bp, Oryza sativa
taccctttggagagaaaccattggtagcatcatctctcttttcaacttttttcttgacataatcagttatcactcttaccctttcgagacacatgtacgttaaagcgatctttaccaattttaaataactgtgtgtatccataattgaaaccgaacattaaaagagaaacagaaaagctaatatttatcaaaacgtcggattgaacagagcagacatgtacagatgtaattaggccctatttctttcaacttaggattattataatctagattattgagagtaggctgaaagaaacaaacaacttattgaagtagcttattataatctagagcccagcttattataatctgataagctcatttaggtaagctttttccagattattgggtgaaaaattatccaccatgccaccccactccctatttagacttaaaaacccaataatctaggctctaataagctaggaaagaaacaactaaccgcttattctactatagattatagcaatctagcttatagtaatctaactcaataatctagattataataatcctaagctgaaagaaacagggccttacaagaacacgtatatac

SEQ ID NO: 69624 - DNA, 553 bp, Oryza sativa
agtccttttctaaacatattctatctatataagctatctactataaccaatcggatatacatgccatatgggtatgcggtacccataatctttccaatttcattctagctctgcccctgtctacaatgtgggtcttaaaagacccatagaggtccttatgatgaaccttatacattgtgagacttaaccatgaggcattgaatattaagattgaccttaagcttgtggctcacctttaggaataaaataattggataaataaactgcacacgtagcgagtgagagaataataacaaggctctgtcataaaaaacgtgccatttcttaaaaatggttggagaaaacaacggaagaaaaaataacttagtttataaaaacaagccgcttcgaaaaaaccatggaggaaaaaaaccggttataaaaataccggatcaaagaaactatcggactcaacgcgagaaaaaacccgcaacggtttgagaaaccgtccgacttagcgcgaaaaataaaaccgactgtttctttaaaaaaaaagttagagaaaaccatatga

SEQ ID NO: 69625 - DNA, 512 bp, Oryza sativa
tagtactccttccgtttcacaatgtaagactttttagcattgtccatatacatatagatgtaatgaatctaacacatacatatgtctagattcattatatgatgaatgtagacaatgctagaaagttttatattgtgaaacggaggaagtagtaacaataatcgtttacgacaaaaatacgcatgggcccactagtcagtgtcttcccagctccgcacagtggggaatacctctcgcaaggtgggccccaccaagcgcccatttcttaaccgacgaaacgggctcacgtgtctgaccatcgctcgcaatcgcaattcgcaagttggcatccaactccgtcccgtccctccctcccccccaacccgatgggaaacgcggccgccggcgattcggccgccgagctgctgctccgcgcggcggcgctggtgccgccggcgcactacgccctcgccgccctcctcctcgcctgcgccttactgtaccgcttcctcgagctccacctcatcggcgac

SEQ ID NO: 69626 - DNA, 561 bp, Oryza sativa
tgtgtacctttgtagatacatgccggatgtatctatgaaattagtagatcaatttaaaaaaccaatctatcaattaccttgtcacgtactcgttcgatatcatgcgatctgacatcttttggtacgtcgcgtatcttgaggcttggtcgatctcgagagatcgaattgttgatgacgatggttccgatctcgtcgggagatgtacttagacaggttggatctccccacagctaaagtcgtcgagtagcttgttgtcggagagtccatctcttaaacccatctcgtcgaaatcctgaagcaccaaaatccccctacctggtgcgccactgtcgacgtttgatgtcgcgattccagtatttgcatagtatggggatcgttggtgctagggtatacgcgagactgaggtaaaagagacggagacgatgatttttatacaggttcgggcccctgaattgtcagataataaccctacatcctgttggccgaagccgatattgctcttattcaccataatcacaccagtacaatatttggggtagcctatctaactgttgtcgacat

SEQ ID NO: 69627 - DNA, 594 bp, Oryza sativa
ttaagcacaaaatccttttcacgaagtggcacttttactagttctgaaccatgaaatgacacttttcctagttaagcaccaagtcctcttcatgacaccgctgcaagactttgtccaggttctccaagcattgatcaaaactctttctatagatggataagtcatccatgatgatttccatgatttcctcaatcatgtcggagaagatagacatcatacaccgttggaacgacacgggtgcattacacaaccgaacgacatccgctggtatgcgtacattccgtaaggacattgtaacatcctcaaattttaaaactaaaatttgactgcatcatgctggcttttgattaatttagtgtgttttaaaaatctatttattcctaagtggttcaagtattacttctttagaaccctactaatttaccctaattataccctttattccgaaccttactaaatttgagcaaattctctcaaatttcaatctttagattatttccttaatttaccctaatattagtaaggatttgctatactccaaaccatagtgaaacctttccaaattcatagtttaaattcaaatcttctcaagga

SEQ ID NO: 69628 - DNA, 624 bp, Oryza sativa
  unsure (1)..(624): unsure at all n locations
cgcacccgggcgccgacgccggccatcttccgcgccagctgcgcgaacgggctgatgtggccgaacgccaagaacgggaacgtgaccgcgtgcaggtctccgtctgcaccgccgccgccggccgncgtngccaccggcgccgcaccggcgcttcccatcgtcactcacgacgaacgtggattgcaatcgagggcagtgaacggagacggttggcgaggactttggcattggttctcgcgactttaaaagggagatggagctgttcggacacagtactgcggcttctgttcggacacaggactgactcgtgctcgctggtcctacctaaccgctcggacattnttgctgttcttttttttttacttactagcaaaaatgcccgtacattttgaaaggggggaaggaggagggnnnaagcgggggggggggggggggggnccccccggggggtgggggaattttggagaaanctnaannttaacctgctaagtgaggggctaanntttctaanaattttacaaccttcnnccnnagtacggggtngnnnnnnnnaaggagggggggggtggggcggggtannancnnntttataattttaatagaaanccaggagggagggaaaga

SEQ ID NO: 69629 - DNA, 670 bp, Oryza sativa
  unsure (1)..(670): unsure at all n locations
gctgtttnnttttttgagtcaccgatccactataggccgaatncgagctcggtacccagtgcgcagcataaataaactattttactactgttaggtgatatggcagtgtaaatagatatgtaccatatatctagaaaataggagtaagattgattctactacccattagagactgctaccaaaattgttaattttcttatatttctcatgtaaagcattcagacatattttcagtaatttatacggttcagtttctcttagggcgttcacagtgggaggatgtgtcgttcagccttggtgccgaaaaccgaatattcgacgacacgtcagccaaccgcggagccaaaactggtcacacgaacttcgctggaatcgaggtatgcggcacggggagaaaagcgggggcgcggcgttttggaagtcaatccctcgtcgctccgtggtttcncccncttncatnntttagtgtggnnnatggtgcgggaggggggtggaggnnnnnnagtggggcgggggggaaaaannnnnnnnnantagtntnnnttgagggagggagatggtcnnnncacncnnnnnncccnccccnnnnaaaggggnaaggaaaatgaggggggggggctttttctnnntctttctttcttttccttttttcttgtgggggagaaaaatt

SEQ ID NO: 69630 - DNA, 2339 bp, Oryza sativa
acttgtgtgtattcatgtgcagttctttggttgaatccttgtgttcctccggcgtgcgtgtttgttagaagtgtaaaaaggggattgaagtgtagatgtctgtaagatagaacaagatcttgtttcttgtatgttgggcttaaaaagttttgagcaagagaatgaatgaatggttgagggagccgtcggtctgaatgtggggttaaaatgatggagatggtgagctttgagcattattatggccagacagcaacagctatcaatcaatctgattctattgtatcttgggtagctactgactgtctgatgtggccaaccaaccggagtgaccatttgtccccgtgaaagaagtcaggtaccgtgctacagtagtactcattgcttaattaatgacgagtttagtttaatacaattagaaaaacctagtgcactcgtagtataatactcccaccatctacttttaatagtcatatttcatcttggcacacagaccaatgacaagcaattctacttatcatccatttaaacatgctaatggagagtcacgtattaaatctgagaaagtcattaagatgataatttgttggattgaaatatacctattaaaaataaattttccagatttagaaatatgacaaccaaaaaatagattgagagagtattctactactagtactagtacttactcatggaggataggagttgtgatgtggctaatttagggcaggagtacattattaatcagtagaagctgtagtagtacgccttacaaatagtagctgtcagtagcaatgtcagcatcattacattaatctgttgcttgtaggagtaaaagataatgttggatggatcggtttgtggtttgcttaattaattaattaaaggctggcctgcagctgcaggcaggcatcgaaacccaaccgcaacagacgagaaatcgccgccgctgcattggcagcgatcgattagaaaacaaaaccaaaaccaaaaccaacctcgcttgcctccttcccatgaccttgtctgccaattggtcgtatttggtgttaagttcgattagtagatagagtaatcaaaacaaaagagagattagcggcggccaaatggcacgtgccgtattctacgccgcgagtctagtactccgtactccgtattgcagtttgtatgggagtcggacacctgggctcagctgtcagtgacacactctccggttgagcagagctcgtcgtcgacggcgaccacggccaatcaatcacgtgcctttgacctgtttttggtctacacgtgagccatgtagtagctcatagagccacgtgtagagaattcttgtgttccagggcgtgacggcctccggaaccggaatggtcgtctcccttctctcttgggttacaatcgcatgctccctccgtttcaaaatatttgatatcgttaactttataacacatgtttaaccgttcgtcgtattaaaaaaaatatgaaatatctaaaattatatgtgtacataaaagtatatttaacaataaatcaaatgatatgaaaagaataaataagttaaattttttgaataagacgaatggtcaaatacgtacttacaaagtcaacgatatcaaacattttgaatacgtacttacaaagtcaacgatatcaaacattttgaaacggagggaggatgtactactcttgtcatttttttaacggaaaatagcacagtagggcctttccgttaagaaaaaaatacattcatgctgctgcctagtgaaaaatctgaaccgtactagtataaaaataccgaaattccaaatggagctgcgtattggccggcaagtggagtacagtagtaaatatcaagtcgatcgttggtacgcatgactaatcaacgtcgctacaaggtccgagaacagtcaaaacgtatactacaccacaaaaatattgagacgtacagtacaaatataattatacagcctccaaaatgttgctttaatccaggtgggaagagttgttggtgtgtcaggttgtccaatggaaactacagggaggctccaaattatgtacaggaacaggatgatatctgcatagtgtaaacattactaatactcagcgttttaaaagcttgattgagattagcgtgcaaaacacacgttgggagtgtacacaatacaggcaggcgtacaccagggcagtagtatagtagattaatggtagggagggaaggccctaggcagccagcaacgcgacaggctgagccagggtggagacagaccacccctgaccccacctcgtcagtcagatatcaccagcagcgctactcctccaatactcacagacggacagacagacaa

SEQ ID NO: 69631 - DNA, 1333 bp, Oryza sativa
tatgttaatatactactgtagttactaaaactcggtatttaatttgttttttttttatgtattgccatctgtaagaaggaggcaccatgcatcaaccgaaccggcaactactggagtaaaatggtagtaggacgtgcctgcgggaagcagtcgtggaagaagatgcggacgaggccggcggcgatgccgatgtcgcggcggagggcctcggtgacgtgccacctcacgatgccctccaccgacgggcacgacgtgtcatagaacccccaggagaggccggcgacgacgggttcgccggtggtcaccacggccgcgcaacgggcagcaaagaggcccgagatcagtagcacaaccatacccagcttggacgccattgctcaacactctagctaacaaagatcgatcactctcagctcgacctctgcctcctgcaaatggtccatctctccatgccctatatatatactggactggaccctatcttgtggaaaagtggaatataatgtatactcctactacgtgcatagtatgttggtctaggattgtggcttgattgctcaagccagcacattatcaagatgtcagtttgctgtttctaattaattgttatgtccaagcccgatctgatccacaggaggcaggcatatgcctacatcaaaggcagagatcaataattaatatatcaccacctaaccttgcagtatgttaactatattcaaagaaaaataaagctgactttttcacaaagataaagctgaccagctagactcatttcttttagttaccatcacatctttaatttgtgttgtacaataatactgcctctgttattttaaacctcacatttttgtattttcttgtggtttccagaatacgacttgggctaatccatttaataactttgcatcaagatcatacaaagattatatttgtatgaacagattttgtaacgaaaaatctaattatatcaattttataaatcaaattctaatagtttcaaacatgtcagtcgtcacactaataaaatatttttttcagcatggattctcggatcttaagactccagattgcaagaagaacgttgcagtgggccatgatgttgatcaattaattagcaagtggtctagtgtatgaaaagaaatccaattagcaagtggtgatggtgcaattaattgcgcttgatatctctatcttacggttgcacgcccccaccaattagacacctcccaattcccatttcttttctttccttctttttaaagcttcacgagccagttagtggtacaaactacaaagcagtccagagaggaaaaaaatcaatggaaaacaacca

SEQ ID NO: 69632 - DNA, 5942 bp, Oryza sativa
cgaaacactccacagatcgagggcttagaacctcacctagtgcccccggccgaaccggcaaaggggggcccgcgcggtctcccggtgaggagccccacgctccgtcagttcatcttattaaaaacttttgtgaaatgtgtcaaactatatgtatatataaaagtatatttaacaataaatcaaatgatagaaaaagaattaataattacttaattttttgaacaagatgaatggttaaacatttttaaaaaagtcaacggcgtcaaacattttggaatggggggagtaggaaacattaaaagtatcttccgcaacctaaaagatacaacaacacccttatctcctctctctgtacctagctgttgcgtagcctcgcgtagtggctatcaaatctgtcttagaacgcaccaattttggctcgtcaatgcaagggccacctttgcctacccatgatgatctattggaggtcactaggccctctccctatatctgggatttgtgcctcttccagctcctcacgtagcctagatatctacacctccgccatcggctagatctggttggtaaatcggttagatttgtgtctctttgcttggtattggtcactccatcggcagcattaattgcatgatgaacatgcttggaattggtcgctccgtcatctacattgtcaaggctagaagggaacacaataggcggagaaaagagggagggagggagtgtggacgtctgattttcttttcacttaatattagatactcgatggaaagcgttatgaaaagtacatattaataagagaaaagataaagtttacatgtaaatcgtgctcagaatgaattatagtggtagcaatggattaacatagttttgtaaaaaaaaaaggaattgcatttgtggaaaataacaagtgctttatatataaagagaaaaaaagatccaaacaaagtttttaaaatctgctttcatcctccgaagcaagcacttaatagtttaccttgcgcgctgattttatagtaaggtttgaaaaagtttccgtttaccctaggaagatatagttaggtccattgaattcggtggtgatcgagttaactaatttctttgtcctccctgagactcgccgtgcgcttgttgtggtctcctgctagcagctaataagcaccatggacctgtctctgatgacttaggcactgtctataaatacaccatcaccatccccacactcctcgctcgcctgcctctctgttcttaattagctagttacctccaaatcaatccaatctcaattcatatatatgcgatcgatcgatcgaacaagcaagtaatcgtcagtagtcctagctagagagacataaatatctagctcaattggctaattacgtgcccaactcaactgcaattcagttcatccgatccagcacagaaattagctataagtaagggccggcgccgccggcaagaagaagtaaagaatatgggggccggcgaggtggtgcaggggctgaagccggtggcggcgatggtggtggtgcaggtggtgttcgccggagtgaacatattctacaagctggcggtggtgtgcgacggcatggacatgcgcgtcctcgtcgcctaccgctacctcttcgcctccgccgtcctcgccccgctcgcctacttcgtcgagaggtccctccctaatataattccctcttctcttctcttctcttcttttcttgagactattattgatcgagttgtttgcattatacaatatatttctacaacttcttcaattcaaagataccagtatttctttattatttttcctaaaattaagtatctccctttctgtataacatcacttgaataattatttttttttgttttccttcacgaccgccccatgcatgaattgaatgaatgcaagttttattctgtggcgaaaattaattaaaccatcagccttttgctgcgaataaaaatcaatggcccagctcactcatcctagctttttctctgcctacatatatatgcatgttttattttaaataatttgtttattctgtggttagtcaattactgaaacaatagcatatatgcaatctgttaattttaggtatgtgtgtgcgtgatgcaggaagaacagaacaaagatgacgtggagagtgctgatgctgtcgttcgtctgcggactctccgggtaattgtttttattcaatcacgctgactgtactaaagtactaacatgcagttaattagctacatatatatagtactcctactagaatttcacttaactatatagcgatacccaattcatcgagataattaggcgttaattagctttcaatttgaatgcccatgctgcttaattagctactactccagctggctatatatactcgaggtcaatggaggctaagcatgtgtgtttttggtcggtgggcccgtccgtcacgaggtgcttgccgatgccggctgacaaaaacgtttggctgcctcaccaccatcctttactctacatatatagtacgttgcttatatattttctctgcataaaaaaaaaaagcaatcaagcatcgtctaaagcctaaagatagatggatggatggatggcgcacatgtacatgacagaagcggataaccacttagttattggacaacacaaattaaccacaagcttaattagctactacctccagtttgaagttcaaactaattttaccttgttaattaatgccatatatatgctaccacgtactactagcagtagcagctggtacgtaccttcctgtgtttgaaggtaagcgttaagtgtttgtgttgcacacgtcgatcggtcttcactttttccttgcttcttttgcactttagtttccactatcatatactgctaatggaaattccatccaacacactgcatgctttctttaattttgacccttaattgatctctaattaatcaaaaccattagaagtaacgtgacgttggcagcatatatatatatacagccacgcacgcagctgtgcacacatcgatgctgacgatggcgtacgccctagctaagttaactgactagtaggagtaggttgcacacttctaggaatgctaatccattcacccacgtacgcgcgcggtgtccgtacgtatgtacatacgtatcacacggacctcgatcgatctgatacgtatacgtacgtacgtgtataattagctacgtacatacctagtggaggaatacgtgtcaccgagcttcaattctcggtgtcagtgcctgctgacgtgtagttgaattaatttgtggtcgatctggtgtgcatgcatgctgacgtgtaaggtaattacgtacgtgcagggggtcgctggcgcagaacctgtacatctcggggatgaagctgacgtcggccaccttcgccaccgccatgaccaacctcatcccggccgtcaccttcgtcctcgccgtcctctgccgctacgagcgcctcgccatccgcaccgtcgccggccaggccaaggtcgccggcacgctgctcggggtcggcggcgccatgctgctcaccttgtacaagggcgccgagctcaacccctggcacacccacctcgacctcgtcgccgccctggaggcgcgccaccccgccgccgccgccgccaccgggaataacgaccgcgtgatcatggggtcgatgctggtggtgggcagctgcgtgttctacgcggtgtggctgatcctgcaggcgaagctgagccgcgagtacccgttccactacaccagcacggcgctgatgtgcgtgatgagcggcgcgcagtcggcggcgttcgcgctgttggtggacagggagcccgcgcggtggcggctggggctggacatccggctgctgtcggtggtctactccggcgtgctggcctccggcgtgatgctggtggtgctgtcgtggtgcgtgaagcggcgcggaccgctgttcgcgtcggtgttcaacccgctgatgctggtggtggtggccgtgctggggtccctcctgctcgacgagaagtatgcacgtcggcaccctgctcggcgccgccctcatcgtcgtcggcctctacgccgtgctctggggcaagggacgcgagaccgccctcgaggccgccaaggtcggcgacgacaacgataaccaccacatccacgtcgtcgtcgtcgtgccgccggaacaagcgcagccgcagccgcaccaacaagcggaagctgatgctgatgccacgacgacggcatgcgaacaaccatcggattcggaccgggcgaatattgcatcctctttacgacacagccatagatacttccatcgttcttgcgggttttaattaattaattactctagctagctcaggctcagctagctgctaattaattaactcgcacgtacgtacggcctgcttaatccatgatctctgttcgagggtaactaattaattaattaatcagcgcgagtacgtagaaaccaattaaccaatcaacaagaaacaaacaaacgagagcggtcgcgatcaacaagctatcgatcgaccgtgcgtacgtaggatatgcatgtatggtaggtaggagaggagattaaatatattgttgctctatctctgatcattaatatatacgtacgtacacatgcatgaacactacttctccaatttctgccaaattcaaattgtaaacttgcaatgtaacccggccagagtggggtgccccttcttcttgagttgttattcatcgccatcggattggcacaacaagtaggcagaggagaatattggcaagggaaagaagatgggttgggctacgtaccggaaagaattgctttcgattccgaccagttaatgggctacttttggtctcgggtatatcatgggctgagctgggctgatttaaatcatggcagagttgggctgggcctaaaaccaagtagtcactcgtcacaccctcaccattcaccaaccattgattcgttcgtccattgatagtttggtgataccgcggcgatggcgacgacgactcggacaaaatatgcaaacaagtataattccgtgcgtgtcaacgtcatgagcaacgaacgaattaaaggatgatatggatgcggagcagccggcgtcacacatactacgtacgtacccagggcagctatagctgttgatttctcaaacggttttggttttgaccatatatacaagctgtcaggttgatttctatccattcatcacccaagctgtctgcataaatgattcacttacgtgccgacgttttcttcttaaagatacgctcgatctatcccaaacgacaaacacaacgtatttctctgcacaaaaataaattaatttattaatatcttttttttagataaaattaatttattaatagctagctgctcctcctcatgaaacacatacatatacatgtatgatgattctaataaagacgacaaattaagctgtcttattcccagccttccctagttcagttcactccaagctaaaaaagtttaatccactctaaggccccgtttaaaatagctaagattgatggatcgatgctttgtttttcctttgattagagttatatatagtattgcacgcggtaagttacgagtgttttgtaaatctagagcacgtggaagagtgaataatctagtttttatgatagttatttaagaacgaatttgctagaaaactttcgcaatttttttttgaatggattaactactgaaaggttgctttagaaaagtattctaaggagatttaattttatatacattttttttcctgaaacacattgtttagaagattggaagcatacaaactaaaaacaacaagtacacggcaattaactgaaagaaagtacttcatgctgcgttggcttgtgttttttttttaaaaaaaaagtccaatgaagcctcagcattattaattagcagtctaattacttcagtatattgttcat

SEQ ID NO: 69633 - DNA, 4249 bp, Oryza sativa
gggttacagcatgcaacaataaagtagggacacgatatatgtgagcgatatatacttgcaccccaccggactaattaattaataaaacattattcttaaacatatagagatatggtagcttagcattagatacgcccacgaaagcgagtaaacaaatggaaagaaaccacgggtcgaacgaacgaaaaaagttcctccaacacgaagcatcacgtacatacatatatattcttcaattcgcatatataagaagcatttctgcttgactcaatcacaacgcgaattgaatcgttacatatatcgatcttgctggtggtagtggtcgctgcactatctatctatatatatctgcagcctttagcaagcagaggcagccaaggtggtgctggttgctgtctcatggagtacttccacctagctagctcattttgtgatctttccgggtggagaagaattaatccatcatttcagtgctggtgggcatgacagatcgcgacatttttaaccttatccggcgagagatgtgtttctgccctctcttaatcactcgtgtgtctcgttttgtttaatttccaggggacctggcctactgctacttgcagtactactcattagcattaaacaagaaccagatgcagatttagtagtattgttaatttgcactatgtaaagctttgttgccctcatgcatttgtttaattatctgcctgtttgtttgtttgtttccacgtgatttcgtatgcatatgcatgcatttcccccaacattattatttgacttctatctgcaagtgcgaatataactatgtgtatgagtggtacgcaatatgatagatattgttagctgatatgattgagcttatccaatgatttgtgctgcttctggtgaaatgtttttggtccaagttaacaagagaccgggagaagtaaaggattaaggaagagtaaaaaaagctaccggcatgcagcaataacagcagcagcaaccacatttatttggagttttggaccatttggttagatgtagctatcagcagttccatgatgcttgcttgcttttattcatccactgctctatgtttatatgcacagtgactgatatttgtcttggtttgcctgattaggtcatcgcaatgatatttggcagctaattaatcaagggctacttttgcttaaatagtactagtaccaatctctgagagatcgataaccacaaggtattaggtggtggttatcttaacaccgccgaactgaaaaggatgatcaatttctctccctttctctgtcatcatgaaaagtgaactcgatcgatgcaggaattgaacagttgtatgcataaatggcagataaaaatcttgagatattttttcccattccctttcctttcatcatgtggaaaaagtcatcttgtgttattgccttgtgctttccttatcctgtttatttgatggataagtacactagctcatatccctttttgtttcagagatttccacttggctcaggcacttgctgtggtctatctcttctgcatattgcaagcattttagcagaagaggcagcaggtgtgatgtgagtataataatatttctctgtatacattgctgatagtgctccactgaactaaatgttttaattaggttttcgcctcggctgctacatttttcagatttctcttgcggctgtccaggtcgttaaatatctgaatcgcattagatatttagttagcaggacaatggtatagaagaaaatggaatgaattacaagtgttaacagcctatcagagaatcaatgccgggaagcaagtttcaagtaattttcttcagagagcaccgaaaagtctccggtcaggttcagtttgtttacctgtaacagacagcagaatactagtagtagcagatagttacgcaaaaccgccttctctgctcgcagttgcagcggtgtttgggaggcagctaagctatcatgtcgctctgtactactactggaccagattagatgctcgagaggggaaaagttgcagaaaaatttcagtagatccgacaaatagggattcaagattattctgaattactcaagcctgaagcttaggtgtcctactttttagtaaagtctgagtttcagtggaatgcacatgtaaattactatgtaaatgcaagagcctagctgactcgatgcatatataaagattgattactagtgctacatatcgatccatgcattgcttgcctcccaatcagagaggaacaaatatttgcaggaggaatagacaagatgcgatctttttcagttgtctccatgctcggggagcgattcatgtgtcttgagcagccaggaaaaacttttgtagattttttatctagtgctctccatgtcggattatgctcgccaaagtggagtatgtcgctgtagactgtattgcaaggtggatctctctctctctctctctctctttttcaaaaaggcaaacgcgcaaagtggatcgtgtttaattcacttttgcctcttatggctccactaaccaatcttgttgccttgcctcatttctctaaactatttcaccatcgtacataactcacaaaatattctacctcctccgattcatatcgattctcttataaatttaaccaaatttataaaaaataatatttctaacacaaaacaaacatattatcaaaatatattctatattacatttaatggaactaatttaatgttataggtgtacctaatttattctacaaaattaatcaaacctaataaatttaacttaaaaaatcaaaatgacttataatataaaacgaatgtagtactagccagctttacttagtaccatttcgatgccgttgactttttcataatattttaccattcgttttatttaaaaaattatgtacatatcatttattttattacaacttattttaccattaaagaaactataatagtaacttatacttttatatatttatattaaatttttaataagatgaatagtcaaactaatacgaaaaattagcgacaacatatattttgaaacgaagaaaatattattttaaaacggagagtagcattgaagtacttgctcgagctaatggttctctgttaattagcctgcgtaatccaatgaaaaaagttattagagtttgtactatgtatttttaaaaggtttcatattatatcattatttaactttttttcatttaacaacatctaatttcacatttttgttttaatttggatcaccccattctatctatctccaaatccggtgactccaccttcgttacacctacaagttcagtaactctacaaccacttcgcgcactaattatctctttcccctctgatggttgaggaaccgccggatctagcaagtaggagcctagatttagcgtctctgctctccaacgggtctgactcctgcctccccgagtctctgcaaacccgacacccttagccttaacgacgaccatgaaaatagtgtacattacgacttgggaggagaagagacataccgatggctagagggtacgacgacgcatgtgaaggagaagaggaacaatggtgtatcatgaggaaagagcggtagtgattgtggttggggcggcagttagtggttattagggtccgaaaagtttactatcgatataatctctaagtgagttttttgtattttttttcttagtaccactgacacgtgggtcacgaatcatcattgttgataaagaatgggctagtttttactatgtgaaaattttgatataaaaggtagagcactcgagtatctcccccttcacttgcataaaagaaaatcccccgtctcgtctcctccgctccttgtgcctgcgcccatcgactccatctggcgactcgcgagagcagagcaggggagggggaggggaagggcgccgtcgtcctggtgagcatccccatcctctgccttctgatttcatctctctctccccccatcgggactagcttctcttctagatctggaagaagctcttctcttaattttcattacactgaacccccatgtctcaagttggatccgcccaaccatgacatcatgtggccatgcatacatacaaacaatctttggacttgagcttatcaagatgtagtataattatggcagctctgttttttatattgtccataagcagtgcctctgatgatgagtgaggctgagctgatttcagcagatttcgatgaccggtgctattagttgttaattgcagcttgtg

SEQ ID NO: 69634 - DNA, 556 bp, Oryza sativa
  unsure (1)..(556): unsure at all n locations
tttttgtatgcacattactatagcgcgaattcgagctcggtaccctccttgagaagaggtgaatttaaactatgaatttggaaaggtttcactatggtctggagtatagcaaatccttactaatattagggggaagtaaggaaataatctagagagtgaaatttgagagaatttgctcaaatttagtaaggttcggaataaagggtataattagggtaaattagtagggttctaaagaagtaatacttgaaccacttaggaatcaaatagatttttaaaacacactaaattaatcaaaagccagcatgatgcagtcaaattttagttttaaaatttgaggatgttacaatgtccttacggaatgtacgcataccagcggatgtcgttcggttgtgtaatgcacccgtgtcgttccaacggtgtatgatgtctatcttctccgacatgattgangaaaaggggaaggggggggggggtggctnnnccgncgggggggagggggggggggaatgttttnaanaagggctncaagggggggcagcggggtcatgaaaaa

SEQ ID NO: 69635 - DNA, 655 bp, Oryza sativa
  unsure (1)..(655): unsure at all n locations
agtgagagcacatattgactatanggcgaattcgagctcggtacccagtctgccgcaaatctcgatatttcccccggaggatcgttcgcacacaagacaactgcctaatgaagagaactcttagatttgagcggagagaacgattctttcggccaaagcgaagccatcccggagatcgagattatccatgaggatcctctgcacatggagtcgaaacccgactcaactgtcgaatcctcattccagtcgctggagccggaggaagaagaaattcattccccggaaattccattccaattcaggggtgatctttatgaaaattatgagaataccctgaattattccagcgaaaagaaggctcatcccaagaatgagccgttcgaggaggtgatgtttgtatcttcgttcgtttcttctggacctatttcccatcttcatgaaactgaacgaatagnntnaccctaaggggagaggggggagagggttncccgcagggggttggatatccntnaatattttatttattatttctgggtaggtggatactatacntatttaatactggtggttccgtacttcnnncctcnnaagcggtcggtggggagttgggtataggncgcgtttgggnannanacncnaaggggggggggagtga

SEQ ID NO: 69636 - DNA, 644 bp, Oryza sativa
  unsure (1)..(644): unsure at all n locations
ttttagagtcgcactatccactatangccgaattcgagctcggtaccccacccaccccaccaatccccaccagatccaacggcccagatctccccctcacctttatccaacgcctccccttcgtcttctccctggagtagtaccccacctcaccccgagccttccactcccccttctnctcctcctcccttctttttacccacccaccctttngnccncgcaaaacccatccaagaagagcttccccccgccacttccattgcgcttctccctgaaaaaacctctctcggcaaggaatacaaagtgaaagacctcttccaagccgacttccgccccctccaaaaccaacttccccaaggtccaaagcccgggcctcattgcgttccccccccaatttcgccccttccaacccttccaaaatattggaagtaaaggaacggncccctcccttcccacccnnanccttacgagagaggaaagatccnccccccaagagaaaagaagctttttaaattntnntncccccnaacccccatntaaanctagtagnaaagaataagatatatttttagtnnnnnnngggacgctgttgtttgtatttgtataaaaaaaaattaaaaaattaaaannccccctctgaccta

SEQ ID NO: 69637 - DNA, 726 bp, Oryza sativa
agtagaataccctcgtgaacctcttctcgtgcggctcgcccaacggcagcgtcagcccgtattggtgttgagggaccaggctaaaccggacctcgggctgggcctgggtgatgtggtggagcgtgagggaaacatagacgaaacccggacacgtcctcccgtttgggtagcagaggatgctccaggtgtggccggccaccttgaacttggaggactcgacgaagttgcccaccatccgtgcatgttggcgatccgcgtgtagccgtcgatcttgagcatatggcatccggtggtcgccgtggtgctgaccgtcgacacggtgacatccttcttcgttggcgccatgagatcgatggcacctgggtcgtcagacaacatacggtggtgttcgatttgtttgtaaagtacgttggtagggttcagttaattaaatatatggagaagttaaggtagatgtcggcctgtagttcgtctcggataagagccattttttgggactgaataagtattactactacatgttggatatcacggatcgttgcaaactcttcaagtctctgtccggttcgtaaacgaacaagggggagatattactgatttcttaaggtgctatgaaaagctagtaaaaactaatgtgttaatgaaaaaaacggatgaatatgaaaaacataatattctgataggaatgtaagtataaaatagaggattgcacaacacacggaaaac

SEQ ID NO: 69638 - DNA, 520 bp, Oryza sativa
catatatcacacaaataaatacctattagttctttttctttgatgacttgtttagcttttttgtcctacatgtcgctcagttgagtagactctccaaatacattttttcctgcaaaatttaacaagtgtataggattatatagtcttttagaaaagaaaatctgaaaatataggtagttacaggccaattccactgaaattacatatgtaatattagatgtgtgcctatgtaattttgagtttatgcattttgggaagattgattttaatcatatatcacacaaataaatacctattagttctttttctttgatgacaagatctgctcctgtgcccagcatgttgctcagttgagtagactctccaaatacattttttcctgcgaaatttaacaagtgtataggaatcaagatgtaaacttacatgatcattgtactataagtactactgttacttcagaaaactgtgtatgtaaattaattatgaaataaaaaaaaataattagttagctggatttaaa

SEQ ID NO: 69639 - DNA, 703 bp, Oryza sativa
cctacacgtgtctggtttttaggttttttctttcggtttttctctggttcttctgtttttttgggttttttaatatatatatatatatatatatacaaactttgtatacatacatatatatatatatatatatatatatatatatatatatatatatatatatatatatatatatatatatatatatatatatatataaagattatatacacgtataaaaaatatgtatacatcatatataaagtgtgtatatgtgtatatatttatatacataaaaaaatatatacgtataaaactccgtatatatatatatagagggagtataaaaaaaatagcacgcaccactgctagatgtattagccgccgcgcgcccaccctatccgcccattagacgcacccatacatgcactggtatcactaaatttttcactcattaattatacactcacactcagagtcatctaattctagatctacatagatcattgttccctgcttcatgtacacgataagcttcaaaatctttataaatgagggctccctaaaatacatatggggaagagcagatacaatcacagatattgagcccgctctaaaacacatatcacagataaatgaagagagattagaggagcggcctacatatttggtacccgctccaacataaactacgagagataatgtgtgtgtgatatgtgggacc

SEQ ID NO: 69640 - DNA, 738 bp, Oryza sativa
tctagggacaaaaatccacttccggtatatcaccaccacccatcactctctacacctgtcgctagctcgatagtgctcacggtaacggccggaaactgcccctcgaatctcgatcagcttagcttagctataaattcagcaccatgcatgccattgcaacctgcgcctgagaacacagctagctcactctcaagctaagctaagctaggagattagacgaagaagaagacctctagctttttccatggcctactcctcatccagcacattgaggtcgccgctggtgcgcgccgccgtcgtgctgatgctgctgctcgtcgtcatgtccgccgccgtctcgcgcggcgagcctgatcatgatcatgtgcagctccagctggccgtgatcaccgggcggagaatgctcgtcgtcgccgggagcaacactgccactacgatcagctcgcagacggcggtggcggcggcgatgccgtactccgagtcgaagaggtcgagccccggggggcccgatcctcagcaccattgattgatcctgtgggaattttgcatgaggctgtccaactccctacgtggaatcaatcaattagtaactactaattaattcactgtgttgttgtgcgcagctaattaaggtggtgtttgggaggggagggacttattttagtccctctcacaaaaacataagtctctcctctagagacttatgcttttgtttagcccctcccacccaaacaccat

SEQ ID NO: 69641 - DNA, 1129 bp, Oryza sativa
ttgtacttgcacctcatcccaccatcgccgccgccgccgccgacgccaccggccaacgccggctgcacggcgcaccagcagaggcagcaaaccaccagcacgctgccgacgacgtcgacggcggcggcggcaagcgcgcctcctcgccgcgccatcactcgcaacgccacagctcagtgacgacgcgagacagtggcatacttacattatatacacttggtcttggttggtttaatgagcagtgacgtcacctcgccgccattgttgctgtgcttttgtacacacgtacacgtctgatatctcgtcgtcatcgttgggctaaggctaagctgcgcaacgtttgcatgttgcaaccgatagaccgggctgggccggcacgacaaggcccatgggccttactgggctatctcggccggaaagtgttctgccgtaaagtaagttcactttgactcccttaactagaggcttaatctaattcgtatccctaaaccacaataccgggatatctcgactccctaattactaaaagagaaagactacacaacggtataccgttgaatggtataccgcttatcccccatgacgcggccccgcgtgccggcttctcccgagtatgtcgcgtgctgctaggattatcatcacgcatgtttgctatgtgtatcagtgtatagtcttgttcctgacagctagctaatacccagcatgcctgtcctgcctttgatactagcctagctattaaataaaaccgaaagtactactagcttgctgtgcatgtcaaatccctgtaatagctactagtagtcccgtaccctagccatgtagggtacttattatggcagagcctagtagcctagctatgtgtttaagatgggttgcatctatttgcatgtgtcctataccatgcatggattagaccagacaaataattacctaaattatatatggatacaatgtattctaattagatatgtcatgttgggctcttggttataccacatcttagaaactctagtatgtgatatatagatgctagattatcatatctgatatccaagtactgggtcgaatacctaggtaccaagtatgaaacctataaatacaagatctgatgccgagttatcgggtctga

SEQ ID NO: 69642 - DNA, 1461 bp, Oryza sativa
agattgagggcttcctctctcagtttggtcgacactagagctggggttcaccgccgacggcgacgacgcacgagggctcagccatggtggagttcggcggcggcgcaatgagaaagagacgaacagagagagaggaagaagaagaacagagagagagagattgacaagtgggcccatgggcaaacttgtctttaaccaaagtttctctctccattttgatcggaaataataaaataatagaaggagtgtccagcagctaattaccacttcttgcagtgtccaccagcaaatacacgatcttggggtgtctcacagcaaaggccgtaatctttcggtgtcctgtagcaaattttgccaaaattatagggtccacatcttttttcccttctcttttcttttttcttttattctcttctcttctccttcagccgaacggcggtggcaggtggcgacgggcgacgtacgagagcggcggcggcgacagatgcctctttccccctcccgccgacgcggccgacatcctcaccccctctcctgtcggcctcatctcccctcactcggtcggcctccactccccctctcccgtcggtcgcttggcgaaggtggctcgtgggcctcttccgaggctcggcgggtaggcggctgtagacccccgattttagaaatcggaaatcttctgtgtttatccgtaccaatccctggatcagtagttggtacacacatatatagttggatcacaacatatcacgaatgaatttaggctaaaagagttaaatacttacattagggccaggtaggccaacaactatcagagaacaacagcggaagacaaaataatataagggcccggttaacatgccacaggcagtcgactagggaacgagacctagaacaagaccgcactccgatcatcttgttggatacgcaagcgtaccgacaagggcttctcttcaacactctcctaaaagatatatgaatagcaagggtgagtaccaaccgtactcagcaagccaccacaacaacaatgcatatgatagagggtatttcaaggaatggcttcaggttcttttgcataaagctaattttacaattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctatcgggaagtggctccatcagcataaaattcatcatgcaataacccatcccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaa

SEQ ID NO: 69643 - DNA, 1376 bp, Oryza sativa
agagtgcaatgaacagtgacttttcctatttatcccgattttagtgtattttccatataaatttgattccacaattcctagttttacatatatgcattttactcaatatttgtgttatcttaactaatgaattcaccctagattaatattatccatatttatttatttatcgcacaaatgaattctttttagattaatttgagttattggccctaaggtgaacttatatatttttgaagactttggggtactattaaatttaatataacgacttgtcatgattaatacattagcagattggtcaagtttagttgtatagcaatatattttacacggataggtttaatctatttattctataaatagtaaattaagactcggtacaacattaatctaattttaaacactcacatattcttgtttatatataaggattaatttatttatatgaccattattttatatgagtgattttcatgtcatgagtaactcggcgacatgttgcaagtatcaatctatatattccggtgaattacttatttataaacacgatcactataatggtgatcatcatttcatgtgttcttatatttcatgtgagattcgattcaaatgaattagatttaatcttactatttctttagctaattgtgacatcaagctatcaatcatggttcgaatatttaatacctgatttgtaatttgtaatagaaattaatatttgacttaactatcttgtgcataattatttgtaggattaacaatattatattctcgtaaatttacctattacttaaatttttagatccttactttactttctttgtgatcatttacggtttggcaagcaattgcaatcataacaaccagcatgatgaaaaagttttgaaaagttcgaaattttagtgatttttattgttgggaattttcaggatgttacagcggcgcaggaggggtggagccgcgtcgtgaccctcttgcgagcgtctccactactgtgtcgccgtactctacgagtttgttctaggcgcggcggtgtccctcatgacgccgagcgtgcgatgccgacaggtggttctcggggcgtggcgcacccttgtcggcttcttccttgccgagcacgaccgcgagctcgaagcggtcgtgcgtgatctcgcacgccgtctcccgcgtgtgcgccttagatctccgccacgctcatctgtcgccgccctcgctccgctccgtcgggcgcttcgcccctactccgctccgctgccacctcctcaccgcctagccgccgacgctgcctcctcactggccctagtcggcattgtttcctcgccggcccaagctatcgaccatcattagctcgtcgttgccgtgagccttagccg

SEQ ID NO: 69644 - DNA, 6390 bp, Oryza sativa
accaagagtagggtagagagagtgggagagagcaggagaagagataaggtggagaataaggatgacaggtgggtcctacattttttttcccacataagcgtctagtcagcatgagtggaccgggtcaaattgccacgtcagcaaaaccaggtgtctattctgctataggacctagactggacggttttgtatagtttaggggtaaagatatctggtattgagaataagggatgtcaaggtataaaattgagggacgacagtgaatgtatagttaattaagtactagcttcatttcatattattcgtttgactttttttctttagttaaacttctttaggtttgactaaattttataagaaaaaaatagtaacatctacatcaccaaattagtttcattaaatctaacatttgatatattttgataatatgcttattttgtattgaaaatgttagtatatttttctataaacttggttaaatttaaagaagtttggttgagaaaaaagtcaaacgacttataatatgaaacaaagggagtattaggcttaaaaaaacttgaaaatttgattaatatgattttcacgacaacttttctatagaaattttttataaaaaaataccgtttagtagttttcgaagcgtacgcgcggtaaacgagggagtaaggttgggaacctcaaattgagagcacagcatcatcatttttggatgggcttggtgcgcatggttggatgaactacgaatgagtttacttggaaattttttcatctcgacgtcgagtttgaatcgtgttgacaaaccgtaataccatatacaatagattcttaacttgtaatactggagtacttgagatcctatagcagtattgtgcttggtttcaactaatgtggcgagttgaatgtggtcaacctggccgagttttgcgtgggatccacatgggccccacttgttagggcccattctctctctacctatctctattttttttctctttcgctcttcatttgtaggctggcgccgcccaacatcatgtggtcgagctagaggagttgctttggcaggtggccacagcggcagtggcactccccctctctctttcgccctttgctcgatgatggttgcgtagggcagcggtggtgcttccccttccccgactaggtcgggcttgcaacgacgacaaccttctccccgtcgagctcctcacccatcactgtagttggtgagctatagggtaagatagacttaaacctagggccttatcactttacagttaaaattaaccgtacaaagttttggttttctcaaaatttggggaggtaacaatccaaacattgccaaaaattgctccactatcaaagtttggcaattttagaatcttcctctcacaaaaaatttaaaaaaaaacaaactaaacatagcctacacttgttaactttaccaaatattgataaatttggtactgtcaaaatttggcaatgttgatatttaggcatcaaaaagtgaacaacccgttccgatgccacaagcccacaacccacctcaccctgccgaccatgtcaaaccaagcagaagcttccagagcaaggtgcccgcggcccacgtagcccacgccgccgaacagcacacagccgcaactcgcacgaacccccgggcatgcctgaccttgtgcggcggcgaccatggctgccccctcgccggagcggagccctcgtcgccggggaccgactccccggtgctctgcgtgcgaatcgtatccctcgactaccacatggcgccgcccctccccggccggattcgacttctcctacagccacttccacggtgcgtttccctccccgccccctttctccacccgcctctctcgagcccccgtttcgccccccttgtgctatgcctctgcaccgcgcccacgtcacgtcaagcggttgatgagtttgatgtgtggtggatttaggtgaaggaggtgatcaggctccactccttacttgcctccacatccatctggtgcgtagcagcttctctgatgagtgcttttttttttctctctgttgatattacggatgagctagttttggtcgtcatgtttggttgcagcttcaagctttcaaccgagtgcgtcgcgtcctttcaagtgttttgagtgtgagttacgctgtgagggtataatacatttgtgtttgctgttaggtagccatgcgcagcaactaatcctcctcatgtattacacggtatctatgcccaacaattgatgcccatggagggaatgtggcaatgtgctctttgttgatactgtacgcgcaccaaattcgaagtttggagatccaacttcactttcgaagttcactaaatttgaagccctcttatcctgcatgggcttaacattattttctatacacttggtgtttgcttgtaatatatgcaatatttacttctgtgtgcacttgatttttgttttttttttgttttggttgagtttggacatgcatatgatgattagctctattatattttgaattcatgtttttgaatgaatacagatatacttcaattttttttatatcgcttctctatggaaagttgctcacactattccattcatcattagttgtgccaactagtttgtaaacgtttgctgttttttgtatctccttcaatttctgtctgtgccttgcacagaggaccttctcataacattgaaaaaggtaattcattatttgtagttatgcaaccctgatgtatcatgtatatgctattactgttacttttgcaatttggtacatggattgttctattttgaattgtactgctgattttctatctacattacctgaaaactttttgctgatgattttcatatctacatcacctgaaacttgaaattgattgttatttattcatattctaactgagccttactgctatctcacaaactttttagacactaattcctcttgtatatggcagttgcacaccgctgttgcaattttattgacttaattaattaattcgtgatttgaaaggtcacttcttcatctgtcgaaagcttgccttgtatgcatctgcaacacatttagataacttaaacagtaggctgaaccctttgtatgtgcatgtggctcggtaagcatctcttagattttgtactggtgaaaagggcacctgtgtctagaaataagtggccgttactttttcttaaccaaatagcctaaatgtgttattctctgcaaatggtagaactgaatactgatgctccctgattaactgttgcttgtaatgtcaagaacatcgcttgatgacaaggagaaattgatatgtctctttcctgccctttctctaggtaattcatatataattggggtctatcaagtgaccttgagaaagctttgcaggtatttgtgatgtccagttatgtatccataactttattgttttctaaaaagtattttggctgctatggatgtttgaaccagttctagattacctgttctttccttcacacctagtgtttccatgaacatattccatatgattaattataaatcaaaaccaaacaaagtatttactgaaatcttcacaaaagatatactgagttgtggaacacagtaactgcatcctcgctgtttcctttgctgtgcaatttctgcctatcagtgttcatcctgaaagattatattaggttctcctttaattaattaattttgatttatttctgtatttttttccttcagaactaattcttgatttcttagcattaactcctattttatatttattgtctagcttctccttgtcaatattgaaactgttgtactcactatatgtttctgtttcagtgtcctaatagtttatcagtaaatatactgaccatttattactggctcaatgcttggtgtgagtatctaagttctgatgtcttatgattgttgcttccacctagagtttgcaaccatgatatattattccaattctggacttcaaggtagtctatgtaaaatggtaaaaatgcaaaacttccttcatttgttctgtgttggagttatcatgagaaaaatctactgatttgttttgtagctaattggctatacataatgcctatgcatatattcttgacaagcattaaataagtcagtgggaattttattggtgttccgtgatatccttaatatttgttgatattgaatccaactattgaataccatgttgcttgtttaaaccacaatttcatgagaaatcatctactgcacaagtgcacattctgctgcagcccagctattggtctgttgaccccttctgcttaatttatgaccttggtattttccaaatttccagtagctaaacatgtctgacaggaggaatatagctgttatacttctagatttttttttctttcactattttttggcaatggtactttgttttattatcccctctatttcttcttaattgttactagtattgtttatatttcactgtctcggagttacaatttggaccttctctgctatagtttaacatccaggtatatccattaaactattatattacagccggaaggtcagccagggatttaatgaaaaaaaatttaaaaaagccttcatttagtgttgacatattaatggtcaaaccttgcagaattttaagggtagttctgacactgaaaggagtatttattgaaagagagagtggtaatagatatttcaatattattattggcttttgttcattgcgtatgtttcctttcagctttacattaataatgactacacttgtctgctgtaggaaactagtatttttacgtgaaagatttgatttcaaacgccttctgttgcatgccatttcacttgaaaaatgtgcattgtgtctcagtgttgcatgtgtatgttgctttattttcatgatgtgaagctgtggattcattctcctagcaacatgaaacttggcctctagacagttatgccatctaggatcgagtctgttctctgtacagactatcatatgttatagtaatttgaaattgttcagtttatcttgtgatcttccttgtaaatacactttactcttctcgaatgggagtattttaaactatttcctgtggttcctgattttgagatgcttggtttcaggatggtgctgttcttaatagagtattccaaccttatgagtctcacattccctatcttcttcactttttggtaagagcaacacttagtttcttttcatagttgttgtgaactgcaagaacagtatttcattttgtctcttatgcagtcttaacataataaataccacagtctagcttttatgatatatagtatattgatatttgagcggctggagtgccaggatattaatgattgaattgaacctgtgaatggagaagaacaaccaaatgatcaaatatcttaccgcagttctgtaaggctcgatgagagtagttcgctgagcaataatattcctcagcttgatgggtcatctgatgaaaaccaggaagttccacaagaagatggtaagtataaaatcaacaggaaaagtgcaggattgcctagttactcatctcctcaaagtagttgaacttctctggtgctctttgccacctcccattaaaaagaggtcagatgtaaatgttgatggtcatgttaaaacctctccagacggtgcgatgccaactgagaaggaaccaagtgtttctttcatgagtagaactggaaagaactcccatgctaccacagataagactggcagggaatcttttagtcgatcaggtgaacatgacccattgtgtgattctgtgagggtctgagagacttgatgatgaggaggaggatatcttttcagtctgaacaatcagaagttggcaagtctggagatgcaatatacatcatttgtaaagagaatgaaattgtgaattccgagggactagaatggcctgattcatccagtggcctttcaattcataaatgtgtttttctggcagtgaatattagcagatgacctttgcacagaagcctccaatgaagaatgaagtattatgttgtttggagggctcttcagcaggtagtgagctgcctcagtttaagttaaagtggtatttatttatcatggtcaatgtaagttccacaagtgatctttattttatcatggtgaatgcaattcatttgatgtatactgtagttgttgctcatgtaaattttgtagtagttttgatgttgttgttaacgatctaatatataaataattgtattagtgcctacgtatgattatgtaacagatgttcattgttttctttcagtttttctagcattaggcttttaggtcctttgccatttacatagcttagcatgtatgcaaaaatagtactccctccgtttcacaatgtaagactttctagc

SEQ ID NO: 69645 - DNA, 633 bp, Oryza sativa
tactgtgccatccggctatacgtggtgaaccaagtgttctaggacaacttgatttaaaaaatgttgtacaggctgaccaccaggcgttgccaacccggccgatgcacctattgaaccttggtgctggattcgactgaatgatttgctgtcttaacagcgtctgctgaatcggctgcaaaggctgttgccttggtggtgtttgctgaactggttgcatgacctgttgctgaattggttgcacaacctgctgaattgggggtgtctgctgaatcgactgctgctgtattggatcaacaatagattgaggcggcagaaacgtggcagcaacctgatcttaggtcagctgatttgcaacctgcccgccatgctgtagctgctctctcattaacaaccgagggttcactggctggcctgacgccattgctgcggaacaagtaggagagttgacgccagtgccgtcgactgagatgttggtgcaacagagggaaccgcttgagttgatggctgaacatcggtaatcaaagaccgataatttggaaagacaccttgcaaataaaccgggcctacagcctgatgctcagctattgaaccatcggctatggacttcatcatgtttgataaggtattgactaa

SEQ ID NO: 69646 - DNA, 10548 bp, Oryza sativa
  unsure (1)..(10548): unsure at all n locations
catgtatgcaaaaatagtactccctccgtttcacaatgtaagactttctagcattgcccacatatatatagatgttaatgaatctaaacacattcatttagatgctaatgaatctagacatatgtatgtggttagattcattaacatctatatatatatatatatgggcaatgctaaaaagtcttacattgtgaaacggagaaagcattatttatttgtttgttatcatttgccatttacacagcttatcattatttattattgttttccctctagaacagtttggactatcaaccaaatgaaatagtataccactataacttactataagtacagtgctattctgttaaaacttaatctttcttgaattttccggtatcatcattcacttcatatcatttaaaacacattatattttctctgttaatccacattcgctcttctgctatttttcaacttctaaactgggatttatcgatatccctctgtttttcaatcagaatgctgaagcgaataagcagaatgaatcatttcaacacatggaaagtagcgagttttcattggatacatggggtgttccaactcatttccaaaatgattggtcagccctatatttgctaacacatgcatttttgccaccccgtgggccagtggctaacctaacaatcttgttccattagtgtctccggtatagattatttcctgcacagtcaatttaatgaccatgtatcgatgttgtcacacactgttatcttaggccatttcaactgtagtgagagagtgtctgttgatcaggaacgagcaaacaattctactctttcaccatactagcaaattacccatgccatgctatgccatgggataaaaaatgaaactgctttgctgtgttattactacgcagcatttgggtgtttttcccccttttttttgttttttcctaattggcggttttctggagaaactgtttggttttttctagagggggtggagcacagaattggttgggtggagaggaggaggacgatgactcccttttagtgtagtagagatatgggaggtcctactttgatggacgattctcttgcatccaaattggctttggagcatagccctacaacctttcctaatggtacagttatgatggaaccagatctttccaaccaagtaatgaaaaatctactccctccgtttcaaattataagtcgttttgactttggtcaaagtcaatctactttaagtttgaccaagttttagaaaaaaggtagtaacattttcaatccaagataaatatattatgaaaatgtattcaattatcgattaaatgaaactaattttgtgctgtaaatattactatatttgtctacaaacttaatcaaacttgaattagtttgactttgatcaaagtcaaaacgactaataatctgaaacggaaggagtagctgattggcatgagttttcccagatcttaggaagagatgagaaggataaactaacacctctcagtcaaattggattccgtggtcctactagcactggtagtggattacaattgactataagtagcatagtggttgtaccacattcttttttcttttgttcctgacgtacatatgtttctttttgttaattcttcatacaatgtaggtgctaatttactgttcgtggaaaaatctatgtctgcaaccagcagttcttttttgttattattaatcatgtcagtttgacttgctctatccagtgaaaagaaaatgcaaagttgaattaccagtttatcacatgacatttatttcattaatacatgtattaacagaaagcagaggagagctgcatcctgatccacgatttcgtgtcatcaacgctgtatcgctggctgttgaggatgatgctgacaacactactgaaatcatgtgctttatacgtggaaacaatgacagttcacacaggaggaggttgtgtgaaatcactcaaatcttggaattgtttgttgttttacttttccgtttcttcttgttttggcactaaccagtcatcttttcctttttaatcaaaattccattctgtttaattttgtttttctcaagcaacatatatcttaatgagtctacagaatctcaaggaattgaactgtcctaatcagaagagttgtgtgcttgtgttaaatgtgaaatttagtacattagtatgtgagtcataatcctagttcaacaagagaagtctgcatggacatcgagtgactatggtggtgactgctacagtgcagtagcaactgatgtcatttgacgagagtactttggatcattacttttatttatgggtctgttaaggatttgatatggtaccatcaaaaacacatttgttgcttccatgtgatgggcctttcatatgtgctgaacatatcctatgcttctggacttgaagaacaccatataacttcgggttcttttatttagaatttgttggatcataaaccacagttttactgttttagagttacactctcatgtagccataattgtttgttttcagctaaggaacttgtttgattcttttttaagggctgtaagagttcaacctgttgtattgagatgtctttattgtcctttttcttgtaactgcagaaacctggatagagttgccggttgcgacataaacgtatttccttgagagacagaaacttttaaaccatcttattaatgaaatatgttcaatcgatccagatattatagttggatgggagattcagttgggatctttaggattttttgctgaaggagctggtataggcttactgaaaagaatttcaaggacaccaccaaatcagatgaaacatccacctatgaacccagtggaggaatcttgtcaggagtttcctggagcatcttcagctgatgatgttattgatgatgctagtgagagcaattggagtcatactcatgctagtggtatacatgttgatggaagaatcattctgaacttatggcgtctcatgcgtgcagaaattaagcttaataattactcccttgaggctgtagctgatgaagtcttgaggaaggtaccattagtaccaaccaagatattgaatcgatggtttgcaacaggtcctggacgaggaagataccggtgcatagaatatgttaacaattgatcttctctcaaccttgaaatattaaatatacttgacctggtaaatggaatcccccacatttatcgtgctggtacatcatcaagatattgctatttgagatttcctttgtatttctagttgaaaacttttatcaattttgcatcttctccttaacaatctcctagccacgatttatcacacagaaatgcagttggttttgttgacatttcttgcacaagctacttctaaatgttgttcttctatagccatttttttccgacaaatattacctgaccatgcaggtaaagaggacatctgtacttgcctgtgtatttagtattgatttcttctctgttctttcacgaagttctctgtatcgtgttgaatctatctatgctcttgagattggcccatacacaaaactaccttgcaatttccccaggaaattaacaggtgaaatcactccctaacatattaagatctcttcagatatatagtttctcgttcacatttaccacaaattctggaacatgtcctagagatgatgttatggattctactggcaggtaacaggcttgtattgtatacatgatttctttgtgccaaagatggccttttgcccatttggtcagcagggatccaaaagaagttactacctccgttttatattataagtcattttgacttttttactaatcaaaccttttaagtttgattaagtttatagaaaaatatagcaacgtctttaacacaaaacaagcatgttattaaaatgtaatcaatattatattcaataaaactaaattggtgttatcgatgttgctaaatttttatataaatttgttcaaacctaaagaagctttactaagaaaaaaaagtcaaagtgcaaggaaaaaaaatatttaggacacttttcaagattttgatgggagtgctattttaagcaccatgaaaacttaactttacctgtgcatagaaacaaaaaaaaaaagggactccccctgcgtcgctctcgcgcgggcggctcggggggcgaaaaaccctagccgcccgcgcctcctctcaatcccctacctcgccactgctggagcttgtcggcgcgaagccggtagctagcagggaaggtggcagcgaggacttctcttcgtggcgcgaagtggacgggacgaagacgacgaagctccccgccggcgcggtccgaggaggccacgacagcaaggtggggtgaggcggcggatcggcctttccctcgcctagatttgtccgncggcagcgggaagaagctttgggcaaggttgcggcggggttgttcgggttggccgggcttggttcgcaagttgcggggggaaggcccaggcaagcccacgggaagggggggaaaagccaagcttgccaaggggggttcattggttgccttggcggccaagcgaagcccaagacgcagcgcccgccccttgggcgcggtgggtctcctcggcgtccaggcctcggtggcggctcggcgtggtgaccggacagtcgggatgccgccgcgatggccaggtgagatgcggcggccgaagaacaggggcaccggcgggtggcgccgatccggagcggctgcgccactagcggccagatggcagtgcaaagggagctggcagtggtgggtcgtcttcctcattgccggtcggcaccctcgcccttcccggagctcctcctcttctttgcagggagtttctaggttggattgaggtggccgctcgtcaacgggggaagctcatgctgccgaagcaatgtcacctagtcccgggttctcctaaagccaaaactgacgaggcggccggtgggtggtggaatagaggggtcctgggccaactctcaggggtggtggttagctgaagtcggccgacggaggggcgttggtgcggtgtggtggatgctatgtactgccatttgtctgtgtggtagttctgagttggtggatggcgatctgcagtcaaggttatagggtaccaggcgaaagcctagttcggtggttcaccgggccagcagcggctacgtcttcgggcgtcgtaacctccttgggcgttgtcaagggttaccatcttcctttctcgacgagcttctttaggtgaaaactgttagaataggtgtcgaatatacttcctatttggttacagttggacttagagttgtaataggtgttaggggatggagttagagtcagactctgtaacccatcatctctcttaaatagagagggaggcaccacaatgtaaccatggcgactgcaatgtagcgtagacacgcagggagatgatgacggcgtggccatgaactcgtagcggctaggagctatattggttggggaggagcgcccataatcagagccccggggatgtaggctttgggtgaacctcgttaacaaatatcgtgtgttcttgtgtcatcatctggcatgtcttgggtgatcaatgactgaagcgatcgggaaggttagtcgtcgttccgctatatcgactaacttttataacaaaaaccacatctttttagatgggtgatggcggcatcctgtatgtcgtgaccaccgtggtggcatcgttttcggagcgtcatctatgtggtacaaaaaccacatctttttagatgggtgatggcggcatcctgtatgtcgtgacaccgtggtggcatcgttttcggagcgtcatctatgtggtgttaccataagcctagcggtgttcggccatacttagcgggggtcgtttagtgctaggtttcaccctcagcagtttgtgcttgggtgttagtgcgtggtgtgtggcaatgcaccttggtacattttaatgttttttcttataacttttactccttaatatactcggttagcctccttcggtccttccggcgaaaaaaaaaactttcatgccgggcatcattttatccatctgtctatcttctggtttgttactcacataaagttagaaaattggatctgttctttgctacaatttaattaaatatgaatgcctaaaaatatagattccagtattttaagtgttctgtgcaacttcgcaggttgcttctcagccagtcatggaatgcttgccactatggaaccagagtcaggtttctgctctgacccattgaatccttttatccctccatgataataagcatatacttgggtaaagttttttccgtcatagtcaagggtacttggtgtcagctcatattcagccagatccacacggaagattgctgactccaaaatggttcctttacgtgcaacctgaggtaatgcttttcttgggtgagctaaattgttttcaaacattacagttactagataaaaccacgcgcattgctacaggaatttaaacaataaaaaaataacatgtaagataggtagataacattatattaagtaaattgatatggtttatgataatttaaatttaaatagtacgtagaatgatgattcaaatgtaaaaagtaagatgatatgattttatggaagaaaaaaagtagggagataatttgaactgtagattaatcttctaagggctaaaaacaattgatgtgatatgacttaattaaagggaaaaagaagaaagataatttagaccatagattaatcatttaagcactacctaagtgaggatgaactatataaatatataggatatcataaaatataacaaagatatacattgaaacattatgtgaattatgttggataataatttaacatgtttgtatatgaaaagctcctaatttataaaactataaagatatagcatgtttgcatgatgtttaaatgtgatgattattagtggatgatgatgtggcatcttgttaattagtatatgaagatgtgacatcttgttagtggatgatgatgtgtcatctttgcatgtttaggttaaggagtttgttagaggaaaaaaaggagaaagataatttggaccatagattaatcatttaagcactaagtgaggatgaactatataagtatgtaggatatcataaaacataaagatatacattgaaacattatataaattatgcggaatgataatttaacatgcttgtattttaaaagctcttaaattataaaaactataaaattataggtaatataacatgtttgcatgatgtttaaatgtgataattagtggatgatgatgtggcatctttgcatgttaaatttaaggagttagtgggggataactttatagtaagatactaggttaggattacatggttttttatttactttgttatagggcatgcctagcatcatatctgtagactgtagctcatattcagcggtgggtgaagtgaccgaaaatcttgggaaaaagtacattgaaggtccctcaacttgtcatcgagttacaaaatcgtcccccaaccacatttatttgatcatttgatttgatgtcgattcttctccactttatggttattctctgcaaaagattagtaatcctaatactagtgaaaagttattattctaacttaaatatgcattgcaagtataactagttttcctctattttggtaatattaacggtcgaaactgattgcgaacgatcgtcaataaggtcgaacacccgagcggtggagtggccgttgccggaggtgcgagcggagtcggcaacttgacccaatggctcgtcttgtggccgccgagcgcttggtagaagctaaaggacttgccgtatacggagcacttgaactccgcacctaccggtgctggccccgtcgtcgagagaggaggcggcgcctggacacggtggtggcccccgcgggcgagcatgagaaggcagagcgcgaggttctcctccgatcgctggcggcgcgacctcttccgcttcacccacccctgcggcaggtgcccgccctcctccccgcttgtggcgctgctgcttgtcacgaccgctgcctcctccatctcgtgctgctgctcctcctccttaagcaccgcggcgtggagcgcttccgtctcgccattcgagacaggccgccgccgtcgcctcctcctttcctgccttgccttgatggcctccgccccagctgccgcccgacttgccgagaagagtgagagagagaggaggaagagagagggtgctgacgtggccacgcggacatacgtgggtcccacgctgactcagccatcacataggacgaaaccgggttcgaaaccatcaaagaacataaagtgaatggtttttgtaagttgagggaaggctctatatctgggtttgtggttggatgatgattttgtaactcagatgacaagttgaggggccttcggtgtaccttttccaaaatcttgtgctagtaaatgggccaaaagggtattcgtaacaggacggcccggcccatatgcaggaagaggaatcgtcttgatgtctcctcagtcctcaacctaaggatacatttccccgtctcctcgagaccttcgactgcggccccaagcgccgccgatccccatcccatcccatccatcccgccttcgccgcgccggaggccgctggtgttcgtccacctattcccgccgtatcgcatccatttctggtgagcgtccaatcctctttctcatctctatttctctctcacacgcacatttgctcgcgttaacccttgtttctctcttctagtagagcattgcctgtgggggacaaaagtttcttttttgtttaaggtattcggaatcaaatcagtctccggttcgtaaacggattagcggtgcgtattccgattcgattccgattcttagacggagtttttttagtttaggctttatatatccagcaaattggatgtaggctttccccagctcatgttaaaccttgaggttgtcgctgtgcagatacaaaaagagtgaagggagggaggggcagatccagatcgagaggaagcaaatgtcatcagaaataataatgtcgtccaagaggctatgcagagagtcagatgacgaagacgaacgccattgcagcagcagcacgaacacgaagaagagggcgtgcagagagtcagaggaggaagacgaacgccattgcagcagcaacagcagtacgaagaagaagagcctgaagctgggtttggttcccttcagctctcacaaccacaaccacaagcagcggcacctgtacctggtgctggacgactgggaggcaggatacagcatccacaaggttgtcgacgacgacttcggcgcccgccctgccgccgccgccgccaagcacaacccgctcatccgcatccaggcgcagcacgcctactcaaggttcttcgctgcccacggcaccaagatcattgccatgcatcccgccagcttcagccctggcatccctgtgttcgacacccggaccctcgagatggcggtgtaccctccccctaagagcagatccatcatctgtccacccgtgtatgcctccgtcggcgacaggctcgtcacattcgtccaccaatatctcgaggtgctggggccccatccaccacgctccgccgccgtcgacgacgacgatgagccagagccgccaccgtggtcctggaccaccgtggagccactcccgcaattccactccggcctcgtcaccggctacgccttgcacccggatgggcgcaccatcttcatttccatcgaggattgcgttacgtttggcacgcgtaaatccaccttcagcttcgacgcggggcgcctcgagtggacccgcgtcggcgactggatgctgccgttcgagggccaagctcactacgaccgtgagctggacgcctgggtcgggatctgccgctacggtgaaggaaccgggcatctctgttgatgcgacgtccctccttcgcccgccgccgatgctgcttgtaccaccaccttgcctgcctggaagttttgcaaggaggtgatgttcaagaagggcttcaccgggtactggggggctacgctcgtgtacatgggcgacagcaggttctgcctggtggattgccgggtgcctgatgactgtgacgtccgcaccaccctccgtgtgctcaccatcacctcctttggtctcaagtatgataaggccggtgaactggtcaccactcggtaccgtgcttacgcatcgatctcataccagattgctggcaaatttaagagactcgaggatcctatagcattctggatgtaatttatttatgatcatgcaaaactagttagtagtatcaggtgttattgtcctactcagttttattatatatatatgtgagcatgcaattttggcataacctgttttatatatggtcgccttgtcaatttggtccatctttgtcagcactgtgttttgctgtaaactgcttttccctcttgtagcacaatgcttaaaaaactgggggaaatgaatccctataactttacaaagtgagttatgtctgatgcctaatcagtacattttgcc

SEQ ID NO: 69647 - DNA, 18305 bp, Oryza sativa
ttgtcgatggcattactgggacttggacgcttgtcaatagcatttcttggattatcttttttctaatagaatttatatgtagctgagttggtaaaggagagaggtgttgggttcgaatcctaaccatgacaaggccggtataaaaaaaatacttaggatgatagtttaatatagtgtggaactaatgctacatatgaagtgttgcaatgtaattttttgccatatctattttgtggcaatatgaaaatttgttatcactaaataaaaatcattacaataacctattaccactatatttattagcaacaatttaaaaatgatagcaacatatatgtattgccacgattttttttcgtggtgacaaatcattttcggtagtgatattcgtttcatattataattcgctttaatttttttcctagtaaaactttgttaggtttgatcaaatttatagaaaaatttagtaacatctaaaacgccaaaataatgatgttaaattctaccaggaaaatagtatgtttgttttgtacgaaaatggtactatatctttttataaacttgtcaaacttaattttttttaaaaaatcaaaacaacttataatataaaatagagggagtaatatacaagcaaaaagaagaaaagaaaattgaatgattgtgtctatgtcattcatgaccaccaggtataggtgctgttattattgcacaaaattcacaaaaactcaatgaccaatccaacgtgtatgtacgtatatttatgtgcaagcactccatcatcatcatccctcgttgtccggccagaatgtatgtgcgtgtatcaatataatgtactcctctgcatcgatcgatcagccgctgtcgttggctagccagtcgaggagcgaccggaatttcttggcgacggcgcccttctgccaccggagccgcttccaccggcttcccaccagcaccgggtgcagcccgaggatgtgctccggcatgaagtcgtgcctcgtcaggatccccaccaccggcgacctctgcaacgatcttattcgaatgagagtttgtaacagtggaacaaaaggttaagtaatttgtaatttggattggagcaggtgtgtgttagtaatttgagtagtggacatcgattcacatacgtcgcaggacttgggcacgacgaggaggtgtcgcaggccgacctcgcggaagaggacgagcgccttggccagcgacatggtctccaccaccgtgtacggcgacgtgttggtgaaggggtgcaggtcgacgtacatctccatctcctccggcgacagctccacgtcggcgatggtgtcctgcttcccggacccgcgcttgtcgaagtcctgcgcctcgaacctcccggccatgtagtccttggggcaccgcaccggcgccgtcaggaactcccgcttcttgagcagtaccagcaggtgcgcgcgcagcacgaggccgtacagcaccggtgccggcgagaagggcggctcgtcgaccaccgggaacgcgtggtgccccgtggtccggagcgtgtgcacgatgtggcccaccttctcgacgccgttgaagctccgcagcggcccggccaccacgtcgccgacggtgagctgccgcatgtacggctcggcgtggccgtcgaggtgcgggaggcccttgagattgaggatgaggtcgtagatgctggagttgaaggagtcggcgacggtcttggagatgagcagcacgagcatgacgagcgggaggaggagcaggttgttggtgagctccaggatgatgacgcacacggacaccgtcatccggagcgtgccgccgaggaaggaggcggagccgaggatggcgacgaggccgtggtcgagtcctgagcggccgccgagcagcatggcgacgaggcggccgtaggtggcgccggtgaggatgatggggacgaacagccccgacggcgcgacgacgccgtagctgagcacgccgagcgcgtaggaggcgacgaaaaaggcgagcatggagcccgggtggtagacgtcgttggtgcccgtggagtagaggttgcggatggcgtcgtcgttgatgttgaggaagaggctggccaagtcgttgtagtgccccgccgggcagtggaaccgccggaatcggttcagcgaatggcacgtcccgttcggcggcgacggcgccccggctgtcgggcacggccggcacggcgccagccacggcaggccgaacacgcagcacgacgtcaggatggacaccaccgccgccagaagcagcttgtgcgcgttgcccctcctgcacatttcaaaaattaatttcattggattggattggatttttcactagaatataatcagttcaacttcaatgtgttccaaatgatgtcataattaattaattgaacgaacaagtaagccatgtgaaattggcaaagatatggaatgatcgtagctagctagccatactcgttgatcacgctgtagacgcgcaggaccttcatcatgaggaagttgtagagggcgcccaagatggcgccgatcacgccgatgaggacgacgatggggatgtccttgaggtggtaggtcatgaggtcatcaaacttggtgctgacgtcgtacatgatcagcccacccttgccgaacagcccgcacttccccgacgcgcacagctcgatgaacatccgcagcaccaccgccaccaccgccgtcgtgaagaacgaccgccagatcagcgcgctccgccaccttgattaattatcagccacaaattatacattcttgtaattaagttgtcagccaaaagcttcagaggatgaacagaaaaagaaaattgcagcagtgcatatcattcatgtgtaatttgatgggtagttttaccatgacgagagtgattcgagagcgaacaggacgccgccgacgggggcgcggaaagccgcggtgacacctgcgccggcgcctatggtgacgagatcacggcggtcgcggtcgttcttgaagtagcgcagccagcggcaggtgaggccgtacttgcgcgacccgccctggccgaagatggcggcgatgcacgcgcccgtgtgtaccattgggccagctttgccgacgtgcagcgaggatgacacggccgcgatgttaccgattatctgcacagttggaaatcagaatagatatggggagttcagcttaaaatgctccagttttgtcagttacacaacgttcgacatgtgtaatcatccctattattatcaccgtatttttactccctcagtttgttattattcatgatgttccatttattttccccatatttgaacgttacgctggttcatatctgtgcctggagttgtacaggacatcattgcctttgcctagactaaccacaaaagcataagaagaatgacctgtttaatttgccattaaaaattttgcacaatcctatgtttgccatatattgtggtaccctgccggtcttgattcaattccaacaatccaatattgccggcacatttcttgcaaactcttggggtacattattattttatttttaggagctgatcaatgtatgctttaggataagtttaccatacttagggcccctttgattcaaagaaaattcataggaattttagaggagttcattcctatataaatttttcctatatagccatttgaattaaaggaatggatcttatgaaatcctatgaaattcctatggaatgactctttccatgcaagtttcggaggaaatttaacataaggtagaacctcatggaaagaatcctttgagtctttatctctcctcaaattcctgtatttttcctatggcccaatcaaatagtcattcctatgtttttcctgtgttttgcaatcctctcttttacacttgcattcctgtcagaatcttatgtttttcctattcctccgtttttttcattcctatgattcaaaggggcccttaagatattaggagataacatatttttctaagtgtaaaacttgatatctccagatactaggtattacacttaacttttatgtaaaattttgatgtctacaagtgctttcttaagaaccataaaatttctcttttttttaacatatggattttgtctaatgacccaataattctttttctaaaaaaaataagagtgaatttcactactttagccaaattatcagaaacctacagatttgacatgatgtttcataatactacatatttaacattaaatttatcacagaactacagatttaaggtggaatatcgcaaaattacacatttagtaacaaagttatcacaaaactacatgttttatatcaatgtaatcacacaatttgggcatttacaactcaaacataaaattagagctaaatatttaaatcccaaaatcaataattgtttgataattttattattaaatttatagtttttggataaatttatcgctaaatctgtagttttatgatacatcagttaaatatgtaattttgcgataatttaacccatgtatctgtagttctatgaaatttactaaaaaaataattgatagataggaatatttcagtcgctcaaatgaacaagttgactcgttttatgaatattggggttttaagaaatctacagaaaaacaaaataagtatcaattattgaggactttgtaggcattccaattcaaacggaagtcgtgctgttacatttcactttcatgagataaagatctagagattctatatcaatcatggatccattttataactctgtcaaccccaatagagagcaaacaggtaaagtaaacggatgagtgatgtatgtagtggatccaaacaataataaaaaggacacccaaggtctcaattattaatgatgcccatgtaaaacaaacagccacacacataaaacaattctttgctgcaagaacatgccctttcatcgtaaaagaattagcactaattttttggcagaaacttgcacgatcacggctattcttttgatcctaatagtactaccactaaggccgtgtttagttctttggccaattttttttaagtatacggacacatatttaaagtattaaatgtagattagtaacaaaaataaattacatatttcgtctataaactgcaagacgaatttattaagcctaattaatctgtcattagcaaatgtttattgtagctccacattatcaaatcatggtgtagttagggtcaaaagattcgtctcgcaatttgtatgcaaactgtgtaattgttttttttcgtccacgtttaatgatctatgcatgtgtccaaacacagaatttttggaagtttgaagggaactgaacacagcctaatatagaacgaattaatgtcccttttgcccgtggataattcaggcacacagttccaaaaaaagaagagaaaaaaaaatcagtcgcacaactggcaattacagtaattgggagtggctcatgtgctaatctgcgctgagctgtagaggaggataggaacgcaccttgacagcgagtgtcctgagcgagaagatgtttggcgcgtccacgccgttgaggtaggccttcacctccgggatccccgacccgccggccgccggcgacacgaacgccgtgatggacgacgcgaacagcagcagggccaggttggttccggcgaacagccagaacgctgtccaatagctgcatccgacatgagtttcagacttcagactcggagtaacagacagaaattgatctttgttccaaaaattcagtcaattttgagggttcagaattctagatcacttgacagatagcattctcagatttgaacaagaattgatctgatcagggacaaaaagagtacgggataataatagacaaagcaggagacaagcatgagtgaatttgtcgtactcagcaaaagcaacattacttttttcttggacaaggcaataggaggcaatgagcagaacctgctggactccatgagggcggacacggcggtgtgcttgaggccggcgacattctcgacggcgaggttgatgacgaagccggcgatgccggtgatgatgccgatggcgaagcagaaggtccacttgagcaccacgtaccgcacctggtcggctttccctctcgacctccagttctgatcgaacaggtcgttctctattatcctgtaacccaaatcaaatccccaaagaaaaggaaaacgaattagcattgtcgcaaaccgacgaaaatattaccaacaggttacagagctgtgtatattactatattagcaaattggaatggtaattgcagcgagtaagataacctccgcaggagtaggtggatgaaaatgcaagtgggggcaagcaagatacaaacatttctgacaagacaataggtggcaggaacatgacatgtccttgagaggacagctgaatcaataaacagagagcaattggatcaccatacgaaacgaggcagcaacattgagatgctatcccaatcaagaagcaaatcatggaacactattggataagaaaaagcatttcatctcgacattgaatcaacaattcaacatgatggagaagcaaggattgggaaagatcagacgatacaggtggtaggatccagagtccctgacaagaacgaacggagagagaaagggaggcagagccacagaggagagggggcgcgtactcgtaatcgaggctctctatggggcaggggttggagccgaccatggcaacctgggaggtgttgttggtggcgctgcggtggagcagggcccggttgagaggcggccggtgctcgtcttcctccatgaggaggtcctcctcccgtggagccgtgcacgccatgagagagcttgccgcagagggagacgaggggagcagagcatctgggtattgcgaagtgtaaatagcggggagcagagacgggtttgagttagttaggcctggtctatagaccaagatgtggaattattggagtgtgtttattatttagtgtggcaaatgtccatatcaatagtagtacatattattttgtcagcaaatatttcttgccaaccacatggcggaaaaaactatttccttaaattgtaccgaccaaatatgtgccttcactgtcggtacgaacttacgatggataaactatattaaagagtctatataccccactaaactttggtaggaaattcatctagcattcttaactttaaaattatacatccaaccccctaaactttgcaatatcatttatattgtcctctaatgccttgttcggttaatccctgcgagggagagattgaaggggatttattccacatgtattgtggtgtagaattattcctcatcaatcccctccaatattctttaatactctctaaaccgaacaagacctaaggtgttttcggatggtggttttgtgaatttaaaagcataaatgagtgattttgaataattaatataatatatttatatatcattaatactcggttctcaatttatactcgatagtgatatcatagtaatattatgtaagtcagaacaaacaaggaggaaaaaaaataaagatttgggtggagattttaacacatatatccaatgtgtatgccacgtagtcaaactcattcaacgtatatacatattagattaaaaaccacattgcaaaaccacattaggagattatatataatggtattataaagttttggtgaggtgggaggggattaaatatccggttttaaagttgaggactttcaatcaaaattagggagtatttggaatttttcctaaactatattatgtcataattataattaaactataaatatataataaaaggaaattttgaaaactaatttctaaaaaaatactaactctatcataaaaatacaataacctactatgagatgtgacaaattctaatattacgagtttggataggtcccatgtccaaatacctaatattaggatgtgttccatctcatactaagtcgctatttttgaaatatgggaagtagagaatatcatgtaagtttatctaatttgactacctttgatcaaaatttataaatttgatttattttaaggaaaagaagctccctagaaataatgaaaaatttagtcatacctcggtgaaagattgggattttagttttactgagtgagtactaaataaacatgggatttaccatcaattatgataggaaaaaacaatgcacgatcaacactgttaatctttttagataaggatgctttgtgttcatgggaggaggaatgcctaaggtaaaccggaataacctgaatgcaccagttgctttgagatttcctgaacgagtagctagtagtgtatagaccgagcccacaggattctagggagagaacaagagcgtgacagggctgggaggggtaggatgacatgatgagttggcaacccgggctggtgtcttttgccttttgggatgcaggggagccgttgttaattatctcatgccaattattgatttgtcgtggtcgtgcgatgcgcctgggccaggagcatctgggagagacaccttcttttcatgaatactccgtaatagcaaagggaggacaaaataaattgctcgtaaggatgtggtatgggttgatcacttgattgcctattgcagttgtaagagcatcatcaatattgattacaaaatatcgattttccttcggagctagagatggtttataataacgatgaaaatgcttattcagactactgaaagcttgtttcattaatataatatatgtgcgatgagtacatgatgagctatagaaatgaagaaattgtaatatgcactttttaaacttcattattcttttatttgccacaccaatcctatatacctatacaattcatccccactaataggaatttcctgcattgttgtgcagccatgtcacctcaaattagcacagccattagatgaaatagcaatggttcagattgcagtccctctcttccctgcctttaaccacatcccaatatagatgggcaagcccaagccactgcctaggcccaattcgcccattccgattatactgcgtcgttatcactcccgacccccaagcgttcacatctgccggtgccgctaaaatcgtgaccgacccgccggctcctgacctcccgcgcgccttccatgcttcccggcttctcgagactgatcgccttcatggtgtttggagagataaaaactaatcgccgccgcaacttcgatttgtctcctacttcatctacctcgctggaaacagcctctccctcccatgaaaccttcacggcttcacccgctcagtcgctcactcaccttcgagtatattcctctccaaaagtatgtttccttctcttcttaaatcttatatatgttcattcaatttattagcatttattttctttccagtcacgctagactgatttttttcatattgtcagtgaagttatcaaatgattaaaaaacagagagatggatttggtttcgcatttctactagcaagattgaaatttatttggtctgtacacattgagtcaattcatggtatttattcggtttatactagccctgttcattgtatataaaccaattttacaatgtttctacacctataatttgttgtctttatgtattcatattgcagttcatcattaatattaattcctattgcagttcgttcctattactactgcctactgaggtcagtccccagaacactcccatccaaagcagcaactgatttggtttctctatatgagttctctatgaagtaaaaatcccaatatattcggtacctcatattcgttcatggtcatcggctttccagatattattattatatgaccatcctacgataccttctttgtaagaggtactaagcaatttcttccataaaaacaccgttagaattttcatgtgtagacagaaaaagatcatgctatgattgtttcagcaattaacttaatttaggtacatatattggttcctggatgtgcacatgctacccttccttgctatatgatgtttctactttacgttcaggtttgtaagctacagttttatgattgatgtaaccttattcttcgcattttgttctgctggaggttttaatgtagtccaaggatgtaatcacatcagctgatgcaatcaaccacaaaacagaaatgccattgatcgccattggcaacaatacatatagtaatttgattatcctggtgttcaaaactttttctcgacaacttttggatctcagattttcctaacctccatccggtaagtttattgatattgtggtcataaatttctatttgtgctacatattgctttctcctttctatccggaatcatccgccagatatcatattttctctttaattagttcgctaaaattgcagttatgtatctatgtggtatttcagtatgaggtaaaactgacccttttaaagcattttatggaattgtactttcttttgttgaactattgcctttgttatacatgttgcgggcacctacattttgtgtcttcttaacaggatgtttcagctgtagacttgctgcattgcaccaactgcacagaccaaggttagtactttagatggcagcttaattagttgcaaggccctagctacaaaattgattacaatttaatctgcttattccacttagacatggtttaagaatataattcactctaaaaaaactatttcctttaattatctaatctatatatgcattacattataccacagcatcaccaatcaattgcacccatgaatggtactttgatgcttcagattattgcataatatttctgtactatattaatcatgcattttcttagatattacacagttcagattatcgaataatattcctgtactatattaatcatgcattttcttagatatttcacaattgaactattgatatatgtttaagtttattataactatatattgcacatgaatccccgcagcaacgcgcggggtactatctagttattattattatgggtgataaattttgcttgcacacgccactacacacatattgcatataccactagagtgtgtctctttaacacacgcttaaaagttactccatctgttttaggttataagacattttgactttggtcaaagttaaactacttcaactttgactaagtttgtagataaatataataatatttataataccaaattagtttcattaaatcaataattgaatatatttttataataaatttgtcttgggttaaaaatattattatttttgtttacaaacttagttaaaattagagcagtttgactttgatcaaagtcaaaacgtcttataacctgaaacgcaggtggtagatgctaaagataaatatttagtcttcatgactgggacacaacatgattttgaaaagttgaaaggctgtttattttgttttatatttaaattgttgattacatattgttgttcccattaatcactagtgtatgtgtcaagttataatgtttctacaaactaaacaaccattatattctagagaaaatccaacaaatatcattgacaaatgtcctattctaagaaacaccatcgacgaatgtcggttctaaaatatgtcattgtacagggctatttgtcccagaaatgctacagttatcagtgttccatccatttatcttcattaacccatgtaaaaatgtgatatggttaacgagtgaaatggatggaaccttaacaaagatggaatttcgaacataagttggctcatacaatggtatttctaaaagttgcattattatttaaaatgggcacttgtcaatgacatttattatattttctctatattctaaggcacataagccgctcataattggaacaaaatactcctatggagcaacatagggtacatgcaaaactttacatactattagtacatgtaccttggcttgtccttttatcactttcttaatttttggcataatccctacaaaggaagcaacaacaagatatagatttttgatttcttgacttcttccttgaatagctttcagctaatagaagcaacatataattttcaaatgctttaatatatactatcaccggatttcataaaaaactgttgacttttgatatagatcatacctttgacttttgaacatatgtttgatcattggttttatcacaaagttatataactattatttattttgttgtgatttggtttatcatcaaaggtatgacttacaattttttatatttatgaagaaaaatgtaataagacaaatagtcaaatatattgccaaaaatcaacaatattatctattaaaaactagagagagaatgaaatacaaagccatgttgaaaaaaattgcatatagttaaataggggaagttataaaaagccacgataattctatccatacatgttaaggataatgtggcatatggttgtgtcattgtcatgctcaagggtagactcgggcctcaggacactgggctggggcacaaggcctatgattgaaggtccattaggatgaagatttttcaaccatataaacacatacatataaacacatacaagtcccaactctcaatgggctggctagggccttaggctaatcctggttccgcccatgatcacattatctctgttttatactattagatgtgttgattttttataaagtcaaaccttttcaaatttgactaatgttgacttcagcaagggggttgggagcccttcccctctagcatgcaaaatggagtggtagattagcacgtgaataattaagtattagctaaaaacataaaaatggattaatatgatttttttaagtaactttcctctagaaaatttttgcaaaaaaaaaaacacattgtttagcagttcggaaagcgtgcgcgttgaaaacaagtgagtagaagttgggaaagtgtagtatagaacactcataagtttatagaaataagtagtaacattttcaagacaaataaatatatttaaaaaatatatccaatgtttgatttaatgaaactaatttagtgttatcgatgttgctaattttaatatatttaatgaaacttaaagaaatttgacttagaaaatttcaagatatcttatatatgaattagagggagtatgatgcatcacatatggcttatactaggagcatctgtaccagtgatcgagtattggagcatgagggcacttgacgtgccaaacagactaaaatccgacgacgatggagcctataggaaaccaataaaaggtggcatctaaagagaatatgatgaggattgctagtttgcgtgtgtgtgtgccgcaaacataagtcacacatgtggtgcgtccctaccgattccgctccttgctactgagtagagaagcgttagctttctgctaattgagaactcatactacgttcaaaacatcaacttgtgccataaactttaatctcaaaaagtcacaaactttcaaatcaaataaaaaactttcaattcaaatctaaaaccttcatatcaaaatcacaaaaaatctcaattaaagtctaaaacgaaaatctcaaataaaacactttcaatttaagtctaaaactttcatatcaaaataataaaaatgtttaatttaaagtctaaaactttcatatcaaaatcacaaaaactttcaatgaaagtctaaaacttttatgtcaaaatcacaaaagtttcaaatgaagacctaaaacttccatctaaaaatcacaaaaattttcaattcaaatctaaaactttcatcttagaaaatacacaatactttcaatacaaaatctaaaacttcaaataaataccaaaatctatcttctcttctagcctcagccatcgcccttccagccccgtagccacgagcacatcgcagggtgcactacctatgctcctcctactctgaaaaggttagcacgatcccgatgcggtacacaatggcaaccgtgagagagacgcggagacaaggagtccccatggcgggagcaacgactgccagcgaggtaggattttcacaatgaatatacaagttaagtagctcttgctggataataaaatgaatgcttatagtatgtagaaaaaaatggtgttttagattatgaaagacaaatagtgctttgaactttaatttccactcaaatggaaacatctaattaattaattagagtatggccctattaattgttggactagatcagttgtagtcacatatataacagtttgagtaccataccaatatgttgacttgatatgatcaacgtaagaattccttagccttgatttgtggtttgttgatatactgatgatattattgtatgatagtactacttattgtgtgtaagctcatggttcactacccacactaatctagtggttagaaaaccgactaatactagctatcggtcaatcggcattaaccgtgtcagtttgtaatatactggccataaacctaagatgatggaattgcatgatatatagctgtctctattgctgttacttgcttcgtcgttataaaataattaaacgtaattctagcatttaaaatttactccaccaaaaaatataattctaacttatagagggtatcatgttttttacttattattttagatatggatacatagtctgtaaagtaaaaaaaaaacccaacccatcccataatacaacaattgtagcataagtataaattgccacagccaatgagccatcgctctcaatttctcattccctgatcaatctccgcaaaataaaataaataaagaatagccatacaataataagattagtgctgctcaattattatccgccctgctgctctgctattaccgaaagctccatcttagagcaagttcaatagtatagctaactactaacttcaattcatctatagctaatctaacagctcattcatataatagttacatactacactattaatatctggtcccacctgtcatacataatatgtgtcttggagtccgtgctatagctggctacaaatttatagcccgttgcccttttctctcctcatttatctctttaaaatatgtttgcagcctctatttaaaatatgtttgcagctggcttatagcgtgctatttccactgacatctgtcgccacgaaaacgtggcccctccggcaaagtgacacgaaccaataaatgctaccatcgcatccttttcctccgtacccatcgcaagcaacgagccaaccggcaatgtagatattcaacgcacatcttcaagcccccaccacatcccaagcacgcgatgcgagatccacccactcccactgatatgtgggcccgcgcgttcaccgacaccccactcctcaccctcacgcaaagttcccacacaacaggggattaaataattgcaaatccgaataataaaagaaatataaaaaaattggaaaaagagaaatagaaaaggaagcgcaccaccgctctcggctcgccttcccttggttcccgcaccttctcctccgcatcgaggcaaatcaatcaatccaatccatcccacacaccgcccatctccctggcgggcagcctcggcctcgcgagggaggggaggaggaggagagtggcggcggcggcggcgcgccatggcgttcctgctcggcgccttcctcgggctggtgctcggcgtcgccgttgtcatggcgttcgcgcgcctcgagaacacccgcgctgagcagcgccgcgagctggtacgtacgtgtcgcgaaatgaaatcctcccaattcatttcctgttcgtgccggggtagcgcattgattcgacccagtccgatacccgccgcgggtgggtgtcggtagtgattgggagctggtactggtggtgaattgcgaatttgcgagaggtgttggttttcggagaggagcgtggagggggaagttgctggcggtgccaaactgtgagcagactggtttggaacgccgtatgccgccgtaattgctaggatttttatcctaatcttcctccttgccaccaactgtgtatgttatgcaatacgtgggccgtgggcatgatggaatcggcagtaatgatcattagagaatttattagatagtgcttaatatggcattataccgagtaatgattgtttgcaagatgtcgttgatcttgcttccgtgtgagttgaggtgattagttttgaccaggccacccgatcatgcgggtcaatttaattactgtgatttgatattgttttagtttggtttatctgagtggagaaaggacatgatgcttaattttggaaaattattgtgtaggccaccccggattttcctaatatcatccgccatgtggcatactcaaacttgcccctttagtttgttttgggttagtttattattgaaacagttcatttgaaagtagtaagattgaaatctcatgagtaaaatgaccactgagtaagtatcacaacttataatagtcaaacacaccatcttcaaaggctgacatgttggttctgtttctcaacttcttactattctagtatttttatagagtagtttctcaatggtagtgtatctcagtgaacctcctcaattgtgctgtacatggataacaatgctgcatattgtgtgtcagtgttcaccaacctagatagttctttaaagctcaatcctcgttggtgccttcatagccatatgttctgttgcaattgcaaaacaatggaataaacctgtaattggtttaattcttatgagttctgaacctctgcaattattcatttctgaagttgctattgctatgatcaacatgcactaatagtatgtacagataaaccaggaaattaaatcatctgaatttttttaatgtatctgtcatagtgagttttgacagtatcttctgatctatttagtgtagtatctgcatgagtatatgatttttctaactgataaggtcataaaatgtgcattattctaatcatatatagttcttggatggtacatccatatggttgtttgtcatttatttgcagataagtgtcatttttggctcatgcacacatattaggtgtacttctattaataaatgtccagttggcattgtggtggattatgatagtctgatttggttcaatggcttctagacattggtgtttgaaaaactgtttctatacattggtgtttggtaaccataatattattgcattttgaaaatttggaacatccaagagagacatgacagctagatcatatatttttgtctaaccttaatttaattcataaaaaagtctataatgaatataagctctaattttcacaaaatcttaaaaacaagcactgcacagaaaaaacaaactaagcataagtccttacattcacagttcgtaaagcccaactgggtgtcaccatggtgagatcacctgtcaactggttagcatggctggcttcatgaggttttgtctgagaattccatccattccacatatttctagtattgtcctatattaccatataattgccttacactaactgcaattaagaacttcaatcatcatccattagagatccaaaataaaatttgcggataatggtcgtacacccaaaatttctttatctcaccccttgcaaaaattacattgccagcactacaagccatagttccatcccatctcatttctgagcgacatgacttggtgacaccacctccccttatctgcaattgttgctgttctctctctttctaatgcatctccactatgtgaaatcattgatgtttcccttcctattcggcttcccacgtctctattcaatatcatgcttgagtttgtcacgtcttcttgaattcctgttggtttatcacgcataatggccatacatgtgtatctgtttgagttttcaccaaatatggcaaagtagcagccgcacgaggccactacgtggaggatccatcagcatttgctggctgtgcctccaactccaagggtgtcaacggatttcatcaacagcgggtataacttgcttagttgtttgcaatcttgaccagttcctctgactagaagctgccacatggcccacatcattgagtgctccatctccatcttcctcaattcaacaaaatacagaaatgatcttacctactataattgttctctgttgcaccaatttgctcagatcaatcattacaataaatttttggcagcattgcatccgttttccactggtttttaaaatattacattgtccttaaaacatcttataagttataagcaattggttttccatgccacggaaattgtcatttgatgtaatactattttaatatcttctttcatttgtcattagatgcattttctatcatgcttctgcta

SEQ ID NO: 69648 - DNA, 23471 bp, Oryza sativa
ctccgtttatctgttttatattatataagtcgttttaactttttttcttctagttaaacctttttaatagtcaaacttctttaagatgtttttctgaacatagaaagttacaaatggcatgattcaattaacctttttttatcccctcatttcattgctctgctaccttcccaatacttctatttttttttctattttttattgtttgtttgactagattgctttgactatcatatgaaagtatctgcatatgcatgggaccttctcatctagaattctcctgacatgtgattggtatacacgcaaatgatccaacggtctatatttattcctactctcatcctaaggccattagtattccagatgacatggctcatcattttttgagacagcttgttgctttcacatatgtagatgggacgagttggtttttatctttctttccaatgttaaatttatgggcgagttggtttaataagacctttttagttgataaaagtaaaaataaagagttatgaagttgtagtatttttttaagaactttcaattttgaactaattcatagcaaagattaagatatgatattttacggatttcctatgctatgcatatttctgtttgttacactattcttattattatgtaagctcacttaacttgagcatcacgtttgtaatgttagatttaattgggtaattgatccatttaaataaattaaatcaaataaattccaaggctcattatgctaggaattcatgtgtattcattctcttatgggatatcaatgggatgaagagttttgagaattaatccatttgattagtgaattggtaacctacatcaattactcctaattaatggttggttgatggatgtgtagtggaggatggttgatggctagttgatgagaattagttactctattgctcttcctattccataactcttactcttcatcttccgttcctcctataaaatgagaatggatttgatctcccgcgtgagagaagagatatactttcatccatttctaaggctgttgctgctacggtaatcccatcccgacgagtgtgtacacacgcgttgggagagtaggcctccgaaactacgcactgctgtgatgtttgcacggacgggagggcgatcaggtttttggggagcgtaaggcgcgactactcactgttcgtcaacgtctacatcgtcttcaccaacatgtcgaacactggagacaacagcaacactggagacaaggagaaggaggttcccgtcaacaccaacggaggaaatatttcctcaaactccagcggagggccatttttagggtataaccttcttacattagaagttttactgttaatgttcatcgcaatgtcaacattacgttattatatgattgttaatgcttattctacgttaagcatgctatgttgattacattcacaactatcactggatcaaatcccattgtaaatatcatgtttattatcttgttattttggattaaaatataccgaattatgaccaaatttccaacatgtaattccaagtcatctatttaaatccaatagttgagtttttttctatatcgatcatcatttcaaaatagggtgaatataaatttcatttttggagtagaagcaaggaagaggtggaatattacaaagagaaagggtaccttataaaaaacaaaaacaagttcttgaaattggaatctattttttttaaaaccacccataagctcccttatatatttagagtgatccctatacttaatgattcacgcagtagatattgactaccgaagcaaaaaccctaccagggacaaaatctttgattagaaaaaaattgttatcaatatggatgatactataaatgagaattttcataatttaactgagccaggccaccaggaccatgttagagaaaaaataacggttatggaatgcacataggataaaatatactctattcgttccaaaatgtagcaatctaggatgagattagacccatcctaatactaatttcatcctagattactacatattagaatggaggtagtaaaggagcttgaattgaattgtgatgatacagaaacccacaattgtacttatcattgagtagtactccctcggttccaaaatagccattgacttttacacggtcttcaacatatagaacttcgaacaccaatcttattcatattactacatctacttttgatatgtatatttcgaaatctgaaaaatttatttttgataggcatatttcaatccaacaacctatcttcgtaatgaatttctcggacttaatgcgtgactctccattctttcacatgagattggctacatgggtatagagaaatgtaaatattaatgaattgcttgtttgcgaggaataactagtagcatgtttaaatggatgataagtagaattacttatctttgatctgtgtgccaagatgaaatatgactatcaaaagtagatggagggagtatattataaagggttaattggatccatgtcattgcaaaaatgccaatttcagataaatttcactattattcacgatatcgtatacatgccactggaatttagggaaattggaactatgccactccgtcacgatatctatcaaaaatcttgttagcctcaactgcacatgggacataacaaacatgttctatcttcttcacctccctcccctctcttctcttttcccaccctctctgaagtctctctttctctggcactcatcatcctccaccaccgtcaccgtcaccgccaccatcgtcgaccaccttcatggctccatggcatcatcctccaccaccgtcgccactaccgttatcaaccacctccacggctggagggctcgggagccattgccgtcaccgtctcaccgaccccaccgttgtcgtcaccgccactatctttgacctcctccatccacggcaggaggctcgggaaccactgttgttgtcgttgttttctttaacctcctatccatagcgcgagagctcgggagccaccatcgtcgacctgctcccatcctcgtcgggagggctcgagagtcactactgtcctccgccatcgtcgctgccgtcttcgacttcctcccatccacgccagagaccttgggagccaccgtcgtcgacgccaccgtctttgacctcctcccatccacgatgggaggcctcgggagccagcaccgtcgctcgtcgacctcctcccatcctcggcgggagggcacaggagcccgctgttgtcatcttcaacctcctcccatctgcattgggggggggggggctcaggatccactgacctcctcccatcgacagcaatttgccgttgcaccggccatgcgcgccgcaccattagcctccctcgttggtgccctcctcaccggcagccacatttgaaaacaagatgagagatgggaaagaaagaagagggaggatgaaggaagaagatggaactgacatgtgggtcctacgtttaggggtattttggtcaatatgatgacaaaaaaagtggtgatgatggcataattttaattttgtgcatattcggatggcacgactacgaatagatgaattacagtgacatttaactaaatcggtatatttgcaatgacatagttccaattaaacctattattaataactagaaaataatcatcatatgaaactactttcaaatacggatataataatatcacacgtatagcactaatcacatatagtgttactttaatttattagttacagattgtaaaagttgattttaggacggagatggaggggagtatatactgatttattttgatcgcaaattacgtcttgccttcagctatgccactgcagctagcccacggtatcggacggatccggtaaggttgccttgcctctcctcagcaccgacctggcggcccatttgttgccattgactagcgttcacccggccctggatccccctctcccatctcccatctcaccacctcggccgccgccgccgccgccgccgccgccatcgccgcagcgatctgtcacaatcaccaccgccaccggcaatgcccaccgcgtcataggtcgaggcgcgccatgcccccgccgaccccgctggcccgcctcctcgcggccatctccgccgccgcctcctcgcccgccgacctccgccgcctctcccaccgcgtcctgtccccctccgcgcctcttccccctctccgctgcctcaacaccctcctcatggccctcgcacgccaccgtatgttcccggacatggagtccctcgcctcccgcatgcccgcccgcaacctccgcacgtacaccaccctcatcaacgcctactgcctcgccggcgacatccccgccgcgaagcagcatctcacctccctcctccacgcgggactcgcgccggactcgtacgcgtacacctctttcgtccttggatattgccgcgcagggatgctgacgcacgcctgccgggtgttcgtgctaatgccgctccggggatgcctgcggacagcgttcacgtacacggcgctgctccatgggctgcttggcgcagggatggttcgtgaggctatggcagtgttcgttgggatgagggcggacagctgtgctccggatacccatgtgtacgcgacgatggtgcacgggctgtgtgaggctggacgaactgaggaggctgaggtgctgcttgaagaggcaatgtctaacggatttgagccaaatattgttgtctacaatgcgctgattgatggctactgcaatgctggagaaatggaacatgcacttaaggtcttcgagggcatggatggcaaccggtgctccccaaatgtgcgaacatacaccgagctgatacatgggttgtgcaaatcagggaaggtggaaagggccatggtgctgttcagtcggatggttgaggcaggtttggagcccaatgtagtgacatacacagctttaattcaggggcagtgcaatgagggtcacctgcaatgtgcttttaggcttcttcatttgatggagactaatgggctggttccaaacgactggactttctcggtgttaattgatgctctctgcaagcgtgagaaggttgaggaggcccagttgtttcttgggtctcttgtcaagaagggagttaaggtgaatgaggttgtttacactagcttgatagatggattgtgcaagacaggaaagattgatgctgctgatgaattgatgcagaaaatgatctcagaggggtttgtgccagatgcccactcatacagttcacttattgatggattatgcaggcaaaagaagttgtcgcaagcaacattgatgttggaagatatgatggagaagggaatacaggcaagtcctgtaacatataccattataattgatgaattagtcagggaggtaggatcagaaggtccaaagaaaatattcgacaagatgatcgcgacaggtatcaatcctgatattgtaacgtacacagtatttgtccgctcctactgtgaagaggggagaatggaagatgctgaatccatgatagttcaaatggttgatcgtggtgttttccctaacctagtcacgtataacactttgattagagggtatgcaaatctaggactagtcagtcaagcattttcaacttttgaagtaatggttggtaaggggtggaaaccaaacgaggactcctacacagttcttctcagacttgtggtaaagaaaagttcctctgataactctgttgatatatggaaaatagcagacatgaaagatctccaggtacttttggaggacatcactgagcgtcagttgccactagccgccgatatttacagttgtttcattagatgtttatgccgagttgacagattggaggaagcaaaacatttttttatggggatgcagaatgctaacttgacccctagcgaggatgtatatacttcgataatagactgctgttgcagattaaaaatactaacagatgctttgacattgcttgattcaatgacgaaaagtggttatttgccacatttagaatcttatagaattataatttcttctctttgtgagggaggaaactttcgcactgctaaggaagtttttggtgatttgttactgaaggaatccaattatgatgagattgtatggaaaattctgatttatggcctattacagaagggcagtgttgctgagttctcaagtctgctctccgtcatgaaggaacatggttaccaacctagtaacacaattaatgccatgattacaggtgaaataacagttacaaatgaagttcaggaaatcgctagataaatttggagaaactaaccaactgttgtgttgatggtctacagcagaaggtatgcatcttgatttcattttccgtccagttttattttggtaaatatgttcaagttatactgcggtaaagtacagtccatctgtaacaatataaaatgtaagaactatatcgttggtgatcaaatagttatttactaatttgagagaaaagtcaacacgaccatttgctttatctaaacaggatttctctgtctcccccccaccccccaaaaaaaataattattctaagttaagtatagcttttttacatgtatctatgttttgttgaaaaataagaactccaattaattggcaaaattggttctgtagcatcgaaagtgtccactttcagttttatagcactgaaaagttcacggttcattttagggcctgtttggtagagctccaactcctaaatttagctccaggagttgggtctagagtgaagttgtggagctgcctaaacccagttccacctctctagttcattttgtgagagagctctacctagctccgctcccatttcaggtggagctgaaactgtttggctgagctccagctctaagagaggtggagctggagctgtgccaaacaggcccttaatagcatcgaaagtttatctccgttactcccactcctttagaactgctgccacttattcctcttgcccttatgttttcttcctcctccacacaccctcttcctaccgttccttttgcacaagaaatcaccatggtacagtggcaggcgggctggagggtgacatggtgaacgatctcggcagcaactgtggtggcagctgacgtgctcgattgtgactggggagtgaactcgagggcagctgcaagaacaatctggagggcagcagcagtggtgtttgatctctgggagagagggatggagccgtggaggcaagatggcctgtagctcgagcacagagcttctgttggcttgagcgtggttgagctgccaagatgttggccttcctcgagcactaagcacctagtgtggaggaaaaacgcggcgcttccgaccatggccgattcgagtgctctagtgagaaaaaaaatcgaattttttaattttgaggggcaatgttcatgaggatgagaggatgccaattgttaaaacaattttgtattggttgaggccttgaggggagatcgagtgagttggaccaggatgtccagatccttctgttcttttctccccatcaaaaatgaaactcagattgttccgcttgttgtgtgggcaggtgtgcaactcaacattgttgcctttctgtgcacagtgaagcaacagatcctcatggactacttccatttgtggcatcagcatcgggctcagtcgagccaggcgcagtaccgtcattcgagcttgagaacacgtggacatgcgagtggtcaagctcatgggcatgctgacggccatcaagctcgagcctcgaggacggtgtccggctagcattcgagcttgagaaaggagagggggctggaggaggaagaaggaggaaaaggcacggctggtatttcacatgttgtttttcgaaagataaaatgaataccaaagaaaattgaacagaactttgtacggaatgctgaatatgagagcaggttaactttcgatgctattaagtgaaacgcgaactttcggtgctataaaactaaaaactggaacttttgatgctgcagaaccaatttttccttaattaatactcgtatctgattagtactaggcttaatagtcatttgtaattatatctttattttttatatttctacctaattagcatccagtcattgtagttcattctacaccctggaaagggcaaaatttgacattcttattcctacaggcgttcagtatgaaatggcaactaactataactggcacttgctcttgcagttggttatgtgtcaatccactgaagcaagcgggctatttgagaagatagggtagctatactttcagtggctccagaaactgctagacttggatatgtgaaattaacatccattacgaatgatctgatcccggagctagcattctagttaaattgctgtgactggccaaataacgatcggtacatactcaattctattgagaactcaacttcatcaaaatttggtggaagagctagagcaattttcagtcagtttgcacacgccaaggtagctgtgatcacagggactaagaaggtatctttgaaattatcatacattctatgttatgttttattcccaaattgttgattgctcatgttacatttgtgatgcacgttttgtccgattatcttattcttatcacccatttcttcttgattaagattagtcacacttaatttaattaagtaggctgatattgtcatgtggggccagcactatatctgttggcaccacagccagttcaaccatggtgcagctgcagaaacaggggtgcactcagcccccttggtatccttatcagattagaatctatctgttaaagagtttcttggttacatttacctttgttgagatattagttaggatatattagaacacacatagagttattttaggagatgttagctatatatgttagggcctctcctatataaaggacttggcacatatacctggacttaatcagatagaaaacagaaaacccaaatacctctcgttctccttggcgcatcacggcgccatggcgataggactctttctcttgacctcccacatcccacgacaacttcctcctcccctctaatccccaaacacatgagccgctgactgatatgacattgtgtatcacctgtgtactaaattgtttatctttctcctttttcttttcctccattatctttatttttcaggatcaatttccaggtcaaaagagatatccatatacattatatatccagaagttgaagtgtaattgcttgtgaaaatggttcgcaggagactggaacatgatgaaattactagattctacttttgttatggtgaagaacatatacatagaatgatggctgagtatgttctgagaaggtcactccaaaaataactggatgtaagttccatttgctgattttgtcttaagtagatcacctcttctttttttttattatttatttcagtttaattgattttacttttttttttcattcagcagatagatgaggtgatcgactccttaaaaatgctacagatgtttttcatggtccatgcactgactaagcttcgtttattttcaaggtaggctgggcagtaccttaaatattagaatggtgattattctatccatactttaattttaggctttagggtgcaataccatgatcaaaatttacaattatcataattcatctctgcgttattatggttgctcattatgttttctattaatactctcctagttttggaacctctgataaaaatcaaaactactccaaagatgaaaatactactatgaaggttgactttctgtgagaactaccgttcatagtgattgtgcatttacccagtccagatggagcgattggtgctgtttaaaatgttggtcaaaacaatccaatgtacatacaaaatggtcagatttctatgaaaatatagttgtcataggcgttgggcagagaggccgaggcccacgaggccaagtcctagcggataaacagtaccacgagtactgtagcagttggttaggacataggataggattagatagagttagtttgagttagtttcttaagggtcaagtcatatcatctctatataagggatggattgtattcatctctagttaagcaatgaatatcaattagtctaatctctccctcccaataatattcttctccctagcctaaatctacatcccttctccaggagccgacgccgcccggctatcttcccggcggtgtttatcccgtcatggccttgggtcatgacaatagtttggtgtctttttaaagaaagatacaatattgcccttaatgaactttcagtgagcagctccaggagtccgaatcaaaggccttgttgatccccagcgccccatacaaagaggactttcctaacagttgtatataagatcagtccaaataataacactgaacaacttagtaataaaaaacttccctagggaattattgatgctgtcatgctgcagaaccatgttgtacactactctgagcataggtttcccttgatatatcgcacatgagagtcagattgacaaaccaagtcattccctggtcttgtaatctctcaaaattcttttttgcgcaatagtgcatcactgtgtcatacatttttctgatagcacctactccctccatcccaaaaagcattaacctaggaggggatgtgacccctcctaggttgattctttttgggacagagggagtagataggtaaataggtgcagatccttcataaaaaggtgaaatctacaggagagcaattgattgcatcataattgaccaatccagtggttgattgagatactttcattaacttagataattattttttattttgtttgatgcctgttttggtttattttagcttgttcatcaaattgaccaatgcttgctctcatccattatgccacttgtatgacagacatgttggtgagttgtcttgtcagtgaaacaagagatttgcaaatatgcagtggcaacataaggcatttatccgatggggttgagatggaccctatcaggatttgtcaacagaaatttcttcctagttcacctagcaaaggctaacagggttactaatcccaggagttatggcattttgtgttcttttggatcctcattgcatttgtatgtaggttgaaaattttataatttttttttctaagaagagaggtaaaattcaacgtaatgcaaaaggagtaatgtctcttggtctgggtctgagtattatgtctaaatctggggttgaaatgtggcttgggcactgacacactgaaatgcaaaaggagatgagaactgagaagttctcccattcaagctgctggttcagctgactccggcacatgccatggtcatggagcccaatcatatcagaaacactgagtcttaataggtgttcagaacaaatgtccgtgtgtcatgattttttcacaattaggtcactgtcattgtgacaatggtagaagtaaatttagtgaaggtgcaagtgagacgattgtgactaatattgtgatgaaaacatgttctatctatgttactatgtgagtggtggtttacatctgtatctccatgggcaataccacgttggattttgtaccttggatggtacatttaacaattttaggggtattaactttgcattttccaagttaatggacctagattacacccatgcacaaggaccgctagtgtatttttactctagttatgattgagcctgtaaagaattcaatttcagtacattttggtgctcaaaagatattattatattaaatacattatgaattcctgatattgtataatggataaatagacggtatgattttaagtcaccccatgccccactgaaagatagctagagccgaaggtggcagaacttcatttgcatgaactgctctgttgtatcagtggcttagtgctgatcctactttgctgagttcggtaggacttgttgggaacaaatctcctccgcacagaaaacggagcagtccattagcgcgtgattaattaagtattaacttttttttttcaaaaatagatcaatatgattattttaagcaacttttgtatagaaacattttgcaaaaaacacgccatttaacagtttgaaaaaacgtgcatgcggaacatgagggaggggagttggaaaaacatactgccgaacacagccagtatatggcagtcctaggagcaactgtttgtttggtatatgctaaatcatagagttgtattaattgattactaggagaagaggatccaaaataggcaaagtactgtcagacattttcacttgtctttcacaactaccttgtccagggaattatgtgtttcacttttaataaatataattttccaaaatggcatcagaatttagtaccaccaataccatcttttcgttcattggaaagcctcatactagtacttgttagtctgtatttattcttttttgtttatgaccactgtaggggttatatgagcatgttttatctttcgcttgtgcagagtttcaagatatgtcatgaaaggcagcatgatggaatattggcccccattttgcagaacttgggcgaggttcttggaaagttctgaacctttgcctatatgaactctggggaagttagtattaagctctatatagtaaatgatattcacagcattcaacttgtgttaatagtttgcaggcgtggaatattctttttgaccggaacatggactaattatttgacaattgtatatagagattcaatcaatacattcttgacagaaataaatgcagatagtggatcataccagtttgaataacctagtcgatttgaaaatgcatgatacaataatattttgcatgtcataccgtcaggaatgctatgagaaatccacttcctgcaaaattcttatgaaattgggagaatagctattatggtccctgaagttttgctccgagaatattttagtccccgacctttcaaattgtccaagcaagccaaactttatcatgtggacatatacagtccttggctcttcaaaaattgccatgtgggcatgccatgtcatctttcgatgcaaatatatgatgaaatgcccaattttcccttaaacatatcatatggaaaaacagagaaaaaaaaggagaaaatacaaaaaaaaaaggtgatcttgcatattaaatatccgttagagttttaacattgtaatgcaactacgtacatggaatttagttggcatggtaattatatatttagtggttgtagctaacttaactttgtagtagtataatccagtgaaaaaagttagccacatatccatagtcacattgaacaaagtttttaaattcttttcattatttttgtatggtatatggaagggtaaattggacatttcaccatatattttgcatgagaggatattcacgtggcaatttaagtgggcccaaggactatattagcccacgtgacaaattataaggctcgtttggacaatataaaagattagggaccaaattgatctcggagcaaaacttcaaggagtatatgcacgaccctaaactccatatatcagtattcgtcgccacctttagggtttaggttttgcttagattaatatgtcaagaatagtttcgccgatccttcggtttgtaagtccccaacttgtgagcttaatcattcatctgcaactttggttgcattctttatcgctcttgtttgtgttcttcgatttgcaagcagggattaaccttttcggcgaggtcagccaggtttcgacacagttgataaccagaggagacgtggtgttgcgattgcggggctcaatagcgtgtttgttcagaagccagatcgacttgtgttgcgacttcaccaaatcaactgtttatcagaacctttcagaagatcagaaacccttgtcgacatcatccacatcctcgagctagcccggatagcggcctcaatgaaccacaccccaccaccaccaccaccgcaatccaccaacagctcgccggaatccatggagactgcaagcctcccggccgtcttcgccacgcgttgcgcctccagcatgctctcggtgtgttcctaacttagggccatcaccacggcttcgccaccctgtcctagaactcggggaggaggccgtcgatgaacgtagacttgaggaacaagtcagggacgtccgcgcagctgccgccagggaactgtcgaggacgtccgtgtcgcatgcagcctccattgcgccgccccgtcgctagctacctgggaaagctccgcccgcctccgtcgccggctgcctgagcgcgcgcgcaagaaaaagaagtagtggactggggaggtgttgggctgagggagatggatgacagctaggcctagggaggtttttaaatttttttctgactgaactgccatgttgggagtattagtccggtataaatagttgcgggtgtaaaatatctggtatatgaatttaaaggggtaattctgttgaccgtgatagtttaaggggtaattcgtattttttcttttttttaagcattattaagaacaaacccgcgggtatactagcttcttgcgttataaattcgtatctccttcggttttctttcattaacaccatcaaaatcaaatgtggcatcacacgtggggcccaaattaaaatgggaagacaaaataagttcaactaaaaccacataacctcgagtccgtgcaactactatatttgcgattaggggtgaaaacggtacggaaacggacggaaacaacctttatcgttttcgtttccatatttttttcgtaatcggaaaccccggaaacgaaaacggaagaatgttatcgaaaccaaaaatggagcgaaaacgaaccggcgcagatacggtaaagaaaatttatcggaatacaaaaacccctcaaactgagcttcaaacttttgtcaagatcaattctcaagccttaggagtcaacaattcatcataaaacacaattatatgaagtctaattgttaagtctcaacagcaaaatatattcttctataacttgataacttcatataatttgcataacaaatattctaaaaaaatttcagcagaacaccatggtataaggtataaagtatacactgttagcccgtagcccgcagcctctctctccctccatgggccggcttccccttcccctcctccctcttcgggccgccggctcagcccttttgctcctccctcgccgagaagtctattttgcctcctcctgaattcaaatattttttagggtagtaaatgatttcaaatgaaaaaattatcaataacaaagttgtataacttatcaagatcaacaacttttgttttggtcattttgctatatgactttgtttcaataatttgaatttgaatttcaaattatgacaacttcagacaatattttcaagtactaaatgatttcaactgaaaaagttatcaacaataaagatgtataactcatcaatatctataacttttattttgtttatttcttcatccgacaaagtgatagtaacattgttcacaaaatttacatatatctcctatagtttataaactatataagagaatatacattttgtaaacaatcttataaatcactttatcggatgaagaaatgacccaaataaaagttatggatcttgatgagttataccactttgttattgatgactttttcagttgaaatcatttagtacttgaaaatgttgtttgaagttatcataatttgaaattcaaattcaaattgttcaaacaaagtcatatagaaaaatgaccaatactaaagttatatatcttgatgagttatataactttgttgttgacaactttcccatttgaaatcatttactacccgaaaaattatttgaatttcttatattttaaaattcaaattttatatagtccaatcaaactcggatggagaaatgaccaaaagaaaattggtagatcttaacgagttctacaactttatttttgacaactttttcacacaagtttatttaatatcataaaattcgattcaaagttttaatattttgaaattaattgtttttccctcctcctcccttcaaattttttcatctcctcttctctctccctatcctgatatttttacctctactcactctctctctttctatcatctcccctcactctctttctttccttaactctctttctctcctctccattcctcctaggacggcggtgacgggagctggcggcggtggcagcggcacggctcggctgccttgggctccggcctggagctggcggtggtaggggcggctcggcctggagctagcggcagcgggggcggcgacctcggtcaaagagtgggcggcgacctcgggcggcggcaccgccatctcctcctcaccgccgccgccgacgaggaggaggaggcgacgggccagatccggcggcgacggttctcgtcccgcccggatccagcggcggcgggcctcgtcctgcccgaatccgacgggtctcgtcgggcggcggcgccaccaccatctcctcctcacctccgccgtcgatgacaacgaggaggtggggggcaggtggcggcaagagcggccggcgagctcgggcgacggctagggtttctttttttgaattctttttggaattttatttttttttcacgatttagtgtgtggccgtcatcgacggtgtggccagtggctggcgtcgtccgtgttgtctgtggtggcggcggcggcgaagatgtaacatcccaggttttagctatagttttagtcacgctaatgacttgatcacactggctgagagtggtgttgattgggccacgatgctggctaggacatataaatatgttgattgttgttctattatggatcttaaatgatttttcgatcgtttccttgtcatttatttatcaagtcatatccatatgcattattgatttatttttagttagagtaaacctggtgaggagtgggataatttagttttgggttaaactatagcgtggattagtcatcacaaagcaaggtacacgtgcacagtagaaatcacaactgaaactatagtaaattattcacaaactatctggttatcggttgcatgcatgcgatacatacatacataatatatatatccatgcatacacatatccattatagatattgtacatatgcatcttatacattgtatttatatacaacattaatgtataaactcacacgccatgcatacaagttaaaatacaaaattaaatgtattagaaaatgtttgtgtgatttatgatcgcaaatttaaatttaggaggtttgcattctagaaagtcgaaatagtaacaataaacgaatatttttgagttgctacaatttataattttgcatccaactatttagggacacaaaaatctacaaactgagccatctcaagccaacttccaaaattatccatttttgcatacaactccctgagttctagggcaattattaatcagtcccttaactctggagtaacctccaaaattccaaaagcttatggactggaatgcaaaattactaagtatcccaatttcaccagatttccattaaattgtaaattagtgagcctctcaaaattattccaccgaacatgccctggtgaggtttcaaagctagcagcagccatgtggtccaagcaggtgaatcaccagcaccaaatgcactgagataaagcataacaatgtgaattatccacagtctggtagagccagccttggttgcaacgatagacacctagctacagctagcaactcccagtagtacagcagccatagtagtagtaagatcccagcaacagcaagcagcctcggctggaaatcagtggagattgggagaaagagaaataatcacagctagtagatcagtagttcaacatctcaaccatgcttcaccacagccgtagcagccttgtgtgtgcagccaggagaggctagagtgagtgaatgagaggtcagaggagtagtaggagaagcaagaaggagcagcaatcaagcaagaggatcaacaccaggaaaagcaagggaagtagcagatccagatatcaatcaagattttcacatatcttaccatgtaaaccaaagcagcaagaagatgctgaagtgagacagcagagagaccaacctgaagaaggagcaagtggtgttctagcagagttaccattgatccagaagagcagcagtagaagagaagacttgggtttctgaaggaggggctgaaccacacatttttcaatcactgtagaatcatcagaggtaaccaaaaattaaaataggggaggagagtagatcctgcatacatagtatcagcatttgttagaactagagtttcatgcagatatataccatccatcctgaccaaaaaccttagtaattctaaatggttaaaagtaacaaaatttggggataaagttaaagataagtgcatgtttttaaatcctgacatatataaattatcatagaagaaatctgaatagtaacaataaatgcctgtagatataattcttgaataaaatcaactggtgttcatgacataaattatttaggaatagagcatatatagaagaaccaaatcatgcatgtgaacttataagctttcagatcctagtcatgtaaacagggcataacattgacatgtgcatatacagatatagaagatgagtagtgtgttccagtaaaaagaatcaaattgggatgacaagattaatgagtagaaaaccatagatttctacagtagatagtctatagcaactgtttagatttagaacatagcatctggataagttgcatatatctaattagttagaccaatagtttaattactgtcctcatcaaccattgtaataaagtaaattataaattgggttattaactactacagcatatggagatgataaacagaacacaagaggcagtagcagtagatcatatagaggacaaaattgccatctatttgtattcatgataatgttcataggtgataatttaattagttatagtacagattttctcatgatattccaagtgtagaatcatgtaattttcagcatcattcaacaaagtttattctaggatctaattctgttactatgtcacaaatttctggaattgagttatttcatcatgcaagtatatatataaggacagaattatgctaatgtgctttctatttcagtaataaaattcataggtttattcatgtgagcattcatacatcatgggcatacaggcatcatccaatctagcaaatccaatgacctagaaccctagagtcagtaatgacaatccatatcatagagttatcgagttgaccattaggattaatttacaagcatctttagtacacccacaatcatatatcagtagtacaaaagggaataacaccttaccaatataaacactagaaattagagggggagaggaagaagtagagacccgagagcacactcatggggatagaacagggccgccggagttgcgcagtgcttggcaccggccatctccacggcagcagcggctattggagaggcgagggatagttagggtttgaacagggaaagagaggaaggaaggaagggggggagaggaggaagcggcggcgatgcgccctgggagcgcagcgctcgtgcgccagggagagaagagagcgagaaagagaaaggggaaaacgggaggaaggaagagaacgagaaaaagagagaagaggaagaagatgggttaggtgggttgtgttgttgtgggctttagtagttgggctaatagaatttagaggtagagttagaaaataaagaaaattagtatatgacatttaaactctttaaattcaaatttaggtcttgcatattctaatgtattattgcagctactattttaattcactccatatgatttttaaattaaattaaagtgtgtcttttttgaagtagatatatgtacaaccaaatctttcatattagaaatctaaataaaagtattccttgaaatatatcttataaactatttttctaagaaaacaaatatatttatttctatgaaagcaatatatatcttggggttgttgaataaaatctgtacagtgaatcaaatttcttctaaataaaataattactctttcttaaaataaaagtttaacaaaagcaagtccataacctatatagatcatgtatgtgcattcgggttagacatatcatgtgcatctcattcatacaaacattctcgtatttagttgtgttttattgtttctttcagttggatgtttatctcggatttcttggagttctacattggtttattcgttcttcgatttcgggtatcttaggcaagtccaacatctttgatcatctcttgttatatttttgtgattgcaatctatatgtatcacattgcattaaattatactttctatgattaaaataaatatgctgatggattggattgactggtggagcagtcggtcatactatagatgtattctgaacttgccatgtggtgggggttcagttgcatatatttatcatcatcataaggttaaacaacaactattatatggcatttaagcgccgtagcgatcgtgtcgaccatatgacctagaatgggacaggctggcttagtagttctttcttaatggctttatcctgtggcttaaggacttccacgaatcccgtgagcgtgggctagcgatgagggttgccgttgttgcagaatccgattagatgatgtggatcgccgttgttgcgggatccgatgattcgccgttgttgcgggaatcacctgcaaagataattgccagatgggattgatgaaaagcttgtgaccttagccttgccggcatacaccatgaagtgtgcttaggcgctggcgtggtggcggtgtagcgcgggcgttaaaaggtttaaggcgtctatgggacagcgacacacctctgcagagtgtatgaattgtgatacgtcactacctgtttcaggtagaaactgcgaacgcggcaggaaaggaacctatcggaggttctaatacctatggtgccttatatgcagtagattttatagttacttaatatgagattttactacactgttttatgaacatgcataaaactaaactccttgttggattatgggatttggagatatatatgtattatgcaggtggattatgggcatatatttgttggattgctatagatggacttgttgagtaccattcgtacttatcccctatatattatttcttgtagtgttgagctaacaattaggtgaagagaagattctacaaaattgatcaagtgttgcatatctctacatcaatttactgttgaaggtgatgaagatctataagagcaaggtactgttagtattagtattttgataaaaagctaatttcttatggttttttatttattaggtttcgctacaattgtttctactatgctactttggtgtgctcagttcttggtaagttggttcttactaaggaatgagccatagaccggtattctacctcggaagtggaatacgagggtcgctacagaaaatggtgggggcgaggacggagcgagagaggaatggcggcgagacgacgggggcgaggtcgcgaggagccgactagccgaggacggcggccaggcggccagcggtggcgcgctcgacccctggatgcgccgctccgccaccgcctctcaatctctggatgcgccgcctctctcgatctctctctcctctctagggttagccaattcgggacttagggacttgggttgggctgggaacttggggaggaattatggactatttggatgggcctttttaacttcggaaattccgacaaactttccggaatttttccgaccgattctgagttccgacggaaactgttattatcatattcgattccgtttccgaaaaaatatttccgttttcgattccgtttccgagaaattccgaaaaaattccgaccggctgattccgtttccaaaaacaggttcggaatccggaaaaattccgaaccgttttcacccctatttgcgatgaagtgaaaaagaactaaaatcacttcatagcatcacttattagtgtcgttaattcatgagccaatatgtccgtctttggaatctgatccaacaggttggcccactttccggccagtaggactccatcgtctagaagctaatagcaaatggcatctattctactagttcggcatacagaccgcaatttcatggagcagctagtactattacaaccaaaccgtatggaaatgttgggccccacctaaatgcaaattcctctcgtggcttatcattcagaatagggtttggacagcggacagactgcagaaaagaggttgggctaatcagcatgtatgcccactctgtcgtactgtatcggagtcagcacttcgcctactcgcaagctgcaggctctccaaaagaatttgggctgaagcacaaaggtggactggtatagacctccgcctacaagaatgggggaatgcgcaatggttgaagactggtggtacaaaatttcacgcatggtgaactgcccaaggaaggcccttaaatcgataatcatcctggtagcgtgggaactctggtgtgagtgcaatgccagaattttcagacaagtggcatctacacctgccaccattatcgcaaaaatcaaagaggaggcgcgggcttggatcgtagcgggagcgactaagctaaccgagattattccagtgggagagtaggtctttaccttttgctttgggctcgagttcctcgggctttgtaaataacttttttaggtttgttctcctgctctatcaatatataagaggtaaagcttttgccctttcttcaaaatctttggccaacttcagtaggctctgtgttgaagagtgtgtcatggtaatggtaaagttatgggagcataattcttcactaggctttaaattaactgaaagagcccaacctatgccattgagttggtattgggtcaacaatattgctcatttctataatatgactagtttctgcaatataatattgagtcggatatttttcaaaactacccaagactccaagatattttatgtattcaagatttctttcatgtaatttacttttcttacttttaagaaataatatttttgtgtggcatatcagagagaaaaccatctacacaaaagataataagacaatagtaaaaatattttgtgcagcaactagtattggaaaaatgattcacataaaaatgacaacacaaaagtattgtatttaagacatacataaactctatgttgtataaggaggcttaaacactacaccagatcctcacatctctgacgggatacctgtgacgggcaatcaaaatggtcactgatgaccgttacctctgacgggtcatacgggatgccgtcatcggtgaggcatccggctgcgacccgtcagaggtaacgagc

SEQ ID NO: 69649 - DNA, 7498 bp, Oryza sativa
caaaagtttcaaaagtaattaagctcaccttatcttgctaccggccttctgaacaccagattttaggaacctattttaaaagacactgaataagcaatcttgtaaaatcagaggaagcaacttcgatttagcatacctgttgctaaacagatcgagtgatccagatatcaagacccgagcattgtttcttgcctgcaaagggacatattaggcttcttaaattcatcggaaagctacatactggtgatcacataaaactgatgagatacaaatctttgcagaccattggtctagcagtcaatactcaacaatgaacaacggaatgattactggccaagaaaactgtttcgcttgtcctttcacttttaaggaaataaagtaagcaaaacccataagcatcgacaccaggtggctaacactaatgtaaactaaattatttgttggccataaaaggaagggttgtagacttatgcagaactttacaggaaaccatttaactgaaatggattgatccataaatatggtttagtgtcttatgttaatattttgtcaaggatagaagcactaaaccaaatctgagcaacaaattccatagcatcaagcacatgagacaagcataaatcctgtacctgcataacagaaaccagtgatatagccgaccctgtgagagatggaggggaagccaacttagactttgggtttgctgagtatgctgacggagaggcggataagactttcaggacctacatatatttaaagaaggataaatgaaagattatagttaaaacttcctatccatagtaacaaaatagactaatagaggcatgcaattttttggtaacaaaatagaaattaaatgacttaccaagctgttagatggattaaccgcatgtccaattccccgaaataatacaggggcctagtaaacagggagagttattaaaagaaagcactacaagtacacattgtaaacaaaaaacagaaaaggtacccacacattgtgtcataggacagcagtggaaaatgtggtagaaagctttttgaatttaatttgacaggcactcgtgggcacaatggacagcaatgaaggaccaaaattgttcccatgacagccaaaattctactgactgcaaatactgtaaatattcttgctactgaataaatccaaaacagtactcagtccatgactctcatgctcattattcaaatatatcaatggtgatcaggatttagtctcaactcagctccaactacagtttattacaagaaagtaataaatatataaaaaattaaagagcagaacggttgaaagacatgagtcttttttgaagtattagtaccaacctcaattttctttgaccccagtatcacatctgactggatgaggtcatcaccagcaatcaaagtatgatcaccttcagcatcagtggcagcataattaatgtgatcaataaccattgcctctggatcctggcaccatccataaacacatgagactgagggaaacagagacaacgattgatcaaattaacaagctttagaaccacaggtatatcttacctcatcaaaatcaaccccacactctgttgcaatgcctcggataagatcagaggccgaagagtctgctgccaggatcatatcatgaccagcatcgatgaattccagaattgaattttggtccactgatcctccaaaacctgccagtgaaaagatacaaacattaagacttcgcaggactgaggctaaaccaaaactgaagcatcacgagcagagagcaaagcatttgcaacttaacccacagatttaaccagccacaaaggagcaaaaatcaattactctgtagcacagcagaattgaaacgaacttgactgttacaaccagagcaatcaaatcagaacacaagtaaatagcccttgcagtggttgatactgttacaatctcatttttccactagagctaaacaactaagcataacctctacagaaccttactacctaaatccttccagttggcgtagaattcaacaccccaaaacccaatggatggattgagctacccatcagagatcacagaattccactactcccaaaacacagatcggatcagacgaacgacctctctactctacggatctaacgcaaaaaccaacccatagccacagatcggatcaagccccatccatccacgaactgagtcactggatctcatgagcaggggggggataatgagggagagagcgtgggggaaaattaattacgcggggtggagggggcgaagaggacgaggccgtcgtagaggtactggccgtagcggtggagtgagagcttggggtcgtcggcgaggcggaagtcgagatcgaaccctcgcccctggagcgacgcgaagaaggccgagtgcgacgaccgcaccgccaggtcgtccacgagcaccagcacccgcctcccccgcggtcccccctcgtccgccgccgcggcggtgacgacgaggagggcgagggcgacggcgagggcgaggtggtggtggcgcggcgccgccattgctgcgagatctcgcggcgtggggaggttttgtttcgcgtggggtttgggagaggaggcgacgacgacgaggaggacttgaggacgcttggaggggggagagggagagatctgggccgtccgatcgtgcgatccgacggcttccaatggactggatcgaagtggccgtgtgcagtgtggctgtctggtctaggtggtgattgacaatccggccccaccgtcagtggttgtttttgtttgcattttcatcctgaaggtttaagggtctgttcagattatgtcaaaatgaacattttcaaaattttggtaaattagtaacattgtcaaattttagtagaatgtgctcgattcaatattatcaaaattccatagacattaccaaaatttggtaacaaactaaatataattacatagttgacgattttaccaaataatggcatggtttgaaatagtatcgatctgaacaagccctaaatcatcgttctttttgtttttttattataatctcgtgtgattatttattggatattttgcttaagctctttcttagtacgtaggataagacaatctatcatgccgtgaaattccaaattggaatttgatagtcacttcttacagtggaaaaatagagaggatattttgctgaatttgaaatcaaatgatgaaatgtgaaaaaagagaaagccatcgttagaagttgtttttgttttcattttcatgagattaattcatccattgttcttttgattttttttattaactcgcgtgattgtttattagatattttgcttaagcttttaaattttgtttctttgtacaagagaatctatcatgccaagaaattccaaattgaaatttgatagcagtttcgcgaaaaccgattggaatagtaagccggggtttaaaccaataaaaccattatagattcttatgactatttctgtacagtatttttacaaagggaggcatgtaggtaccgtatcatatgaagataggcttaagctgtagaacaccatatgatttccaattcaacgtcaactattagggtcagctcagcacccagagcaatctcaaaaaattgtattctgaataatgagcataatatccaaactgaatctgttgacagtggaattttccagttaatccgttacaaaactaggaattcggtattactaacataaatcacatcagcatggattacaccatctactctctctttgcctaccaaagaacaagtggtcatgatagctgcaattgcctgcaaacagttacagcaaaaacaccactttctctccacatgggtaatcaccaggtcaaactatccacctgaagatgaatgcttcatgttgtagcctgaagaagcccgaacctgaattttctttgagctgccagaccagagctttagtcggagcacaagcggtttcttcataccagctcctgatccttgaagctcgacagtttcgcattctcccggtcacgcttgaacacaaggtacaaggggctgtagaacaggacgcagacgccgaaaggaacaatcatcattgtcagaagtcccctggagagcgcatacgctccttctgctgacccgttcgcaaggttcacagtcttgctgtcatagccatatatcttctcggtgaccaagccgacagcgggagctgccagcgaggcgaatgagccctcgaatgcacggtcgaaggcgtagatcatggtccggtgcttgggagggactacctccgcaaacatggggttgtttgcagaggtggcgcaccagcttatggtgatgcccatgaagaagagggtgacggcgtaggcggaccagtaatcaaccgactgcgggatgaccgtcaggaggatccacgagaaagggatgcccatgaaggcactgaactgagcacacatgacacgtgcagaatctggaaagtgtcgcgagaggcgatctgctatcacccctccaaggaaagctccagttgcgcacccaatggcaaacaggctattcaatgccgccgagctgttattgtcaaaacctaagaggatttaaacatcttgacgtcaaattgagggcactgtaatcatttgagtgttcaaaataataatcaatttgtcatcataccgatgagttcaaaccacattgtgaagaaaactatggcagtccatggcaatgatccaattattccttgcaggacgatgatctgaaacgtccgcaccttcattacagatcttgttgctaccaaagaatccctccatatagaaggaggtggaagaacatctttgctggccaaatgtaacctgggtgatgaaataccaatttatgctgtcatactgaagtgcatatagtattgttcacagttaccagctgcaggttttaattctaatattgtgcagtaattagttcagggataaatccattgcacgcttacccaaagcacaacgaatgcaaatttacaattgatgagctacgcacaacgaatgcaaatttacaaatttacaatgcaatctacccaaagcagaccatgaatctagaaaggaaaagcgatgtaaaattccaatagaatctgatccattggataaaaaacataggatggcccatttatcctagtgtatcataaaaagaaatcatattgttaagctcatctacaaaataaccctgttctgaaatgaaattcgaagcagattaaaatcacgcaaacaaagaaagcgttataatgatttcatatcctatatgacaaaatcataatgatatggagatactacttgagatgatttccatgttactgtattgaactccaaaagatctgttgaagaattttattcttaaaccctttttgtaaaccggacttgagtggtactttttatcaatgatgtaacacaagaagatgatacggaacgaattaaataacatagataaaagtacctctcatagtcatcgtcgtcaagaagatgattaccagggatttttcttgggtcagtcgcatataagtacacaagaatgccaattatcaaactgacgagagcaaccataataaatgcaacacgccatcctgccaaaccccaatagtcatttccagccatgattgtggctagaatgctaccacctataccacctactgcaccgatgaggcttagtaaaccaaaccctgcgccacgtgtaccatctttgtagctgtcagcgatgaacgactgaagtgccggtattacaatagcaagtccaaggccatttacagctctccagaatgcaacctgccggaaatgctggctaactccaacagcccctgttgataaggcccagaagacagtccctattgcaagcactgttgggcgatcatagtgaagggagaggatacctgccaagggagatgctatcgacttcagaaagttcattagaaatgtaaggtatcccagatcagcaggaccagcattgaacgctgcactgacttccttgtaaactgccggaggagattctcatcggcacgctccataatggaagccagattgatgaggatgagagatacagagaaaccaaaaatattctttgctctgcaagaagggaaagactagaaacggttaattctatattacgcaaggtaagtttccctacagtagaaaatgtaattgtgtgcctcaattttctcaaccttcattcgaaccatctaatttccaactggatacagcacaagcattggaatgacatagccatgagtccatgacatttgcattttgcagtttgaactttgaactacagatagaattttgaaatttaagctgcacaaacctgatgtctcttgacatgaacctagaacatggcactagaattgaagagattcaacagaaatggagctactttgctgagaacacgatggtggtctggcttttttccaaatgagcaagacatagaaaagtccgacagatctagctcaaatatatcaaattgtgtttttttttataaaggaagcttttattaatctcagacgattacatccaattgtgtacagaattgcttgttaagttcattttacatgatatggttccacatgtaacaacttgtcagaaccgtgaagcaatcttctgtaagatggaattaagtcttgtttgtaacggtggaacctaacaatggaaaaccagaacttaagaagaaatctgctcccatatttttttccattcgaatgaaagtgggtatccactcaacacccaccatatgccacataacctaagaccaaacaccatctgaagtgcgcggcatatcctcaacaccttttctctatccaaattgcgccagcaactagctagagcttgccttttttttcattgcccactagctgagaaaaaggtgaacgatagtggggtgaatgtcaatgccaagtccacttgcagtggtacttcatgctggcatcaccatgttccatgcctaccggtcaacgaaacactgaagcttcttccaagatcttcctgtgccttttcctctcagaaaagataaggtgaaaaagattaaacttggtcacatccattcttgttcttggttaccaattcctactgcagtctagccaccgacggcattgcccatacatgaagccattagccatggatctgaatcaaaattctcactaatcttatcctacttgacccgatataaaagactaaaagacgaagctttgctgcgatgcttgccgatgtaagcacatggcatatcacccaaaaagcatttcttgagcttcttgtgctcgatctggtaccaaatacccatatataacatcgagaatcctcgtttgagataccaaatagcccgtatgtctaagaaatgccaaaaaaaaactaaaaagaaagaaaacaaaagcaagctataaacaaatccttctcatttcccatttcttgttttatttgaatcaaagcatcaccaagattccaccacaccccagcttcacggagcattgctttcccaacaaattggggaaaaaaaagaggagcat

SEQ ID NO: 69650 - DNA, 1601 bp, Oryza sativa
gggacaacagttcacatgcgcttccaaactcaccgaattgcttatgttgttatgattctattgactatgaaagtttcaacagctcttcatcaggcaagattgaaagaaaagggggatggttggaagattctagcagcaggagtacaatttcttgttatcaatgatagtggtcgtcaaaggtgctctagattgcgctacaaaaatatggttctatgaacttggaacccccaacactgggtttacagcacaatcagtgcatggatctagcacacatcagcctcaggtaactcgtgctctctcatgagttatctatttgtggtacaggtacacaaatgagaagatgaagaaggctcccatctgcaacaaagagggaaattatataaagagctaggtcatgacttttacaaacatatatgtaacttttacaaaaatcttagtaattccagccaaggaaacaggtatacaaatgagaatatgaagatgctaccatctacagaagtgacaataactatgtccatctaaaatgtaaggtcaagaaaaactcatgtctattgaaatgtatcaagtatatcttactgttgaaaacgacgcagcatagtacggatatgccgaagttatgaatctttcatactcattatgcctgtaagggcgcactggaatctgcaggagagaaacaaatggttgaatgcagttttacaaaggtcgataattatcgcaaaatgcatatgctttgtgtgaagttgtaaaaaaggaaagcatcgtggaaccaacctgcttagaaagagagagaccagtatatccaagcctctggtactcaactttgaactggaaaactccataaacatctggaactttgaaggatgttgaaaatacaccctgtattggcatgaaattttattttaacaaacagcaagctaaaaacaaacattaatgcaatactgactcatagtatctcataccttcttgtcagtcgacagtgtcttcagaacataagggctcatcatgtaaaactgaacttgaacatcatcagcaacatacggcttccagctggtcccagaccattcgtagatctcaacagagtattccttcagggaatcatttacattagcatgtttaacttcacagtgctcaattgatataacaggcaaagagttaccaagtcatcattgatgcggtacatgccaggctcatttgtctccccaaccttgttatgcttgacattcactgcctgaaaagtgggacatagcaaggttatgacatcattcttatttataatttctgttgtagaaacaaacatattcaaaacaaagaaaaatgtgataaaggtaacatataacctttagatggcccctctcatggaagacccatttgcttgtttctgtcacaaattgttcatttccagctttctcatgcctgcaccaatatatgacaaatatataaagttaatatcatttccatttgattgaggatatcatacaaccatttttaacatacaaagcataatatgacaaacattaatacagtgacaaaagttacaatatgctttcagtttcaggtatgtctattcagaaatatgcagcactaagatctgcatatattga

SEQ ID NO: 69651 - DNA, 706 bp, Oryza sativa
tcccatctcctcttgattgatgtaccacagcccattacgcctgactccagtccaaatcctcctccaaggcagtagccaaaaaaccagccaaaacaagagacgtaccacctccttcttagttcctgcagcaaacaatcctcctatgtcaccaagtctgcagccaagccaccatcctccttttcccttagctgagctcctcacatttcctgcgtgagcagcaggttacaacacacgcgctgcgcccgcgcggccgcgcgcagcgcgcgctcaccagcccctcaacgtggctgtgtgtagaggctggtcaggccggatgagagcaggggcgacgtgcgacgacggcagcggcgacggcggcggcgatggacggcggcggcggcgacagcaagctagggttagggctctgataccataaagttcagttttggggattttttctggtgtgttgttcacagccacacacacactatttcacttagctacatatgcaagaaggtccccaatacaagagcatattacatcaacatgcaaaacatccatcaagtcaaataatctgaaattacttctgcaattataatgctgacaacatgctaacgcatccaacagttaaaagtgtgcaggaactaataccactcaatttagtaattcattacagccacgcttgatggaaacaaagagaaattaaacaatggtttattggaaatta

SEQ ID NO: 69652 - DNA, 2504 bp, Oryza sativa
  unsure (1)..(2504): unsure at all n locations
taggatcttgaggtacttgaaaggaactcctggtaaggggttgtggtttaaaaaaaaccaccacttggatgtggaaggatattgtgatgctgattgggcaagcagtgtggatgatagaagatctacatcaggatattgtgtatttgtgggtggcaatgttgtctgttggcgaagcaagaagcaggcggtagtggctcgatctaccgcggaagctgagtatagagccatggcattgagtttaagtgagatgttgtgggtgaagaatctattgttggagctacggttgttcagaaataatactgtggtgcttcattgtgacaacaaatctgctatcaacattgcaaacaatccagttcaacatgaccgcaccaaacatatcgaaattgataggttcttcatcaaagagaagatcgatagtggggctcttagactacaatacattaaatcttctgagcagctagctgattgtttaaccaagggattaggtcctagtgagagtgagtcaatgtgtaacaagatgggcatgattgatatcttttgcccatcttgaggggggggtgttgatgtaatatgctcttgtattggggacctgcttgcatatgtagctaagtgaaatagtgtgtgtgtggctgtgaacaacacaccagaaaaaatccccagaactgaactttattgcatctcacctttctcttttgacacattgaatttgcgtactgttcttttttagttattacttattagctcttaatgtgttttatattacctcatttagttgctcttacaaagatatgtttaatgaactgattataaagtaaatgcttgtaacaatggagcactcttaatgaactgattataaagtaaatgcttgtaacaatggagcactcttgttaatatggatttccattcaataaattcaatttaattttagaatttaagcaacgtgtcaatctcacattcatgatagaagactagaaccagatgattgatatgtgatttttggattttagttgcaggaaacaaaatgactaattcttttgatggtttattttgtttttctgctaagacacttttgtttctccaggaccagcaatcaggatctctgctcatctatcctggctacaaaacaaatgagtgttcccagaacagctttggaaagatgtatgttgtgattattgtgttgaatttttcttaatctgtagatgctataactgaaggcttagtttctgccagaagctacaccctatagagtatagataattgtctctttgaagttactttttgttcattttattacagtctgctaaactcctatccatcagaaattttttgttgggtctgattataacaccggtatactttttgtttaatattttattagggaatcaacctcatcattttttgctgcttatgatgacagatgtgaagaggaaatccgtactgtgtgccatgaaaaagtagaagaaagctnnnnnnnnnnnnnnnnnnnnnnattagtccgaggtaaaccactatgataaattttgatatgttttctcttttttatcagagcaaataagctatttcagtttacattaaaatgatcttaaccagtgtacatataaatatttagtagggatgagagcggactgggggtcaatctggtacccatcgacctattccagtccaattaagtgaacttagtacccaatatgaactagaaaaggctttgtggtgcatggagtcgccaaccacctcaaccttgagaaaccccctggtcaagacgggtttagagatcaaaaccaattagcggagccgatttagacgaatagggagaaaaacccatatcatgggtggagcggaacgttttcaggactaacctacaaagagtacttgcactcttgcggcgaagacgaataaatgaaaactttcaaaagtgtcggtgccccgggccctatttggataagggcccaggtccccattcctcgccaactgttgtcctccacttccgtggtttctgacctggcaacgaattatagatacatatatgtatgtggtagaaagtgatttttgtgggcccctgtgtctcatgatcctggggaaaaggggaccctggttcccgtttctccaacaagcacaaaccaacgaagatagacaaactaggctaaaagctaggcaaaaagtagatgctttattgaaagaacgattcaattagcaaattgcgttgttgtacattgtgtatctcaattgaaccagccatgacccttataaaggggttggtcaggccctccacaggaccctctccacgtcccactaggtgtagaaaccaattaggactcgaaaaacctcaacccaagcaaaaaaatcccgagaaccgatgaaactagactcagaactggaccctgccggtcttatcggctacataccgccagtcaaactggccccacaccgttggtctgatcggccctatggcggcggtcagaccggcttcgcgcagcaagccgggtcctctacaaatttgaccatat

SEQ ID NO: 69653 - DNA, 1459 bp, Oryza sativa
tagcttatatagcagttgcaagaaaaaaaaacgattccatgttttctggtgtatggtacaaagttgaaagcattttttttctggtatatggtctatattaacctccataagctgccattgtctcattgacctgtaatttgccaccttttatattcactcaaatttcgcacacttttattctggtcctttggctgatatatctgttttgctgtatcattttgttatatagtatgtacaatatgcatataatcagtggaacacctttatgagacaattagaccaaaacatgagagggatactggataagtataaatatcacttcagaaatattggactagctccaacatgaagatcaacttcaactgatctttgctcagttgcatgccatgtaaggaccaagtggaagtgttatggtgcctccaagctgcttcgtattttacccctaagatgcttcagattttttttttatttgcatgtttaaaagggaatacaagtgctgctttcctattggttatgtttgtgttctcctgtactgttggccaaaaaaacttttagcattatgtagtcatgtcctgagtggtggagtacattccaaatcacttcatgctttgttattattggcacacatatttctttcagtgccgatgacatcatgatgaattctagacttgcagcttctgaacatggagcgataatttactagcctgattctcttgggtattccatggatcgatgaactggatatatgtgccatatatagactaggacactaggtattgacatctatagctcttgatacacatgtgtacatcccaattgttaatacacgtatgctaatgatttctaaatgtgtttgctcataattaagttcattgtatacaaaactgtcgatataaatttggttctttagtaaacaactcctatttgttactctaaaagcactattcttgcataaaccaataaaatgcgatttttttcttatcgccgttcagtgggtgctgatacttcatggtaccattttgttcgcaccatccaatgtgtctttgtattttagggctaactaataatatggccctttttttttacatgaccaatgtttccaagcattggtttttgatacctctgtttccagcagttcaaacttcaaagtccctggaagcacatgaaaatagttgcaagtgtacagattaacttgtagattacccagtggtgttgtgaacaagcttgggctggacagcaccaggttcagtccttgcttctttaggcatggtccaactaacacatcaagctgctacttgtaccatgtttgtctttgcaactcatgaatggctctctcctgacatttgaactccagattctgcacaacctcgccgccgccggtgaccgttcccagccaccggcggcggcaccaccaccctaccccagtgacctccccccatcttctttcttctattcccct

SEQ ID NO: 69654 - DNA, 7690 bp, Oryza sativa
aatccaaaaatgcattttgagtcattcgtacaagtttaaggaccgcacgtgtgcttcactcaaaagaaaactaattaggatttctccacagtatccacgaaacaatattcagcacgacacataattcacaattcgatagaatgatggaaagctttttctgatgtgtctctaatttccgatgtgtctctaacatgtgggttccatcataattccattttttttattgacggtaagtaccacgttgtcgacattttaggtcatgactatggtatttgcatggtatggagatcgttggtaccaggatatatgtgatattgaggtaaaagagataaaatgatttttgtacaggttcgggccccttatctgacaggtaatagccctactcttgttgggcgtagccggtgttgctctttattcatctgaatcacataagtataataattgggataacctatctagctgtcatcgatatggcgacacggacaccaacatgtagtcgacgatagggtagtcttcctcctcgaatatgaactcgtcgagatcagagattgcgctagatccctcttgtcggcctccgcaggaacctgattgggtctgtctaggctaatatctgatttcggtgtctagcttgtctttcttgtgtgtctgtatctccctctccctagggggtattgtatttatacccataaatatcccttttccaagtagaactagggagataagtatgggtacaacccgagtagtcctggtcatttccatatggaactctactcattctttcttatttggaactcctttttatatacgagatatgatttcgcataagactcggtatatgttgggccttgccaagtttagtcgactactattgggtatgtttatccatacccctgacacacgtagcatagtagaaaaaattggaccagtcaagcggtttcacccgaaaaaaatgggaacccagttcggtttccttcaaaggatcatttcacgcaattcgacccggttgtacccggggcggttttgcggcaaaccggcagctccttgaccggttcagttccttccaatagttcacgcaatcaacccggtgtgagccggttgaaccggatggttttaccgcggaccgccaaaccgggtgaccctgaaccggctagctcaagctagctagccacttgatagcatatttttatgggccatgtaagacctgagggctcaagctagctgggccacttgatagtatctttcttatgggccatgtaagacctgaggcacaacttaattttatgtgagaaaaaatagtgcaaggggtgggattaggatatatacaaaccttgccaaccaccaggctaagttaactgctctgactttgaagaaacacaaaatatacttaggcaataaaacgcggttccggtgacccaatggttgaaccgatagaccgatagacaggtgaacagagcacttcaccaggtcaaggatcggtctgattttttttactatgccacgtagatggcatgcttacctaaaatcggccttaataaaaactgccttatgattatatttatatcggttattaagatgagagatgccgctttcacggttgacggatatgattgaaactcagaacccttagatgagggacatgaaatggacttcatccttcgcctgaacccatgatgatctacatgggctgtgcgcctgtgccgagttacccaggtccaccaatttgtcattcttacatgcctagtcagcaaatcggatggaaaatgtcctaggctgcgtgcgttcgggagtcctagttcccaacctcttttcctcattttccgcacgtatgtttttcaaactgctaaacgatgtatttttttaaaaaaaatgtatacgaaagttgctttaaaaaatcatattaaactattttttaaaaaaatagcaaatacttaataaatcatgtgataatagatgcttcgttttgcgtgttgaggaggaagggttcctcccgaacacagccaggctagcgcctaaccatgctgagggagagcgagcgtacgacatcggcgctagacatgttccttagcacggcacgatggagggacaaggcggccagtgcgagagagaaaggagctgcgaatggcaacgtcaaggactcaacctggtaggagctagagagaaaactccaatgacggattgatgtggggtgggaaaaaagaagggaataacggggggaatgggttcactggagtcagtggcggagccagaaattatacaagactacggataaggtagggctcgactaatggagtttcagttttctgaaaaatttacatggtgaatcaacaaaatttaagcaagtttttggagcctagctgccctaggcctgtctctgcccctgactggagtggaggagaggtggtggtggaggaggagatcagcaggcggttggcagcggctcgacaaagctcgaacttgaagcttcatcctgaggagggaagaagatatcgatatatagtaatggatggaagggggtggtggctggcttttatagctagaggaagacaagggaagtgagaggtagccgggcagatggcaacaacgcaatggccgaccaagacacgactaggccgcaggtacaaaatcaagtgttggagatcagacttagaaatgggtcgagctagtctggttggggatgacgattggcggcattaattggtgggcttcaaacagaggcggaatggtgtgctccacactgagcctatgttcgggcatccttgttctcaactggaacagcaatcacacaaaacggagcggtctattagaacgtgattaattaagtattagctaatttttctttaaaaaatatattaatttgattttttaagtaactttcatatagatttttttaaaaaaacgcaccgtttagcagtttgaaaagcgtgcgcgtgaaaaacgagtgagaggaattgggaaaaaaggtgccgaacacagcatgagtctatcttcaaatgccatgccagcaaccaggtgccgcagatcgtgctcggattcgacacatccgcgtgtgggccagggttcctgtgagttcaccgtaggattctaaggcacaacttctctattttatattagtatagatatatctatttggtaattagcattccatgccagcatgcatgcagcattagtgcattatgatagtgatatcatataaaaaaaaaggacttccggtggaaagacaagcatcaaagttttgagtctttgagagctactataatatttcttcccaggtagtggtttttgatgttaaattaactttctgcgcttacaatcaaagtgatgaccattttgtatgtgttgtaaaggtagaactaaaaggtgtaacctaaagtgggatgacaaggtatctgcctgtctaaccgcacttaagtgaacttgtgagtgtgcatgagtcagctgcaagaggtcaacatgcaagttaagatcagcacacaaagtaaataatggcttctccaaaaggttagataaaccgtatcggtggttctgatatggtcagggaatttgtgtagacacatgacattttcattacttttaaggtcttcaagataaaattttgaccaaattttaatcagatatagtttataaaatttgtttatgtgattatgaaagtatatttccaaactaactattttaaaacttattaataacaagagtttgaaaggtaaataaaaagaacaatatattttcataggagaaatcacatacttcctccgtttcacaatgtaagtcattctaacatttcccacattcatattgatgttcatgaatctagacatatacatcaatataaatgtgggaaatactagaatgacttacattgtgaaacggagggagtagcaattatctctatccagactaaagatgcctccaacgttaatttaaaaagaaaatatctttatctaagttaaatatgtggagtagatcagatatggtaatgcgcgtgggatacaattaatggttagatcgtaaagacttgtaataagctggttctcacctaacctaacttttgaaggttactaaactatcaagtacaaccctttaagaaacagttggtaagtactcgactttcgagaaaatatggagaccacggtaggtatatactccctccgtctcgaaataagtgtagttttgcactattcacgtttaacgtttgaccgttcgtcttatttgaaaaaaattttatgattagtatttttattgctattagatgataaaacatgaatagtactttatgtgtgactaaatatttttaattttttcacaaaattttcaaataagacagacggttaaacgttgggcacggatatctacggctgcacttattttgggacggaggtagtatgtttggttttctgaaaattttgtaagcagatacagcctacggctaccacccggtccacaggcccacaaacagggcccagggctaggcccaaatcatggtgacatcatcggagctacagaccgtacacctgtccggtgaataaacttatatgtactttggaaatcttttccagcaaacacaaacttcttgtagtatagcgacggctgaaactgtccaaactgaacgaaactttaatttcactggtcctgcctctttcctggcttggttctcgaagcatcgtcgtcctgatcttctccagaaattaaccatctgcattcttagttgattactacattggatcgtctaaaagaatcgtagatgaaaaagaaagtactcgatccgctcctaatcagcaatgtaatagtgtatgcatgtgtgattatatatcgcaatgcagacaaatcaaagttgggtttaagagatttgatagatgtatgatgtatgcaggagatttttgtgtatgatgacgccaaaagtacgtacacctggggccataaactagagcaattcatgacacgtgtcatcaccgccaaattatttggcctgtcattgtacaggcgacaagatcaactgatcgagttgtatgtgtagaataaacgggtaaccctagcatgggatgcttgaagttatttgtagccctagtccaatttacacctgatggatagagtcatgcactacgattccatcataatgattttgtagtacctattagtacataagcctttaaatatacgagtatataatgaaacaggaccaaacgatgaaacattttcaactttggccactaaggtaatttttttttcagaggttgataggtaaattcaacgaaatgttagtacgtttttgtaagggtcttcggttacttccatgcatatactagctcagttcccaaaaatttgttgttgttgaccagtattatttcagttttaaccactaccaattccaaaatgaatggttaaattacgatgtaggaaaattttaatattaatttgtattcatgatatatgcaaccgataccatggctttaattttgagtatttagatttcttttttagaaaaatagaacaagttttcaatgtttaaatatggctggtgcatatatatggtgataaagtaattggaagcggaagaaatgattatgaatgtactccctccatttcatattataaggctttttaatattgtccatattcgtatagatgttaatgaatctagacaaatatttttttataatataaatatggatattactaaaaagtttataatataaaacagaggaagtattatttattataatgaacaaattaacataagctatatcgcgatgacctaaacatcaagtaaaatggacgaaccttggcgcctttacacgcaaaagtttgtaccggctaggttgtaaagtagtgcacgtatatactacagatgagagctagacgtgccaggaccaatgagcagtgcgtgacgtgttccaagaaaaaaaaaagagaaaaggtctggcttgacacctgtccctgcaccggcaccaggcgggctgcttatgcatggatcatacttgtggttaagtatcccttcatatttttgttatttataaattttttgttatttataaattgtattctagttgagctcatatttttatttttctattttctgaatttattttattttttatttcgaattttaattaatctcgtattgtgttttatatagactattattttaatattttttattttttatttccaattttaattgtttcaacattgtattcgtacttaaactctctattttattttttctaattttggattttttttattttcaattttaattagcatcgtattggtttcttatatagagtcttttttcaatattgtttattttcattttaaatgttagttattttaaaaatgtattcctacatgaaatcttcttttattttttttctaattttggattttattttatttttattctgaatttttaattaatctcgtattggattcttatatggaatcttctttcaacattccttctttttaattccgaatttcagttatttttaaattatattcctagttggacttttcttttttttttcctaattttggattttattttatttttatttcgaattttgattaatctcgtattgtgttcttatcttctttcaatattgcttatttttaatttggaatttcagctaattttcacttggaatcttcttttctttttcttcgattaatgtagaaatttctagtcccgacagcgaatgtggtgcatcctttcaaatgaaagctgttttaataatataatagatgtcttcggcttatgaaccgcgcttcaggctctcttggtttggcttaagcttttaactgacattttagcttccatattaaattttaagtcattggcttttaagagcctcatcatttggctttttccctaaataagccaaaacggcttattagggaataaaaatgaatttgtaggtaaaccttttatatatgtgttcttggggacttaaaagtcaatgctgaaaaaaaaactacattgaaaaatctcaaaattaagtttgaaaatttaaaatgtggctttttctttgactgattagaccatccgatgagagcctaagtctcaatgatatagtgttatctgcaaaaaaaagttactcgaacctacctatttatttaatgctataaaaaatggagatccagcaaaaaaaaacgtcatgcttatttgagctagtcttttttgtcttacaaactggctcaagagcccaaacaaagagaccttaaaatgtcttcaaccggatccgtgctcctagccctatttcctctcgcgtcgctctcccctgcggcggttcgggagacgatgacccggccgccccctctctcccacctccctcctctgcctcgccgccgtcggcaaagccgcgcggctgcaaggacggtagcggcggggcttcgcgcttcccaatatcaggcggagggggggcacgcctgggaggcggcggcagggaccgccagatccgcgccgctcggacggatctggtgggacggcaacggcggcgaggttggcgatgatgatggtcgaggcgagaggcgcggggaggggttgtggccgatggcggtggggatggcgacggcggcagggcggcagcagtggagtccgcggatccggcggcggcgcggcggccggtgtcctgcaggtagcctgccccacggctggcgtggccggcagtggtagtaaggaggacggctggatctg

SEQ ID NO: 69655 - DNA, 4867 bp, Oryza sativa
aggaccagcacgtcaatgtcagggttttcgccggttttcctttaattaaccgtgctgttgtaaggtttttggtccaattttccttataaactggatcaactctcttcttctgtaatgaactacatgaactccctacctgtcccctcgaaaaaaaatgtcttcaaccaagtgctaagtttcgtaaacaaaaacaaggctaaataaatatacccagcaaaataatacaacactcagatgcaaattcttaaatcagtaagatcactattagatcaaaatataagagtttgagatttgaaaattgtattggtagatttgtcaatatttgtataaatattacaaaatttcaatcagaaaaatattgatcttatcagtaagaactgaggtaatatatcagcatgattttttttctttataatacaacactcagatgcaaattcttaaatcagtaagatcactattagatcaaaatataagagtttgagatatgaaaattgtattgatagatttgtcaatatttgtataaatattacaaaattttaatcagaaacatattgatcttatcagtaagaactgaggtaatatatcagcaagatttttttcaaagaagaaatccgcacatataagcaacacacttaatataaaacagtgcttaactattgcatcgttgtcaagcaagttgcggtgtgatttcttgcatgggaaatactccctccgtggctccgttcaaaaacaaacgtagttctagataaccaaatgcatattaggaaagagaaactgaaacagtattatgcgtataattaatatggagaggaaacaaggaagatgatacgacaaaaatgagaagaaaatgatgtagtggtattaaagaagttgtatggaccactccattttttttaggttaaaaatacacttttttgaggatggaatggaggagtaaatatgtagctccaaattacctctatttggttaaaaaaaatgaatactatagaatgatctaatatcaaataattaaaatggatgaggcttcaagtcgtctagcccatcaccttggtgaagctaaccgaaagatttctgggcgtttctgattctttgtttggttatataacaaatcgacaaactcttacggactactacgtaaaagatctacttggtgatctactgatgttcgtgaaagttttgaattttcttcgtaatagggcagcaatagcatacgcataacttaaacccggtccacagtaaaatcaattgcaatggctggtaaaatttaacatcccgacatataaataagatttcatcgttgagaattacttgagatatatatggaattgatgagtatcaaagggaaagaaaacaaattcagaatgcgtctcttatatttttgatttcgttctctagctccctaaatttgctgaataatcaagatcgagatgttgtgtttgtgatgacagtgacagtgacaaaagtagatataagctcgattcagttttccgaaagtaaagatcttcaggtcgacgtatctctcatgaaaaccgtgactgtttctaactttcaatggatcgatcatcaaagatataaaacatcacatgaaagtggtgagtcccgtggacatatgctttgtttttcctgtctttggtaaaagcatgtttgtaatagagaaatcttatgctgatgtatcaaaatttcaccaaaaagacaaaattagtatgtttctcatagtacattagcattgcctaacatttaaattttgtattaaaaaaaggtactaatttgtttcgtaaaatttaaaatttgtacaaatgcattactccttgaatctccaaatccccctacccctcccccagcaccgccaccacaccccaatctgtgaagtggagtttctccatattctcattagctagtttctcgtaatttttactttctcaaacaaaaccttaaataattaaataaaagtctaatatatatcaaccaaacacctcttggagaccaaggtggctatataggatggcttcatgcatccaaccaaatgtccccttgcatacatgcatctactccagctactagcttaattatccagcagtgaactagctagcaatgcagtggcaatggccatcttgacaaattcaggcgatcaaaatgacggcacatgtaattgctccctgctttcgaagagattaaactacacacatcacatgcacgcttccaataatgcaatccccaggcgattgggacaatcaaatacatgagcaatcatgcattcatatgaatggtaagtccagcgcaattattggctaccatggtggcgtgtcctcctataatttgtcttatctgtagatttatgttccatctgtcgacttggatcgatctatagcttcttttaaaatatatgaaaaaattgtaattcagaatttatatcacaatataagtgtttctagaatctagacagtaatttcgatgtacggaaatccatatattttaagcgaatcaagtcctatggaatctaagcaaattcaaaattcataatttgatcactaattatgatggctgaaaataatattttccttaatattaatatatttatttagtaaacaacttagaaatggctatatatttttggaatagaggaagtagtactaatctatatatctatatattttggtatattttgataaataaacataaagggttgattatattaattaatagatcatgttgagttgaatcgcgtcttatgaagaacgtatatgctaataaagttctcttggaaaagaaaagaaaacgagacatatattaaatctcttttttgcatttaagcaaaacacagcttttgaatatgtttaagctcagggataaactcgactttaatacttcatgatcacttgagaccggccccctttcagaaagacgaaaccaagacgatttatttgagtgcaacatatcaagatcaggcatatcaattgtacacgaccaattggctgcattattgcagatcaatgtcgcgacaataatgtacaattgtatttaacctcatcatcatgtattatatattcatgtacatgtagagctacattatacctgattaattgatcaacgcgtattaattcctccctgtaactattgtacttctaaatcttgctctttttctcttttgtgctaatggagaatacatatacatacatacatacatacatacatacatacatacatacatacatacatacatacatacatacatacatatatatatatatatatacatacatatatagacttccccctccttaccaaggcccaaaacccacctcccacctcggtcaaaggcccctcccaccggtcaaacccgcctactaactccccccaccacccacctcttctcagctctcgtcccaggatggtgcagtaacacgacgaccactgtgcagtaacattgtgtcttacgtgcagtaacaaagttaaaatatagttaaaatatagtcatgacggatctacttttgataagctctttttttctagcatcatggtgcaaacggttttaaaaaaatcttacatcacttgggagatattgttcttcaaagcttgacttttttgcaatttgtctctccacaagtagtaataccattccattacctggtaccacctggctaatggaccgtaccaccatccccttatgaaggtacctcccctgcgtttacctatttttttggggtggggtacttggataaccccatggtaccgggtcccttccgtccagtaccacttttattttggggcagcaacaagtatatggttagcatctgagacttttaacctatatatttttgtttcaattcctaatttactgtaattcaccacaatattactgtcacatcttacacatgcagtaacgctatattggagggaggagaccaattttcttgagaagagggagaaagatcggttcttgaggaggggaatacgtagatgcatcttgaagtttaatcctccatatgcagtaacactataacatcatggtggaaacggttttaaaaaataatacatatcttgtgagatattgcttttcaaagattgacattttgaactttagccctccacatgcagtaacagaatgtgtaatttacagtaacaggggtatatacatgtagtaacatggttttaccaaatgtataaaattgttcaaaacactcctacatcaatcagacatcgctcaaagccacctacagactttacctatggcccacctatttgatcttcatctcgtaaaaatgacatagtaacactgcatttatcatgcagtaacatagctacttggaagtggtaacatgcacctattatgtagtaacacttctacttttgtgtagtaacaagtatacggttagcatgtgaggctttaacttatatattttttgtttcaattcctagtttatgtagtaatactattcaagaaatgcaagacactttgttactgcaaagcttattgtctttactaaactcttgtagtaacattgtgatagaactgtagtaacgtacagtagtaacaagtaatgctattgtattactacttgtggagagtcaaatttcaaaaagaaaagcttttaagaacaatatctctgatgtcatgtatggttttttaaaattgtttgcaccatgatgctagaaaaaaaagcttatcaaaagtagatccatcatgtctatatttcaactatatttgagcgttgttactgcacgtaaaacacagtgttactacacggtgaccgtcgtgttactacacagcttcgcgagacgagagctgagaagaggtgggtggtgagggaagttagtaggagggtttgactgagttttgaccggcgggagggggttttgaccagcgttt

SEQ ID NO: 69656 - DNA, 4705 bp, Oryza sativa
actccatcgaacatacttgatgagttgagggtttccctgtaataataactttgtattattatatattttcataaaattatgtattgttaatttcttctcccaccagtacgtgcgtaaaaaatttattgctagctaatcattagccccatttgcaatgatagaattctaaagggggaaaaatcattcgatttaaataatagagaattaccgatgtcatagttgtccaaaacacgatttttcttcctacgtacgtgaaagtaacttagtcacgaagaatttgagaaaaataatttacaccgacgcaatcgcttgctcatcgacgacaacctacaagtaacaatataacaaatagtgaggaaaggaaaaatataaagcagcattcaatcagtcaacacaggtgttctagccatatatatgcaacccatcaacatggggaatgcaacaatatatatagcagcctagctagtcttcaaaatgatgaagcccacagaaaatgcacacaagcaaacaaacgatatctcaaaatataaaatcaccagatataagacagacgctcccatacctgaatttttgtttcttgcaagaaatcaatgcatgatataactgtaacacatcaagttgtctgaccatatcatatatcatcatgcatgcacagcctaattaaatcttacacacaaagaaaccaaaattggagaaatcaaattcctcctctcccaggggcaaaataggaagagagatatttctttttgcaagaagaagaaacagttacaaaatctcatggaaacttacacctgtcccttggccattttgatcaccatgtgatgtgagtccccccacttacattaatctcatgctaaaaaacaaacagataaataaataattgccattgccatgctgccacgtgtcatgggacacgtcacctcctcttcctctcccgcgagtatataaacccctcgctcccctctccttcctcccgccatctatctccctctcttttgaggagggcaccgccatttagttaattagtagttgttaattatcttcactaaccttaattaccctcacgcaaagcactctctaatcctcctcggcgctcgcataatcttgtatccctcatctcagattatcatcacctcgccgtgttagaaaaaaggtactatgtttggttgatttgtaataattttcttggttggtggtttggttgatttcttgattagtgtgatgctaattgttttcgtttgaagggagtaagttcgttttatcgtcggatttggtgagagttcgccggagtagaagaagatgacggtgacgccgcagatcacggtgagcgacgggaggctggcggtgcgggggcggacggtgctgaccggcgtgccggagaacgtgacggcggcgcacgcgtccggcgccgggctcgtcgacggcgccttcgtcggcgccgacgccggcgaggccaagagccaccacgtcttcaccttcggcacgctccggtgagcaatctcacagaattaatttcccaagatttctacaaatttgtcttcgctgcatttttgaattcacagaattttaaagagtttttggcatctgaaattttgcagggaatgccggttcatgtgcctgttcaggttcaagctgtggtggatgacgcagaggatgggctcctccggccgcgacgtcccgctcgagacccagttcatgctcatcgaggtccccgccaccgccgccggcgacggccacgacggcggcggcgacggcgagccggtgttcgtggtgatgctgccgctgctggaggggaagttccgcgcggcgctgcagggaaacgacgacgacgagctccagatatgcatcgagagcggtaagtaggtcttaggatacaaattggatgaaatttgtgtttgaaaattaaatttagacgagtttcggtgaaattttccaaaactttggatgaaatttgtagtgatttggacgacgtttttggggcaggggataaggcggtgcagacagagcagggcgtgaacatggtgtacatccacgctgggaccaaccccttcgacacgatcacccaagccatcaagtatgaatttctctccgctgtccccatcactaaaattcctactcgtactacgtttcaaatgaaatttacacatctgacacgtctataaattctaattctaatgtttgaaatttgaaaatgatgcagggcagtggagaacgaatgcagacgttccaccacagggacaagaagaaggtaatactaccaattccttttgaaatacagttctttcttctttttttttgaaatattgagaaccgatttgatcatttttgtttgtttgatggatcgattttctgttcatgtcacagatgccgtccttcttggattggttcgggtggtgcacatggacgcgttctacaccgacgtcaccgccgacggcgtcaagcagggcctccgcagcctcgccaatggcggcgcgccgccgcgcttcctcatcatcgacgacggctggcagcagatcggcaccgaggacgacgacacggacgaacaccccgccgtcgccgtccaggagggcgcccagttcgccagccggctcaccggcatcaaggagaacgtcaagttccagagcaagaacggcggcgccggcgaggacacgccggggctgaggatgctggtggaggaggtgaagggggagcacggcgtccggcaggtgtacgtgtggcacgccatggccgggtactggggcggcgtggcgccggcgccggcgatggagcggtacgaggcggcgctggcgtacccggtgcagtcgccgggggtgacggcgaccagccggacatcgtcatggactccctctccgtgctcggcctgggcctcgtccacccgcgcaaggtgctcgacttctacgacgagctccacgcctacctggcgtcgtgcggcgtcgacggcgtgaaggtggacgtgcagaacatcatcgagacgctcggcgccggccacggcggccgcgtcgcgctcacgcgcgcctacaaccgcgcgctcgaggcgtccgtggcgcggagcttcccggacaacggctgcatctcctgcatgtgccacaacaccgacatgctctacagcgcgcgccagaccgccgtcgtccgcgcctccgacgacttctaccctcgcgacccggcgtcccacaccatccacgtcgcctccgtcgcctacaacaccgtcttcctcggcgagttcatgcagcccgactgggacatgttccatgtaagcatcaaccccttcgtgtccgacgccggcgccatttcttcttcttgcttcttaggtgttcgatgtgtggtttttgcagagcttgcacccggcggcggagtaccacggcgcggcgagggcgatcggcgggtgtccgatctacgtcagcgacaagccggggaaccacaacttcgatctgctcaggaagctcgtcctccccgacggctccgtgctccgggcgcgcctccccggccgccccacccgcgactgcctcttctccgacccggcgcgcgacggcgagaggtaacaaacaaagatttcgaaatttgtgtgaaatggtttcgaatttgggttaaaatttgatggaattttttgtagtttgctcaagatatggaacctgaacaattgcggcggcgtggtcggggtgttcaactgccagggcgccgggtggtgcagggtggccaagaagacgcgcgtgcacgacgcggcgcccgggacgctcaccggcgccgtgcgcgccgacgacgtcgacgccatcgcgcaggtcgccggcggcgacggcggaggctgggacggggaggccgtggtgtacgcgcaccgggcgcgtgagctggtccggctgccgcgcggcgccgcgctgccggtgacgctcggggcgctcgagtacgaggtgttccacgtctgccccgtccgcgccatcgccgcggcgccgggcggcgccgccgtcgcgttcgcgcccgtcgggctcctcgacatgttcaacgccggcggcgccgtcgaggagtgcgccgtcgatgccgcagccgccgtggcgctcagggtgcgcggttgcggccggttcggcgcctacttctcgcggaggccggcgaggtgcgcgctcgacggcgccgacgtggggttcacctacgacggcgacacggggctcgtcgccgtcgacctgccggtgccggagcaggagatgtacaggtggaacctggagattcacgtctaggatgctgctgctgccacgtggcggtgcgatctttgccctctggtgttcgtggctgagacattcccagccgttggatcattgccattgatggtttgcagcagagatggacggaccgatggagagattgtgatgtgccctcttacgacttgcaacgcggtagagggagtatgctttgctacatctaaaatgaaagaagaaaattatagtatgcttttgtcatgttatggcttgtaaaatgcaataatatgatgtaatgctatggtttatgtattattattagctgataaataaaggatggtgctccttaaaaatatatttgcttactcgcctgggtacttcgaggtcttgaagccctccaaatgatgggctcctttggaacggggatttcaaaaacacatgaaaaaacataatgtaggaatttcatgccatggcaaatcctataggaaatgaatccttaggtttttaccaaaattattgtttgg

SEQ ID NO: 69657 - DNA, 2619 bp, Oryza sativa
ctccccgagctattgaaaccagtgcaatttgaatcgctcagcggttttgcagggcggttttgctgatgtggcaccgacatggcaatgttgacctagtcttcgtcccatgtggtgctgacgtgacattagaattaaacaaatatatgtgggacccatatgtgattcacacataaaaatatattgtgggtcaactgacatgtgggccccacatgtcatcctccctctctcttctctctcccttccctctctttctctctcatggcgcaataagccggcaggggcggcgacgacgggcgggagccggagtggcagcagcgatgggcgagggccggagtggcgtcgggcaagcagagacatcggcgagcagtggagacacgagcatggcgcaggggcccgttgagcggcagagacgcgggagtggcgcggcgttggggatgacgacggcggtgctcagcctcgatctccgccgcggcggcccccgctccggctcaccaccgaattgcgccaccgctgcctccgtcgcccctttcacgcccacctcgtcccctccatgctcgcccgctaccccgccctctcccgcctcgatctctccctctgcccgcgcctccccgatgccgccctcgccgcgctcatcgccgcgccgtccatctccgccgtcgacctctctcaatctcggggattcgctgccgctgcgctcgttgctgcatgcccgaactcaatgacctcaaccactctaatggcccaacgccgctccggcccttgcccgctgccgctgccgctccggccatcacccgccgccgctccggctcccgaccgccgccgccgcccctgccggctgattgtgccacgagagagaaagagagagaagggagagagaaggaggatgacatgtgggccccacatgtcaatggggcccacaatattttttatgtgtgaatcacagatgggccccacatatatttgcttaattctaatgccacgtaagcgccacgtgggatgaagcctaagtcaacatcgccacgtcagcgccacataagcaaaactaccctccaaaaccgctgagggagtcaaattgcactggtttcaatagtttggggagtcgtcctatccggttttgcggttgagggtcacggattagattcgggtcactttttagggagtcaaagtggacttattgcccacaaaacctttcatagcaaatcagctcaccaagtatgatgggcccatggccaatgataatacctcgccgttgctttgcagcctgtccattccattggattcattacttcagcctgtcatcgtcaattcgtcatcagttcatcgctcgtgtctgctctgtttagacattcagtcgtgtttggattcataaaatcctgtttagattcatgatctacggtgtttaacctaaatcaaccatctttcctcaaacgtgttcattatctaaaccaaaacacatatggtcggcatttcggttcatgtgccacgattgatctactcgattgatatttaggggaagcagacacaaaagcgttaattcccaaatgcccaaagaatccatctagatgggagattaaatctaatcatcgaaatcaccatcatctcgacataacagaaaccaaatcattgctttactgggggtcatgtattgctcggaacggggccaagattccaccggttctattcggcacccccttttgaaccgcgataagttttgataaactgaggatgaacagaggcctctccttttgtttcggcacctaaccaataatcatcgctcttaattatgatctacctactttatgtctgcacccgaatttttgggacttcttttccaacatgtgtcataaccaggaaaaaaaagcatgaaccccccattggtttagcttctctataagtatgtcctgtaatcaacagctgtttgcgtgcaccgatcagacttgagtatggtcacttcttcagttcttcctaaggtctgcgaataatcacactgccattttttgtgaccaaaacgtgccgaagctgactagctagcttggaattagtgtccgtgatgttgtaatctagtggatcatggatggaacgaggcgtatatgaatgtgtctagaatgcgttaatggacatatatatcttccatcgatcttctgcttgatctaactctacacgcattttggggtctttttctttctttctcaggtggttgatgatgccggcgagggcgaggccaaccctcgccgggcgaaatggtggtacgcgacgttccacagcgtcaccgccatggtcggcgccggcgtgctcagcttgccgtacgccatggctcacctaggatggtaagtcaattatactgtacgtacgcgcgccatggctagctggagctgtgtgcatgcagcgaatgactgtggtaatcgatcgaacgatcgagcagggggccggggacggcggcgctggtggtgtcgtgggggatgacgctgtacacgctgcggctgctgatcgagctgcacgagtgcgtgcccggggtgcggttcgaccggtaccgcgacctcggcgcgcacgcgctgggcccgcgcctggggccctggctcgtcgtgccgcagcagctcatcgtgcagctcggctgcgacg

SEQ ID NO: 69658 - DNA, 12471 bp, Oryza sativa
  unsure (1)..(12471): unsure at all n locations
ttcctgcagccccgtctccctcgccgccgccgccatgtccgtcggctactcgacgatatcatgggcggcgtgcttggcgaggggtactcccgcggcggcggagggcggcggtgggggggtgagctacgcgtacaaggacgggacggcggcggactcggtgttccgggtgtgcagcgcgctggggcaggtggcattcgcgtacgccgggcacggggtggtgctggagatccaggcgacgatcccgtccacgccgacgaagccgtcgaggggggccatgtggaagggcgccgtggcggcgtacctggtcaccgcgctctgctacttccccgtcgcgatcgcgggctactgggcgttcggccgcgacgtctccgacaacgtgctcgtcgcgctgcgccggccgccgtggctcgtcgccgccgccaacatgatggtcgtcgtccacgtcctcggcagctaccaggtgtacgccatgcccatcttcgagaccctcgagacgattctgatcaccaggatcaggctccctcccggggcgctcctccgcctcgtcgcccgatcagcctacgtcggtaagaatcgatccgatcgaccaccacccatcgctgcaagaactgatcgcatattcgcatccgttcatggctgaatcatatctgtcatggcacgcagcgttcacgctgttcgtcgcggtgacgttcccgttcttcggcgacctgctcggcttcttcggcggcttcgggttcacgccgacgtcctacttcgtaagacgcgattgcccatccgaaatgaacactttgccataattctcgtaacattcggtcttcaccatgacaccatggatgaaaacatttaaatttcttttgaatgcagctcccctgtattctgtggctgaagatcaagaagcctccgaggttcagcgcgtcgtggtttgccaactgggtaaataaagacacacatttttttccgtcttccggacactcatatgaagcaaaaactaaactgaatgcatgcatgtaactgtagtagtagagattcaggtttgacaggttctgtttgtttcttctgcttcatctgtcagggttgcatcgtcgttggagtgctgttgatgatcgcttccaccatcggcgggctacgaagcatcatccaggatgcctcgacgttccagttctactcgtgatgggtgatgatgcatacgtactgacttagtacatacagaacgtcaggatcaactgtaaccaggccaagaaattagaggtatcaagagtagttgcaaacgatggccatattattctgtgactttcattgatcgttggcctcgcttgcagcgtgccggccagcggtccttgcgaaatgtgtaactgaagacgaattacagtagtgattcagtgatgcgcatcgaccctgtctgtgcaccagatgtaatagaccttgctgacacacggtttcgcaatcctcatgctgaataacatcgatggcgattgcagggagaaaaatatatataaacatctagtaatacaagtttactatcgcagtgattgcgaatcttctattcttctgtttcgagtgcctcgtctttttcgtttatgtttatatttgtcagccaaaatttgaattttcaactttaaatttgaagctgattttaaatttcttttcattgaagtttatttttcagcctttgctttaaatcgctaagaacacatatataaaagttttattcacaaattactttttgtttgcaaatatgccgtttcgcacaatggctccgcgagtgttgtaactttaaccttgaaaaaaaaggggaaaaaaactcagaattgtcttgtacatactttatctgtattataaaaaaccaatctagaatcggatatgatatatcctatgtttagattcttagcacttcctctgttttataatataaaactttctagcattactcatattcatatatatatatatatatatatatatatatatatatatatatatatatatatatgtctagattcactaacatttatatggatatgagcaatgctaaaaagtcttacattataacatatatatgtcacatcggtattaggttggtgttgacgaaaaaatcgaacacactggcctgggagatctgcttagctcctgtgcaggtccaaatcttgatgagatgcgggcgtgccagtcagtttgatcctgtaactgacaagatatgcaaatagtagatcaaaacagccgatcgactgacaagccgatggagtagttccagccgatagccaataatagccgatgccgataccagccgatagcgatagggtttaagcaatcggctatatgtccaatgtagatgatgatataaaggcaatcggctgatgacgatgtaatgaaataacaatataatccagtataaaccaatcggctagcaatgatatgataaataagcatcaatctgaaggttaaagcacacatcggctggaggtccgatgtcatgaaatctacaagattagattaaacagtgaaacctttattgtcatcggctaaatccaacttatatgtatatgcaatccttatgagccaatgcaacgtccagataactcaccggctgaagccctgatgaaacccttattggcaatcaagaagcagactagagattatggttctaagcacgacttagtagatcaaacttaactgatgcagcactaagtatgaaaagaaacataatatctagacaatcaagccgttgactgagttttcagggtggtagatgtctaagctaatctaatctagcaacgcgatttagccgataccggcataaatcctaaaacgagaagcagccgatagagctaaattgatatgctaagactagattaatagagacatatgataaataggtaggcaaatatatcatccaaaccagagcaatccaagaggtcgaatgtactgatgcagccttgaacgacgccaacgtaaacgatacaattgcccgggccggtggaacattggacttaccctttagccggagatcaaacaccgatgcagccccgcgtcaggtgccaagtcccgccggacgataaaataaagtagaaaaggtaaaaggtggcgatgcgccgaattgtattcatcgtgaagatagattacatagaccccaagtgtacatatttatacccatgggttgatacaagtctttgtcggacaagaaagaaactttactaaagataaaaggaaaagataaagtccttataggacactaaacacactttactaaagataaaggaaactaacaaactatttctaattaatagataactgcattatctttgaactcgatctcttctggataagcttcctttagtagattaatttctttaaccgaatatagtaagaatccgacaactgacgacttacaactcttatcggctaatctcaggactccgaagccgatgctgactctaagccgatgactactccgggcttaccaaatttctgttaccagttggtttttcctgagacaaaatccatcccgttttataagttgtaatatgccgtgaccatataggccacgtatacgacaccttgttccacacaaatcgtgcgccgcagcgtcgcgcccggaaaaaagcgcttatcccccgcccctctccaccccgctccgcggccatggcgatggcggcgcgaaccctcgccctcgcattccccctccccctctgcgccgtctcctccccgcgccgcgccaccccactcgccttgccccgccgcggggcggcacgaccgctggcctcgctagcccagtgccccgcgcgtggccactccccctcgccgcggcgagcagcggggcgggcccttgcgccgtgcgcggccatgcgtggcagcggcggcggtggcggtggcggagagtttgcctcggacgatggcggcggggcgcgcgcgctgcttcgggcgacgctgtggggcgccgaggccgcctacatcctctggctcttcctcctaccatacgctccggtctgtacgtaaacacgaactttttttgctcctgtttgtgtagatttcgaagacaccagattttggacattgcttcaatgaactggattaaaattttgccgccagtaatgcattacagtacaggcttacaacattagttcgttccgatgtacttacaaatagggattactagcattttgtgtatgactatcttttgattactcaacatcaattttggtacatttgcatctatgaattgtatttgtacagtttaagaccaaaatgcattagtgcttcttcgatgtagttagcaacatcggtgtatggcaatacttttgattcgttcattagtgcgtcccgacgtagttagcaattaacatcgttgtatggcaaaactttgattcgttaagatcatgcagggtgacccggtgtggggtatctcgcaagcaacgatcagtgacctcattggcttgtcgctcaatttcttcttaatcctgccattgctcaattctggtacgcctgtaatttaagaatctttagaggcactctaatttgaagttcacagcattacggccattgattctattggtgagttttctgggcagcgtagctggagttcacctgctcgaatccccggtgttgcacccagtaagaaatcgatctgcatccacttatcacattgtgattgttgccatgacttgtgggtacagcatttgtgctaaatttggtattactcgcctaggtggctgaaggattgttcaattttgtgatcgcttggacactgctctttgcgccgcttctcttcacggattctaggagggatcggttcaagggatcactcgacctactgtggggttttcagatgttcctcacaaacagtatgatctaaccgacaagaagtgctttgcagctcatggatagatcacttcagattatctaacaacaatttttatttgtttagctttcctgataccttacatggcaatccgactcaatgatcctgacaaggacaagtctccaccacaaacatcaaaattgggttcagttatggtaagaggtgctccaattgtcggcctaactggtggcttggtctgtattttgtcgattgcttgggcactctttggtcgcgcggatgctagttttgggggcattgctgaacgctggcagtatgtccaaagttatgtcttttcagagcggcttgcttatgcatttctttgggacatactgctgtattccatattccagccatggttgatcgcggacaatattcagaacgtgaaggcaagtgctactgagtttgtgaattcagtaaggtttcttcctgttattggtcttgttgcctacctgttctgcttagaggacagagatgattagctgctgacatgtcataatttctgtggccaagtatggagagatttatgttaaatgaattcttcacttggtggcacattttctgctctcctaatgttcatggcaaggaaaaaaaatcgatggcacaaagtacttcccttgaatgcctcaactgctaaatccatttgctatgaaaaaaacaacaggggacaactaaataacttctctacggcacaattctaatctcccctaagtcttcagaatgtcagagctgacaccaacgccataaaaccaagtgcgacaggaacgcagtcagctatcagcttgagcccgctgctgtattccggcgtctggctgcttgtcttcggtgacggtgtcatctgttgcggcggcgcccgtgtcaccgtcaccggcgtcggcgtcgatggagcagtggagttcggcgtcgagcgcgggacgctcaccggcggcgatggcgctgctccccctagatcaaaccctacaagagagagttggaagaaatttttcaggttggtcgccgacgaagaaagacagggaagaaaaaaactcgggacgccggcatgcgatggattggacgcggcgcacgaccgaggctgcacggcgacggcgagatcatctcggttacctgggcaggcggtggccgccggcgggaggtcgaggcggcagaggagaggcagctgcaccgcgcgcgtccggttcacgggcaccgggatcgcgccgccgccgccggactggctgagggcctggcagaggcagagcggctcgtcgtgcaccatgctgcccaggttggcgcagcacgtgttcgacggcgcggcgttgttgccgccgacgaagccgaggcatgggaggagccggatgaggccggcgttgcagccggacccggacgacgcgccgccgggctgcgccgccgcgccgggggcggtgaccagcagcagcgcagcggcgacgacgacgacgcaggcggcaacgacagctgaagaagccattggtactggtacgtactacgtatcctctcctagcttagctactcctttctcggctgatttctatgtagattcattagttgctttgagatgctaggatttatataggcatatagcactggaggaatcatttaatcacaatgaaaacgcgtggttgctatgcatggcagcatgggaatggtgtgcttgatcttcttgggggcgccgattcggtgattcctgtgaagttgaacgcgccatgcatcgcatgcaggatgtgcgttctgtgtgatcatattgtagcgtttaggatcgagttggcatcgtgcatggtgtgcatgtagtaccatgtactgatcctctctaggtcggtgtgatttctattgaaaatttggaatcagctgttacaacttaccagccgcttgaaactgctaccttgcatgctgctgatagctaagctaaggttagcagagtttagtttgatgccaattttggcgatggctacctcttatcaagctttgataggagtgaattgatttgtggagcatttattttgccgctaaaatttgggaatatagcttcctcacttggatctatagtttgattcatccccaaaggtgaaccattgttgggagtaaattagtaagcttggtttggcagacttgccaatgcatttcccaattggtcagtcgctctcctctagctcactaactagtgagaggtactgggccacgggttttgctgggccctttccgattgaatgctattatgaagaaggccacatcttcgcttgttgggctgtcgtagggatggcaacagggctgggttgggcaggaacgcccccagccccgctaccttgttcggggcaaaaagctcgaatttttttcgtttttagattttttttaatatttacagaaataatctatcaaccaaaaaaattgcagaaatagcccctgccgcccacctctgggacggcaagctgacgtggcaaacgggggaggaacgggcggtgacggagggagggttttttttgcaggaaaacccttgccgccctctggtggggcggcaaggggcccgaatgcaaaaaagccagtcggggccggctattttgcaggcggccccttgccaccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttagaattaatacattaccgttgcattggcttacacaagaagatattacgttgtagatgtttattgcatgaaagagtaatatgatctagttatttcgttgacagatatgtcgaacaaacaaatattccaagtttaccatggaccaagaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgaggaaccaagtgttgaagtaaacgagacttctgtggaggaggtcaatgcacgagaggacgggggcgtagtagctccagtgggcattcaaccaggtggagtggccgacgagggggagactgtcggtgccattgtggatgaaatggagagggaggattctgacaacgagcgtgtaaaggaaggtgattcgtcagatgatgagacggatattaatccagcagaatgggctagtgaggatttttctgggctgatcgtctctgaagaggatagtgtgagatgggagttcaaagaaaatgaggttatccagggagcgatttatagtagagcagaagatatgaaggaggcggtaaaacattttgcagtgtcacttcatagagagttttgggttgccaagtcgaaccggtcgcaatatgaagttcggtgtgttaaggaaaaatatggttgtccctggagagtgcacgtgtataaggggaaatggaaggattattggacagtgtcagttgttaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgctaaggcctggagggccaaacagaaaataatagagatgagatttggaacttacgaagcctcgtatgnnaccaattctgnnccacgnnncctgncttggnntgttatcgagnngaaagaaannncctgggnnagctcttacnngaaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaagccaaatgtatgtctgatacatgataggcacgctggcattctgcgagcgataggagagttgcagtttgggagtatggaacgaggataccccggtgtttgggaagatgtacagagtaggtggtggatgcatcatatgggagctaatttcttcaagcaattcaagaacaaggagctcatgaacatgttcaagaggctgtgcaatcagaaccaggagaaaaaaattcaatgagctttggaagagattaggtgagttgacagccaaatgcagtgatcagcgtgcagcggctccatcgaccgccgttgctgaccctcctcaagctcttggacctctcccaacggatagtccaacattagttagaagaattggattggagattcggaaattttctcagtggattctgcatgaaccaaaagagaaatgggccaaggcttatgacacaggtggtgctagatatggaataatgacaacaaatttggcagaagtttacaactgggtgatgcgcggtgtccgtggactgccactagttggcatagtggagctcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttcttaaagccgacggcacatgtcattgctcttgtgcaaagccgaagctgctccacaggccatgcacccatgtcattgctgtcgcagcggagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacagtaatattttttgaattgttctaacacgaaacactatatttttcagagatggcacgtcaggatacaccttagttgttggacccggcgatagatcaccgacaccggtctcaccttactgcggtgggtgctcagcttgggacgttccgggcacggacgtgcggtgagctactcacggttcacgactcctttgtcgagaggtacgaacagtgttttactataagttagttgcactgtagagcagtcttctctttgtttacttgcttcactttccagtactgtatgcttgtgtaatgactacgttgttgttatatatgcacgataccttttggcgcatgcacgatacctttcggcgcatgcactactttctgccgcaccgatgcagcctcctttattcgcgtgtgatacgagtatttgcccgccatttggcacatacgaccaatgtaactttcggcgccgatcatgcatgtatctttcggcgccaatcaggcgtacccaccataccccaccacgttcacatgtcaggggtatcactcgattttttgcgcttatataagtcgccttaacgagtgaggcctcacaatctttcagaactaagtcacattcagtactctcttccccacttgcttcattacaaatccgaccggctttcgtcaatggctagacgccgagatgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcagcttatgaacgacaatgtcgtgaacaacagagcgactggcgggtgctaactacggcactccctccatgggaagcccgtccaagatgcaagtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccaaaagggttctaactccacctagccgtgttgtgcagcttgaactaccagagcaatacagggttactaaagcgcggtttgagagaggagagggatcctcacgtaggggttagctattatcggacaacttagcatattgaaatttctactgtcatgcttccttgtccca

SEQ ID NO: 69659 - DNA, 12383 bp, Oryza sativa
tgccacgtcagcttgccgcccaccattaggacggcaggggctatttctgtaatttttttggtcgatagattatttctgtaaatattaaaaaaaaatctaaaaacgaaaaaaattccaaaaagctcacccttccccggctccggtgggttcccaaactctgaccggggcccctcgggtggtgaaagaagaggagaaccgacgacatatcaggctaccagtgacagcagattgggttggggcgagggatggcaaactactggcacctcgaaaggagacgtaggagccagaggagtttcgaattgtagccgaggagcgtggtcgacacatgtgttggaatgttgcaggggaggagccccggacgctgtcgggaagatgggagcagagaaggtggggaagcttcgtactgcaggaaagaactttgcgttgagctgggaagagcgccggctgtcgcgggaacaaagcttggtgggggcacggcatgtgcgctccgcctcttcgagaggcggacggcggacagagggatggagacatggagtcacggagagatgggggcagctataaaaaagagatatacagatagggttgtgctagtctacggttcatatttgggctagttgttgtgggctttcctctctaaattgtgatatttgggccaacttgcctctaccaagtgggtctcctgggcttgcagtgtactatattttaagtgctaacaaataccccggggcctcgcgggtaagtttcatcccccgtcccctcaaatgaccgggaccctgccccgacttccccatgggttagaaaatcccccgtccccggtccctacgaggaaattgccacccctaagctgtcaacagctctgtctcctttcggctgatgggtggtggcggtgaaggggtagaggtattgtaggaggtaaaaaaaactggagtaataaacaagcatcttagctcactgcatatatagtgaagagtagcaaacataccaaaaaaataaatattaatccaacatttagattttttttgtccgtttgctactctttactccctccatctacttttgatagacatatttttaaatctgaaaaaattatttttatagacatattttaatccaacaatctatcatcttaatgactttctcagatataatgcgtgactctccattccttcataagattggctacatgtgcatcgagaaatgtaaatattaatgaatcgcttgtttatgagaaatgactggtagcatgtttaaatggatgataagtagaattacttatccttgatctgtgtgccaagatgaaacatgactatcaaaagtagatggatagagtaacatatatggctgagattctgatttattactccatatttctttttagatttttaccttatcaatctcatcaccgcatgattagcaactattacggtgtaggggtggagctgcctacctgccatagtgccatcaaatgctggtacgagatggaaatagttacgttagtttcgtgcttaggattagcacttcgcgcgattttgatacttatgattagtgatgcaatgctggattagacaccgaagtcaacacacagtactgaaaaacatgatgagatatttggtcacaattaatcagtaaatgaaattgtttcagttttgcattgaaataatgaaattgttttgagttttgcattcaaatgaaattttagcgggttgcaaaatgaccaatgatttttcttaatgaaaatctggtgttgtggcccctttctctaaaagcaatgaggttgtttgaaaataatgtgtaggacttctaaatccacttcacatatgtgcatgctctttacacgtacttagcgataattggaggcgcctaaagatccctcctgaaagacatgcacatatgtgtactcttaaaattattaattgtacggaatacagtgttgctgatgccatagatttggcattgttggcacagtgcacatgctagctatttggccacaagccaacatcgatcctagttaaatcacttacagtagatctttttttttaaaaaaaagaatactatcgccggtatggattctaaattgtacaattttttttcgcggacaaaagcttatataaccacccaaaaaccgcgttaaattgatttgaattggagtaaatttcaaggggaaaaaacgtgcattgccccatcttctcataaattctgtgttttttttggttaatttgatcttgtcattgcaaacgtgtgacttttacagtacaatatacaacaatagtatatactgcaagtatacatgatctaacggtgtagattgatttgattttttagttaattagattacagtataaaatttgaaagagtaattttgtcttttctttgttattctatcaaatcgtgctatcatcacgtgtttcgtcatcaaatggcggtcaggatgctcctcctctagtgcaccataagatccaggactaggtactctcaattagagtcgctcagtattttttttatgctttcaaaaaaaagtgtattttttattttctatcaaatttctaacatgtcattctatatactaccagtatatattgatagtatattgtaccataaaagttctatgataaatgccattacaaattacctattcatagccgtgctactcaaattttataaaattagaaccataccatcaccgtgacgtttttcatcttcttccccatctgcacgtggggtccacccctcagattcatcttcctccttttttttctttcttttttctcattccctaaacacatttgcaatggcacggatcaaatcaatctcttttttttttctttttgctctacattgtcttcagtacaattatctgttcggtcctacccgttgtcggtgatcggaccacccagctttccggtccttaaaacggagtagaagaacgggagatatcaacgtgaagtacggctaccggagtagtagcaagttgcaagctctccccggttgtttgaggctggccggatggccctggctcctcgcatcaatcacgggctgcgccgaatcgtcaagaggcgtatcgttgacggatttatgtctgatttgatcgagcttgagatcgcatgtatatttgtcgtaaaactacaaggccccctcgaagcttgaatgctatcaatgcaaagggaaggagccaacgaaggagaggcgagagcgttgagtttggtaagaaaaaaaaaggaaaaaaaaagaaagctaatagaatcgaccatgcatgcaatgcaaccactttttgatactgatgtccgaatagaattgaaatcaacattgattgatggagggaattggctagagagtaccccctgtcttaatgctttggcttatatggctaagtaacaatgattagcttggaggttaagcccaggaggtaaggtgactcgatcttccctccatatgatgccctttagaccctacttaagtctcatccaagagaattatgcatcagtatcatcactgtattcgctagtctgtcctgtgccgcgtgcaactgatgcagtgccatgtttgggtgaaacatgtcttcagaagttcagatgtatctctggagagaggagcctgccactcatcccatgcacttcaccgacttggagggcactcaattctatcccaagtttccaaccacatccagggcccggacattcttcaaggatgctaccaatctaacaacacagatacacaagggtagggcatatatggtacagtttgttaaaaacacacctcctgacagcttgtatgtagtactaccagtagctgtaaagaccaattcaaatgtgtgaggccaagggcattgaattgttctcaggggagaataatggtctcagatcagcaatggtaaatgggggtactgctgctgataatattattgcttgcatgagggccatagcccatacagccttggggtaaacttgcatgagggccatagcccatacaaccttggggtaaaaaacaaggctgcagagagcacacaacaaacttgcaaagggacagatgaacaaagacaacaggagcaactggaggctgctataaaaaaaaagtgaatttctgtgccagattgctttactatacatttgaatcttactgaccatggtagtagtaataaattagtaacaagttcaaactgagctgccatgtaacaagatctagttttggataagctgtggtccatgtttagtgataatgatagtatattacctttgggttatatacatatgacatggatagcatatagtgatagcggttatcaagccccctttagaacggagaaatttcacgggaatttcgaaggcaatgaaccaattcatgtaaaattcatgcattccaaaagagcatcccagatttcttcagatattaatttgtgcctcatgtagtgtacccaacatcgtgaaatcaaaccatttttctatacccagcttcgtctttaaaaaagtaccaaatttgccaacgactcctttggaacaaagtaatcttggaggaatttttatagaattcaaatcctatggaaagtgtcctataggtccttttggaacaaagcaatggctgtttttggaggattttcaacataagacccaacctaatttaaaaaaaaatcactctctttctctctctctctctctccatctcctaattcctacattttccatgcgttatatccaaacaattatttatgtagttttgatgtgatttttcattcataggatttgaggtgccaagtattcccgtgtttcggaaatttcggaacactaaattaaaaagaggagtaattgcccaagagagaaaaaaaaggaagtttgatacagcaggtcaagctcaaggtcaaaacccaatggggcaggtgcgtatggaggcggtgacgcaaagcatatacacaggtacatacatgcaacaatgccgtcactgactcgccgctctgctgcacggacctgccattgccatgggattccttggagtggcattgaagcctagctagctctacgtttgagctgcccccgtgtgtacgtgcctgcccgccgatcggccatccccttggatctcgcagctttctccagtttcagcttttgcttctccttctcccacgtcctctctctccctgaccctgagccaaagaatctctccatcctccatccttgaaatggtttgatgcctgcaggcatcagccatgtccagttcagccagaggaatcaccctcctctgcctcctcttgatcgtgtcatccactgttctccacttctcgatcggcggcggcagcaatggcgagaagaggagagacgatggtgatggtgacggtgacgatgagaaggtgaggttgttgcttggtgccaacgctctgggcgagcgggataggcggcatgggcatgggcatggaggtggtgtctcttcggcgccggcgccggctccggctccggctcgtgcccacctgccgccgccgctgctgcacaagaacgcgcggctcccggacccggtgcccggtagagtcgggctcgggcacaggagggggaacgccaccgcggcgcacagacggcgcagcgagcgggaagggaagaagagcacgccgcttgtcgtggtcgccgcgggcgccgcgctgtccggcgcggcggcggtgctcctcgtcgtcctcgtggtgttcctggcgtgcaggaggttccagaggagggccatgccgggcgctgaccagagcgggacaaacaaggtgagcttcgatcctggccccgacgtgttctacctggacgccgtcaagccgtacgtcgaggccgaccatggcggcggcggcggtgttgtgaagacggcgccggagttggccgggccgaaggaagagcccaggtgcgaggaggaggacagcggagttgccctgtccgacgacggcgccgactccgtccattcctcgtgctgcttccactcgtcgcacttctcctactccgagctccgggacacgaagccggggagcaatggcgtgtcgccatcgccatccggccggtcaagacgacggagctccgcccctgtgacgccctcagagaagaacaaggctgcgagcccttattcgccgcagtgcccgcgcacgccgagcaacagggagcgatcgtctcgcgcccactccccgagctcgtcggtttcggacttgacatcggtgtcgacatcggtggtcaaggatcatgaagtccggcgagccgtccattccctgatgtttccagaagcgcagagcggcggcgcggggcacgtgaaggaagacgaggcagaatcaggcaatatgaggccgcctcctcctcctcctccgccgccgccgccaccgccgccggcagtaacacagcagcaggatgtcaagacaagctgtggaccggccgttcccccaccgccaccgcctacgcctccgccgccaccgccactgctcgcaccgaaacagcagagcagcggcggcccgatcctcccgccggcgcccgcgccgcctcctctgttcaggccgtgggcgccggcggtcgggaagaacggcgcgccgctgccgaagctgaagccgctgcactgggacaaggtgcgcgccgcgcccaaccggcggatggtgtgggacaggatccgatcgagctcgttcgagtacgtacacccaaaacccaccccatctcccctacgactacgaacgagctcgaggtgttcgacacttcgaccacacgagcgtacacgttttcgcgccacacgctgatcaaaccacgtctgattcgcaggctggacgagaagatgatcgagtcgctgttcgggtacaacgcgaggtgttcgacgaagcacgaggaggtgcagagccggagcccctcgctcggccaccacgtcctcgacaccaagaggctgcagaacttcaccatcctgatgaaggccgtcagcgccaccgccgagcagatcttcgccgccctgctgcacggtaaccaaaccgcacggcacgatcgagcacgaatcaacaccgtcctgcacggcacagttggtgtgtgtgtttaatttgagttttttctttctttctcttggtttggatggattggtcgcagggaacggcctgtcggcgcagcagctggaggcgctcatcaagatggcgccggccaaggacgaggccgacaagctgtccgcctacgacggcgacgtcgacggcctcgtcccggcggagaggctgctcaaggtggtgctcacgataccgtgcgcgttcgcgcgagtggaggcgatgctgtaccgggagaccttcgccgacgaggtcggccacatcaggaagtcgttcgagatgctcgaggtgaatcttggggtgttcgtcgcaatggcggtcttactgattctgcagctttgtgattatactattaagattctgagtttggaaatggcgtgtcgttcttggtgtctggaaggaggcgtgcagggagctgatgtccagcaagctgttcctgaagctgctggaggccgtgctcaagaccgggaaccggatgaacgtcgggactgcccgcggcggcgccatggcgttcaagctcgacgcgctgctcaagctcgccgacgtcaagggcaccgacgggaagaccacgctgctgcacttcgtggtgcaggagatgacccggtcgcgcgccgccgaggcggcggacatcgccgcggggctcggcgccgagctcaccaacgtcaggaagacggcgaccgtggacctggacgtgctcaccacctcggtgtccggcctgtcgcacggcctgtcccggatcaaggagctggtcgggagcgacctgtccggcgacgagaggaaccagtgcttcgtggcgttcatggcgccgttcgtcgcccacgccggtgaggtgatccgggagctggaggacggcgagcggcgggtgctggcgcacgtcagggagatcaccgagtactaccatggcgacgtcggcaaggacgaggcgagcccgctcaggatcttcgtcatcgtcagggacttcctggggatgctggagagggtgtgcaaggaggtgaggggagccaagaattgccatggcgggaatcctgccctgaacctgaacaatgtatgataccgcaaatattggggtgaaagaacaacattgtaattcttggcttcggattgttcttgacatgatcttgccagattagaacagatcagttcgtttagattacaagcatccagctcttcatctatccgaagttccgatgtgcattgcacaatcatgcaagtatgccaaaatcacaccgtacaagcgttcctggtaccgcaaagcagacagtaccactactatgtctgatacactgaatatcactcttgatctgggggaaccagtgtttgaacgttgagggagttcaaaacaggaacacgacaaggttgagatgagatgcgcgaaatagcagtggtactggtcgaagccgtttgtttgctcccgcgtttcttccgcttttgtctctttgccatgattcctttttcccagcagaatttgaatccgtttgcgtcacctgcagagtatcagaggcccacgttgttatcagaaccgctgtttatttccactgctgctgtgtctgcctcgtgcttcttcaggcccccccgaggagttttactgccgactatataactagtatacgacaagtgacagtatagaaaactaccgtactcatgttagtgttgtgataagatacctacgagggatatcattatcacgggagcatggagagtttgaacttttgtatccgtaagcagagacagtacgcatgatatgtgctaaaaaatagtactagctgaaatatacatcaaaagaggcatctgaatcttggagaccagcctgaggtaacagcacaatggtcttcagttatatacttcgatttagagagtaagagcttttcgtgatatactgtatttgatcttgataacaagcagagcaagcgtgccaaatggccttggccggaaccaatagccgtcggaataattaactatttgccactcttacgagcggtgctaaattatttgcatccggtaactgagagctcggcccatgagctacaattgtcaccactaagaaaaaagtaccaaaggtccctcaacttgtcatcgggatataaaaatgtcctcgaaccgcaaaaccagtatgcggggtccttaactatacaaaattggtcacccgaggtcctttggtggcggctgagtcagcgtgggacccacgtggggcccacatgttagggttatccacgtcagcctcctctccctctttcccctcttctctcccttcctcatctctttctctaggcagcctcctcatctccttccgccgctctgggcaggccggcgccccgcccaacgggtggggaggagagcaaggcggcgacgcgacgcggcggcggcgccaactcaggtgacaagttggactgcgagaccatccgctggctcacccgcgagctagggcacaagtccgacagcgagaccatccgctggttcatgcagcagtcggagcctgccatcgacaccgccacggggatgggcaccgtgcccgcgatcaccaccattgtcgacggtatcctccgcatccccactgagtcgccctccgccgtcgcggcggctgcccgcggcgatgagcccaccccaaagcggcgtagcaagctccagccgacgcgcgcggcgaccgacgacccggtggaggcgctggccatggctcatcccccgcggtctactacccctttgttgctgcccccctcctccaagccaacggcggtggctcgatctcaatatccagcggcctcgcccccgcctcatccgcaacagcacccacagccgctggaggcagcacaatcccgttcatcgccatgccggcagccagtgacggcggcaagcaggtgatgtcaccggtgactgtgtggatgctcccgcccggcggcgcgggcgtggtgaaccagccaatgcaatacttggcgttccaacccaaccgcgactaggccaacttcgccagcagctccaactcccagcattagccattctacaacgtggggcagaatcccggtgtccagaattcctcggttctcctctccgccgggctcctccctcgccagtcgccggccgcgccggccctcccctccgccgcgccgcccgcgccaccgtgcgttgccgcctcacctcgacggacctccagctgctcccccgccgcccgcgcatggagaaggccgccaccgctcttctccccagcatgttcccgcctcaccactgctcttctcccctgccggttgccggacctcctcctctcccgcaccaagtcggtgccgcaccaagccgccgccgcatcgcccgtcatcggccaaagtgagagagagagtggaagggagagaagaggggaagagattgtcctacgtggcatcatggcatgtgggacccatgtgggtcccacgctgactcagccgccacgtaggacaaatccagcgtcaatactgccctaggacctcgggtgaccggttttgtatagttaagggacctagcatatctggttttgtggttggaggatgttttttatctcgctgacacgttgagggacctttggtgctttttcctcaccacgaactgacgtcaaggcccaactcgttttcctgtcctggtcggtcaaatacctgaaaagcaggccgtgcacaacaccccaaccagagttcagtggcggttctcctacgacaggcttatccttagagcagctccatgcgaggataaaatcgaaccatgtgaaaacaaagaccgaacatagcaattgtatcagtcgactgctacgaatttgagaaaaaatccacctccaaagaggagtcgaaataaaccgattaatgccccgcccccatcgggatggctatatggctgtcgactgattttctatagctggatcattcgttttgttggccgtttgatttatttgagattcgtgcaagctggtagggcctttgctagttgggtctgtgggctttttattctgtgtgggcttttggttctgaatttgctttgggcttggacaattgcttcgggtgtatagcttggacttttggtctaccatgggacccacttgcactgttgacagagagagactgagtgactgtgtctgtgagagagagagagtgagagcatacagggcgagaaaatttcttgctctcatcgtcccacgcgatgcggcgattgtggaaggcgacacaacatcgattcgccggtgatctccttctcctcttctccagtgaatttagttcccgtttgtttactgctttgttcatcgacgcgtcgactatttgtattttgtagtggtgggtttttgacgctgatttgtgggagtcatcgacgattcgttggcaatatcgttcttcctttctccggtgagtctcatagtcgttgtgtagtgtgttttgtgtcctcgtcgtcctcgatccgagcttgtcgttgtttccttgtgtgctgcaaggttttagttgtttcgatttggatatgtgatgtgttcgattttcgaatgtaactcggtaaatccccttgtttcttattcaaatctgacatggtgatctccttgtgtgagtttttcccttttatttagggtattttagtttttttgtggggatttgtgctatgcaatgtttcaatttcgagttgtgtggtgtgagttgtcacggtgagccccttctgtgagtttttcccatttgtttagggtattttagttgtttcctgcggggatttgtgctatgcgatgttccgatttggatctgtgtggtacaagttcctcatgatacatagagtagaagatgaggagaagcctttgcgatgcattgttcagccttgctagcatgctattgaccttctctgaatcagaattaacacatgttattttgatgacagtgactgaatctcttgaagcatccatggccttcttatgctaaaagtctgcagatgctatatatgctatgtggaatctagtttggtatttttactcttcggtgaccaccttagactaattttattagatctgtaaagagcacaagttattgaaaattttgaaatgcatcaatgagtttccaacattttagtattatcatgcagattgtctgacattttcatgaccaagtctgctataaatatatagtgatgcacttttgctgcaacaataaattgtataaaaatgattagtccctcatgtcaaattagaagtagtagctaaacatgattttcttctagtttgatttatatgtaagaccaattagtgggatatgattatgtatggttctggacaagagcttctttgcttcctatgagcatttttttcttgagctgattgtccaggattgagaggaaaaggacacatggagaaatgggctagtctaaaaaaatagaaagcatacatatatgcacaactgattga

SEQ ID NO: 69660 - DNA, 7347 bp, Oryza sativa
agtgttgcatagatagaattgacaagaccacgatctataatggtttggagaggtttggaaagatatttcatcttggttgttgtttacacccaaatttggcacctagggtcgaaatagaaaaaattgcgaaagtttggggctctgccggtttcctccagaaagggccggtctgaccgccatatgtgggccggtcagaccgccgccggagagccggtcagaccggtggcatgtggccggtctgaccggtagagtctgagttagactccgttttcgtcaggtctcgggtggttggcgactccatatcaccgcaaggcgtttaggtgctgcgatcgtgcttgttgacttgtcacaaaaagttgctcttgcctttgataccagctcttgcccaaacaccatatatattgcataatcatcccaattccctccttccacaatatatacttcggacccagccaatagcaccatgtagaccgtgtgcctacaaagattcttaccaaaagaaacttaaaggccaaaatcccatgagtaccgcatatgaatatctccaacccagattgagcttcaagacagagcaaattttatcttgctttgggcaagacatcctcgaccttgtttggcaaaagtttaaagagagacaaatgaaaatatttcaagattatttctttcatctcttataaggcagagaaagaaacccagccatacaagtaatcatatacatgcttcctatcttaaggttagatgatcatcaggtaatctctgacccatcctatagattcatggttctcaaagccgaaataaatctccaaagattccgaaacttacccacatacaaccatgatgaaatatctctccaaaccattatagatcatggtcttgtcaattctatctatgcaacactagatcggattcttcaatttgatttaggaagcgctgtaaaagatgtctgtagaagacttagaaatggaagatacaggattatcttctcctccataccacctaaattcacaccacatgctcgtccagcaattcactatatatatatatatatatatatatatatatatatatatatatatatatatatatatatatatatatatatatatatatatatcatgaataaacaatttaattttcaagaaggcggtcctagcaaattatcagatgaacaagaagaaatgtatacaatgattgcaaatcatgagaattggagattattttctgaagctgcagaaattgaagaagctattaccatagattatgaatatcagttggttttccaaaacaagatcacaaggatttttattagcagatattataaccaaagttgtgaatatttcaagggagcaggacgtataattaaaccagattttactacagaagcctggctcagtggtatcagaaaacagagccatcaaaaattgacatgatgcaattggcacccatgatatacagtgaagataatgaatgaagatcttgtcatccccgacaaaaaacactattgaagataaggaatctacactattcaagataagatatgcctatagtcaaaaggcgatattatgatacttttattgaaggtcaaaagcgtcatcaccaaagattctctccgtgaagtctaaagggataatcataaaaccccttaaagtcaaatggagatatcataaagattcttcaccgagtcctatataaggggctcaggaacacaaccacaacacatctcactcaaccattcctcttcacctctccaccagccatcacacttcactccatctaagtgttagtagatagttatagttataacctaaataaaagacttatgaaattctaagtgtgagagtctatgtaagagtccttgtgagagtcatgtacctgtataattacgaacgtgttgtaccaagtccttggtgtaatcttcagaaggatctaccttcaacctatcaaggtatatgaatgaacacatggaccgttctatataaaactactatgttctaagtatctaatttacattatgtcttgtacataattggtatttaccgtttgtctttactttctatactgcatttatgtttgcatagaactttaaaaattcaacaaactggattaccatccattatgttctaagtatctaacattcttttctctaccccacacactattaaaacttgattaattcactccctttgacacttgtctccttgtagatgccatcatactctactccctccgtcccaaaatataagcatttttagctatgaatctggacaactgtgtgtccagattcatagccaaaagttatattttgggatggaggtagtatgttaatattattattggaactgttcatgaatgttactttatttttgaaattttccatgtctttgcatgcattatttcattttcatatctcgggggattaggcgctcccaacctagtgaagtacacattacaaattccaagaattatttgaaacaagttatgatgtaattattacccaaggtctcgtgcctagtataaaatagtttttctgatatacataactaataatcattctatccggtggtataagttagtaacatgaaagtgcatgggtatttaagaggcacaattagaggtgtaaggtccaagttcttgggtcctggacaaaatgattctttcgctataaactttctggacatattacattgatgtgcttctgattattttatgtgtataaagttttgctaaaggtactatttgcgagcatttcttagaacagtaagaaaagttttaatgagcacatgtgtctaaaattattaagaaagattgaacgctgatacccagtggcgaagccaggatctaagtatgagggggcccagctttataagtgattaagattataaaaaaaatagcgtagaaaagtttatgctaatctaaatgttccccataggtaatataccgtatcagtataaaaaaacacacgacaatttaaaacacaggcaggttaatttagccttatgagcagacagattataagcagtgattgtaccattcaagctaaaagtgtaggtaaacaggaaaaaaataaacaaaaaataagaactagattatggcaaaaagagcaacaaactatccatctgttacaagtattaactaatattttagaaatttaaaatttcaatgttagccacctagtgatgtaaataatacaaatgattagtacatattactcggtattctaaaaggaaaaggaaatagatggtgttgtgtgcctacaaggctagagtaaagaccttatcgctcttgctaaacatacatacgtgcaagcacagtgcctagctaatccatcagcagaatagaagggtggagggggtgggaagaggccaggcccctccgccccctggcgtcgctcttgctgatacttttcttgttctggtacatctgcacagataaattataatgccttttcatctcttctgtctgcttatggctttttaagataaaacagagcattgatcttgcatgctctacacttcgcgcactgtttgtttttgccaataagtttgcacacatgtagctgtcatttgggtaaacaaacttgcagatagtgccaaatagtcataagaaaataattttcatgggctcttcagataatacatttttattcgaatagattttacagtatcagatattaatcatccaagcatgcaaactgtgtcttgttatgtgttagcttctttatgaccaatacattttaagagctctgaactgtagcccttaagaatagtgaaaatataggcaacacttccacaccataaattgtcatggatgcaattggagcctgcaataatttcattaagttataattgatgtttcactaaagaactgagaatggatagatggatcatgtgcagaaaatctgagttaccctagtttaggaggtgtggtttgctcagcatcattttgttggcttgggggattgagttcaagacgagcaggagtgttggcttcctcgataaccgcaaagttgtatggagttgttgaatctcgattcgcttcattttctgcccctgtctcatagagctgaggagagagattagctgtcatcatataatgaagcgtatatcctgtgaaatcatctatctgcatttatcaagtaccttcttgtacagctcagcattttcttggcgaatcaggttgacctttctgtacagttccatgttttcttggtggatgagacttccctgcaaataagccagcaatagagttagcttactagctgattcaaagatttagcaattgtacatgatgttgtagaacctttcgattcagttcgtggatttcatcaatcatgagctggtcctgaaaacaacaatattgatcttaagttaatccattatataatcaatcaggtgcccaacaaaaaaatatggttagtaggttgaccttttttgtccggatgcagcgtatgctcatttctagctgattttctagagtttgcagttccttgacacccaatccagaaagatcttgccccatcaactgcctgccatcaaccaatggatgttatagtgttgttctgatgatatacagagtgaatattgacacttaattttagctgatcaacagacagctgttaattgataataaaaataatttgtacctttctagtttaggtattgtaaattaggcctgaaggacaaaatggagtgtttgaacaataatttaccaggcagaaagcacaggtgaagaaaatgtgatattcactctcctttgtaaatttggtctgtccgcctttgatgggtgctcagttctgtttttcttttagagataaccggaaatgcataaaaatcgaatggctgaaggtatatatttcttacttttaaatgatatagaaaattcacgtgccttcttcatttcttttgtttgtgaaggttaaacaatgcattatctataggaaatttggaatcagcatatatcactttcatactctgttttttcttcttttttctaagtatcatatacccaagcactaggtgcttgtttttatgatctggtactagtttatatttactatacaatcaggtgctggaagtattattgtcgctagcagttgctggattcatgagcaagtccccacaaaaaaaaaaagttcatcatcaagggttcatgatgcatgtatttcatagtagtagatatatgatggtttatgtttttctatcttgaggaattttctgatggaacattgaaaaacttgcagggttttatggccataccgatgattttcttgcaagctgtgcagttgttgtctcaagcttgctgcctccctttgccagaactattggatatgaaaacagagtcaagaaatgcagaatccaggtttgccaaaagcagcaatataaatatgttgtgtatacccatagaaacatgctgggttatcaactcactagtttttttttaaaaaaaaggaaactcaattacattagacaagaagactatttgaactgaggaagttattgtgtatggtaaaagaagtaacaagaggcaaacaaagaaatttgttgtaaacaaataagggaagtagtattatctttccagtttgaagacagtttttttttccagataagacgatgagctaccaactctattgaatttggtactccattatcagtcctcgttttgcggggtgttaccccctattgtaaaaagcttgtttgtctaagcaaaatgcttccaagtcccaccaaagctagattaactacaaagtatctgcagagtgcacaagtcaggtaaaaaacttgtttgtctaagcaaaatgcttccaagtcccaccaagctagattaactacaaagtatctgcagagtgcacaagtcagataaaaaacttgtttgtctaaacaaaatgctcccaagtcccaccaagctagattaactacaaagtatctgcagagtgcacaagtcaggtaagtgatgattatatcatcctggtacaagctttattgcggtgaaagataagcagttagtctgaaatctgtacagatctgtcagctgttaccgaagcaaaaggttcaatgtgaacttaaagatgcagtactgatccttttaagaggatttaacacagatttaacaggtacgtgccccttgtgattctttgttagttttcttgttataatgatgtttttatcctctgaattcaagcagggtgttctgtatgcgagctgtgatgggatggttctcttcagaagcattttattttaactaaattcagaagcatttcgatggcatgaggactgttcgattgacaatttgtatgtacatttccaccgtttacgcagcttaggaattggaccataattagttgtgtacctgcaagttttgtatacgaattatcctgaagggtgttcggtggattgaatattgcccttttggttgttttgcgcatcgtggatgcggctgctctacatttttcttataggaaatcagcttctgataaaagggattattatctgtgtgatctactgatcgatattttacccctctagctgagtttattaagccaattgattatcgagtgggatcctctcaacgacacatgagcatgagcatccggctgtttgttgattaaggccctcttttgtttatgtttaaacctaaataaatagatattttttcgtttgtattttttaaggtcataagtcactctatgttaagctaaaagctaggttacagtagcttttctggtctatgtgaagctaacagtctactacttaaggtttaaaaaacagcggcttaaacaataaaaatattcaaaagaaccaaagcgagagggcttaaatggttcagccgtactttaacggaaaattttttggaaagacaaaatggcaaagttgattgtcacccattattatccaatttcgacgtttggacaaatcctcaaattttaaatgataaaaagtactccctccgtattttaaacgacaccgttgacttttcgaccaatgtttgaccatttattttattcaaaacttttatgtaaatatgaaaatatttatgtcatgcttaaagaacatttgataacgaatcaggtcataataaaataaatgataattacataaattttttaaataagacgaatgattaaacgttgaacaaaacgtcaatggcgtcatacattaaaatatggaggtagtaatttagaaggtaagatattcctttacatgtgtggtcgagtctacggaatgaggattagcgacccacacctcgtgtggtagggagtatcagatcatctgcccaggagccatagctacgcatgctgatctatagtggttcacccataagttctttaatacataatcgagggctgcagga

SEQ ID NO: 69661 - DNA, 3674 bp, Oryza sativa
atagacattgatatgtgtaacactaagaaagcggaactcacatataagtgaccgtaatggtatagtgatattatggtagaggatcctcacccgatttgttgtcctctttatttccctttttttaagaaagatgacgtgtgtgacttgttagttgtaagatagattcacttgttttaggcgggattatttctcacactacagcaaaagagggggagcaaacacctgattttggtaaccttggtaaagactagaaatgtttctattttctctcaaaatgaaagatagcgaaagtggtgatttggcaaacccaattcaatggcacaagggctttcgccattgtgaaaaggtgagctctcagaagattttggggtgtaggtggatgcatataaatggatgaggttgtttattttgaagttattggctaccatctttgttgctgtagagactaggttttattctattgttaaaaaaaacttgattcaagtgtaatcaactaagagttgagaaggccaatacatatttattccttaccattgtcaatgtacatttactatgcaaaaaaccacatcactaacatttaaaacaagagaaattatatgtttcgttattgacaaactaccgattttaaaagttgccattagaaagctcgagctctagaaaaatatcatcgtacaagtgttttttttctcgttttgtcactgccattaggtttccatccataaacctccattaagtctttagaaaaccaatttgcccctagaatttgataaaaactgtatgaaaaaaatgtttgcacacttaatggagatctttttatgagcagaatggtccttttagaagaatgcaggtctatggatggaaacctagtggcgatgataaaaagggacagaaatgcttgtaccaaggtattttgtatttcgtagaactcacgttcgtcgatgccaatttataggacatgtcgcttgtcaatcgtaaaacgtagaatttctcttacaacaaacaatgcttacttttttcatcacaaatgtagttagtaataaaagttgtaagccttgttattccttgggtttatcccgagaaaactcacaaataaattactaagtctgagttgagctactagctatagtttttttttttggaaaaaaaaaagggttggcttactaactagtgtcaacatcattgagtcacggtgatgagaatgcaatatgttctgcaagctatgctaccttcatatagcatgcctctacccattacatgcctatgtcataattttgcacctatgaagggatgagctagatatacttaagttggcactacttcttaagataactccttatataccatccaaagctaccttatatcccaatagggcaaaaccaatggtagaatttgcttgcacggtaggcattgttaggtctatcaactaaggaaacatttcgcttattggaaggttggttgaagagtaaggacagaggagacaccactacaacataaaagctcatcgtggataggctatcaagaactatttgaaattcctcttatatgaatatagagatgcttggttaccatgtccatctacatttgttgataccaagctaaagattgtctttggtgagaatattcggtacttataaggttcatcatcactatatatagttaatgtaaatctcttcttctctcctgaagccacatcatcctagttatttgtagcctttggatcattcatctacgatgtaaattgtctatgttctctaggtatacacacatctaatttatttctagcatttttaatacaccatctcaattatttgtaccctttgatctcatatgaagatacattatcttaatatttttagcatgatatataatatataaatgatatttacttatatgatgtccaatcatttaaaataaagcaaatctaatttgcatctcatgtttacttatctcatacattttttccgcggcaacacgcatgggggttcccctctagtatacctaataaacacgaccattgtttttgtatatgcatacatgcatgcagatcacgcgaattataacgtagaggatgaagcaatgtgcttacatgcaataatggtgaaaaggtgtcactaatggaccaaaatgggaatgcatcctgctaagtgctagctaaataggcaatagctccgataacaaagttactgcaatgtacacatgcagtaggtagttttttttttcctggcctgtttaaattaaaagcctagctaattaaagccattttcctgtactttgtgccttagttttgctacgtataactacaaatataaacttgcctaactgatgcacagtaaaattagagaaccttgattgtgttttcttttaagataattgaagtgaacactcccgctctacgtataactacaaatataaacttgcctaattatctcttattacataattcactcaaaacaacggagattttaactgaaaaactctgatgtgtccttactcgaaaataatttcttggtaacagttgagatgatgtagacgaaggaaaataaaggatgttgtcaacacgatgaaaatattgaacatttataagtttgtgcatgtttgaaatatcaaacagtattagtgggaaaattaattatgcatatcatagacggtcagatatcgggaaactatccttcagacatactgtcgcagaaatttgtgaattctgaataaacagcactgacaaatttatctccaccggaaaccaaattaatcaggctttcatctgtgcgatgatcaaatttatcttgttcaattacgcttgaaaagagataaatagtattccggcagggggtgtagtgcatgtgcatatgtccaaccaaaacactggaactaacccaaatgaatagatgatgtcaaaggattatttcgatctctgttcttatttttagttaagtactgcattaattagaacaacttgctagctcctgcatgctttttttattaatctctgttgagttaatttctctcaggttagagtttagaaaggttagttctctgttatatatatgaagacgctacaaaactcctaaacaacacaaatgacagagatcggcagaagaagaaatatgtttagttgcagtcatcaaggcataccttcagctccgagttggggtttgcgacgtgctgctgctcctccttagctcgcccatatcgatcaatcactgacttcatgctgcacaaaacgaatggccggcacaactcttactaagattatttttgtaatctgaaagcacatgcatgcgtgtgctagcttttgagtgtaagagtacggcaaaaagggtaaattaacaattatatgaagtgagcagaaatcatacgtataagtgtacagttatcacacaattttattccaagagtgctagatcaattattgcttcactgcaaagcatagttgacatatttattccttcgaaaaatatgcatgacaaaatagtaaacacacaactgacatatggccatacatagggggaccctagctagaagaaggttaaaaacaaagatgaacaactagtagttaatctgagactaacaggaaattgaagaacctgacacatgcattagttcttaaacacttatggccgatgtatatgtatacatatgacagggaataataggtgcaaagatgcaaaaaaaaa

SEQ ID NO: 69662 - DNA, 7985 bp, Oryza sativa
gggacatcatagaaccccttaaagtcaaatggatatatcataaagattcttcaccaagtcctatataaggggctcaggaacacaacacaaccaaaacacatctcactcaaccattcctctcacctctccaccagccatcacacttcactccactccatctaagtgttagtagtatagttataacctaaatagaagacttatgaaagtcaagtgtgagagtctatgtaagagtccttgtgagagtcctgtacatgtataattatgaacgtgttgtaccaagtccttggtgtaatcttcagaaggatctatcttcaacctatcaaggtatatgaatgaacacatggaccattctatataaaactaccatgttatggtatttacagtttgtctttactttatgtactgcatttatgtttgcataattattttttaagaaaatcaacaaactggattaccatccagttgccacataccaatctcacatccaacattgcatctagatgctgcattcctatcctcatatctggtgactagacccctagcactgcctgggcaagagctggtatcagagccaagtgctcgtaacctccccaagccatcttctccgaaagggggaggggggaggggggggagagaggggtcgggtagcaaatagtacttttagcaaaactttatacacacaaaataatcagaagcacatcaatgtaatatgtccagaaagtttatagcaaaagaataattttgtctaggacccaagaccttggaccttacacctctaattgtgcctcttaaatacccatgcactttcatgttactaacttgtaccaccggatagaatgattattagttatgtatatcagaaaaactattttatactaatcacgagaccttgggtgataattacatcataacttgtttcaaataattcttggaatatgtaatgtgtacttcactaggttgggagcgcctaatcccccgagatatgaaaatgaaataatgcatgcaaagacatggaaaatttcaaaaataaagtaaaattcatgaacagttccaataataatattaacatactacctctgtcccaaaatataacttttggctatgaatctggacacacggttgtccaaattcatagctaaaaatgcttatattttgggacggagtgagtagagtatgatggcatctacaaggagacaagtgtcaaagggagtgaattaatcatgttttaatagtgtgtggggtagagaagataatgttttggtgattaactacactagcaaaataatttagcgatagtaataataagacttacgattttcttgcaagatatgcagttgctgtctctagcttgccgcctccacttgcagcaactagcagagaaggcaaaggaagaattagtcagctggatcaaaagggtcatatttgaaattagttgctagtgctattggcagttaaaaaaattgcaaacatacaacaaaaagttcattggcatactacacaaatatttgcttaacaaatttaaatgttgcagtaatgcagccttcccctttcccttactatgaaccgcgagagttcgtgttaaaaacaagtttatgtttcagtaaaaaacaagttgatgtttgctcaaaatgcagaactagaaaccttcagttgtagctcaaatggcatggaaaactatttccatacaaattgttctacaaactagcttttgcattgcatgtgtttctagtagcggtgcagtgctactacaaagtacaaactgtcctgaataataataatcatcaggaaaatagcatggaactagcaaaggttttgtatgggaaacttggttaatacaattgtatattcagtatttcttcactgaattagaaactttagtaaagtggtaaatgctcaaaagcagagggcatacaatgtgttcatcaaagcatacaaaagctcatatcagcgaagaaagaaaaactaaaaatcagagatatgaagaatcaactgctgttctcagctaaattcaccccatagtaccagtaggtcaacccacccccccccccaaaaaaaaaaaaaaactaatctatttggcactggtaggacatgctcaaaacaactatattcataatttagtgactaatttgactggcccatcaaacattaaaagacaatcatgatacagggctgtaaaaatagaaggcctgatcatgttgcaagacatgagttcacaaccaaacagacactacaaaaactagtcaactcaaatgctctgtttcaagaactgcataatgcaagtgctggtccaaactccaaaactgtgaagataactttgacatcagataaacaacacattgggtatgcaacttagtatctcttttgttttattatcctgccaatagcaaggatgatatttatatgatgagacatgtattaacactaaccagactccatcacactagtgtcatgctcatgtcaaaaaagaatccaataatagtatagcgctaatggcagaacaatctgccatgaaattttcattaagctcaatttgtgcaaggagaaaaggttgatatataacacagtcacaaaaatacaaccttgagcacaaaatatttttcaacgtgtctgtaaaaactaaatgtttccttgtgctgacagcagtggggataggaacatgaaagtcttttggcaatgggctattgagaatggagtatgtttgggccaaggcccatttagtggttgttataatctgaggtgttaagatgaggaccatacaaaaactgagcactgctttgtccaaaagagtagatgaaataaaatagagttatttctgtatactttgcttctcttctatcttctcaactccattctgtattcacattggtattgttgcattgcgattgggctcatcagtcatcacctcttgggacgtgacacaaaaatgcggcaaagagatcttttagacaatctactactagtatccccacatcacactcatacatccaacctaaaattcacaaagttgttggttatgtttcaaattgttcaccataattaccatccatcacattcttttattactggaaaggtattagtgttacggaatcctttccaagttccaacagtgaaaacattttggaaataataatgaagcaacaagtctaagcatgaaaaccatatgctttatatttttactgaattaattcatcaattctcaaatggtcagcccacatgccaatttgacctccagcattggcagaatattttgcatttttaactatttattcatgcacctctatgaaactattgcatgcctatcaacaaaagtaaactaccataagatatactgcataaactcttgagttctacaaaaccaccaaatagacattctaacatgcagactgaaactcagtaaatgcatctgaagaaatgtaactacagccaggaagtttcagaataaaacattctcttgaatgaattgtactatattatgtcatatagaagggagtgttaaactttagcagcatgcaagagtataactttagcatactcatatgtccgttacgcataatgaacacatacatccgacatatacacagatcagataaactgtgtatacatcctcagttagaaaacatatgttaccacacttcacaagccaaaacaattataaattagttcaaacttaagctttcattatatcagagtggatgtgcagtacatgactacatgtagggcgctgacactaaagtctagaaagaagtactagaggcaatctcgttagagaccaatacaagagttatccacttatcctaaccacggttaaaagcagcaaaatcctcccaaaacaaaactaagtaatggcaattctagtatcagtgcaactctaaaaaaacaattaataatgcactccctgatcaagaaagaaaagaactaagctaacattaacactggcattgacaaccgtacatgaaacaaaacgcataagctgcttgtaatttcatgctacaacgaaactaatcaaacttttcacacaaatcacaccaaaacgaccgcacagctcggggcattcagttaactcagtatcagcaattaacaacttaactatgcaaaaaaaaatacatatatatgagagcctgaggagaagctgtaaaatcggtggaacgtctcacctgagaagccggctcgaaggttgaaccctagatgaagagaggcgggtcgctaggcggcacagaatcaaaatcaacgcaagcatatcggctggggctacagcctacaggagcggcaatgggagaagctaatcggggagccaacggccaccacgatccgagggtcgtggtcatgcgacgggcggcagcaagctagatagctacctcctacggaaatctagggggggggggggcagatgccatggaggacgagaccgcgattggcgcgatcctatccaatctaagcgagggggggctccgagagaacgacgcgaagacgacgaccgccgcgaggggggggaggcgatgatggattttgcgctggatttggtcggatgcgacggagcgtgtggtggtggtggtgctctttgtagatgaagagagagagagataacccccaaagcaaagcaggcgcccccacgccaagtggggtggggtttccgggggagtaataaaaaatgcggcggacgagcggcgctccggcggccacgtcgcccccggcgccattttcagagggggggcgctgctgcggggcaccccgacaggtgtaccgtccgcccacccgccaccgccgatcgccggcaagtgggcgcgtgggttgggcctgcgcctcctgcatgctctgcctgtcgagaaggctcgcgaagacgcgaagggggcgcgtgcgggaaatcgggagccgtcggatggggaggtggatgggcgagatcttcactggcggcgacacctgtccaggagagagagagagaggggttagatggtcgaggaacgggaactaccaacgcgcacggtgatgtttttggatgacattttaaacatttcgccgtacgtatattattttgtttgcaaaatgcaacttgccaatttttgattatgcattttaagcctgtttcgagcgtacacacaggaaactattgaaaatatgatgaataggcactattcatgtcgaagaaaaaaaacatagggctgctatgcgaaataattctatgtgagccaattatttattttgtatacatttctactctattcctacttttttttctatttcctgtgatttaaaaatcatcttaatcgaagaggcaatgctcaccatatcaacaaatttcaagtactcaaaatgtaccacctgcagctaggaatttgtggtagataattaattcaggggcccaagtatatattgtcgttgaattttttttcatagtaagaggaaatataactccccagctctgcaccaactgcacacaactaaatttagatatcaaaatttaaatcccaataaatgaagtcatgcaggtaccacaactataacaccaatagtgataatttccttgttttgcctttcataatttatcagagtatttgattgggcttggatggtacaagtagctagattgttgatggcttcatgtagacatgttcacccatagaaattacgaactcatcgtataatttacttcctctatcccaaaacatacaacaaaactagtaaaagatgtcaagggcttttttttcatagttcttcaaagggggatctcaattctggaaaagactgcatgagtgtagagtggtgttggagagattagtaatgaaagaagttcataaagggatggtgtatatttttggacagatgtttggtgtggtcagtcttctctaaaggtgttgtttccaaagctttttgaaatcggctgtcatcaaaatactactgtgaaggatttgtatgatgaggggatatggagtttggagtttagaagaaatctggacagtgttggggaggctgagctggaagtgttaagaaatatgatacaagattatgtcctagagggggacagagatatgttgatctggcctcataacagcaaaaagaccctcacaactagattaatatatagagagattacttttgggggtgtaagggatattgagacggtgaatatttggaagagtgaaatccctttaaaatttaaatgctttctatatatggcagacatagaaaaacttccttgtacagtccaattgattgaataaaagaaaatggcaaggaggggatgagttcttcaagctctgtggcaagattgaaactactaatcacattttgtttaaatgccctttagcaatgtttacttggtgtgtggtgagagatgctttggggttaacaagtaatccggtaaacattagagattgtctgggcttggtgaatgtgtgttggatgctctggttaactaggaatgaccggtttttttcagatattttggtcaagtcccctttacagatcactttataaatctctgtcttttattcagtggtggtgcattctgctaagggaaaaagatcaagcaatcatgaaaagggcggtgtgagctgttgatgggcaaactgaactggaaactgttttaaacactcgggtgaacgttcacccgtttcttacatgtcatctaaatggttatgcaaaattttcaaaaaaattgacatgataggttaatatgtaatatatcatatcacaaacatataagttcaaattcgacttctacaagttgtaataaaaataacaaatttgactgtgaatatacgtatactagttagagtttaatttgttatttttggtacaacttgtagaagtcgaaattaaacttgcaagtttgtgagatgatatattacatattaacctatcttataattttttttggaattttttcataattatttagatggcatgcaagaaacgggtgaacgtctccccgagagattagaatccatctcccaaactgaaccaattgaagccgtgctgccttcctgcagtagtttagctgtgaaatttgcacttggcttctttgttatgtgtttcgagctctatctagggtgtgatatcttcgctaggatggatggtgcttgcttttgatgagttccagcgctgtttgttggcgttatgtttctgttttattttgttgcttcttttttttgtgaggtattttgttgcttctatatctatataagactctggttgtttattgggctttctaccaaagccgggtcaatgaaattttgatatgttttaaaaaaactagtacaagatatgatatctgtgtagatttatagtatgatgtgtgtattaatttcatctattttagaacagagagagtacacacgcgagagtaagcctcacgctaaaagcctccagcatcttattaactgaaatcataaaacatactacatattgatccagtagtcttaatacattgcctgcatcatactactgctactactcatcagatgaaagacataacctctttgcaatttttacacccacgcaaatctggctgacactgttgcaaaggcacatatatatagacaacacatggtgggtgcccggccgagggcgatgacgacacaatattgccaatggaaacgcacacatcagagctcatggctctcgcgacaagatgaaatatagcagaagctaaaaacaagtttgacgtcgaccttgcacgtaggcatgccctgcctactgcttgctacgcttcctacgcacgcgctagcttgatcggcgcaacgcaagcccacatgcccgcggacgcagacgcgcactagcgagtcatccccgggtgcatctgcggcggggcagtcgcgacgcccttccccatcctctccatgttcccctgccatcctgaaaaattcacgaaccgacgaacgaatcaatctcatctgcagatcaaagacgacgaaccatggcatcgccgtggacccgtagtgtggctcgatcgctacaaatcgacgcgattccccctcttctctaacata

SEQ ID NO: 69663 - DNA, 10843 bp, Oryza sativa
aaagattccaggctcccatgaatggactattaaatcaaagaataagcttaaatttaaatttttaaacttaattttgatattgattttaagatatttttaacgtagtttttttttcagtattagcttttaagtcaccgagaatacatatataaaagttttatctacaaattcatttgtattctctaataagccgttttggcttattacgaaaaaagccaaacgatgagacctccagatcaagtgactacacgcacaaaagttacatgatttttgcttttctgtaggcgatcgactagacgtgtatactgatgtatgctgaccaaccgatcgagatgaacggagatacagctaaaaatcatgagggggctctgaacccctaaacgtagtaagaactgtggctggcatggtatgttgtggtagggtcgtcagggcacaggccaggggcgccaggcccttggctgagccgaggggccctaacgggcgatcgatcgccagcgatcgatccaagcgataagatcagccccccctccccctataggcaatacctcctcccactcctcccccttcctcctccccttcttctcttcctactatagtacaccacaaaattttttaaaaaaaacaaaagttaaaaagttagaaaaatttatgtatagaaatactatacataaaaaatttgaattcaaattcaaatttgaatcgggtatgtaaacttttgacttataaactttgggtctataaactttaggtgtataaactttaaatgtatcgaaatactatatatagaaaatatttgaattcaaattcaaatttgaatcggatataattcaaattcaaatttgaatcgggtatataaactttaggtgtataaactttagatctataaactttagatgcatagaaatactatatatgaaaaatatttgaattcaaattcaaatttgaatcggatataattcaaattcaaatttaaatcggatatataaactttaggtgtaatatttctatactttagatgtatagaaatactatatatacaaaaatatttgaattcaaattcaaatttgaatcggatatataaacttttgacttataaacttttcgtctctaaactttagatgtgtaaacttgagatatataaactttaggtgcataaatttactaaaataggaaagtaatgcggtgccaaaaaaggaaaccaggtggagagagggagggggaggggggcgaattgatcgctacccccacccccaggcgagcgatcgccctttagcatttccggtccagttgtccacgatcgctctcatctccacgcaccacagtcgtagctcgccacgctgttgcgcagaagggcttcggctctattagttgggaggcaactccggctcggatgtccgatgcttttgggaaaaatcggacgctgttaacaaccaaatttggtaatatcgacatcgggaaagaagattagatcgaagcaaagtcggaggcggagatcgagttcggaaacagagcatgaatcgactggagtccagatcggctacgattaggatcggctgggtctgagtcgggctaggtaagccgatgcagccgattccgacaatgcaacttgatgtatgacatcgggttgaattgaggtgcttcaaggtgattgccgcacatggatagagtcctgagaaggcaattgtatctattaattaggatgttttatgtaatttccttacagatatgcttgggcaaaagtctgccgcaaagacttatggtatcttagagtttgttagagatagttgtcgtgtccattatggacatatcttgtaattttcgggtataaatagacccgagccctatgtaacttgaaaaaaaaaacacacacgttcaatacaatctcggcgcatcgccactttttttgctttagttttatttcaacgagttcttgctttcgggttgagctgcatcggtttcgatcttcaacaagaggtaaaacttgttatgacggcttgcgttctcgggattagtgcttccatctttatgacactctaatcttgtttatgtaattcgtcaagttatcatatatcctacataatccttggcaatatcgatatccaacctacaatcggctaacatccgtcaatagaaggcagccgattaggttaaataccgatgttgacttagattatataggatatctaccactctatgacacatccaacggcttgattgtctagatattgtcattcttttcatacttatagctgcatcagttaagtttgaccttatgagtcatgattagaatcttaatctctagcccgcttcttggttgctgattagggtagtatcggagtttcagccgatcttacctgatttaactactttttatcctatatgcttaattgacatgttaaatctgccctttatgttaagatcttgctgcatttaagtatattaggcttgtgtttagtatattctacttgctttaatatcttaatatagagtagtatcggagtattagccgatacatgctagatctatctgatcggctatgctatgaacgtatatagtctcattattaatatatatttcgatctaagtgatttatactgtctcggcatggcgaccgatctatcccaatcacttgatttaagtatataccgatataaagattatatattggtaatatctgcagccgatcgagtagattcagtcctttcttatttattaatgactgccgatcgatgcatatacgacatctgctcaaagataaatgatatgtcatcggtacctagccgattggctatcatttatagatttaactgcggtttctttgcttctatttcttgttgattacagtatcaaatcaactggcacgctcatacattcgaaggcgagctttgaacctgcactggagttaagcagatctcccaggcctcgtgttttctgtcaacagacacatgacgccagcatccgatttacgtgcaaaactattttaaactgatttttctcttaaattacttatccaaattatgatctggttgtaccgttaaattcgttgcaattaaatcttctaaacaagaccacacatggatatattccgacgaaattttttttagcttattattgaattatttttaaatgttgtacgatgttacaacaggtatatcggaattgtttcactaaatagatcaaaaatgtttcactcgtttaaatcgggtgttgtttcaccttatataaaaacaatgtttcaacaaatagcgaaagaatgtttcagttcactgcaacattttatccatacatagtgaaacattataagtacactaggtgaaacatttttcggtggaacaaaaaatgaaacgaattcccttaatagagagttttcaaaatatgtgggttttttgttgcaatggaatatttcagttaactgcaacattagatcatagtgaaacattgtgagtacactaggtgaaacatttttggtggaacaaaaaataaaccaaattcccttaatagggggtttactaaatatgtgggtgatttgttgcaacggcgtgttccataaatatcaaaatccactgcaacacttgatccgtacatagtgaaacatcgcgagtacactagctgaaacatcgtaaaactactggttaaaacatcaaaagagatcatatgcaacattcaaaaaaaaatatcaatagaaaagctaaaatattttttatcgaaatataatcatgcgtggtcttgttgtaaagatttaatcgcaacgaatgcaacggtgtgatcggatcgtagattggataattagtttaagagaaaattcattttaaaactatatgaaataggagcggcagaaggcgtgggtgtccgaggcgtccaatttttcctacagccgtcgggcgcccggcgcgcagtatttccctagttgtgacttgagtcgtacgcctgccgtggggagggctttagcactcttttaccacggccgcggagtgcatacgccgcggtcgatatggcagtacagtctagctggccgccgttcatcgaaccgctgttgttctgcgtttttcttcgtgggctgcaaaacgagcgaaaccaaccaaactcgatctgtcctcgccggccggccgggaccagctccgcaactggggtgcgctgatgcgcatgtgtttggtgtggcgagctaagctacactcctttcatccctatccgttccaaaagtatgtttttgacaatcactcatccgaatacgtagttaaaattattatatttttaagacagatgcagtacatctttgtctcttccatttatcgcaaaataacttcatttttattctcttacatcgtctatttcaatggaagtgtatttttttgagcgagggaaaattaatagggaggaaaaattatccagctgcccctgttgaataagggggtttagagagagagtggttgagggtgaaatagagagaaatttaaatatgatgtgattcaccgatggagaaaaggtttttaaccctggtcccggactaaagatacccatctttactctcgggtgaaatacctaagactaaagatcgatctttagtaccggttggtaacaccaacctaaagatgggactaaagtttttttttccttttttgccacttgcatctactgatttcgagcaccacaaatcattcataaaatcatccataaatctttccacaaatccccaaatacatcaagctgcattttctccatatcccattcactctaacccttactaccatcatcatatcacaagcacataaacaaaaaacgtgaacagaagaaactagaaagaaccatgatgaacaaaagacataaacgccgaggccgtgcgctgcctcccatcccgccgtcgcggctgcttccgctgcaccggctgcggccacctgccgcctcccatcccgctgccacggcggcttccgccgcgccggccagcgcctcctaccgtgcgccgcctcccatcccccgccgcacaggtcacctatcgcccgccggaggggagggggccgaaggaggagatggggccgggtgagagaatgaggggaggagaggaggtgaagagataaggttgagacttgagaggacgggtgagaggagataatgagatagaataggtcggggcagtaaatcgaattttttagcgcgcggttgccgaatttttttcccggttgtttaacaaccgagactaaaactagttctttagtcccggttggtaacagatagtagagaggtctgataccgtctggtattttttgaaccgggattaacaatgatctttagtcccgattggtaaaaaagtgttgttaggtttttcaaccgggacgaacgatattctttagtcttggtttctatttaaatcgggactcttgtgatttttggccaacccatcaaagatgattttctccagtagtgattaataggataagtagtaaattgcacttttcttggctgaagataatacttaatatcggttcgcaaattgatctctttattccttcgatacccctactaacatctaacttatcaaaccattgatattggattattttgtcttcatcttattttgtatccataagatccaagatgaaattattttgggacgcatggagtagcctatacagataagggcagcttcagttctcgatcaactactgcacttcacggaaggcgaacaaaactttggttcggtttgacagatgcaacgatagcatttatttgtaagacccatgtaaaatacaattttgcttccctgtaaaataatcttgattaagccatttaggtttatccttcactgctcttcaccaatactcaaatgagaagggcttcaatgtttgcttcacctctttgtatttttcataaaccaactccataagttgctcattaaattgttcactttaatatatgtgtttttatttcctgtccaacatccatgtgactttggaacaagtatgttggttgtatttcaattattcttgtactgcatatgtgttctttttgttcctttaaagatatacgtgctgtattcttctatgactggcttccagtaataaggctcctttaattgccattgattgggtcattggagttgttcaactaagcacttattaaccacatgttgtcttcttcagaccaatgcgtgcactcgcctttcttttcctcatctgaaccaacatcgctctagccttcaatcctatttggtctttgtttgtattttgtgtaggagctattggacaagtaatcaaagaaactaagccctcacatctcgaaccactaccaccatcaactctaaacaaagctgctaaaccaactactaataatggaccgatagctatactaggggtgggcaaaataagactgtaccgaaaagaccgagaccgataaattcggttagtagtttggtctcagctattgaaagaccaaaatttattcgggtaattcggtcattagcctcggttaaccgaattaactgagaaaaccgaattctagcctagtaggctcggaggcccaataggcccagtaaaccaaaccctagaggcactcaaccctcaggcctcagccatagagacaagaggcaccgcaagccacagcgctgcgccgcgccgccatctatcctcatccatcgcgctcgggctcacggtctcgcgcggcgcggacccgcggtcacgccgcctccaccctccgcggctctgcctccatcgtgccgccacaccgcctctgccctccagccagcccgcctccacctcggcgccgcctccaacaacagcgagcccgcttgcgcctcagcgcgacgacaccgcctccagcgacagcgagcccgcctccactttttttttgtctctctgaatatttttaatttgctagtcgcgtgtgcagatgctgagatgctttgtctatctattgatatattgagttgctttttgatttgtcgatcaaatatttgcggtttgttttttgtgattttttttgttctaacttctgaggacttctgctcgggttagttcggtcatgaacgagaccgaacagactaaccgaggaccgaattgttcggtcttcagttttgttcaggaccgatctgtcttgagttattgattaccgaaatttttaagagaccaagaaaccgaaccaaacttttcggttagaccgaatgcccacccctaagctctactaccccatgaaaatttccatgagcagaaatactatgttgataactttgaagttgggaattgccagtaacctggcggaacttcaaatgggtttaaattttatgggtagcgttatggttgaaagttggggccaaaccgatgggatgctatattcctgtgtaaatggggtgggaaacaatgggattgttggttgttttgagatcagaatttgagactgtagagttcagataatttgtaaaactatgtatataatatggagtcattgcccatttttgagggtccaaattatgaagtggtatcgacaaacaaacatgtttacaaatatagaggagaagccaacaaagttggccaaccaatggcttgcacgaaccatgatttatttggctaggtttgacggatgcggcaacagccatgtctaacaaacaatatgtttaaggggctgtctatataggaatcgaatgatttttgaggcttgaatcattcagattttgataccattggatcaacatctaacagctcacaatattacaagcccaaaaataatatatatatatatatatatatatatatatatatatatatatatatatatatatatataacttcagattttttgacttttttttgacaccatcgtatcggctcagcccaatcaaaggcccattgagcccaattataaacccagataaaaaaaagcccaatttaatatcaaacaatagaaaactaaaaaacaaatttgcacaaaaaaatcttcaatagcccaattaaaagggtcagcccaattaaaagcccatttagcccaaaaagccaaaattggaaaactttactgcacgtgattacagctcacgtttttccagctcacgatgtaccacttctttctggaatagagtacatctccaatcccagatcaatctcgcgccatggaagaaagtgaggagaaggaaaagcgaagcttactccactagataaaagatattggatatggagatagtaagaatcaaaatccagattcaaacaagccttcaaatcgaaaacagaagagatccaaaccttaagaaaagttagaatgcaagaatcaacaagaaggtaggaaaagaagaaaagttgcaaatcaaagccagaaaaagtaaaatgcttaattctttgaattaacaggacaaattcaaaaattacagtaaatttctaatagaattacagtactattaaactgtaactgcaatatgtttgtactgtaaattgaaatacagagaacaatctgaaacttagtaaaagtcagcctgtcttagtcatgtaacaatctaaaatcaatttgaaactaatatgaaaaatatctacgagcatcaggaaatcagcctctatgactcattttgaaatcgtcaataacttttgttctttactcatgcaagattgtcactgaaagattaaaaatacctaactaaattgcacatagcatatagcatttgcaaaattatagcctcaaaaacaccctgaatgcttcaatagaattagtaactgtcatcaatcataaaaattcagaacatcaattatatttctacctggtctagcaagaattgcacattcttgtcatcaacacaaattaggtagcaatgcaaattgtcaccataatcaatctttcaattagaaaaccctatttaaccatttgcagattacataaaactgttcaaatgcacacactgtacaccctaacaatttcaaggttttcagctattatacaactgaagcataaaactattcaaatacacacattgtacaaaattacattgtaattataccattggagatgatgtaattaataaaaaagtgagttaaaaaattataccattggagatgatgtaaaattatcattatcttgaacagcttcattaacatcatcattaatttcattctctggttcaacaccttcattccaaattaaaaaaatgcatccattacagttaactatgtattattttacatgtttcaaaacatattacagttatttagttaaggaattacaacaaaagaaagagtgtaatttcagtaataaattactgtaattgatgaattaatgcactatagtaatagtaatagatatagtatttatagtgcaaaatgataaagtacacatgcatactaatttcaaaccatgcatttaacttggtgacataaaaaagaataaaaaatgcacatcatatttctcctagtgaagatattagccaccattttcattttcattttcaagaaacaagtcctctaatttacatacaaacaaacaaactggacaagatcaagaagaacacacaaaagtagccaaggacagcaaagtcaattattcaaagttacaaacaaaaatattaaaagagtaacatacttacaaaacagcaaaaaaacattcattatagcaaactatgaactgttttacatgtttgcaaatatattacagtttttttagttaaagaattacaccaaaaaaattttgtaatttcaatagtacattcctgtaactgacacaaattactaactcagttcatcatttaacacagtactacatctagagttcattgtctcaaataaggcagataaaaacaaaatctaaatatcagaaaaagtcacttcagaaataaacttaaacctaaatacatcaataggccctaatatatacctgaactctagttattgtggacaatttccaaatagacaatgttaaagacatcagtataaagtaaaaggagataaaagatcatgtttacttctgcatttattaatctgactgtgtaaaattctgtatagaaaacaaatcaatcatctgaaatctaccatgtgaagtgatctcaatccatcatacatgtttcacagattgatagaacaaatttaagttacacagtttcaattcaaaaacagaaactgatcaggtaagatattacagttatttagttaaaaaattacacaaaaaaggtgaaatttcaatagtaaattcctgtaactaacacaaactactaactcagttcattatttaacacaatactatatctagagttaaatttcagaagtaacatggaagtaaattgataaagtttcaaacatacagatcaggaagtattctctataaaaaaaagtggcctcacatcaggcagataaatgcaaacctgaatatcaaaaaaagtcattttagaaatagaactagacctaaaaaattcagaattgttgtaatgtcatgataattttaccttacattttttttagataatttcaacgaactagtcagtgtaacgtatcgatatcaacaaaattcaaaactcttaacatatcaaaaagttagtgtgcagtacttatctttttcgcattcatggcttccctcttaggacaccaattcaaatcaacttccctgcaagagaaacaatgcagcactaatcagaacaaaatttccaaccagccatatggaacaaaatcaaagaaaatggaagaaacaacctcaggtaaacaacatctggagacatatggaaaaaaagattctatgaactactcaaattatcttatactgaaatcagaatggtaaccgtgtgttggaatgccaaacaacacattatgcatctctgtatattttgcacattatcaatagagattattcaaacaaactatagtccaattgataatgaattacatataaaaaatat

SEQ ID NO: 69664 - DNA, 1771 bp, Oryza sativa
  unsure (1)..(1771): unsure at all n locations
ttgggagagaaaggtgacaaggtggtggaacaagagtcccaagagctgataaatcccattgagatgctgacccaggaagatttagagggaactcagaatgattggctgacaatgggtgaaaaaaacttgttggatgatgagatggagaggtgtcaaattcccactgattctgacatagaaaggttgagggaggaagaaaatagagatgatgaatagagctttcaagaggtgtctcataagaagaaaagtagggggagaaaaactgaacctacaattacatccaggatgagcttaaggaatagggagttggctgatgttcctgtcaccaggagggctagaattctcactcagaagaagaacatggaaggtaatgcttcaaacccttttgctatttttcagctgctagattcagttgagttaaataaaattgctattgctgctaagatagatttgggtagtacttctactgagattgatactaatttagaatccttgaaatcaaaagagatagcccatgctaaactagctgaactaaactggaaaaaagagatggaaaattgaaaagtaaggaaggtaatgtagaaaaatctgaggaggtgaatcaaaagttaggaaaagaggttgtggctaaaaaagtaagatgccattagaggaggtggctgctgaaaagagccctgagctgataaagagaggtggtgtgttcaaacaaaggaaaaaaaaatgattatcttgttctaaaatattaaagggttaggtagtgtagctagaggtggacaactgaaagagctgatcaaagaaaagagggtgtacattatctgtttacaagaaactaagaaagaggtgttcttagatagagagttgaattccttccaaggagggaggtcttttgtgtggtgctgaaagcatccaggggacttctggtggcattcttgtaggtgtgaattctgagatgtttgaggttatctctactcatgccggagcttatttcctatgttgtgttttgaaaaataagaaagatgactatctctacgaaatcattagtgtgtgtggtcctgtggacaatcacttgaagggtgggtttttagatgagttgaaatggcatattcagggtaatgattacccctttatattaggtggagacttaagttgtatagatttgcttgggaaaaatccaatgctaatgttgactctaggaatatgttgttgttactcttttattgctgatttagatttgagagagacttttaggaatggacctaagtatacttggacnataagcaagagtgccctgctcaggaagtcctagatagagttctaatgaatgatagttgggatattaagttcccctctgctctgctctcttccctccctaagtaggttctgaccatactcctcttcttcttgacactgatgaggaaagggaaagaagctgtagttactttaagttcgagtcagcctggcttgctgaaaatgggtttaaggagatggtttgtcataagatgttagaaagagatagttcctatattttagagttctggactagaaagcaatcagagatgagaaaatttttgacaggttgggtgtcgcgaccgagaaaattgcattttcccgaacgctagtgtattaatccccgtcccaggaaaagccggggtacaccataccaacatgatataaaagacacatctttattatatcgataatatttacattaataccaaggcacttaaaggcctgacaatcaaaaataaacagcagcggactagcgggccta

SEQ ID NO: 69665 - DNA, 21851 bp, Oryza sativa
  unsure (1)..(21851): unsure at all n locations
tactttccactattctcttcatgttgtcatcatttagcattcagcgtattcctttacaccttcgaccttgatgagttccttcccattggatcatctcccaagacatggcattgcctggtaaccggtgcctgcacttttcactccgtgtagcatctgataccgagttgaagatttcactccttgccttcatagaaacacttttacctaggtcatcttgcttactcacagatttatttttttttctctcaatgacaaggtgactgttgcagggcgattactgtcaggagtcttccttgtgtgatgcagagcatgtttctgattatcctttatcaatcacctttcggcctacgtctttcctgctagagaacatcttggccaacctcttttatcaatcatctttcggcctatctctaacaggtggtactctttaatgtgggttgcggacacttctggtggcgatggggtcctttggtctgctgcctttcagtgaaaccttgaagtgttttcgccaaaagctatactgactgtcattgcctttgatccgaaaaagacacgtgtgaaactcttagtccaaacaaatgtctctttggttaatcgcttgattttcttttccatcatcaggttggttattaactcgaggttagaacatagttcctctgaaatgagaccctaagtctcctttgacagtaaacaattatacacataatcccatatcagcatcttctgaaagagtcctcatagaacttgtttttattacacatttctcccatattacatgaatacgaggcactaccttaaacaaaaagggaaggtgcttaacatcggtacattgtatcctcaacatgaatcatccataaacatagtaaactcactgtttatagacatgaatatatttatttattacatgattgctgcaaactttcgattacacaatgataagtagcgaattgaaaaccacaaacgtggctgctcattttgattctggagagatatagctggcattgttctagtaactgcatcatccttgattggttctgtgatgatgtgataggactgcatattgctatcattcacgggagaaacttccttctgattgctgtttgaagcagataacggtcttctgcttggtatcgccctcctgaggttgattgcccttcgctcagcctagagtaggtcggggagagaaacaacttcttccatcgacgacaattctttgctgaggccgtaggtgcagagaatggttggtgctgaaggtattattgttatgatttattgcagagtcaggtgcagcaggaggagcattggtgctgtggatgatatcgtcgatgttgctgttggagctgactagctgatgagacaatcgtagggttgttcgttggatttctgcggtcttggtcaacaacacactgagttggcaatccgtgggcacatggtttgtaccttcgcacagaaaacatgtgaccttgtgggtgggacattcacctggcggatggtcttcttcaccatgagggcaaagtgtgagacacctgctagcaatgtgtccaattttctccacaacgggtgcatgcctttgattccatctcttcctcgccgagatgtcggggagactcttcttcatcatccgaggagacttgatctgacccttcactatcagatactctgccaccatggcttaggaggtgctgggtcaactatcgtgcacctcggaaggtatttcctctttgacgtctaggaataggtatccctgctggaggccattcggtgttggtaatagtcatcttacgtacttcttcttcagttcgcatcggcgcttttctcttctgattcttactcttcttgcctttggcttgcttagtacgtgaccccacgtggtacgaaaggctaggaggaaagcatttcccgggattccatggattctctccattgggctctctactttgcacactaggctgcaagcttgacttggtgtgaggaggctggtttagcgatgtctgccctgctaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatagtgattttggtcttgacttccatccaatggtagctgcgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacttattctgcaagttgattaaacaaacaacctaccaacatggttacatcacaccccactgatgcaaaccaagcgctacacacacaagcaaggaaacacacaactaacgactctaccctagagggtggcttaggttctgcgacgggttctccaagatcttcactccttcacagctggcttcactgcttcctccacttcgctagcggatcctacagtcttctggagcttcggcaaacaactgacgatgtcttcttcttcactgacctgaccatccagtactagttgaaatccgaagaaggaagaagggagtaaacattttgaaaatagcattagggaaaggaggaaaaggaactttcgcaaatagtttcatttataaaatatgtccttaggttttatccacttggcttatcctacagtcgagacggctctgataccatcttgtcgcgaccgagaaaattgcattttcccgaacgctagtgtattaatccccgtcccaggaaaagccggggtacaccatacaaacatgatataaaatacacatctttattatatcgataatatttacattattacaaaggcacttaaggcctgacaatcaaaaataaacagcagcggattagcgggcctatggctccatcttcacaggcgctcaactggggtgtaagccaagactccacctaagacatcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacggcatttaaaaatcacttagttgcccaaagccattttaaaaagacgatcctagagctacacagtattattaatcaaggtcgtgaacccgcacgaacctgccttaacccaaggcctacgatgattcagaccgaactggcaacccgaccctgggtcccagctcgtcccaagccaacccaggccaaccattccacattttagctgttaagcaaattttaagaattaaaacactaacttgggtgcattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggtaggcaggattgagcccctagcagcaggacaccagccctgtaccatgacatctcgactaccgggccgcagctcgtgtagccttcatttgtcctagagatgtccatcgacccccgacttcgtccatctccatccgtgtagttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacaaaagccaaccattccaaagtatccaagtgatatgaatattcccaaagtctaaagttataaaaccacctaatgttgcctaattaatcagcgaagcatctacctaaattcatactagtggaaccatgaataaagtacccactagttggggttttgtttaatctagggtgaacaaggtaataatatcaataacaataatattaagttcataacaaaggtaaataggcatggccaaataaaacagtgataacgcgggattttaaataaagcgataatgcaataatttaaatcaaaataattttataaactgggattcaatatgttcaaggatgatgtgacttgccttgctccgggagaacggccttccgaaccttcggcgacgaccacgaaccacgcttcgggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaattaggttttgcaactataaaacatgtggaagcgctagcctggaaaagacaggaaggctgcgttgttgacatgcggaccccacatgtcaacctaaaggaccacggtagaccgagtacacagagacggtccacgggtcgacggaagcggaccccatgtgtcaaccgaggcgagtggccaacaaacggactccactagacaccacacgggctgcacacgtggaaaccatgctgctactgagcggacacactaacacggacaccacacggtcaccacccgcacacgtgaacgactaccgacaccggtacacgggtaccggggtcgacaaccgcacaacgggtacggggcgacaccgaaaggacgagggcggggcagcgagaggagagaccttaccaccacgcgacgaggcgtgagaacgacaacgacgaacgggcgcggcggagacggacggcgagggaacgacttcggcggcgatccttgaacgaaggcgagacacggccggcacgaggcttgacgacgcggaggcgaggacgaagacgacgacggctacagcgaccttgacgaaacaccgaggacggacgagaacggcttgacagagggacgaacgccacgacggccgggaacgacgggaggacgacgacgacgacgaccgggaccggcgaggagacgacgagggcagccggcagcggctgcacggaggcgaggacggcgtggaacatgccgcagcgatgcccacgatggaggcggcgccgcgagacgacgaaccgggcgaggatgaacggtgaagacgacgacggataccggcggtgttcggccgaaggggaagcgatgccgaggacgacgtcgcggctgcgatgccgaagatggtggaggtgtggccgaccggtgcacgggcgaggagggacgggcggccgaacaactccggcgaggcggatggagaggttcgcggcgatgtgcggcggcttccgggcgaaaccgaggggtggacgaggtggagggctacgtcaccgtgccgagggagggacggcagcgccggctgatgcacgggcgcggcggaagggggctgccggaggagacgtcgacgaggaggaaggagaggccggcgcgggcgacggcgttccggagaaattcgggcgacgccgtggcctggccgggaaagaggacggcactccggtgccgggagaggtggtggcgacgtcggccggcgcacagggacgcggcagaggcgggcggaggcggaatcgtggcggcaacaccacggttgccagcggggaggcacttccggaggtctccgcggaaaacagagggtaggccggcgaagaggaggcggctgcgatgctggaggaggcgacggcgcgaccggacggcgctccggcgaggagggagaggcggctggaggcggccggaggcacgggagagagaggaggactgcggggagaggtgatacgaccacggggagactcgggatgaggttaaaacgatagaacggaggatggggattccattttatgggatgggggagggagccggccacgggaggagcgggaacggcggcgggaaacacggccggcggcaatggaaggcggccgggaatggcgcggccgttcccggcgattgggggcgccattcaaggggaaattaagggggaaagagagatgagggaaaggggattaattccccccaattaattttggaatccaacgcttaaatcgcgcggattcgagggaggaacgaagctagggttcacgggagagagagagaggagaccgggcgggaggaaggagacgaccggcctggcgcgtgggccccacgcggtcgggcgctcggtcagcgcacgcgcggcgtgcgtgcgcgggaggggagcggctcaggcaggggcacggcgtgggccgggcggccggcccaggaggagaggaggggaggggtggcccggggagagagggaggaggagggagtgggccggggaaggagggagggaaggagagggagagaaaaagagggaggagagagggacttcgggctgggcttggcccaaaggaggaagaggatttatttttaggtttttctttttaataaactttgataattgtttttgttgcttaataattatttccggtgttctgaaaattcaagtaaaatttgagggctcattttagaccaaggagaatttaacaaaaattctccgggccacatttgaatttttcttgtacgtattttagtgtttgccaatttcttttcgaattttaattaattctattattccttttggaaaatgatttttatttcgggatgaatttatcaggacgtgacattggggaatcaatatcctgaatgagaaaagaagggaaaagaaaactcttcagggaaaattggaggagctagataggaaagctttagaagatgacttatcccctgaagaatggaattagagatatgaggtggaaagggatctagaacacacttataagatggaagagttgtactagcataaaagatgtggagaacaatggatcttggagggggataggaacactgagttttttcatagggttgctaatggcaggaaaagaaagtgctcaataatctctttgatggatggagatacagagctgactagtaaagaagatataaaaaaaatcatattgtctcttattacaaaacccttttttagagctgatgttttaactatacccacttggctcgagatatctggagtggcggtctgaacctttctgctgacaacaaagagagtttgattagacccttcaagattgaggagttagataaggcgcttcaggaggcaaaattgaacactgctcctagtccagatggttttagcatccttttttgcagagcttttggcctcaagtgagaaatgatttgtttgagatgttgcttatgtttcataatgaggagttagatctcaagagactgaactttggggtgatttctttgattcccaaaaacaattagcccacagacattagacaatacaggcccatctgtgtgctgaatgattgcttcaaatttctcagtaaagtggtgaataacagactctcagaggtagctaatgatgtgatttctcctacccaaacaaccttcattcctaggagattcattcttgagggctgtgtgacaatccatgaggtgttacatgaaatgaggactaaaaatagagaagggattattttaaaaattgattttgaaaaagcatatgatagggtcaaatgggagttcttgatagaggtaatggaaagaaaaggtttccctcccaaatggattaattggattaagtcttgtgtgataggggccgggggagggtctgcattaacattaatggggataggactgagttttttagaacctttagaggccttaggcaaggggatcccctttctcctctccttttcaatctggtcaatgatgctttagctgcaatgttggataatgctaagagaaatggagttattagtggcttggttcttgagattgttcaaggggattacccatttacaatatggtgatgatactgctcttttcattgctaatgatgtctctcagattactgccacaaagtttatcctttattgctttgaagagatggctggtctaaaaattaattaccacaagagtgaggttttcactatagggttagaggaatctgatactattggagcttctcaaatgcttaattgtcctataggtcactttcctatgaaatacttgggcttgccaattagccctgagaaggttttaaatcctgattttgatttcttaggtcagaaactagagaagagattgggaaattggggacctggtagtctttctcatgctgggagagctgtgcagattaatgcttgtatgtcctctattccttcttatgctatggggttctatcttcttcctgaaggggtgcatcagaggtttgacaagataagagggaggtattactgggctggtaacaaattgaaaggtaaatatcacatggtcaaatgggaagacatggcttttcctaaggactttggggggcttggttttactgaaacaaggaggatgaatgcagctctgctggccaagtggattattaagttggaatccaatgatcagagtttatgccttcaggtgctgaggggaaagtatatgtaggaaggtggtatgtttcagtgtaaatctgggaatggttctcaattttgaaagggtttgttgaatattagaaagtgagtgcagcttggtgctgaatgggttctgggatgtgggaatcatatctatttctaggaggatttctggttacacaattgtcccttgtgagttatgtatccaaatattttcaaaatttgtaatcaacagaaggtgctggttgcacangtcattcagagaggtgtggagtgtctcactttangaggtcctttggccctatagaaagtgtagaatgggacaacctgaaaaatgacatagagaatgtgaatttgagtaatgagcctgacaagccgatttggggtttagcctctaacagaagattctctaccagatcactatatagagctttaacttttagaggtattagagaggtgaactcagagttgtgggctgccccctgcccaatgaaaatcaagcacttcctctggcttgctctaaaagatagaattcaatctgcagagaacctgaaaaagaggggttaggagggttttgaattctgtcaactttgtgggcaaattgagactactagtcatattctttttaactgtggcatggctaggatggtttggtgcatttgtagagatgctttgggatggggttccatccctcgaaattttgatgagttctttctattatgccaatgtgactgtaacccatcttctatgcatctgtttatgagtttgcttgcggctgtttcctggaatctttggctaactagaaacaatatggttttcagagataagatcttgtactccccactaactgtcacagcctgatttttcgttttaggatttataaattatttaataaattattaatagaatttatattaaatgttctttaatttacaagtgaagttaaatgtgggaaataaaattttctaaatataaagcatggatggatttaatttttaaattctccatgattaattatactctctgaaattttctcagatttttcggagctcaattcctaaatgatacaaaggacagttcagtaattagttaatcaataatcattaatgatttaattataattatgttaagtgcttttcttgtttaaaaatccttaaattacaaattgttgtttaattggaattagtagaaatgatcttaaaagcttaaaagaaaagatctaattttaatttgttaaattctaagataaaagtgggctagataaaatttcattaaatactttacttgattctatagttcctaaatttttctgggatttatttgagccaaggaagtatttttaataaatggaattgcatttcatgaataatttaaattgaaaaaggttttaaaatctccctttttgttttgggccgaaagtcggcccaaaagccctctctctctccccggcccaagttagcccaccagccgagccgccgctcgcgcgcgcgctctcgctcgctgacaggtggggcccacctgtcaggaccttcttcctcctcgcgccgtcgcccggccgagctctagccgagccgcgccgccgtctccttccaaatttggtcgcacctttcctgctccggccaaatcatttgaggggaaataatccccttgatctcctctatcttttcctctatagaaacttcggataaaatcgtttggaaaccgatggatttgagctcgattcggattcgtctctctcctctaaccctaacctttccatcgccgtcgccggtcgctatgggcctccgtcgccgcctcctagcccctataaaagcatccccgggacctcctccgtccgccgccaccctcgccttagcccgccgccgtctgtagcgccgcctccgcgtgagatcttgcgccgccgtcgccgccgtttgtccagccgtgcgtcgccgtcgctccggtcgtcgtcgtcgctcgggaaggccgccgtcgtgatcgccaagtcgtcgccgtcctcgtccacccctccgtttccaccgaggatcgccggagcatcgccgtcgtcgtcaagccgatcgtcgccgccgcttcatcctcgtcgccgtcgtcgtccggttgtcgtccgccgccgttcgtttctcggtaaggttcgccgcgtcgcccactacccgttggtgtcctccgtttgcgccgctgcgccgtcgttcgccggcgagcatgcaaggctgagccgccgccgggtgatgacgtcaccgctgacgtcatcgacgccgtccgccgtagaccacggtagaccgagttgatctcggccgtccgttttggataggatagatttcggccggccgttccgtagaccatcgccgtgcactcggtccaccgtgagccgagcccactgacgcaataattcccttttccgtttcaaaaataattctttattgcgtcataattcaattaaaatccatataaatgttttaatccggtttaatctttaaaaattcataactaattcatattagctcggttttagttggttcaagtctctaaagttgtataaaataaagatctacatattaaaattatccataaattgaattaaatttatttaatcctttttaaataggctttaattagattaaatcttgtaaaattcgtaattatttcatatgaagtcagaatgagcccgttcaagtctcataattcatctaaaatcatgatctacacatttgtttactttatatgtattgtttatttggagtttcttagtctttttccttgttttgcgttttagcttgtcgtttccgtcgtttcgaaggttcgcgagtgcgccggaagtattcaagaagattaattgaagacccgttattgcaaggcaagtcacacagatcccaaacacagttcctttgagcatgctgatcctatatttaaattctctatttatttcaactgtgcatttattttttaatgtcatcgggctctgtagacccccgtttttataacaggaatcaatcgtgtaaacagtaccatttccctggatcaagtagtctggtacacacgagttcatagccgagataccaaatgcacatacacgagagtctagtgcgaattattacaacataagtctgcaggcgtagtcttaaatcatcagaccgatgtcacatcctgattttttcgtttcaggatttataaattatttaataaattattaatagaatttatattaaatgttctttaatttacaagaaaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattatttttgttaagagcttttcttgtttaaaaatccttaaattataaattgttgtttaaaaggaattgttagaaatgattttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcagcccaagtcggcccagtccgccgagccgccgctctcctctctctctcagccgctgacaggtgggtcccacttgtcagggtcgtcgtcctcctcgcgccgccgccgccgcctgaaaccctagcgcgagccgccgccgtctccttccaaattcggccgatcctttacttctccggccgaatctttagaggggaaatgatccttgagatctcctcttccttttctcttttggaatcatcggctaaaatcgtttggaaattcgtggattcgagttcgattcggatcagcctctttcctccgaatccccgatctttccatcccgccgccggtcgccgtgggccttcgccgtcgccttccaacccctttaaaaggacccccggtgtctcctctacccgccgcctctctcgccttcgcctaccgtcgtgtgtagcaccctagcctcgtgagcttttgcgccgccgtcgtcgccgctgctccagccgtgtgccgccgccgtttcagctatcgccgtcgctcgggaaggtcgtcatcgtggtcgccgtcgggatcgccaagtcgtcgccgtcctcgtccgcccctttgccgccgccggagaccgctggagcaccgtcgccgccgtcgacccgatcttctccgccgctttgacctcgtcgccgtcgccgtccgttggtcttccgccgctcctttggtcaccggtgagttcgtcgtgccgtccgcttcgtcccggtgccttccgttcacgccgtcgcgccgtcgttcgccggcgagcgtgcgccgtccgagctgccgagccgcccgagccgccgccgccggtggtgacgtcatcgctgacgtcatcgtcgccgtctcccgtgagccgccgtggacccgatcgatctcggccgtccgttttggatagggttgatcttggccgtccgttcccgtgaactgtcgtcgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattatccataaattgaattaaatttatttaattctttttaaatgggctttaattagatttaattttgtaaaattcataataaattcatttgaagtcagaatgaggccgttcaagtctcataattcatctaaaattatgatctacatgtttgtttactttttatgtattatttctttggtttttattagtctttttcttcgttttgcgtgatagttagtcgtttccgtcgttgtgaaggttcgcgagtgcgccggaagtattcaagaagattaattgaaggccgattattgcaaggcaagtcacacagatcctaaacacaatcctttgagcatgttgatcctatgtttaaattctctatttatttcaactgtgcatttattttcgaatgtcactgggtggtgtgaacctattcctttgttatggcctgttttcattgattactttattccttgataccttgggtgattataattggactagttgagctttatatatattggttcaactagatattagatataattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatgattcattgcggagcaccagactgagaagtggcggagataagcccacgggggtcactggggagtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaacaatcaatcaacctcagttgaagacaagttgcgaaggagaagacgtttggcttataccccagttgagctgcctgtgggagtggagccggagcttcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaaccgagcagtccggaatacatcccacagcagaaatagataaagcagcggcatgccattgccacaggcaacgaccgtaactaagacctattgagcgccatcgtctgcatcaccctcctggtaataggcatagggatcctccgaagcttcatctccggcctctgattaagtttatatttgcaagggtgagtaccaaccgtactcagcaagccaccacatcaacaatgcacatgataggggtatttcaaaggatggctatggttcttttgcgcaaagcaagttttctaattcttttcacaagcctaagacctagcattgactgatcaaattttagtactagtgtttatatttaaacaacgatggttctgtccaccatccattgtgatcccaaggatagcttcccgccattgagtcgtcatggttttctgaggacgtccaccttcccccttctcaggaagtggctccaacagcataaaattcatcatgcaataacccttcctacacaagttaagaatttagagtctagcccaggtttaatacatgtcccggtgctaatacccgcaagcacggttaatcgaataaatttgttttactcacactgcagtggatgtacactttacccacactccgggactgcccaacacatgagcctcgtcccaacacatgaaacgtatcacggcaaagcttttcgataacctcgcattggcagtacccgctccatgaacttttcatcctcatgcactctaggtgtacacagtttctagcagtgagaggagttctggcgcaccgggaagggaagactcacacacatgcattaagttataattatgtttaaattatcacatggcagtcctaccaatggtgacaccactgtagagcccctgccttacacatcaagaaaccactatgcatggatactgcctccgctcagctatttactctgctaggtctatccccatacgagaagtgtggttgtacggggtcgtttcatgcttaactttatggctcggtcctcaattgaccggggacggtactagcctttcccagataccacccaatcttaccgtcggtcccagtctaaaacaagtgtttaatttcatttctattttcacaattcatgtcatcatatcatggcaatgtggcgctcatgtttccacatgccgcatctcaattaccttcccaaaggtaattgcccaagcatatagtatttgataaaatatgagcatgcatgaatctaaaatagcatttctaagcaattgtcatagttgactaggggctcgtacgtatctatggttacaaagatttaaaggtgaacaataatcaaggcatggcatatttcacaagtgggatgttcatcattgcatgcaatcttatttgtaaacaaaataaattttgcaatcgggatcaacatgctcaaagaatagtgatgacttgccttgctcaatgtcttgcgggtcttgaccttcgctcggatccgcaactccctcgggctctacaagtacgtgcgaagaattgatttgaattccattagaattcaaataaaatccaataaagaccaaattgaaaaacgagcgcgagtggcgaattctatatcaactatattattcgtgaaataggactattcctcaacctatgatattttgtgtctcctaagtaaattcctaagaattcaacatatttatttagcgcttaaataaatctaatttcttaccgcaaattaattactcatagagattaccaaaatataatttaattttgcaattttacgactataattaatctatacttaaataattaattattttaaattttctatttttattaacctccctatcctatttctcttttttttctttctttttctctcctctcattctttttctttctttttctctcctctctttttccttccctttttattttctttcttcctcctctcccttccggcttctccctttctctctctctcggctttttgcccaccagggcggcggcggcaatggacgcgagggggggggggggggaaaacggctcaccggcggcggcggcccaaggcggcaacgctcggtaccacacctggcgcggcgcggtggcttcgaggcgacggcgcggcgcatgaaggcggcggcgcggcgcacaacggcggcggcccatggagaaggaggagaagggggaaaatggaaaggatgggtgtggggtggaaaaggggaggggccgggttttataagggcgtgggggaggggcggacggcctcatggcgacgcgacaggcggtgcgcggtgtggctggcggcgatggcgacgggcgggcggcgcggcgcggggctcggcgcgacggcgacggcgatgcaacgatgacgggcgagcggcgcggcagggtgcggggcgcgaggcggcgacgcgacgggcgagcggcgcgcggggcgcgtggcgcgaggcggcgacgcgacgggcgagcggcgataggacggccgacggcgacggcgcggcagcggcggcacggggcgcgagataacgcgacggcgacggcgacggcgatgacacgcggcgacgggcggcgacgtgacggcggcgcggggctcgaggcgatggaacggcagcgcggggctcggggcggccacgcgcggggcagagtgggaggggggttagggctagtgacctcaatcgaacacctttggggcaatgaacagtgacttttcctatttttccaacttggttgtttttcctattcaaatcttgtcccaatatttctaatttttgctcaaatcaagtttacacaatatttgtgttgctctaacctagattatcactacccatattttatttttatttttatttttaatttattcgaatttaattagggttaattcttattccatcgcacctaaatttaattgttaccaatatggccgcgataatattttatttatttccaacctcacctaatctatattttaattagttattttgccaatttaattttagtgtttattcctaattaattattccttattcgcgatcggtaaactttgaaaccaaattccaataaaataggcaaataaaatcagcatgatgcaatttattaaaaagtttttgaagggcccatatttttagagttttgattttcgttggttgaattttcaggatgttacaaacctaccccccttaaataaatctcgttccgagatttcttaccggtcttcgaacagatgcgggtattctgtcttcaagaattcttcactttcccaagtggctttatcctcagtgtgattactcaattgtaccttgtacatatgccacactttggccctagtcctcttttctacttcatccagtatccgaactggatgctctgggtacgtgagatcattgctaatatgaatttcctccaacggagcttgctcctccggcactcgcaagcacttctttaattgggacacatggaagactggatgcacatcggcgatgttttctggtagctgtagctgatatgcaacttctcctcgtctagccgtgatttgaaagggtcccacatatcttggcgctagttttcctttgaccttaaaccttttcgttcccctcatcggagaaacctttagataaacataatctccttctttaaattccaggtttcttcttcaggtgtcggcgtaactcttctgtcgtgattgagccacttttagacggtctcgaatcaggcgaaccttctcttcggcctctttgataatgtcgggtccaaataccgcacgttcacctgtctcgaccacattagtggagttcgacatcgttgaccaaacaatgcctcattgggtgacatctttaggcttgcttgaaagctgttgttgtaggagaattcggcgtagggcaaacatctctcccattctttgctaaaatccaatgcacaagctctcagcatgtcttccaggacctggtttgtcctttccgtttggccatccatctgcggatgataagctgtgctaaaagcaagataacttcctagggcttcatgtactttttcccagaaatgcgaggtaaactgtgtgcctcgatcagatataatccttttaggcacaccatgaagacacactatcctggtcatgtacaactcggcgagtttagcactattatagtttgtcttgacgggaatgaatcttgccgtcttggtgagtcgatccacaatcacccagatggaatcataccctgttgtggtcttgggcaacccaactatgaaatccatacctatctcatcccatttccattcgggaatcctaaggggttgcaacaaacctgccggcctctggtgctcagccttcaccatctggcatacgtcgcagagcgctacgtattcggtcacatctctcttcatgtggggccaccagtaaccctccttcagatccggtacattttggtacttccggggtgtaatgaatatgccgattcgtgagcctcctttaggattaatcctctcagtccaccctgttcgggtacatagatcctctttttgtaccatagaacacctttttcatcggttgaaaattcctttgcacatcctgcagctaggcgtcccttcacctctcggatttcctcgttgtccttctgggcttcttctatttgggttctcaaaagaggttgaacgtccagggtgtttatctatccatgaggtactatatgtaggtttagttgagccatctcctccttaagctcaggaaccatcccttccgtcctcagatgatggcaatggctcttccgactcaaagcatcggccacaacgtttgccttgccggggtgatagtgaacctctagatcgtagtccttgattaattccagccatcgccttagcctcaagttgagatctgactgggtgaaaatatacttcagactcttgtggtcagtgtagatatcgcaatggtttccaatcagatagtgtctccaaatctttagcgcatgaaccacagctgcgagttctaggtcatgggtggggtagttttcctcgtgtggtcgcaattgtcgtgacgcataggccacaacctttctgtcctgcatcagtactcctcctagtccttgccttgatgcatcacaatatataacaaagtctttcctgatgtcgggaagaactagaataggcgccgaggtcagcttttctttgagctgctcaaagctttcctgacactgttctgaccacacaaacttcttttccttcttgagtagttgtgtcatcggtcgggctatcttagagaacccctcaatgaaccttcggtagtatccggccaagcctagaaaactccgaatttcagtcacagacttgggtgctttccatttcgtaacagcctccactttagcaggatccactgctactccaccggctgagatcacgtggcctagaaaagcaacttccttcaaccagaactcacatttgctaaattttgcatataacttatgctttcgagtttctcgagtaccaatcgcaagtgctccacatgctcttcctcatccttggagtagattaaaatatcatcgatgaatactaccacaaatttgtccaagtaatccatgaacactttgttcataagattcataaagtatgccggggcgttggttaatccaaatgacattactgtgaactcatacaatccatagcgcgttgagaacgtggtcttgggtatatccccggtcctaattttcagttggtgatatcctgatcggaggtcgatcttagagaacaccttagctcctttaagttgatcgaagagatcatcaatccgtggtagtggatacttattcttgatagttacttcgttcagtgaacggtagtctacacacatcctaatgcaaccatctttcttcttaacgaatagcactggggctccccaaggtgacgaactggggcgtacaaatcctttttcttgcaactctctgatttgcttcttaagttcctccaactcattgactggcatccgatatggtctcttggatatgggagcagttccgggtatcaggtcaataataaactctatgtcacgatctggtggcatcccaggtaaatcctctggaaacacatcaggaaatcgttgcactacaggcattcctttcatgggtagcatggtgaatatgcctccggcatgttcggccagtctaggatcttgatccatagttgttctcatatccgatccccaggggtggtcaaggtaacttttctacgcctacagtcgattacccctctgttctttgttaaccaatccatacccaatatgacatccagggtctgaggtatcaaaaccataaggttggagggaaacacaacatccctaaggcgaatatgtacgtctatgcaagcatgactcacagttatctcgccctcaggtgagtgtaatatcataggctttctaagtcccactagggttaagttgtgcttttgactagccttcagagatatgaatgaatgcgatgcaccagaatcgaagagaactttaaccggggtagaattgatagaaaacatacccattagtatgccctg

SEQ ID NO: 69666 - DNA, 7195 bp, Oryza sativa
ctaaacaaacactacatttaactcaccagatcaaaaggaagcccaccaaacagaacccagtttttttgacggtgaagaaatcctgcagaaaaaggtaaatatgaaaggacactaaaaaacaacttgcaagtttggtggagtggaaggaactggatgcaggctgttataccttcaaattaccacacatcgattgtgtgagtgcagaattcaggattgtattccagaagatagtgtagtttagcagaaaagctagcatgcatgagaatagcagcaccgcctacaatcggaataacatcatatgatattgatagctttctgaagaataacagaagttggatgtgtcactcctccactgaagtgaacaggcatgattgggtttttctttttttaaaaaaatggtgcacccagaagtgctggaatctttaggtgtctaaaaacattacagataaaaggagggtagatattgcacaaataagatcagtgatgaccatggttctgtgaaatctgtacctgaaacccaggggaatagaggtagggaaattctatagccttcttaggtcaccctgaatatatgtcagaaaaagtactgaaggcccacagacaagtcctggaatccaaatggataggatatgaatgctaaggcaaatatggtttaatctggatattatgaatatgaaacaggtcatcaaaataataccgttgcaccacatcaggccgaagctatttagaccactagattttcctaaaacaaaacaaaactgctggttagaaagctatgtagtttagaatgggattgtatgtggcaaaactgaaaatgaaatgttacctatacggtttatagtagcaaggtaaacagctggtgtaatgttggccacaaagacaatagcatacccacgagcatcaaacgacaggtctcgagctccagcgataaatgctccaaatacaatcaaagccacgctgacaaacccatggtaaaaaaaatcagaaagtaaaatatggcatattcagaacataacaatgttctggaaatttttagcgtaagaaaacaagtgctacaactgcaaccttatttcaagctacaaaaatacaggtacaacagttagcaataggctacagaaaacaaaaaacagcaacagatactaattgctagttcactgggatagactaataatttcagggtttccaaaagatggaaataatatatagaaataaataagaaagcatatgacaaaaggaagcttacattagttactagcacgtcagactattctgagaatattacgaatttataatacagtaaaaaaaaggaaaaatcatttttatagacatgtacctgccgattataggtggcgtatgcttctgttttgccaagaaatactccattgtcattgtaaagactactgttgtgcgcctcagtgttgtatacatcggaacattgactccacgcacagattccattgaagctaacttttaccatgatggaaaacattactcaggattcaattcaaatagaatacatgcgactaagtgtatttaataaatgtattataagtgaagaaagaagcataccatatagagtaaataagccaaagaaagaggtgtagtacgcaacagtattctgaacggaacgaagaataacgcatcagaaggcacggatggctcgctatttgtaaatgaaattatctttagccgcctcagaacataaagaaggcctgttgagcacaccatctgcacatgtttattaagtgtcaaaaaaaaaaagaggcaggagatgcgagcagcagattacatatatgcatcaagaagttcatcaacagtgatatcaaataaaggtatgaaaagacctttagcaatatccattgctaagcagatgctcaagtaagggtcggaagttcagaatgttctttgattagataaaatcgaatatgtaatgttttgattatgctatcctacagtttatctcctagactacaagcaagttattcatgtgtaaatgtgtaatgcacacttgcacaacataacagcaaagccagactttccagagtccatccaaggggacatgagaagtacctgaaggagcgtaatgacatttgcacaggggaaattatatgaagacagtgctgctttgttaaacatcactagcaacactgcggattgaaaagttgccaaagttagtaaaatgatacctgagatctgaaaaatgaaaacaaatgtagaaagaacgaaaacaagatgtccgtatgtgaaattaagtgactaatccctgtttcataagaacaccacctagctgactatctgtgttggacaactaagtggcataatattggattctcaactcaatcatcaccaggttttcaacctatcatcgacatgctatctgcatctcagagatctctatcgattttgattgcttcgcagatctgccatcatggccaaacccgaaacaaaagtttcagaattttcaccaaacgcagtttttctcttctaaaaggttattatccttgtagattttcactgaaacgctgacagtaattactacataatgatgtttgtacagccgctgaccacttagcacctcctgtcctagtatttaatgttgaagatgcaagcagcctcccagacccccggaacacatccgtcaagtgaaacccccacgaatttccaagcaccacgcagcatgtactttgcgtgtaatgccaaaatggatgaacttttttttctgaagttgttggacacaagtcaaccaaccggccctcttcccaaagataatcgaatccaactgaattaacgaccaaaactgaaaccaaaagtcacctagtagtagtacaaattcgtgagctgaacccgcaggaaccccaaccacgcgctaccccccaaattcgcagccgcatcacgagacgccaccctcaaattctcgctaacgacgaccgcatcccgagacccagccgacgcatcagagaagaagaagaagaagaagcggcgcggatcgggggaacgtaccggagcaggccatgtaggagagcgcggcgaccgcgccgcgccgcgtcatggcggaccccttgaacagcgcggcatcgtcgccgccgccgcccccgcccccgttgcccttccccgcctccgcggacatcggcagcagcgccccccctcccttcgccatctccgccgcccggatctcccgccccccgaagcctccgccgccgaggaggacgagcaccaccacgacgacgacgactcaggaggaggagaagtcacgaggatatttctaaacgagacgcggtcagcccgatccgacggccagcctgcctcgtccgcgcggtcgcgatgcggaaaacttcttctctctccgccttcctggtgcccgagcgtggccagcgcggccgccgccttttttataatgaagtggaaacgcttttactcccaccgtcccataatctcccaccgtcccataatatagggattttgagtttttgtttacaatatttaaccactcatcttatttaattttttaaaaattattatttattttatttgtgacttactttatactttaagcataactttttattttatatatttataaaaaaaaatttaaataagacgagtggtgaaaaaaaaaaattaaaatcacttataccgtggacggagtgagtactacacaaaaattgcgccctctcgctgtccgcggcggccttcgcttcgctcgatgggcttggctttccgccgttggtgagttggtcacatcacatcatggatggatcgcatcgaccacgtcgaggccggaaaattttttggggggaaagaaaattaccagaaagccaacacgaggaggcagccctgccggctgagtggagtctcttatctcgacctgacctgcgaatgcgcgatgtcaccacaagccactgagagcaagtacaattacagggctataaaccagatataaattatattttaaaaagataaataaagaaagagaagagcagcggactatacatctgtagccagctgtaacacggacttcagaacgtaatgtgtgtataacaggtaggaccagatatctatctatctgttatattattaaaacagccttgaaaggaggcaccacgttcgctgtgggactagaaattctcacattaatcggagaaaaaaagaaaaatctacaccgttagatcgtagtggatctaaattataacggtgtaggttgatagcaatatatatgtagtacaattgtagtttttaaattataataagttgtggatgaaatatagcaatctactgctcatatttggaatcaggcagaatcggattatttttctttgatgaaaccgttaaggagtaggattaggattgcagccgcacgaatttttccttttctttaatgaaaccgttacggggtagaattgcagctgcccaggagccgagtgccgaccggcccttcatactctgtctggctgcacggctcctgtgcttagaattctagatttactgtgaaaagcataggctcatggtaaactaacacacgaacccaatacgagattaattaattttcagaacaacaaaataaaatctgaaattagcaaaaaaaaaaaaggaaaagaagagtttgagtagaaatacaatttaaaaataactgaaattcgaaattaaaattatgcaatattggaagaagagtctatataaaaacccaatacgaaaatattaaaattcggaataaaaaaatagaaattataaaaaagaaaagaaaagaagagttcaggtagaaatacaatttaaaattaactgaaattcggaattaaatataagcaatattgaaataagagtatatataagaacccaataatactaattaagattcggaatgaaaaatagaataaaatccgaaattggacaaattaaaaagagagttcaagcaggaatataattttgaaacgactaaaaataaaaataaaaaataaaaatattaaaagaacacaatacgatattagttaaattttgaaataaaaaataaaataaactctgaaattataaaaattaaaataagatttaaactaggaatacaatttataaataattaaaattggtgataaaaaataaagactattagaagaaaagatcatctaaaacacatgacgggattaattaagtaataggcctataaaagagtagagtggtggcggttgatgggatatctaaaatctattaataaaacactaaatagaatgataatgggcaggtcgtgaagcaaccggtctaggcggttggtgggacttcggaaagtaaaaaaaaaaaccaatgataaccatatttgatttttaaaatctcaatgataataaaaaggagaggcggcgggagggtcatacaggagtacaatggcagagccgacgatggttggttagacttctagaaagtaaaaaaaatgaattccaacgatagttatgttcgatttttagaatcccaatgataataaagagtaggcggcggacgggtcgtagaggagtatagtggcagcgtttgacgagatttctaaagattataaaaaataaaatccaacgagacaataaattataaaaactataaggtccaaatttaaaaggttcgggcttatgaaaagtaaaaaaaaccaatgataaaatctcaatgagagtaaagaagggaggcagcgggcgagccgtattggagtacagtgataaagtcgctgacgttttggtggaacttccagaaagtaaaaaaaatgaacctaaacgataattatgttcgatttttaaaataccaatgacaattaagagaagaggtagtggacgggccgtagaggagtataatggcagcgtttgatgggacttttataaattataaaaacaaaacccggcgggacaataaactctaaaaattatatgatctaatttttaaatgttccaagaagaacgaatagaaacagtgctagatcgagaaagcaaataaaaaaaagatatgacataattaaggggtatcaactggcgtgtgacttttataaaaactataaaattaaaaacacagtgatgataatgtttggtccaacgagataattatttaataaattttaagtaaaattatattaaaaatatataattttgtatgggtgttagccgcgtaattgcgcgggtcacccagctagttaatattgtagtaagtaattattatatgtattagcttttatattaattatagatgatttgaagctattagttggctgtaatgttaaacttgctctgatggctcgctcggtcgctacgcgcgacagtatactaaacaagcaaatcgtatctacgcgacgggatacgtcgatccactggggcatcatccgtcatgtgttgtgtggcttttgacggggtgatgggccgggctagatagagatggggcttgggctggcctggttcgagtgaaccggccggggaatcgcgtgtcacctcgagatattttaaggggcagcgcgttactcctatccttttctactgctagttgctgtcacataaacgagcaaatcttggggatatggtattggtatccactggatgtgtgatcaacagccttctgcttttgttgttcgagcgtttcgagtgtttgcttggattagcagatctgcttagtaaggtaaggcgtcatttgccgatacgaattaggcattgttatatgatgtacttccggttttggttgatgcgtttttgctttgagcgtcattgaaccgagcaaatcctgatagtagctgtcacctccaaattagtacgccatcatggtgtgtgatacacctccacctttgggtagtgcgctttatggagagcagtaatgcgttccgttttaagcatgggcaaacggagcaaaacattgtatcctcataggtagaggttgttactaaatctaaccgctttaagcggttaaatgaacggtattgagaccagacaggttggtgcatggtaatatcattggtggagaaaccatctttcctcccggttcgtaacccccatttaattccagttatttaaccggggctacaaatccgggactaaagatcgctatctttagtcccgggtgaaataaccgggactaaagatcgatctttagttccggttgttaacaccacccgggactaaagataggggattaaagaggagataacagcagtctagatgccccatccttttttttttcttttttattttctccc

SEQ ID NO: 69667 - DNA, 2942 bp, Oryza sativa
  unsure (1)..(2942): unsure at all n locations
atgaaaaggctaagagaaggatatgataggagttcttacttccaaacatgattacttcaatgcaagttacagcaataaatccagataaaatttcgtgcttctatttactgaaggatgaacatttggaactaatctcatggcacggaataataaacagctaatctgctcaacattctacttagagatctccagagttctacaaggttagcttaacaagctctggcctccaaataacctatgataatttcaatggacctccaaacatcctatagttgttttaactcaaacaactccatccacaggacaagcagtgtaagtaaataacatatttgtactccagccgagatcttcttcaaatggcactccatgctgagagtgacgaattccttcgaaaagtaaggagaatgtcactgggatggctctatctaatagggcaacatatcctatgcacacaagccctcacgtgtncacacgtgcacaccaactaaaaaatgtcaccaaaaaatctagaaaaaatcatacacatactttcaattgtattacacctagggttaaaatcttaacgtcaaattcattatattttagccgtaacaaaaaaaaaaaacaaaaaatctgacagttttaagggtgcaattttgtcagaattttatcttttttgttattctctatgtagaatgaatttgaagatgcgactttgcacgtagatgtaatactattgaaagtacatgtatgaatttttctagaattttttgtgataatttttagttggtgtacacggtgtgtacacgcgagggcctgtgtgcataggatacgctcccatctaatagagcccgtgcaattcggaggagcacataacaaaaaaaaaaatgtccaacctaatgacaagcacctgcgagctacgaacctatatatggcatttcttctgatttcatccacccccaatccccaaatcccatgaatccgcatgctataagctagtaaaatgaccaaaaaaaaaaattcctcaacccgagcactcaattcaacacacacgagaacaatcagtgcataaaccgatagaatctttcacggtgaatcgggaagagggggattattacgatgggaaaatcgaggggcgaccgccgcgtaatcttctcctcgtcgggggccgcgcacaccacgagcgcgtcccatcttcgccgcctcctcgaggggaccgccgcccgcgcgagggagacggaggccaccgaggccccgaggggcccgggcgccgccgccgccgccgccaccggcgcagcggcggaggccgaggccgagaggcaccagacggacgccatggtgaaggcggcggagctggctctcttcgtggagtggagaagtcgggttggaattggggtttcgcgaagtggtggtggacttcttgagcttttcctccaccggaggctggctctctctgagacgagaccggctccgggcgataagagtcggcccgtgtacagtaccgccgacttgctgctgtgcggagtttgctgtgctgtcttagtgtcttgccgaggctgagctggtggagaatttctgcggatgcacgccacagatggagaaatcatgtccatgtccctcggcctaaaaaaccatatttgcagaaacgcccgtgaagagggtaaatactaaatattgtgtttatatcatgttcatactatgtattctcttcgtttcgtattataagtagccttgattatttttctagttaaactttttaagtttaatcaaatttaaaaaattagcaatatctataataccaaattagtttcattaaatatgacattgaatatattttgataatatgtttattttgtgttaaaagatattattattttttttctattaactcggacaaatttaaaaggtttgattagaacaaaaattaaagctaatcataatattaagggactgcctatatatatactagataatacctcgcgcgttgctgcgggatatttttttgcatgacctagagttgtaaacttttagtaatagatattgaccgaaagttgtttcatatagtctaatgttacatgataattaatttgaaaccctgatgtttgtagcagtgaattgtgaagatgttcacctagaataatggaagttcttaattaattagcagcttatttgtttactgaatcacattcaccagtttgttatattcttacgtcatgattgaatggttagcctgattaggttgcaagcaacttctgagctccagccatacgtacaacaaatgaacctgccatctacagtaaaaaaaactcggttagtcgagcaacaatgtgtaggctgcatgtgaagttaacggtgtgtaattaacagtgtatatattttcaaatatatataaaaaatacgtacaacacactttgaacaatagattaagtaaaattctatgggaacatttgaaagggtcagttaagttttacctcgtaatgcagtattgcactttattgagtaaacaaatagctgaaaattttccctagtaaagcttatacatttctagacttttttaaactaaacaaaaaacgtgatatttgcaggatgaattcagaaagagaaaaaaacaatccgtaaaatagaagctacggagaacgaatactaacacacttaactgatggatagtgaaatactgaaatacctgccctgtactgcagatgacgatcagttgcacttctattttgtgtattgatcaaatcatgcacttcatgcaattacatcctttcactacatctgaatcacctgataataatatggtaaggtagtgaatcacctgatgatactatggcaagaaaaatgagaaacaaaggagaaagattagagcaccttcggcaacatcttttattatgaaaaggaaaactggattctcaaaaaggtgaaaaccatgacagttaaaggtagaagacctggggataataaac

SEQ ID NO: 69668 - DNA, 1736 bp, Oryza sativa
ccaaataactttctgtacatatcaaatatccaaagggataaaaataaaactacttactacggttatcaatgcagaacatcgtacatgtggaagaagcagagttggtggaggagaacagagaacctgattgaagcattccccagtaataagcgaaggccaaggatgaattcaccatgacgttatgggagcagtaaattgatgtatttgatgacaaccatgaagtctgatctcgaagcagcggtttcgtttctcatgacattccaaagaggaggcgaaaaggctgggaggcggcaggtgggcttgaaccaaaggcagagggagcgccatatagatggagggacacgacgcacgtgggagaggaagtgacgggcaccgccacctcaggtggtgcggtgtatggaactggagggttttcctgaattttttttatttatacttttttttattaaaatatttacaaaaataattttttgtttcgaaaatttacaaatctaattgcctgccgccctcaagaagggcgatttttaaaaatcgccctctcaaagagcggcaagggacctaaatacaaaatttttatttgtgttcaaacccttcccaccggttttaattacttaaaaactaataatgcttattcgatactccaaatgattttaaatggaaaagtgataaactacaaagttatagatctcatcaagatatacaacttttatataaagtttatctccatccaatatcgtttgaaatatagatctgagattttttaaaatgtgttttatattttgtaacgaatatttggatatctaaaacatcttaaatgaaaaagttactaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgcccttcttgagggcggcaggcgattagatttgtaaattttcgaaacaaaaaattatttttgtaaatattttaataaaaaaaagtataaataaaaaaaattcgggttttcctctggttagggatggatacccgttgagttgggccataacatgggcttcttttggcccaataaacaaccggggaactctgggaggctgcttcatggattccctgccgaatgattcagatcgtacggttaatagcaaatggggtgacgtggaagcaccaggaagtagagaattcctagtagtggggatgatttgtatagatatataggatatgttgacagaaaatcccacctcccatctttcaaattttggaccgtcggatatgcttttagattcgtgcagaggtattaaccctaactctccttccgttcccctcccctcgctcattccgtcgccgccactccctcccatcgcgcattccaccgtcaccgccccaccgtgcattccaccgccaccgccccaccgcgtcactacccgcctcaccggctagccgtagggcataaacgcgccagcgagccccccccccccccggccggccccttccccttcctctcctcttctttcctcaagcggatggtggcgtgctgtcccctcgccgtcgtcttccccgtctccggcggcagggcgccaccacctgccgcctcctcctaacacacccttccgctttgcccccgccgcctacaccgac

SEQ ID NO: 69669 - DNA, 18640 bp, Oryza sativa
tggtcacagaccggataatcgagtgcactgcactgtatttcatgcggcgtgacacgtttagccgaggcgcaataaatgcgattaggtgagaccccgctgtgctcacctaacccatacacgcggagtagaacccgcgaggggtcggggcgcctcggccctcgggggcgaggcaggagtggtccgaccgacccccccctcggggagaccaagaggtgggtgcacacatcaccctcgggcccgacgtcccccgagggtgccaggccacgtgggcgattgtgtctgcctcaagcctctagtcatgatactcccggtcccatgtcaccgacagtagcccccggcgttatgccagggcgatcgcccttctcaagggaagcggtcgggcatgacgccactcctaaagcctggtgacaggtgggaccggtctccatggttgggcaaaaacccaacggtctcaaaccatgcacatcggtaatggtaacttggctgtcaataatgggcggtctcttcaagactgccacattacctgaacagcgcacgaatctgggcgagccgatttgcttcgcctggagatatggtgatggtgcttttctcggagccatcagaatagcgtatagcatcttctgggcctgagggtatcgggttttggcgtcccggagggcctcgctaacaaagtagacgggccgctgcacctttcggcggggccgatcctcttcgctaggggccgcatctccagggcgctcttcctccgagaggcagcgcggggcgccctcggcttctgcgccgacgacctcggggtcggagggcgacaggcgcggccttcccgcagtggccccgaggctatcctgacaccgtcggacaagcaagtggagggccaactccggccgtcgggggccttgggccgccgttcggcttgggggcctctcggaccctgacttctccccgtgggcagcgctggaagagttcccttccggaaccgaggacggcgcacgcgcgcaggtccgggacgccgccgaccacatcgtccacagcttcgagggtacggcccctcggctcgcgttcgccctcgactccgacgaggagggcggtgacggtggtgcggacgacagcgacgacaaggctggtgacccgggcgcgtcagagtgagcccccaggcccccgccaatcttgaataactttttctttcttcttccgaggccttcgggcccccttcttgtatagactaatttaatctgcaaccaaataaagaggaaatttctatgtcaattctatttgttgtgtgtatgagacgaggatggtctatgcctcggtccttctgtgtcttggcttgaacaagggctcgtgcccaggtcctagtcctcaaatggctcgggtcggggctagtgcctggggagatccacatgtcgaggctggccaggccgggaacgtggtgaccgagggttatgggtgacccgattgtgggtttttgccgattcccccccggagttcaccacgtcccggggcacggctcggttctgggccccgtttggcgattttagccgacccgagcccccgaggacaggatcgagcacgagcgtgctaattcaagccaagattcttcaaaaggaaacaatggcacagacacagtccttaggaaatcgaaaatgcttttattgaaatacggaagagaaaaaagataagcccccggccaaccctgcacgccccggggggggggggcgcggggttggcccgagcccaagacctgacacccgacccccactaggggtagaagcgacgagggtgttcgatgttccacgggttaggcagctctgtgccgtcacccgtggccagccgaacggagcccggccgggggacgccgatcactcgatacggaccctcccacattggtgagagcttgctcaatccagcacgcgtttggacgcggcgtaggacgaggtcgtcgacgtagagtgatcgggcccggacgtggcgctgatggtagcgccgcaggctctgctggtagcgcgcggctcgaagggccgcgcgccgccttcgctcttccaagtagccgaggtcagggagcgtcggcttccttctttttgtcgctcgcaggcctcccctttcgggtggccagcgaaacgccctcgacgacgtggacatgaccctcatcgtcggaataggccgacctcttcttcctcctcctgtctcgccgccttgtttgagcagcagatccgggggcggccgaagctgccacaccggaatcggaggggttccaggtccatgcttcctccttacgagccactcggtctgcgagctgaaaaagctccgcagtagtctggggctctttggaagcgatcttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgttggcataaatcctcccaagagtggaccgacgcaggtggcaggttcattagccaaccccgcgcctgtcccttcagggccatgggaaagaaattcgccatgaccctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccgacaccaccagccgggggcacggagggcaggtcctcacgtccatgtcgaggtgacactctggacgaagaggcgccctccgttgcgcggggagtacgccggctattacgccagcgctcgatgtcgaggcgggcatccggctctccatgctgatcctcccgagtcggaggtgccgacgagggagtggcagccgaatggcgtgcaacagccgccgctcgccgcgccctccgccttgacgacacggagccggtagtggcggcgccggaggtcttggtggtggcggaccgtccaccagcacccaggcgctgctgtgccgtcatgaccaagttggccacgtcgtccagccatcgctgggctggagactccgggtcagggacgacgggcgggtgacgtaggagcgcgccaacagcctgaagcgcgccctgaggcgtgctgccgtcgccgtagacgaggaggcgacgctccccatctcgccgttctcctgcatcacccgcgactggcgatgctgcggatttttcgacactctcgagcgcctccccctgcttaggattttggtgtggaggaggtgggggagtacgagctcgacggcgtgggtttggctccccgtcgtcgccgctcacactcggagagaggtcgtgcacctttgcttgctcggccattaggctgaacaagaaaaacttggcgcacacagaggagtacgagagctcagaaaacacacgatgagccccctacctggcgcgccagatgacggagctcgtggctcctcaccgggagaccgcacaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatttgtgtatgaacaagtaacaaagtgtcaaccagcccccaatcgctctgggatcggatctggagaaggccttgtgtccaaaagtcctctcctatctaagtgggccaagtgtgagccaacctctcacttgttctaggttccgaatctggaaaagatcatcctctttccccatgggcaaggtcctccttttatacttcaaggggataccacatgcacccctccttttcaaactggacttttcttcccttcataaatggacggagatttgcacggttgccctccgaacgtccttctgatgggacggcacatacctacctccacttctgccgggggcaggcgcgtcgtgggaacgtggctgtgcgctgacgacatgagcagtgtcagaccggtcacaaatcggtcattcttgtccaccacgcgtcagcctagcaacgtgcatgtttgcccttcttcacacaacatcttgcctgtaatggttaggatgaagcctggcatatatcgatcggggctaacgtgccatctctgggatgtaacacgctagctccagctggggacgagtgcctagaagctctcgtcttgacgggatggggcgaagcgtgcgtcagaccgcctgtcgccacctaacccgcgatttgaccggtctgtgactggtcacagaccggataatcgagtgcactgcactgtatttcatgcggcgtgacacgtttagccgaggcgcaataaatgcgattaggtgagaccccgctgtgctcacctaacccatacacgcggagtagaacccgcgaggggtcggggcgcctcggccctcgggggcgaggcaggagtggtccgaccgacccccccccctcggggagaccaagaggtgggcgcacacatcaccctcgggtccgacgtcccccgagggtgccaggccacgtgggcgattgtgtctgcctcaagcctctagtcatgatactcccggtcccatgtcaccgacacaactcttagctccaaatcatctatagccaatgtaattgtcaatttatacaatagttgcttactatactattaatatatggtcctacctgtcatacacacattacgtcttagagtctgtgctacagctggctataaatctgtagcccgctgctcttctctctctttctttatcactttaaaatatgtttatagctagcttatagcctgctattgtacctgctcttagctagaaagagtgcgtggttaattgagtcaaattaattttgtcttctcacgataaacacctatagaaaaggggagtgtccagattttaggtgactggaaattttaaataggtattaatagttgtattaatggcttatggtctgttaatttgtactccctccatctacttttgatagtcatatttcatcttggcacacagaccaaggataagtaattctacttattatcatccatttaaacatgctactccctccatctacttttgatagtcatatttcatcttgacatacagaccaaggataagtaattctacttattatcatccatttaaacatgctactcccttcatctacttttgatagtcatatttcatcttgacgcacagaccaaggataagtaattctactcatcatcaatttaaacatgatactagtcattcctcgtaaataagcgattcattaatatttacatttctcgatgctcatgtagccaatcttgtgtggaagaatgaagagtcatgcattaaatacgagaaagttattaagatgatagattgttgaattgaaatatgcctatcaaaaataaatttttcagatatgaaaatatgactatcaaaagtagatggagggagtactagttattcctcgtaaacaagcgattcattaatatttacatttctcgatgtccatgtagccaatcttgtatggaagaatggagagtcacgtattaaatacgagaaagtcattaagatgataggttgttggattaaaatatgcctatcaaaaataaatttttcagatttggaaatatgactatcaaaagtagatgaagggagtaatatgctaatttaagccacttatttatgcatggtgatatgttctaaactcttaggggatgtcatcactggttcacctgcacagttaaaaatgcaacacagatattttaccaaaaatcctcattttttttctaacatctcggtgcattaagattcaaaaaattataccatatcttaaaaaaaatcaactccatatttgtgaagggaaaaaagaagataattaaattgtgaattcacgaccttctatttcccttcttgtgtggatcgagttcaaacactccaatactttagcattccaactaccaaatgtgatcccatcatctcatcttccaagatcatgttcacacacaccgccggatcggagcggaaggtaaggtgggcggccggtttgcatgcatgcatgcaattgctaaaaccagaagtcgatggacgctgcaaaaacacagtcaatcaggcggctgggcatgcagggtcgtcataccagtccaatccagcgattcacctcgaaagcaccataattatagatcagcgggcaggcctaggcgcgcgcccttggctagccttgtgccctattatcggtggtgcccgccgcgctgcaatggctggttggaactcggaagcagtggagagagaacgagagagatgggccatgggcgcgagacgaacgacgatgcgcacgcgcgcgcgcgcgcgtccggcggcacgacatgtcagagaagagagaggcgggttggactgattttttttctgcacaggtgtgcgtgcgcggcggtttgaccggcgttgttgaggcagcgagcgtttcgtctctctctctatgctctcggttatttttttcttcttttctccggcgcgagcgggaatctttcgctggattcgtcgccgttggacgggacgaaccgtccgcgcgcgctaggacccgagcgtgaatccatccacgcgtgcgcgtgcacgtacatacgtcgtatatacatacatagtagtgtggcgatcttaacttgcttgcttgcgcgctatcggatccaagctctgatcgagtaaggtctaagatagattgattaagatccaaggatatgtcgtccctgatcgatctcgttcttgttaagcttatttattcggctagctagctctttcccgccactgcttgcattggtatatatatttggattgatcgagctcctcgatctacatgtcatgcatgtcgtcttttgtttgggttcagattcatactaattaaaaggagaacttgatccatgctatatagtactatatgacaataattcaacaaaacaattgtcatatcccgtatggtttatgaatgcctgaacttttcttgatttggtaggagttaaattgctctccatatgtattaactgacggtaaacaactgctagctccatccgttctcaaatgtgaacatttctaatatttttttgcccccttcagcttcagaatcctgacgaaacaaaagaaacataactacttgctagctaccagcacaacgtctaaggctctgttcttttggttgagttgggaacccatccctccggtacggaaaacgaagcagtccattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccaggaaacgaacagagcctaagactagtcttctgctatactctgttcttaacttataaatacaggcctcctagaacatttcccctcctctcaggtggccaggatattttttttcttggcctctctctcctgccatcttcacattgacccaaaatgtagtgcatcccctggaaaagctatacctcccccgtatcagcttccaacttagtacatccctcctctcatcctcaccaatgttttcactgctgctctgatcatcagcaagaaaaccaatcccactgttctatcagcttcttctccccctgagatggcttctgcaaacaactggctgggcttctcgctctccggccaagagaatccgcagcctcaccaggatagctcgcctccggcagccatcgacgtctccggcgccggcgacttctatggcctgccgacgtcgcagccgacggcggccgacgcgcacctcggcgtggcggggcatcatcacaacgcctcgtatggcatcatggaggccttcaataggggagctcaagaggcacaaggtatgcatgcacgcgtgtgtctctcgttttctagtagtacatggagtgatgggtgtttgatcttgatatttgatgttaacgcagattggaacatgagggggctggactacaacggcggcgcctcggagctgtcgatgctcgtcggctccagcggcggcaagagggcggcggcggtggaggagaccgagccgaaagctggaggacttcctcggcggcaactcgttcgtctccgagcaagatcatcacgcggcggggggcttcctcttctccggcgtcccgatggccagcagcaccaacagcaacagcgggagcaacactatggagctctccatgatcaagacctggcttcggaacaacgggcaggtgcccgccggccaccagccgcagcagcagcagccggcggccgcgggcgccgccgcgcagcagcaggcgcacgaggcggcggagatgagcaccgacgcgagcgcgagcagcttcgggtgctcctccgacgcgatggggaggagtaacaacggcggcgcggtctcggcggcggccggcgggacgagctcgcagagcctggcgctctcgatgagcacgggctcgcactcgcacctgcctatcgtcgtcgccggcggcgggaacgccagcggcggagcggccgagagcacatcgtcggagaacaagcgggccagcggcgccatggattcgccgggcggtggcgcgatagaggccgtgccgaggaagtccatcgacacgttcgggcaaaggacctcgatatatcgaggtgtaacaaggttagaacaatattggtttgtctatgctactatggctagctacatgcctacatactgatcgatgatggattgctgattcctttcaaatggaaggcaccgttagttagaaaattaatgatctcctttttgagtcgaggcgcgatcgatctatcgagaacataaactatcatcagatctatggttctatactagatagctagctaactgcaatcgaatttagataaataataatgcaatcgctcgatcgagacagtggctatatatgcaactttgagttagtatatagtttatgtgatcctttggaaaggtaattgggtataggctatatatgtagaaagttcattgatctaagaaaaggaggacaatgaaattagatgttgatgatacggaattagtatggagttagactaacttcgttaacaagctaaatatacgattgggaagtaaataattttgttcacaagaaataggagccacactagtattggtaattgttgatagatacgatattactaattctggtattgcccatattctaaccaattgaaaaaagatcaaaaacatgctaatacttttgcttattaatttttctcactaatgttctattgcacacatatgcgcttagatcgaacatgcaaggatgtcaaccaatgtttatatttttttttcagacgtgattttgaatcttaatagcatgcatatgagctttagtaaattacctgctcttgaaattgttggtttcaggcatagatggacagggcgatatgaggctcatctctgggataatagctgtagaagagaagggcagagtcgcaagggtaggcaaggtaatgcaaaatgattatatatcatctcttttctccctccagcataacactacgtatgtatatatgtacacttaatttacagtactgattaagcattctttcaattcgtctgttccccatcgcctaatgactctatccggaatgacaccgttatgctccgcaatgcgcagtttatcttggtatgcatgcaaacgccttcagtttttttttcattgtatataactatattagtgactgcacaatcattatacttgtatcacgactactcaggtggctatgacaaggaggataaagcagcgagagcttatgatttggcagctctgaagtattggggcacaacaacaacaacaaatttcccagtaagaaattaaacatataagtttgtcgttttagttttctagctagcttgttaatagatcatagttttctacacaccacttataatacagtatataaaaattaaattgtgcacttgttgattgcattttcccttttttattataaaatttcactgcagataagtaactatgaaaaagagctagatgaaatgaaacatatgaccaggcaggagtatattgcatacctaagaaggtaactgatgtttcaccatatggaattatcactcccagaatatcagactatcacactgagatatgatttcattaattaaatatgcaggaatagcagtggattttctcgtggtgcatcgaaatatcgtggtgtaaccaggtaattaattgatttatgttttcttcctagctagtagtatacaaaaaagcacgcaatgtactagatgtgcttgttgtccttatttatatgtattatgaactactaatctctaagctatgtcaacatatatgtacacggctcatgttaactgtatatgcttaaattttgtagtgatattttggtgttccaatgttgtaatatagattaacatataatttttgagcaggcaccatcagcatgggagatggcaagcaaggatagggagggttgcaggaaacaaggacctctacttaggcaccttcagtaagctgctacactgatcttagacctgtctcatctaaacttaatcgctctcctaatgaagatccttaaaactaatcaatgactagtcatagtgttatatccccaagatctaagtcatcgacccgtactaatttagtccttttttcttgaaatcttcgtacgtctcgtagaactgaagattagatattctatatgttgccctatggcgcataaaatagtagtactcccagttagcgcattaactatgtccgaaatgtacctttcaaagtttttgtctcaaagttgtctgagaaaaccggggcatggagtcaagggccaagtagaaaaccctagcccctttgaattttaatcacacagctctagctttgccctttgcttgcaccgtccatgcgtgcatgcatgcatgcaatatggaacatgttgcacacatgcgtttgggaaacaaaaaccctaatcatatgcatctgatcatgatgataatcgttgcgtataggcaccgaggaggaggcggcggaggcgtacgacatcgcggcgatcaagttccgggggctcaacgccgtcaccaactttgacatgagccgctacgacgtcaagagcatcctggagagcagcacgctgccggtgggcggcgcggcgaggcggctgaaggaggcggcggaccacgcggaggcggccggcgccaccatctggcgcgccgccgacatggacggcgccggcgtcatctccggcctggccgacgtcgggatgggcgcctacgccggcttgtaccaccaccaccaccaccacgggtggccgaccatcgcgttccagcagccgccgccgctcgccgtgcactacccgtacggccaggcgccggcggcgccgtcgcgcgggtggtgcaagcccgagcaggacgccgccgtcgctgccgccgcgcacagcctccaggacctccagcagctgcacctcggcagcgccgccgcccacaacttcttccaggcgtcgtcgagctcgacggtctacaacggcggcggcggcgggtaccagggcctcggtggcaacgccttcttgatgccggcgagcaccgtcgtggccgaccaggggcacagcagcacggccaccaaccatggaaacacctgcagctacggcaacgaggagcaggggaagctcatcgggtacgacgccatggcgatggcgagcggcgccgccggcggcgggtaccagctgtcgcagggctcggcgtcgacggtgagcatcgcgagggcgaacggctactcggccaactggagctcgcctttcaatggcgccatgggatgatcgatgaagaggagcaacaggagctagtatagctaattaggggatcgatcgattaattaagctagatcaagtcaagtttaggttagacgaatcttgatcacggttgtgttgcaactcgtttggtcgttgatcaggttttgcttgactgggtgtgagtgacacacacgcaaggtgctgccttccggaagctgggtaatggcaggtaagggtataagctagtaaagtttgtgttgtaacttctaagttaatatccttgcttgctgttagttttgggtatagtttcagaaggatcatgccaatcctcagaggagatacacactaattaatctcgtgcaatgacaataactccatcataatatcttggcgctcatactttatttagttgtcttaactcttatcattattgctctatatagttcttagatcaattgccatttagacaatcactagtatttatctatatctataaaaattgggcaatactcgtacctcccacgtgttaaaaagaatggtaatttagccatccttagaaatgtaatggaaagtatagaagtacattttctagtataaaactcaatacctccaaatacttggtactttgaggtactaaaatttagtataaaatttagtagcttagttgttttcttaagaattgtaaaaaaaaattaacctggaagatttggttagtaagtgtgtggattaatatataggttgtaactaatgtatataccgctatctaaaataacagtgataatattttttaataatatgtataattaaagtttggataattataatatcaataacaataacatgtgcaatgcacgggctagcttggtttgtaattatagtatatattattgttatcgataaaaatcctgacaatagaaactttgtatacatgtgtcatgtttgtgtgttatcgagggaatgccaatcagacaaggtacgatttttacacaggtttaagccctccttagagtaataatcctacgtcctgtcagtttggggaggttgctttatttatatatggagaacacaagtacaaaaggggtgtatgtgtctatcataagcctatctactaatcccgtagagggttttgatgaatggtggtatgatgtatgtatgaaagttggactccgctggctctcgatggatcatcgcctccacctcacagccttacttccctcctccctccacatcacggtgggccgatgtgggtcaaacaactctctcatagactccgtcgccaccgctgtgtgccccgaaatcgctcagcctctatcatgcatccttgtctgctaggttcctcgagcgccacaatggttgcataggaaggatgggtgttggtggtggtggtcgattcgatgggccacagaggaggggtctgagagctgaacccattcgatgacatggatgtcagcgatgagctcgtcggaatgccgcttgatcgaccacatcatcatgcttgttgacaccgttggcaatggcggaatgatgcgcggatctggaggaagagggaagggagtgacctcgccgccgtccctctcttctccaccgttaccgagttgggcggttttatgcgacctcacggccgtctccgatgtcagctgccctgtttccggtcgttcctgagccacccccaaccccactccacctccttgctgccatggttgcgatggcagccgccaccaccacatcgcatctcctaaccatccccaagtcattcctacccgctgggcgctgttccttgccagaacacttgatgcatcgaactccagaggaatgagggggagagatggagagaaagaggagaggtagggggggaggtgagtagattgtagatgacatgtggggctcacttttatttttgccaaataagcgcttggtcagcacgagtggaccgggtcaacttgccacgttagcgaaaccagccatagatactgtcgaagtacctactttaactcggttttataagttagatgttaagatttctggtattgcaatttagggatgtgtttgaaactcgatctcaaatgagggatcaaaagtgaacttagtaccaaaattcatcgtaattaggatgctgggccctaataggtgaaccgggcccaatgccatctccctactcggttcatagtcaatctccccgtcgcctcgtcttcgactccccgtgtccgagcgagtccgcccgccgcccgagcttatctccatcctacgagcagcggcgccggctccggcgtcggcgtccccctgctccttccgccgcctcctcgctctcgccggtgagcatccacacgtcctgttacccgcatcctctttctcatctctctccgcccattcttcttctcgaattcgcgttcaaccctagctctcttattagatctggatgcttttcccttttgcgttacccttagtaagtactaatagcagacagtttgttccccgtcaaattggggttgaaatgatcatccataccccatctcaggcccgtccctggggaatgcccagctgaattcaatggctcaagttactgcgaccgcgaatgctcgggtgctcggttttcctgccgccagccgccatggtggccctgtaggatcgcgtgctgggccggcgtttctgaatctgcgtgctcccgcacttcgtcatgacagtaaaaagcatcctttgagaggtactgattttcttgcatatgtgtaattttgcattggatgacaatataagctcgttactgcccatacactaacaagtggagaaaaactgaaaattgttatgcatacaggggtgaaatcctggatgatggtctttcaggaaaatgattgttctgagaagttttatttttattgggatacaagtttacaattaccatagttatagtgaacgcacacttgatgtttgtagacttgttactctatcttaaacggtgcatcaattgtgattaagttacttatcagcttcttttttctttttttaaggtgtatgaattcatatttataacatgttatttctttgtttcagttggtgctgcctcttcattattcacaaagtatgatcctatcaaaggcatcaaaccattgctgtcaattgacaagttacgtcctagaactcaagttggctgtcgagcatctttatcatcattcagcttccctgagttggagaccaaacctagatggtggtggaggaccttagcgtgtgtcccctatcttctgccgctgcacaacatgtggtcctttgcagatgctgtgtaccagcttcatccatacttgcagcagtttgggttgttctatgcattcatcgacacaatggcgttagtcccaggatggctctttctgatgatcttcatgaccgtctacttctttgtggtcaggcggaagtggttgccacacttcttgcggtatcacgtcatattggctattctccttgatactggttctcaagctctggcgaccatgtgcaactggaatccaagcattgtttatcagggtaaaccaatggtgtttttctggatgacgattgccttcattcagatatccacagttcttgagtgcatgaggtgtgctctggcaggcatgtatcccagcgttccgtttgtatctcaaacggctttcatccactctgatatgagtatgttcaggtagttggttagtgcaatatgcatctttgaatataagaagcattaagggatttttatacgagagatttgaaaactgctgagacagtaaaatgttgggaattatgagatacaagaggtggggatgcaaggggatgaaatcagaggcaatgcttatttgcagtgttggcacttctaatatttgtggcctggagagttacttgatatattgtttaggttgtgttttgtttgattttgaataggatgaccattttgaagactgtgagttcagttttatagccctggaattttctttttttatttttatccttggaggcgcccttgaaattctcttaaacctcttcaatgttgctgtgttgtgttgttgacatattgacctgttaataacgtggtatgaggtttgatgtctgcaattacttggatgcagtccatagcagcataaggctatgagtacgaggttatgaggtggaatgggcttactggagccggtatacatgaaaaggaccagtgttgctcagccacttctccaccgactccacgtgccataacatgatacattgatactgccaggctaagctggaatagctaatatcaaagtgaagaccaatcgattttatgtacgcagttagtaaacggaacatcacagctgaaaatatctttccatcatatatgcagttactcaatggaatattacaaattaaattatcgtcgcgcttagttcctgccatattctgtttgtctggtatgaatttcagttgtacagaaacatctttaaacttaccagaaaaaaaaagaataaatcagatcgtggtcttctcaatgctcgctaagcaatggagctgtaaaaatagtgaaacaactttgtttcagaccttctggtcaagctctgattgtgatgacttctgagttttctcgctgggcaccgagtaaatctgcctctctttgcctcccggttttgacgaagcattcccgtaccaaatcatgccaatcacagcaagcatcatgccaaggactacgtgaaaattaaggccctcttttccaaagaaaagaaaacccaaggtcaatacaagaatcgtcttcatatggcctagaacttgaaatgagacagctgtgaatcttccaatgcatatgaactggcttagattggtcccaacagcaattgtgcacgacaatacaatgaagaactggaaattaagtgagtgaagaagaaagcattagtcccagtttgctcatgtaaggaatatgtaaaagtcaagggaacatcaggtctgcactgctatgataaaaaaccatacatgtcatgctcattccataaaattttattcatagatagaagaaacagtgtaggcaactaggtatctcttaatctccatgaagtatatataagaagcaaaattgctattgtgcaacaaagaactattcatatacttctgtactatttgaaggagggaccatactgtaaaaacacatttcaagtttcaactgtaatgtgcaaggtagcttactaactactagcagttaggtggttgatccattatagagaggtaatgaacatgcacaaaagggattgaaaagaatcactgccagtactctaatatctaataacacttggataatacaatgttcaaaaaaaatatctttaaagctgctgtaaacttatatcaaaacagaacttaaaatattcctttccagcctaaatcgtaattcatggaccaaatccaggagataaatctggtggttacaggatatggtaaactcttcatggtcatcagtatctaactcaaaacggattcatctacagctatgtacagtttataatgccgaaatagctgcatagagccaaatgggactgtaatgcaacaagttcacaagagaataagcagagaactgattcaaaacaagaatcacataccgtaactattgttgtgtaattgaaagtatcaactcttctattggtcagccagaagtccacaaaaggccccagtattaacagggatgctgcctgagctggagcagtatgacccaataggttgaatgagccaagcgagtacttcttttgaaggtgatgaacgtactgcagcatgaaagaaaaataactggaataaaacaagtgctaattatccaaaacctcaccattaaaagtgaaaacagcagcgagggacaaaatttctgttagcagataaatgagtaagactaaatatttgcaactcttttagatacaagttactattgaacatttcctttgaacatgagtaatcagtacagcagttagaagcaagcaaatatcgacagaaatccagattacagaatgagataaatcagactgaattcacacgaacagtttggaaaatatgtaaatgtaatgtaccatatgcgacgtaatttgaactgaaactgctcattcagaagccaaggtatttaaaaaggagccaaacagagcagttatcactagggcatggaatacgtcaaaatgtgcacaatcaaatactcacatgctgctgtagtgctgtgctccaaactgcaattacagctgctagcagcccttttgaattcacactaacatcagtcacagtacatacagcaactcctactaaaacaagcactatactgagttttgtattccttgagtaacggactttgtcaaacaggatttccagaatgcacaagactggaataatacacaacttggcaatctgaagaggcatgaaacgaaaattagtatgtgccctccattctaacattgaatatagaaggatttaaaattactcttcccacctgatagaatccaacagagttccacatcaaactaacattcatcccaacaattgataagtttgcaaaaaagacgaatttaacgagttctggcaatggtaaataggatggctgaatatgtcccaaccatttcattactaatgtcatcaaggttgtggttgcaaaatgcaatccagtcaatgttgtagctgcacaaacacacaatggaacacatcattagcacaaaaaatctgactggtttgctgcacaacgatagttcggtttag

SEQ ID NO: 69670 - DNA, 835 bp, Oryza sativa
atccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtagtcgccggccgagctccatccgcgtcgcgccgccgcctccgccgtcgccgccggtctccgtcaccaccgttaggtgcgcgggagggtggagaagcccggccgctatctccccgaagccgccgaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcttgtcctccaaagtcgcagccgaccatccaatctccggcgaggtcgccatcttggttcggccattgatgaggtgacgtcatcatcgtttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtcttattcttcgttttgcgtgttagtttgtcgtttccgtcgttgcgaaggtttgtgagtgcgccggaagtattcaagaagattaattgaagaccgattattgcaaggcaagtcacacagatcctaaacacaatcctt

SEQ ID NO: 69671 - DNA, 8214 bp, Oryza sativa
taggtgacactatagaatactcaagcttggggcccaataggagcattctgggtaccattgtcagaccagactccgtgctcctagaccggaaaggctggaacaaggacgctacaatacctgacatgttaacagaaccctgggaaccattaccccgtcagtttgatagcgataatgatgcagtctataattggcatgtgatagatgatgaaccactgcccaggaatactcgatcctcatcggaggacacaaggccatcacctacacaaaaaaggaagtcttccaaaccaaaacagagatcgcggaaaaaggccaaggctgattcttcgagtggtaacaatgctgaaaatggtttcaagcgggggaaaggattagcacaatgtgatagatcgcatcaaagtgcaggaagcagcagacggagcaaagggccgagagagtatgacagatttacaaataccctcccacaatatactcagcacattagtaggtggtgactttaggctgttactgatagcatttacagtacagttcgggattgggagatcccacgaggttttgacaggcagaatggcgccttggcagacgtcgaagttcaagcagctttctgtagccatatgtatgatttattatttatttgtttgtctaaggttattcggtcctttgtaacgccgatgaaaccgatatattcagttatattatcatcgtatgaactgcaatttcgccaacttgtctatggcaaagtttcagactattaaaaattatctttggctggaacgtgaattcataattcataacaagacgtcacttcggtgacatccgataaaaataattcataacaagacgccttgaaaggtttaagttttattaaacgaaagaggaacataatttagattgtcgcagctaccaatcacactaaatacatgattggaagttaaataaaatcaagcttatagtcgaatgaaataaaaaggttccaccttcttttcccagtttagaactgaacaagtaaacagctttgtttaccgttaccacaacgacactgcaagcttaatacagctagctaccgtcttttactcgtctttcttctgtgcgaatcctgggggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagtaaaaatgcaaaacaaaagaagctaataaaccgatattgtaaggccacccaacaaacagctgacaggatcaagatggtgtaaactcgtcaaatatattcataccgcaaagacataagtttaccaggttacaagcaggtatgtccattaaaagtgaggacatatgctagcatcatcacttaactaatctaccattcttattcagattgacccttcagctgaaaaaaagtagaaggatttgcaccaatctgctggctaattaaaaaaaaaggaagccagattgaagtggccttatggagagctgataagcttccagtccatattagaagtggagatcctttgtgagaccagtgaaacatctcaatatgactggttcattctgcactaacctgaccattctcgtggggatgtaacattgctacctgcattgagcttatcagccatggcaacagagtctgcaggttgggctgcagttaccactgggagagctacgctctcaactcgatcccgtggataccctaccacactagctgtttcaaacatatttccaaatggctgattatgcacgacttgtggtcccaaatgatgaaatgccatcggaccactcgctggatgctgaggcagaacagcaacaacagtagcagcacagttagaaggattcttgaatgtggcgctgtaggattggccactaccttgaacggcataggatgccacactacagtggttgggcttgcttggttgaggtgggcatgagctcaggccgtgttgctgcaatggttgtggctgctgatgctggatgttaaggtctgtcgatggaagcaaaactgtattgccttggccataaaaagaaggcatggcttcatgatgcttctgctgaggtgaagagtatggcgagtgcacaaccatgtttctcagaagtggctccgttgtagcactggcaggcttctgagaagagtatggaggatacaagacagcgacttgaggagcactttgagcctgaggagatgatgtttgctgttgaactagctgtggtggaacttgctgaatattgtattgctgcggttgcaccacaaggggctgtgttcgccatgcttgtgactcaacctgctgagcaggcagatgtagcctttggtcctggggttgagggtacaattctgtcacctggctagatttctgagataggtcaactgcaaccctggcttcaggattctggatttgtgactgaataacatgtaccgcggattctgatggttcactctctgtgcacttaataggattttggctttgcatataatacacggcagcttgactcggctgctgctgatctggttgtgtgctcaaagagacaggcactagttgctgcaaaatataaccattgctgctttggactggcacagcaggagattgcattgcattaacttgctgaagtggcatgaaagcaacctcatgttttgcaacttgtgtgctgtgatcattttcccttccgaatgttgagaaagcagaggcttcatttgctctagcagggaactcatgcgctatttgaagtttggagaactcgttcggtgtctctgaaatctcatgcttatcctgcagaatctgcacagatttttgaacctgttcgccagaagaaaagatttcagtgtgttacaaaatgatctgaatctcacgagaacagcaagtcgttgaatccattgaattcaatcgtaacaacttgtgaaaaaaattgcactgactccttaagcacgagtgaaaaaagaaacaaattttgaaacgtaaatggcactgttaacaactacaaccacaagctcaagcttcaaatctgaacattgcatcaaaaagttgcaagccatggattaattaattaatttttaaacagctttattactttaccgtgcgagatggatcaatgcgagtaattcgaaaacatcgaacagtttgggtgcaagtaattccgttgaccgtgcaagaacgtgcatggatctagagccagagcacccacctgcctcagattcttctccaggcaccggaagttgaccgtcccctcgctgtggtaatccatgacgtcgctgcgcagctccccgatggacctctcgagcttgtagcagtagagctccagctgcgacaggcggccgccgattccctcgagcgaatgcagcaagccctcggcctgcttcttcatgcactcctccacggccgccatgaccgcctccttggtgtagttctcctgcccaccgtacacgttcacgaacgtcctcaccatcctcttctcctgctgcaaatcctgcccccattcccccccaaacacacacgcacagcatcatcagaaaccccggacaacacagtcgggaaaccggaaaagctttcggggctcctgctacctccgggcggcggcgcgactggtcgaaggagcagcgggcggcggcggggtcggcggggaggccgaacgcgccggagacggaggcggcggcggggcgcgcgggggacgccatggtcggcgcgggcgggaggtagctagggtttttggcctggcgggaggagacgagacggtggaggtggaggaggagggagtcaggaatccgaggcggaggaaggggcgaggaaagtgagaaccgagctgggcgcggggcgcagtgtggctcactggctgtctctgtggagtggaagccaagcaccaaaaagcagagcaggagtagtagttgtagtaaaacagagagagagagagagagagagagagagaggggtaatcagatccggtgaaaaataaaaagtgtaaagtaaagagaagcggaagcagaggagggaagcaaagcggaaggggttggttcgccgggttcgaggcgtttgggaggaataaaaatgggggcggaacggaacgcgtgggttggtggggttgtgtggactcccggggctcccgttgcacgagacgagagagagacccacttggggcgtcgaaatccgcggttgtctccccgtgagatccatgggattcagtggcagacgccactctcctacggtcgcttgttcgcagcctcgctccgcggcctccgcccgtcgacaggtcgagccgggagttcccgcgcggtttggggttgggtttggattgggtcggctgcggtgcggcgtcactatcctcctgaaccatgtgcgcgattagaaaacagcgggtagcgtgcgtgcagcgtccgcgctccgtgtcatgcatcgcgcgggtgtgtaactgtgtatgggcaacgacgtgatgtctacgtaccgagcggtcgtctcccatcggtgtcgagatggttggggaggtgtgttgtggcttgtgggtggcaggtgggacacatccacgactccaccgccgttcactcggtgcacgtttggcacaagcacaacccaaggcgcaggtcgatctcgcaatctgccgagccgatgatggttgcctgccgatcgaggaccgtggccagattctccccgtaggcccatccatccaccgagataagggtaatgacgagagggacgcaatcgtctgtacgagtacaagggaggggaggatagcggcggtgcggcaagtgttgtggggaggcgacaaggaggcaaggacggaaccggataaggccgacccaagtcaagttgcgattatgttgatagtagttgggttttttttacgctctcgccaaacccagtatgctccttccgtttcgtatgattttcttttctaatcaaattttattaagtttgactaaatttatagaaataactaacgatattaaacaccaaattaattttattaaatctagcattgaatatattttaataatatgtttattttgtgtaaaaaatactacaatatttttttataaacttagttcaacataaagaaattcgattaagaaaaaaaatcaaaataacatatataatataaaatgtagggaatacttgataagccgtaggcatcgtgaggtacgttgagtggagtttgtgcgtctacattgtacggagtatacttgcctagtatacaaacaatgcttttttttaagtaaatgtaagttaattggttagaatttttatggtgtaattagactacccgaatttaaatcctagatttatcacgagcgactgcatttgtggctaattattatttcagacactcgttaccagttaggcgaccgtaatgattttgtcaatttcaagatatattggtctagttttctggagatactcgtaggggtcaggtgcgcgtgtgtacgcacgttataagctcctgtgttactaagggaccaaaacattcaaattttttcatcctttagatccaacaccgacatcattgctagcaaacccacggagagtagaaatataataaggattatcccaaaaattaggcaaacaataggggtctaatggtgtagctacacactatacttactttgtaaggggggtttagatctaagggtgtaaagttttggcgtgtcacatcgggtattatatatggtgtcgtatggggtgttctagcactaataaaaaaactaattacagaatacgtccgtaaaccgtgagatgaatttattaaacctaattaatctattattagtaaatgtttagtgtaacaccacattgtcaaatcatagagcaattaggcttaaaaaattcgtctcgcaaattagtcgtaatctatgcaattagtttttttagcctatatttaatactttatgtaggtgttcaaacgttcgatgtgatagggtgaaaatttttggggtgggatataaatagggcctaaataccatgtatgtgttatacatcaatacaagcgctgaattagtggttaggacgggatcgccacatgtcttccacacaattttctgttattttcttccatctagcgcacacttatcatgaatccaatgacttaaaaatcgttagtctcaaattttataacaattccgttaggatgatttccctcacaccatggtcaataacattcgtccgtttcattttggatgtggatttggatcctacgatttaaatgagactggcggagccgaggcctggctaggatgggcaggtgcccgagctcaagccatgcagcaaggcgtagcacctgctgctgattctattgcctattttatgcaccagaccaccagtaattaaacaatagataattgagatgaatattccctccgtcctagaatataaaaagttttagagttagacacgattattaagaaagtagatagaagtgggtggtggagggttgtgattgtatgagtagtgtagatatgtgagaaaagtgaatggtggaggattgtgattggttgggaagagaatgttggtggagacgttgttatattttgagacaaatactaagagttaaaagttatttattttggaacggatggagcactaagtaattaattatcattcttagacatcagcagagccatatgcatgtagacaggtgacactagcagcagccgtgtacagtaatattaatgaacatgcttaaccaaaactagcaaattaccaaagtgccatcatttttttctttgcatgataatacaattaagccctataatcttgtgtactattttttctcaacctaaattagaacatgtcgtttgtcaattttacttgagtctatggtaagtgacatacagatttatacaaatatgtgggtacttttattcgttgttaggcttgctcaggattaagaaaattcatggcactacgccatatcctcacacttttgatggcatatctgtgacgggcttcagcactagtcagtgatgagggttacctttgatgggtcctacgggacgccgtcatcggtgaggcatccttctgcaaccctctgatggcttccacttccagcccgtcacaggtgactagttacctatgacgggttgcatccttatggaccgtcaaaggtgaggttaactcacctcaaacggccctgtcactagagcccgtcataggtgggggaggggggagttgactagggttggactaatgttatatcctctctctcccttatccacactctttctcactcactctccctctcggcttatggcggcggtagaggacccgacggccctcgggcgagccggcggcggtggttcggtggcgtgtggcggcaacggtggtgccccatcctcctcccccttctttctccctctcccccttctcttatttctcgatccggtttttcttgaagtagcaatggcaaggaggtgttgacgatgtgcggcggctcgatgcagcggtgaggagggctcgacggcgtgcgctggcgaggaggaggtgagcggcggtgccgcggcctccatccccgaccgccagtggccaccgcctctgtcccccgaccgtcgggcgccggatccacgtcccccagcctaatggaggacgaatccgtccaccgggcgccatctcctccaaccgccaagcactgccacctccatcccgccgggtgccagatccgtcctccacaaggtcatgggacgcagatccggccaccgagcgtcgtctcgttcatccccgtgctctggccgccgcctccagtcaccgggcgacacatctgccaaccgctaggtgctgccaaccgctaggtgttgtctcctccatccccagtaaccggctgccgcttccaaccaccgcctcctccgagctcctcggcatcaccgtgccattcttcttagtctcaggtcgtcgaggccatcaaggatttttcaagtgttttatatgatttgattttagatattgcaagtgtaaattggaggggtggatgactgattataaaagaaactcttttgtgattgtttttcttggagaggtagatgactgattgcttttcttcttaaaatttcatggatctaaccgatttcagctgggcactatttttgttttttctagg

SEQ ID NO: 69672 - DNA, 20879 bp, Oryza sativa
acatgtcacaccagtacaaatcagaatcaacaattatctgcaacagttcatatccttccaccagatctaccgctttgtataaaaatacaacggcactgacataactaggacagtcgcggtagtctctacccgacgtgaaatcccaacaaccttgccctgcacactcacactcccagttcagaaccgagtggaacaaccccgagcggagagaacaccccaccctctccgaaatccgatgccggagatcagcgcagtacgcggaactcggattccgcggaggcagcggatgcgcggatggaatggaaggaatcctccccatcggcggaggaggggaggagaggagaggagaggagacgggagagagctatggcttcgatacctcctcttctccgcagcgggccgcgtcgggcgatggaatggatgggccccttctcttcctcctcctcctcccgtctcatcttctccgtcctcacgcgccatcacgcgtacgcgcaggggggaaaaagtcgggtcgcgtcgcatcgcgcgtggccgcaagcgcgagtgcgtgcgcaccgagccaccgaggtgttgtggtggtggcctggtgcggtggtgggcagcggcgccgcccatgcggctcggctcgacttgggcttccgccgtgggatgggatcccaaccgaattgggcccccggtgaaactaggtgactagcccaactcaaacccagccatccaggcatccccgaacgctgcatatgctgctgcaggcgcggccacccgccgggcggtctgccgtctcgcttccgcgacgacgtggccttcgccgtcgacggtgttgggtgtaatcccacatcgataattgacgatagagaaacacgacttaaaagataggaatgatgctcatccatcagactagtcttttgggttgtataggcctagaatctaaagttataactccggttggacctgtggtggaacagatctaatgtgactgtgacctaggtgacccatggttgatgggtcaggatgcgcactttaacttgaaaacgtgtcggggaaatcacgatgttgtgatcttgctgtgtctacgcagtggcggagtcagcatggggggaggggagggttctttcgaccccactacccaatccatatatctattgaagggggttaaaaaccactacccaatccatatatctattgaagggggctaaaatagacttttgtctgatttttagaagacccaaaaacccaaaagactgagggcctgttcactttgatgccattttcaaccttaccaaatttttgtaaagttgcaaaaaaaatggctatatttagtttgctgctaaattttgataactatataagaaatcctaccaaaattttggtaactctgcaaaaattttggcaaatgctaaattttggtaaggtttttttttggcaacaaagtgaacaggccctgagaagcctccactataattttatcctgtctccgccactgtgtctaggtaggatttatttcgctggacagctttttttcaacgaagcagagtagtaaatttttctctcaacttttttttttgagggaaatttctctcaacttttggcgactggtccatccaccggacaacagtttgatgaaaagcactgttatttagtggacgatattaattaggcagaagctcaattagggtgcaaaactgacggtgattgatccatgacagacagcctaaccggctaacccccacccttcttgacattgcaaagaccacgcaaccacgtcgagagaaatctgctagaggaatggctgtgcaacacacataacttgtgtgacacaggacaccatctgaaacgagtgtcaccatttccgaaaacaaaagaaaacgcccgcaagattgttgagcctgaagttctgaacacgacaaatcttttcttcttttttttctaaatggagaaatgctacacaattggtgttcctgaatgattgtgattatggaataactaatgactgctatactttatttaatcgctaagcatggaagtatggaacacaacatttatttcggatgtaatgtaagcatagagcataaacatgcgttggtctaattcttcccattacgtacctttcatttgcaaatcaccaccaaatccttatcttagtagggttttgcagtgtcgatttgatcgctcatcagccaatgtcctgtgtgcgaaaaatactacttgctcacagtctactactactactacaccaaggctcaagaaggggtttggtgctgagtttacttcacatgacccaccactgggtgaggtatgtctgcactactgcatattgtgctttcgctccattcccagatgttacatcttagcttcccaccgatgcaatcttccaactgatgataaatgcaggatagctttgccctttttcaagcaggttgtgcatcctacgtcactgtctaattccatacagtatctagtaactagttcatccggtgctcgaactgtactatatggtatagatggttttctggaccaacgtgatgacccttttcattgaaaccgtattctatatgtgcgtacctaatctatagaaaactggtaagaatgtattgtgatgcacatttctgtcatgctaggacgacgatagtgtatgacttgcttcacttccctagcagcgtgataaactgacgtcatgtgatttatggtgcagtgatttggtctaaaacctcaaaagctgacagaatcattttaccgaattgtgttcattagcttaacaccacgcataaggtggcacatcaatccccatatggctaggtagttcagattgctcttctcaggcctaagaataactgcacaagattttctgaaagcaaaattacacgcattgtgacattttacgaacccatatgcaccagtcatactcatcttggttgaaacagtttctgcatcatgagcaaacatattgcagacagaccgaattcagaattcaaatgacaaaacacaactaatgtaaggtttttaaaattagctgcaaacccatgtaatcctgcatcccggtagaatgtcaagagagtgggacatcattcttgagctggaagtggagcaggaagaaaaaccacttccagtgggggcttgtgtgtgtttcggttcggacacagaactcaacagcccaaccgctccagttgagtttgacagaatgctggaaccaccaaacttcccttggttgccttcttcatcttcttcttcctcccctttcccgcgaaagggccactcccgctgcatcctcgacgcctacccagctatcctcatctcctcctccattaaactccagccctcgccccctttttaaatccaccgaccaaacttcctgaaccttgccaacagtacagaggcctcgcttgttcatcttcgtctcggctctgcctgaaccttagcgccatggacggcagtggtgtgcgccggatttaagctttgtttaggctgatgggtcttcatgcttcggttcatcttcgtctcggctctggagttcttgtaaggtatggtaaccatgtttcggttttgcaatgaatatgttcattagctgcttctgttgatgaaatttgctgggttagtcatatgtattctgcacttactagatatgtgcagtataatggcaaggttaattctcttagtatttaggaatcatataatatgatttgctcggtataataagttttcacttggacccaatttcgatataatgatattaatcctgcaatacaatgagctatacacttaatccttagagaccttggggagatactagaaggtaccatttttttttctttttaataaaatttagtacctcctagtcaaatacagcaagaccattctaatccttaatacttggaggcaaaaaaaattatgttcatatttgtggtttgttttcataacgcaaactgataaaattgtatccaaagctcaaatgtctgaggttaaattgatgaactgataagcaattgagatgttgagtttcatctagcaaccaacaaccactaatcatggttgctttagaaattagaataccagagaaagaaaactcctttagaagagcttgacactagagtcatgtcagctttagaaattagaatactagagaaagaaaactcttttaaaactctttttataaattacaaaacccacttagaatgaggcatgtcatctttctaggattagtgtcatctactcatcttggtacaaactgattgtgtatatttgtatgttctgtacttgtgtatggatattgtcgcaacaccctacgtctgcactatgctcaactaataagctactagtgtaaccaaatacattgtagttcactctgagttacaactttttcgaaagaatgctatgtgcataagatgattcagagactaggatacttattccatgatctaaaaaagatactccctccgtttcacaacgtaagtcattctaacatttctcacatttatattgaagttaatgaatctagacatatataacttcaatatgaatgtataaaatgctaaaatgacttacattgtaaaacggatgaagtaattttaatatttaagacttgaatgctccatcatttgcttttcagctcatcaaccgcggccaaaatttaaattaaaaaacttaaattcagagttgttttttatgttttatcgtagttatattggcttttaaatcacgaggaacacgtttaaaaaatttacacataaattattgttttcactaataagtgttacggtttataatcagcagtggacgaaacgatgaaacttgaagtgaagaactgaagatcctgttgagttggtggttggtacatttcaagtgaagaactgaagaatcgtagagggaacaatgtcggagatggaaggagctctgagatcctgcatggagcagctgctcatcgccagggaggagcgggagcagatcatcgtggaggcggccagcgagatctcctcggagaagaagaaagcgcgggagctccagcggaagctcgacgccgcgaccaagaaggccgcgaagctcgccgccgagaacagcagcctcgccaaggccctcgacgccaaggacgcggcgatcggcgagctgagggagtccaagtcggcctccgacggcgagctcgccggcgcgagggcgaggctggacgcggcgcagaagcaggcggcgtcgctgcagtacgaggtgcggatgctgcagaaggagctggagatcaggggccaggagcgggagtacgacctccagtccgtcgacgcgtcgcgccggcagcaggcggagagccagaagaagatcgcgctgctggagggcgagtgccagcggctgcgcgccatggtgcggaagcgcctcccgggccccgccgccatcgccaagatgagggacgaggtggaccagccggcgacacccagaaggtcgcgctccgtggcgccgatgtcgccgcggtccgtggcgccggcggcgccgatgacacccatgtcgacgtcggcgcggccgatgactcccaccatgtcagcgcggccaatgacgcccatgtcggcgcggccgatgacgccgcgccgtgccgccgcggcggagcacgagacgcccgcggcggcggccaagctgcgcgccgtcgaggacgagaacaaggcgctgaagcagacgctggcgaagagggacgccgagctgcagttcgtgcagatgaagtacgccgacgaggcgtgcaagctctccgtgctgcagcggcagctcagcgagctgaccgaggagaacaagcagctgagcgacgcccatggccagacggagtcgtgggcctccgcgctgatctccgagctggagcagttcagggccgcgaagctgcagggagcagcagcatctgagatgagcttgctcgacgatttcgccgagatcgagaggttggagatggcttcaggtggccaaggattgagatcgcccaagaatgcgcattcggaagcgatttcttcagagaagaatgataaagacactgtcctagaaaatggtatctctatctccaatggccagcctgaatgggttcaggatatgtgcaagcttgtgatgcagaagcatgaaaccagtggggaaaacattgacacaattcttgaggagataactcgtgcattggatcagagtgctaataatcagaaaggagatgatttgaatggatcatatgactggagcataatgaaggaaatggtgttcagcctgactgaaaagatcacctctgttattggcatatctgaagaaggcaatgttgcaagttctcaaaaattgctgcttgacaggtctgaattttgtgctcgccttgagcatttggtccatgtctgtcatgatctactgcatggtaaaactgaccttgaaaagtttgtgcatgaggtttgtttggttctagagtatataatcaaccagtacaagaatatatcattccaagaacaaccagacactgtgaataataatacagagaatttggatggagaggaatcatttggtaacatgaatggtggatgtgacataaaaagtccgaaatcatcatctgctccagacatacaaactgaagcactggaagaatcaattcagtcggtagaaggccgaaaaacagatcatattttggttaaccaagaagagagtcaacttgatgaagaactcacaagagttatactagaccaggacgagaaaatcagtcaggagaactcagcatcctgtgagatagaaaggtaactaacactgaacacatttaataataatctgttcatgtgcaattaagttagatgagaatggtgaaaaattgtgttaccctttaaattactgagaaattaagttactgcaattaagttagagtaccaattttactgctactgagaaattgtgtcccatcatgccgtttttttaaatgcagcccccatgatcatccaagtgctgaaaccctggcagagaaagaggaaaagcatttagcatcagtaagtttctctgttgctcctataattttcagtaatcatatgcatatcaatcatataggtatctggtatgcttttttcaccattctcatccatacataatacgttcgtcagaacttaatcacaaaatttgagcttatgcagagttcagagatatcagcagcggctgagaagcttgcagagtgtcaggaaaccatcacaaatctaagcaggcagctgcgagctctcaagagtccggcggtttcaggcaatctagacagcccaatgtccaactccagaccaagctcatctgactacaagccccagtcacttgcatgcattcttgctgaaggggaggactccagcactgaggatgccatttctcctgcaaccaaagaggtgcactccaagaaagagcctgatgctgcatcacggaaaagcgtagcacaagatggtagtgttaatgctgccctcaaagctgtcgaagaggaattaacacaaaccgttgttcatccgatcttcccagagccatcccaagagattatttctgctgatctcaagaagaagagacggagccccagcttgctgggcaggataatgttcagaaagaaagtggaaggcagctaggtcatgctgctgatctggtggatgcactgtgctggtaaaagcttgcaaaatctagtagcgctccaccactatgctgtcactggagatttcgactttgaacgaacgagcttgttctgtttgttgagcattcctgttccttagggtgcaacctttttggacacgtattctgtcacagagactgatgacttgtggtaagagactctgagcacatgatctgtatcggttttccttgacatggacaaattttctttttgtatttatggcctccatggttgtgtaaatgttaatttaataagttaaaaatttgttcttgttcactggaatacgtacatgcaattctttttttctgtctgagcggctccaagtttcaagacctctctatactgtttggaaaaatccatacaccgacatgagattacaggtacagaagtagagattttggaaaaaaaaaatatatcacaaattcacaaataaaaagcattggagatggattgcttctgaattctgatactgcagaggcagatatccattgtgccttttgaaaccacaatagcgatctactgttagttgccccgtagttgtagccatttgaatgcaaaagcatttcaagattcttttaggtagggtgaggtcgccaccagtactcatcccaagaaggattctctcatcacagggatgtgaccttctgactttgcatagtatactactactatatttactttataaacagctgaaaaataccaatcatgctttcctttcaaataaataaaaaatcatgccggtgattgtcgtaatcatttacgaggtgtacagtacatcaccggcccagctgatctcaacagaaagaagcacaattggcgtaggcctcatcatctagaagcaatacgtcaaaacttatcccgagtcagcagcacaaaggatggccatattcagatattctaaaggcggccgtgacaggatagaaggcaacaccatcaagccactggggtttccagacgctgaccgatcccaaaaacaaacaaaagtctgaagcactaatatacttgcgtcaaatacaaaagaacggcatcactgcgtctgcatgctactgacaattttctcaaggctttatattcctcgagtcatttgcgttgcagttgcagacacctggatgcagttctgctccaataattagattatcattcaggttgcagacaggaactcatccaggcccggtgatgcctgggacggcaagagcttgtctttttctttcattttttttgtgttatttttctgctgctgatagactgatgatggcaattgtttgtcacttgtcagtcatgtactctgccttgtaccttttgttgctggatagcgttattcggcaacgtagccatgttatcgtgtcttatcctgtaatacatccgtcccaaaatatagctatttctagcacagtactttgttctaaaataaagctatttttctacctaccttctcctctcaaccaatcacaactattctttttttacctattttctcttttcaaccaatcacacaccttcttcaatcattctcatctactttcttaataccgtgccaacctcaaaaatacttacattttaggacggaggaagtaggctttctttgggttgtaatgcaggccaaatggcaacttgtagaatggtttcagatccttcacgccgcgtttggtttctgaaggggactgagatttcgtctccttcccatttggttatagttatctgtttatcaccacaagtttactgtttgcttgtgttcttggtccaattcagactgctgcagtgctgctttcttgacctgcagctcatccaaattccatgtatacttttcttgccatggttatcctttgtaacactaaactgtttctgcgcctgcgttgaaagttgatctgcgtgtgacgcgttcatgtattgtaccttaaacttcatcacaaacttgtttcactaatttgtcaaagttttgctttttgcaagtttgcaaccgtaggaactgatagtacaaatgatcaaggacagaagaagatgccattctcagccatgcaattttgtacttcaacaactgagtcttttatttttttgaaattgaagctcttccccgatccttttctcatctttattccagattatagttacagaatctacctccaggctccagccctacatctttacaccccaaagaaaaagcaaaaagaatgaaaggggagaaaaaaaaaaagaagaacgaatcagaagctctgttctcaaaaaaaataaataaatcagaagctcactatataagacaaccttttccatccttttaatcttttgacctttttacatgtttacatctaggtaacaacatctagaagatacaaacatccatggaaaactgcagccgcgatgtcctaactcctaagcatattgtcagaatcagccattaactgctgctaattcctgtttgacaagtgagccacctgtccctctcatcattgcttatgtcagtctcgtaatgagatctcgaacaggtcggagtcggcgtccgggtcgccggccgacgcgccgccgccgccgccgttctccttcctgctcttgctcatccgcgacgccgtctccagccagccggagtcgacgcggcccatggagaagaggtcgccgctgtcgtcgaagtcgaggcccagcgaaccgccgctccggccgtcgtcccccgccgacgcggcgcggaggaagcacgggttcgccgtgcgccgcgcgttcgccggcgcgtaccggaacttgccctgcccgaggttgaccagcgccatcacgtcgaagctggaggcgaggaccgggtacatcggggtggagaacgcgtcggcgttgcagctcacggcgtggaccagctgcccgtccaccgtgaagaacaccttccgcttcgccggctcgaagccgcagcccaccaccttgtccacccccgcccacgacgacttctccgactcgtacaccagcttcatccctgccatcaaaatccgcagaattttcagctcaagatttccacggttgcaacgcgagaaagagaattcttgttaccgtcgaggtagaccgcgccgttggagtggaagccgatggacgacgcgtacgttccggccagcgacggccgtggcggcgcggcggacgcggcggtggcgaggccgaacgacatgaccgtgtgccgctgcttgtcgtggtgatcgtcgactttcgtggcggctctggtttcttggaccgcgttcttggcgtccggtgcaaagctgatgagcttggcgcggtcgctctcgctggagccgtccctgccgcggcggctcgccctcgacgccgaccactccggccgccgcgtgttgaggtagatgatggtgatctcgaagtaggcgtcctgcgggaacggcgcgccggcgaggggcgggccgggcagcggcaggctcatcctggcgaggcacagggcgctgctgttccccgccgcatcgtggtcgccgccgcggagcgggctcgggatgctcccggggagccacttcttggtggacgccgagacggccgccgccgccgcggccaccaccgggttgagccgcaccgcctgcatccgctccgacgaccccgcgggcacctcccacgcggtgtccgccatgtcgcggctggtcccggagtcgcaggcggggcagagcccccacagcggcgacgacgacgccgacctcgtccgcggcggcgccacggcgaacacgaactgcgcccacccgttctccgccgcctccgtcaccagccgcgggtggtccgcccactggaacggcccctgctgcgcgccgccggcgccggcgccgccccggtgatgatgcctcacatcgacatgcccatggtggtgatggtgcaactgctggaaccggagccccgcgcggccactcgtggcgttgtacctgatattcagcttccccaacccggggctcaccgccggatcccctcctccaccaccaccagccacactctccggcagctcaggctgcgcgttccgcgacgacgagctccgccgccggtaaacaagaacagccaccgcgaccagcgccgcgaccggcaggaacacggacaagaacagcttcagccacagcgccatactctcctaattaacctcctcgcacctctcactctcacaccactctactcgatcaaatcatcctgcgccaccggagctgagtcggcgaggtggggcgaggtcatggacatggtggtcgtgcctggactgattcgtgtgacctgttgagttgtcgtgggggtttggtttggtgagtggtctaggaaggcaggcgcggcaagggaggaggctgactggctcaacggaagcaggcgaggaggaggaggaacgggagggcggttggagatggaaaggtttttaagccgcgggaaagcggggtgcatttttggggtgatttctctgtgggtgggtagcccgtagccgacgggaggagggctaatctgcaacgggtacatgggcacgtcatagggttgttaggttagtgacgtgatgtgagaacgccttatgttaataacacaggcgaaagtgttccgcaccaaatctctgtttcctgagtatgaacacttttcgggctccaaatggagaaatgtttttgcgttccattggctttatagcactcaataattaattaaacatttgttagcatacagttgtgagactaaacatttatcaataagcgtagcatatatatatccacgattctatgatagagacgccaattgtagtaaaccagtaaatttagtacatatttgtatttttaattttaatatagtcgtctttgtcattgtgttgttcttaaaccatcgactcgttcaactagatatattggctaaataataacaccttcacacttttacgcccccacattttttgttgttagtatattacttctgtgaaaaaaaaatgaaatgcattgaaattttgtttcggcatataaaagttaatgatcagtataaccttgaatacgacgattataatctttttagactaacgagattgattgataggacaagcctaagtgttttaagacaatggataaattggtcattgctttaatagaaactacaactacttattacaagctaaacataagagccttactgaatgaatgattgaatgaatgcaaaaatttaattttgaacggaacattttgttgtggataagctagtagtgtgtccttctctcacttagtgaatgtggctcacaactttgatataaaatgcattcccagaattatgtatgaatatatgatacatttttttagaactaatatatgatacttggagtagtctagtagatgcagcactgctctcaacgaaatgtcactatgtggtatttgtgacaataagttgtagttggttagttactatcactttcccaatcactatgataaactacatgacgttaccaaatacgtgtaatgatgaaagtataagtacacaattggtagttttcgctcacatctcttattttaaataaaataaacaattgaaacgctctagtcactcacatatcttattttaagataaataaacatatcaacatgcactagtcatccgcataccagctcatctgtactccctcccatatttgattttaaatatatgtttgacaattcattttacttaaaaattataaaaacattacttgttttgttgcgacttttaccattaaaggtgctctaaacatgtcttatgttttatactaaatttttaataaacgaacgatggaaacatgaataaaagtaaataatgtcatatatttaaaaatagatgtaatattattttgctgatttcaccaatgtgaaaaaaaaactgtccctaagaatcggtcaagttatgtaatttgtgtaacctcccccctccctacaaaagaaactgatggatgttggcagtacttcttttcagctgaaaatttttcaaaaaaaaaaaacttaagcgcgtaattaatctgcataacgcatccgttaacccttttttctttgcaaaagcttcagctctgacctcactcctcactaagccatccccttgcagtttaatttggaggtacaaaacgccggtggacgtaagccggatggcacgcgagaacagacgtcagatatataccaaatcctatgaaaagtaatatgttctttctccgatgcgtcggtgtcgcggcaaacgtcagatgcccgcatgatcatccccggccgttctgttcacgatttcttccacttttttctattccaacggctcgctaatctctctctctctctctcgttgatagcaatcaacagcacgtgatttggaaggggctcacacgtggggaagcatcgatctgggacggtgtcatcaggcgagagtcatatcctgttcggtctgtgcaggaacgagttgaatttggtgcttagtatctgtcttaatcatggagctatgcatcttttgtcagctcaacttgggtgcttatttttagtcccatcatgaaagtgtattactactagtttcttgttatggacagcttgtcctacttttaaatccatctcggctcaaacagagaatattggctttggacataaccttgatttgggccttgcaaagggaatgcatttcgattggaccaatataactcagtgaagcaattgactaggacggtacaggcccaaagacgaggtggaaacagtacaaaaggcatcaaaatgcctgtgtccacttgcttggagactggagagtgctttaacctgagaattcttttttgtgtgtggagaaaaacctgatattatgtaaatggatattacctagggtaagcctctcatttgcatattcattcagattcaaagccaacaaactagaaagatagaatagaatgatagaactccagctcctcgttgggttcacgactctacccacccgctagagaactctagttcaagtcctggtgtcgataattatgaccgtgtgcatctgtgattagtgtagatgctggaatgtatagaaaaaaatcttattaaattcaactagcattgtggcctgcgcagattgcgcgactaacatcattatattttctctcatataatagcatatatgttttctcattatattatttaaatatattaaaatgacaacataattttaaattttaatatgtaatgttcctattgtattttatatacgtgttagttatgaattatttttaatatcaaattttagttatttgtaaattatatatattcctatatagactctagactcatcttttaatatatctttttaattttgaatttttattatttctaattgaatttctatgtggactctaaacttatctttcaatattctttaatttttaatttcaaattttaattacttctaaattgtattcctatactgactttaaactcttcttccgatgtttttcttaattttgaattttagttatttataaattgtatttttatacgaatcaaaacactacttttaattttattatgtttattccgaatttttgttagatttaaattcctatatggactctatactctacttctaatattccttattttttaattccgaatttctattttttttcttaattgtatttctatataaatctatactctacttctaatattctttatttttaattccgaatttctattttttttcttaattgtatttctatatggactttatactctacttctaatattccttatttttaattccaaatttcagttatttcctaattgtatttctatatggactctagtttcctctctaatattccttattttttaattccaaattttaacgatttctaaattgtatttctatatagactctagtctcctcttctaatattccttatcttttaattccgaatttcaactgtttctaaattgtatttctatatagattagtcgattagtcgagctgttttaataatataatagatagatagatatatagataggcattgctgcattcttcactccttgatctaggaagtagcttagaaacaaaagagaacaaaaaccttgaagagaattttctgaaaacatcaagggcgtactggccccagcccaggttgcttcggcccagccctggacatggtggctccttatcggcttctttcttgggccatgtatatggcgtcagaactcagaagtcgattccgcaacaggaagaactcatccctctggttcctcttcccgcacacaaatttcccgtcgcccgggtgcaaaatcccatagctggcggggcaaaattcacacttcgtcttgtagccgtgcggtttactcttatctgttgatagagtaggaaaacagaagtcataaattaggatccttgttatgagagtaaaatcattagcagctgacatcagagagtcggcatagcagagagtgacataaattaggcaccaaaccaacacacgataaatgcagtttatgaaattcaataaatccgtaacatgagccgtgacttaccgatgatggtgcaggtcacaacggtcgcagagtcgtagtcgtcgtagcgtagctcggcgaagaactgcttgtcgggtgactcgggaggagccctgttgcgcttgttgcgggagcgtcgcttgcggcctcttttcacgtcggattcgtcatcatcggcagcagcagctgctgcttcatcggctggcttcaccgggctgctcctcctgcgagccaggaagctgacatgaacccagagcgcgcgtctgaagctgacggacgcataacccagagccttgacaggtcgaactcggcgccctggaaaaatgttgctactatgtcagtaacatggtttcgtttaagtacattgctaatcatcggttttgcatccatacatattcagttgttactgcagttatgtacgtagtgaggtgcttacaggattgttagcgttgtagtgatggagagcgcggttgacatggtcgacgatcaaggagagttcagcttgcctgcaattgcaagtgcggaattattgttaccgctacatatactcctcatcttaagaaaatgaagaaatatgcttccttccaaaaaaaaccctatcactgctcgatgcacttatattgttaaattcaaaaacaaaacgcaattcgaaaaagtatccaacaagaaattagtccagcaacgagagtaattctaaattttacgcaacctttcgtgttggttgtaaggacatttttttttcgttctcgtctgtgttcttttattggcctagggtggtcggtcacgcttagcagcggccgatccagtgctagccttctcccagatatgtgtgtttgcgctgtcgatatgtggatggtggtatatatttttttctttttcctggttatgaccttccagtattgtaatcttgtattttttttctgctctatcaatagaacttcgcaccgtctcgtgcgagttgttaaaagaaaaaaattacgcaaccttagatattatggtctaattaagttgtacaaaatcacaaaggttttggcatgtatcacataaccctgggttggtattatgggctataaagtttcacgaaactaaactatttatcattttaactttgatcggagaaacacctaggggtttttcggctagctccacaaggtggtgggctaaacgacctgggttcgaagctttaccccttctaattatttgatattaggccctttcctaatatttattttaactttgatctactacacgtttgaggtctacaatcaacaatcacatatcaaatttatgagtttttttatctgttgtatataaatgttacatccatataagtaaagcttcttaaaattgtgatataaaagtatgtcaaatttgttaatgatgtggttgtgtcaaaatttatatagttttgtgagactacaatagattgggttttataaaaactattctctctctctctctctctctcttaaaaaaagttcttttctatgaccattatgctgtggcacacaacaatatatcgtgagaggatttttttttaatggaatcgtgagaggaattgcaagttcaattttccaaacggccccggcccgagccaaaccgcttgagatctaaacaatcaatcaacatagggaaaacttgcagatcgatcgtgacgagctagctgtagacgatgatcaatggaggcgcaaacatggcatgagaattgagatcgaagacgtaccgccgttcagggcatgggaccccgcctcccctgcagcgacgaatgtcgcagccgcagcggcgcagccgttccaccgcctcgtcgatcaaacgctgccgccgtactagctccccgcgcgacaggttgaatagaaagggcagcctcgtcgtcgtcgtcggcggcggcggcggatcagcgtcctcctctctcgcttgttgggatcccatgtcgctgtgatccagccaagatctaatgttttacaagaaattctcaaaaaaaaaaaaagagaaaagctttacaagggaggctaaagtaaattcggcccatttaagtgttcaggcccatttaagacttttaggtgctgacgtgggctgcgcgtcgtgacccaatggaacgggctggcttgcaactccgtctcctcgcgcttcctcccgacggcgtcccgtcctggatgccccgaggtggccgttcgccattgacaggagtacgaggagctacgtgcatgggggtgagtatgtcgatcgttgtttccgaggagattggatatcgtcggagtaagtactccttccaatcttcttctttttctctctttttttcttcccgaaagaaacatgctttggatctctagttactttcttgatttcatcggatcaaatttggattctgttgaataaacacaaggcgaataggtttctctaaacgatcgatcgatgcacgaagcttcagattcagagtgggcgggcaatccggtcaataggttggtacaggttcagacttcagatttcttaccagcgaacagtgggctggttggaggcttgcagcaagctcaatcagccggtgagtccgtgactccgtgttggtgacttggacgaaagaagatgttcgacctcaagcatgccgctgtcgatagccgacatggcacggggagctcgctccacagccgcaggcgagaagataagaagcccaatttgcatggatgattaaggtaataaatagcgtttatagcgcccgtaatagcggccactatatagctgtagcggacctctaccgctacagggtagtggactgcaaatagcgtattggaacttaacggccgttatagcgcttcgcggccgctatagcggcccactattgactttattagatcgctattaaacgtgtagtctaaattttaaactttaactaaaacttgatgttaatattgatatacagttatttttcttaattttgctcttggaacttagcatccgcaatagcacctactatccgcaattcgctattcaaacactaatccactaccaacccgctatacgctatttattatcttgtggatgatgcatccttgagctttcccttcccgaattccagttccagctactgagcaagataagtcagcatgtcatttatcaagacggcaacagggagaagaggacgtatattgtactggacttccggggacgtacgacgaatgttaagatgcctcaacatctcgtcctttgtcctgtatgactggatttgtatgtcagctatcagcataagcggtcaatccacggcacggcgatttgagaaacgaagcacgcggatgtaatgcaatgttattttcgaagtgtttttaaacccttggccatggggcctggcacaaccacacacgagaaaagactcgtatatactctattttaggaggcaaatctccgggggggaagaaaatctgccatctagcttgatcgctccaagaaaggtaattagtttttttaacctttacttacggtgcttaaaaaaagttttctaaacataatttcttatacatctattatgagctatggaatgattacaattatgaaacatgtcaggattaatttttcgttgttccgatgtgccttgcacgggcaccattctatgcctgattttcaaacatatgactttttttattgtttgatttgcatttttaaaatattgttgtagcgttaggacatgcatattactagtatatatatattggagaaacaacttttactgtgatatttatggatattataatcaatctaaattttccatattttctcatacaatgaaataggccaatttatcctatcaccttaatcagtagcccaagagtataaatgtctactcaatagatcaatggattaggtcgttgccgttggtagaagaacaaccttgcacagactatttatgttcatgagaatgtttttggcttatccttttcaggtcataaaagagataccaagcccttacataacaaaacataccatggttgttccatcggcattgctgctgccgctgccgctgctattgctgtgttacggatttggaaacatccattgctcaccagttcataggagcagcatcgatctccactcgctgctcgacttcaagcagggcatctctagtgatccaaatgaagccttgaagtcctggaacaccagcacccactactgtaagtggacgggcgtcatgtgcacccaaacgcgaccatggcgcgtctcagggcttaacctcactggtctaagcttgggtggccaaattagctcctctctcggaaacctgaccttccttaattatctggacctctcctataataatttctttggcccgttgcctcttcttaaccggctccaacaactgaaaaaccttatcctaggaagcaacagtttgcacggggctattccagtctcacttacaaattcttccagcttgtcatacctggacctctccacaaaccttctagttggtgcgattcctgcgaacataagcttactttcgaacctagagtatttggatcttgatcagaacaatctcaccgggaccgtcctgcaaaccataggagacattacgtcattagaaatactttatctttttcaaaatcaactaagtggaagcattcccgataagatttggcaattgccgaatcttatgcaattggtgctcggtgaaaataatttgtcaggtggaataccacaaaccctccataatatatcttctctacaaagattaggtttggagtacaatatgctaagcaaagcattgccacctaacattggtgatgccctctccaatctcgaagtacttgggtaacaatatgtttgaaggtcaaattccagcttctttaggtaatgcttcagggctacaa

SEQ ID NO: 69673 - DNA, 4791 bp, Oryza sativa
acgaatcaagatccaataaatcagacctaaccgggatagtacgagattaatgacaagtttaatagatctaaataagctgatagactctgtataaagtgattgatatattgaatctaaccaagatagcaaagcaatccagaaacgagccaatatatcagataagaaacgcaattaagaacttaattagaatattggacttaaccgagaaagtactaattacattgatacaagcgaagttgacggaacttatttctcaccggagatcgaaactgatgcaacacagctcgaaactaagaactcgtagaaaactaaattatggtggtgatgcgccgaaagttatatatttatctggtcatagttaccaagactctgggcatacatacttataccctcgggctaaaacgagtctgctcgaacatgattcgactggcttaggattctatctccttaataaaaggaaaattaatacatgtcttacctatagaaataaatctaaaaaaaaatctaactaaccaaacctatcctagattttccaaccgtaccaagccaaatttatagtgtcaacttctccttttgacttgccttgactaacgacaattgtcaaattttgccgttaacagtttcttacaatgatctagctcgagctacatcaggcttcttcgagtaaaacctaataggaagagaaatctatggttcatagttactgacttagttctaagcacgacttagtagatcaaacttaactgatgcatcactaagtatgaaaagaaacataatatctagacaatcaagcctttgattgattttcagggtggtggataccttagttaatctaatctagcaagataatttaaccgataccagtataaaccctaaaatgaatctcagccgatatgatcaaattaagatgctaatctagattaactaagatatatgataaataggtaggtaaatatatcaaccgatccagagtgatccaagagggcgaagtgatgtaaccttgaacaacatcaatgtagctgatacaatctctagggccggcgaaatgtaggacttgccccttcaccggagatcgaactgaaccgatgcagccttgcatcaggtgacaagtttcgccggttgataagtaaaaaccttgaaaaagagggtggcgatgcgccgagagtagttgtattgatctgtgagatagtttacaatgactccatgtgtacatatttatatccatgggtagatactagtccttattggataataaagaaacttttctaagataaaaaggaaaacataaagtccttatcggacactaaacacactctcctaaagataacaagaaactaatggactcttcctaattaatagataaactctgcatcctccttttgaactcggtctcttatggataaatttcctttaattcaattaatttccttaaccgaacccatcaagaatcagactactggcgactgttagtgcccatcggccgatttgtcacaccccaatccggcaccgccatacaacggcacctgacaagagcgtgtcgtaggaaaaacggcgcgaaccgcttcatacgaaaccacgatcttagtaccagtcccaggacatagcgctggtacccacggtgacaaatatgaatcattgcaatccttaaaataaatagaggacttatttaccttaacttaggttgcagctcagaacagcccgagaatgcaacagatgacccggacaaggaaataccaacaacagcagcagcagcaacggaaccaacggactaacacccaacaccacagacgatagctaggaaccaggacgaaaccctattcttcacttcacttcatcttcagcttcagggcggaggaactatatatatatatttatatagagcaagggtgagtactttcgtactcagcaagccatgggaattaagtgtttaatgcaggcttcaaaggaaaggctgttgtttttgcaattgattttagttaaactcctttttgaaacaactaagtgagtgcttctcaaacgacacagatgagacagtgcgtctcgttcggtcggagtatgtgcaatgtatcagtctttgaatagattcaaggttggcacccggccaacaactttcaaacggccacccgggcctagctgatcccatcagccacagagattttcccaaacatcgaacccattccacaacagcaatttcacaaagtagtaatcaaacaaaactacactaggaatcacctcacgtccgcccatgaccgtgggcacggctgttcgaacaatttaataacctctgcagagggtgtacactttacccacacgacgttactagccttggtcacctaacccgtgcggatcaaacacgtctggtgacttggggctttcacgacaaggcatttcgaaagccgacacaggttcaccatatgccaacgagaggggtcccagaccgacaacaggttaggtcccagaccatactgtgccaggaagcccgagggttctccccggcaccaccccgttgaatccacatgtctcttggcatcatggttctcccgattagcaaattactcagctaggggtgtcccattccacccatgtggtcgcacttgagacttatgttcggatgaaattccaagggaaccggtccttaagtgcaagagcgggaaaccgtactcccggtaggtcccccggtctgtggtattggaaattcatttagtttgcaaacaccaaccctggtgtcgggttttccaagtttttttgtaaaaccccaagttttacccatcattggatattttaaaattgaggggaggtgttccgatgcgcatgcccgaaggcccgtgcatcaaagcacaacagttgacaaaggaggtttaagtgttcaataattcaaggagggtaattgcagcaattaggattggggccggtaggctatctcgcaagccgcggccgaaatactcgtgttaatcctattcatgcaatatttgcggaaaagaaatacttagatttaaattataggtgcaagatgatcaaaggtcacttgccttgctcaaggccttcattgagcttcacgaatcttcaagaaaacccgcgatcgacgaaaatccggtaatcgcaactatacgcaaacaatcgaaaacctaaaaaaaaaaccaaaagaaagatcctatttagactggttaatagtgccattaaatagatctcaattttatggaattactagaagcggaacggagtcaatcggatgagcagctgagaagatattgaattttggaagtttaattggaatttctgggcgaaggaagatatttgtggaacaaggggaaattgatttatgaaatttatagaaataatattctcaagaatattattgaccgtcactgacgtgcgggaccaaaggaaatgatttataaggaaatgattcatggaattttggaataaggaattgatttatggaacaagggaaaaaggatttattgcatttactggattaaggaaatgatttattgaattcatggaaaagaatattcccaagaatattctttaattactcattgacacgtgggaccaacagggggaaagatggacttttgtgtaggggagctgatttgatggagggaagaaatatggactttagctcatgagggatgggcactgggcttagagggagggactgaaagtggactttagaggtcggaccgagggagagggggcacggcccgggtgtggaaggaatggcccacggccgggcgggcgaggccgagccgggccaggcatgcgcgcgggcgggcgctgaccggtcaccgcttgacccggtcaagcgggaccggcgggctgaggtggcatccacatggatgccacggtggcaaggcgagaggggaggaggaggcgcgcccggagatcggacggcacacggcagccgatgggttccggcgagcagcggcgagccggagggggatgcgggcaccggtagatataggaggagatggggaactcattccacggctcggatcgaagagaggaggcgcgacggcgatcggtggcggcggcgaagctcgtcggatcggggatgtggtcgcgcgagggaagggacaagggggcgcgaactcgggcctagccgaaccggtacgcgactgcgatgcgcacgcggtgacgcgggacccgatggtcaccggcgacgcgggacccgatggtcaccggcgacgcacgcgcggcggcgttatgcggcggcggaagcggcgacacagcgcggagacaaaggagaaggccggcggccttggggcagccagggggaggtcaaggggatccccgggagcatggcggcgagaggaatcggcgcgagaggagccgacaactgtggattgcggcggcggcaatcaccggcgagcaaaaggggaaacacgaggagacgacgagggttcgattcaaggggggtgggagcatctccggggttcaaggaatccgtttccggtgtcagatggggcagagcggcgccgtggtggcgcggcgacgggaggcggcctcagggagcggtcggcaatggcggcgaggccatgccgggcggcggcggggattggggtggcatccatgcgtgttcgggaggctagccaagctaccacgcgagctagagagggagagggcgagcgagaagggagaacggagggtggcactaccgagccgggacgggcgcagtgacgagcggccgacggcgcgggagcgagctctccggcctcgggctgaggaaggggaagaaggagggtgcccggagtcccgcgtccgcgcgcacacactggctcccccggagct

SEQ ID NO: 69674 - DNA, 9782 bp, Oryza sativa
aggtgagagtttagggccgttatagatgatatgatccggcgtagtgtggatccgccgctcagacaaagttagaggggtacaatactaccatctctgtttcacattataagaaacattataagatattttaggttttaaatatattcatgaacgaaactatgtgtgtgtcgatccatgtatgtgttttatatatgatgttttatatatgcgtctaaattcatatgtatgaaggagccaaaacatgaatggaaggaatgggagataagtttcctatgaacatattcacactaaacaaacaagaacgattcgttgtaatacccgatatagtgaattttcgtagcatttatacttctattacattattatcaattgcaaatcacggtaggtcgtgaagccaagattttgagttgatgggctcatggctttcactagtactagtgtcatatttaaggggactctaactcctagcatttatagctcaaaattcttttgtagctagagcagtgtgtaaggtaggattgtttcattttactaaaagtaattttttaaactctttattctacaagacattagggatttttaaaaggtccaaaaatataagagttagaaccatataaattgagcctaacaacaatgcattcttttggacataaaagcaagttacggaagttgtttactgcctcctccatttcaaatgcaactacctatccaagatgtttttcattccattatctaaaaaaatgcaactacctatgcccttatttttttaagagatcggttaagatagagtggtattgaagaagtagttgtattttaagataaatttaagtaatagaaatagctatattttaagatagagtaaatagcttaaaaaaacacagctaacatttagtttgagtagcagaactattggcctaatgcattaattgatacacacaccacatagctaaaatagatcattaacggatcaaaatgttaaattgtggcattggcattagtggtgctgtggtgggttgacagtagcataataaagctaatgaattgcgcttccatagaaagaacctactatggccctgttgagatcccattctaaaatttttttatcctgttacatctaatgtttgaacacttatattaagtagtaaatataggctaaaaaataactaattacatagattgtgactaatttgcgagacgaatcttttaagcctcattgctacatgattttgataatatgttgctacagtaaacatttgctaatgacgaattaattaggcttaataaattcgtctttcggtttattgacaaattctgtaattagtttttttatagtgtccgaacacccatacgacatcctatataatacatgatgtgacgcgccaaaactttacacacctacatctaaacaccccctatattgttttatcttttatcagctctaacatattagctatctgaccggggtcatcgagctttgtctgcggggtcattagctacaaaatactccctccattccaaaatgtttgacgccattgactttttaaaaaatgtttgaccgttcgtcttattcaaaaaatttaagtaattattaattcttttcctatcatttgatttattgttaaatatagttttatgtatatatatagttttacacatttcacaaaagtttttgaataagacgaatggtcagacatgtttaaaaaagtcaacggtgtcaaatatttagggaagaagggagtactaagtgattcatttggttggttgaatgccaccggggtcatctgacccggtgatattattgtggctctgtccataggtctttctagacggactaaagtaaagtgtcgttgccaactcgttgcttgttaatttgctcttgtatctttgtttagcctatgcgatatttagttggctctcgcgtgttttgaagatatggagatgttgcttaggttttaaccttatcacttgtcttgaattattaggatatactccctttgtcacatttaaccgatgtattacagtcatgcagtgagaccaagacgaagggattctctattattagtaattaaagcccatatcatagaagcccaattgtttgctctggtttcttgcatgtgaaacaaaagagaaaggggcatcccatttttatttgagagaatctattatataccactgagtttgttcgagttcaataatttttcattgacattgtctctttctataatacaccggtgactttattaattgttctacaatatgccattggactgaacattctttttaaaaatacccaaaatacccttagagatatataagattaacaattgatttatctcattagaagtttcaaaaaaatatgaaaacttttatgtggcctccttacacaacatgaaaatttgtacagaagtttcaagtattttttacatttctattttttataaaaaaatataacttatctgttatatgctacataaaatactcgtctattgttttttaatataaatcatctttcatacactacataagatatttttgtgctattatctcttttattagcaaattctctcttatataccacataaaattatttttttttcaaaaaactaaatataccagaaaaaacttaaaacttgtatacaaatttccatgttgtgtaaggaggccacataaaaattttcatatttttgtgaatcttctgatgagataaatcaattattaatcttatactccctccgtcccatgatataagggattttcagtttttacttacaacgtttgatcactcgtcttattcaaattttttctgcaaatataaaaaaacgaaaagttgtgcttaaagtactgtagataataaagtaagtcacaaataaaataattaataattttaaaatgttatgaataagacgagtggtcaaacgttgcaagtaaaaactcaaaatctcttatattatgggacagagggaatatgtctctaagggtattttgggtatttttgaaaagaatgttcagtccaatagcgtattgtataacaattgataaagtcgccaatatattatagaaagagacaatgtcaatagcaaatattgaacttgaaccaactaaatgttatagaatagattctctctttttatttaaccagcagcttacacgtgaactgaatggccaacgcctccttgcatacatgtgaattcattaaatcaatatgtaaccaaatagccatgcgttccacataagactaatgcgttgatttcttttaaacacttcatttttcataggcgtcgatcaaacatggacaacagatgaagtatggtagccctagtaattaaaaccttgtagtatatttattgccccacgcataagcataccactactctgtcatatccaaatagtagcactctgggatataatcgggcaccagaccaatgccttcacgttgtcggtgttattattaaagtaaaactagctgggtggtccgcacaattgcgcggctaacacccaaataaaatcatatatttttttaagtatgatttcacttaaaatttattaaataactatcttattgccttaagactttgaaagaccaaatcttatcatcctcgtgtttctaattatataatttttaaaagtcacaccagttgctacctcttatgtcatctccttctttatttgcttactcgatctactattatttctatccattctttttggaacctttaaaaattggaattttatagtttttagagtttattgtcacattgggttttgtttttataatttctagatgtcccgtcaaatgttgtcattatactgctctacggtccgtccactgctcttctctttgttgttattgagattttaaaaatcgaacataattatcatttgggttcatttttactttctagaagtcccaccaaaccaccagcagctttaccattgtactcctctacaactcgcctgctgcctccctttcttattgtcattgagattttaaaatcgtacatgattatcattgatttttttttactttttagaagttacgaacctttaaaaattggacttggagttttattttttttataatttttagaagtcccatcaaacgatgccattatgcccctttacagcctgtccgccggctactcttattggtattgggaatctaaaaattgaacataactatcggtggaattcattttttattttctagaagtcctgtcaaccgtcggcgggtctgcaactatactgttatacaccccgcacgctgcttctccttttttttgtcattgagattttaaaagtcgaaataattatcaatggggtttatttcttttacttttagaagtcccggcaaccgtcttacttttttgcttcatggcatgcctgacgtccctccttttaatcgtcattaggattctatttggtgttttattaacaatttttatatgtcgtatcaaccgccaccactctactcctttataggcatgttacttcatttatctcgtcatgtgttttagatggtcttttcttttaatagtctttatttttatcacaaattttagttatttataaattgtattcctaattaaaatcttatttttctttttctaattttagaattttttaaattttagttaatactgtattgtgttcttttaatatttttatttttgattttcaattttagttgtttcaaaattgtattcctatttgaactctcttttaatttttttttctaatattggatattaatttattttttattctgaattttaattaatctcgtattgggttcttatatggatttttttttcaatatttgcttatttttatttccgaatttcagctaattttaaaatgtattcctacttgaactcttcttttattttcttttgctaatttcagatttatttttatttctatttttttaattaatctcgtattaggttcttatatggactcttcttttaatattccttatttttatttctgaatttcagctaattttaaattgtatttctacttggactctcctttccttttctaattttgaattttattttatttttattcttaattttgattaatcttttattgggttcttatatggaaacttctctctattttccttatttttaattccgaatttcagctatttttatattatatttctacttggactctcttttccttttctaattttggattttattttatttttattccgaattttgaataatctcgtattgggttcttatatagaaactttcctcaattttccttatttttaattccgaattttagctatttttaaattgtacttctacttcgactctccttttctttttttttcttcttcgactctccttttcttttttttctttttctctgattaatgtggaaatttctagctgaattttaattaatctcgtattgggttcttatatggatttttttaatatttgcttatttttatttccgaatttcagctaattttaaattgtattcctacttgaactcttcttttattttcttttgctaattttggatttatttttatttctatttttattttgaattttaattaatctcgtattaggttcttatatggactcttcttttaatattccttatttttatttccgaatttcagctaattttaaattgtatttctacttggactctcctttccttttctaattttggattttattttatttttattcttaattttgattaatcttttattgggttcttatatggaaacttctctcaattttccttatttttaattccgaatttcagctatttttaaattatatttctacttagactctattttccttttctaattttgaattttattttatttttattctgaattttgaataatctcgtattgggttcttatatagaaactttcctcaattttccttatttttaattccgaattttagctatttttaaattgtacttttacttggactctccttttctttttttctttttctccgattaatgtggaaatttctagcctccacagcgaacgtggtgcctcctttcaaagctgttttaataatataatagatagataaactcataacttatacgcccaaaattgtttggttattatcaactctcgtatgattaaaaaagttgagaccatgaaaaatatatgttgaagttttggggaaaaaatgtcagcaacaacgtaaaagaatattaagaccatgaaagatcgatacattcgaaatttcagagagagagagagagagagagcatcatagttcaatcgcgtattgggccgtgacaagatcagaacgatctccatatatctgctgaaagaataggaaggacatcatagctcaattgcataatgggccacgacaagatcaaaacaatcttcatatatctacgaccttactatatctatcctaaaatatacgtatcaaaatatagtaatttcagatgaaataagacacgtttaaatttatagtattaaaatatatcttgtttgatctaatattattatgttttcgaaggaaggagtagttttattctcaccattatctaggttccgctatgcctatgcatgcatgagtaggcggtcacgagcgacaccatatgcatcacattctgcatacatatagtatgtggcaacagtcgatgtcactttggatttgtcccactcctacgtacattctccactgaccaacttccgccataaagcccgttatctttcgctagttgtatatataatatcttttaaattctattatatatttttggaagttttggtagctacagtttctcttaaaataaattttttttcttaactaatttagttttcttttatattttgagaaaccgtaattgtagaattcagaaaataaaataaaaaaacgaaaactagtttttttttcgtttctcaccggctgaacttataatctaaaacttcatagaccttttttttcgaacggccactcctcagacctcaaactggctctataagaactctcatgcagcatcagtatgattgagatgtgcactttataaacaaagataataaaaactaaaagagagtttggtaatcaacaaagggctgtatataatgggaaattgggaatgcatttccccttccgattccactcagaggcccagtggacaacgagcgactaaccagctttggcaagtgctgccaataacatttgacccctgacgatcatttgagagatatgaatctaatcatcgtaccacttggcccagaaccattgcacaaattaatcaggtcctaattaagtgcatgtaaagtactaagcaaactggcacggaaccattgcacaattggtgcccctgctcaatttagcaatcccacggacggattgaccactaaaaccggccgtttggcagttgggtgttgaggcagttggtttaatttgcctgcgtaggttgttggtgcatcatactccaacccacttggcttaatggtcgccagcgagatatccgacgcctgctgcggcatgcatattgcatatgcagacggtttcagttctcggcggcgcgcgcgcattggtggccacaccagcgacgatgacaatgtgcgatgcgatggccggtggtggcagacaggacttctgtgcttaattcgctcttataattgctttggttaaacgatttcgttggctttacttcgtctatccatgggcatgccgcatgcggcgtgtcccgctgtttctccgtgatccgtatatatacatagttccatctcttgacgtggcgtttggcagaaaggaacgaccctaccgattggaattaattgtaaatctaaacggtttagtatcgataaaaaataatttataatttaaatttttgtatgtgtgtttttaactacttaaaatccaatattaaaaaactacgttaaaaatatctttaaataaaaattaagtttaaaaacttaaaatttagtactccttccctcccaaaatataacaacttttagttatcaggatttatcctaaaatataataacttctccaccaaaattctcttcccaactaatcacaaccctccaccattcacttttatcatctatctccactactcatccaatcacaaccctccaccactcacttctacctgcttttcaaccctaaaatttcgtatattttaagatgggggaatggcgacaaatacttatatagggtaaacgatgaggacgtaagattccgatggtgctttttggttcgatgtttcatacttgtcagccggcactgaagttgattaatttggttttggtattttactctctttattagttgccctgcttttcttcatgcacgcacgtaatcacttcccatattgagcatatatggccgtatgcacttgttcgtcagagatcgatgatgtaaacgtcagtttcagcaggtgctgctttacaccgcgagaaaggtgctgctttagtaatatttattagtttattcgcatttcacagatgacgtggtagtgcaaatattgtctgacacaattatatatgtgcaagctgctggattattctaagtacaaatggagcacatataggagtactacatactttacatggttgtattccaccacatgtctaaagaggttgaagctctagacttatatatggtacggtacggggctatgccttgagcgtaagccaagtttgagaaattagatagggttctgtgataaacttgtgaggggtgttgtggctgcaccttgtgaacaatatatttgagcaatcaatatcatattcaatcatcatgccatcaacgatctcttccggtttcgtaagttttacttttatgtttggttttggtattaacttgtgattgttcgttttgctgtgattttgttcaagttaatccatcaaaaacctttctaatatttcatagatcagatctggaaagttccgttgattgtttcttgctagattcgaatttgcttaagttttaggttttgttcagatttgctaaaattctgggacaactgactttttagggtgttttctcttaaaccatttattagtttgtaaatccctccggtggagttgttccttggtttgtctaatttcgtctgtcaagtttgcaactcgatacaatggttggtttaagagaaatcatgttttttttaccaaagctctgttgttatgtttttaggctaacggtcagaccgcgagagaacctacggtcagaccgaccctagtaggtcgaatagatcgtaggacgtgtgttccattggtttttgaggtcgggttgtgttttgatttataaagattcgattatttgacttccgctgatgtaatctatcattcacccctttctggtaggcttggttacttgtgttcgatcctacaataacttatttagatttaagtcttaaacttcagattcaagtactagattttataatgataatcttttcatgtttaatttcacaagatagtatatgtactctctatttataccgaaaatctcatactcgaaatgtagcatcatatactcctctccaatttcttccaatctccttcgcgaacaccgacgcttgcacgcacacctcgtgaagcctgctgcgaagatctctcccacgtggtgtccatccaccgtgtgccatctcgtatccaacttcatcacctggtattccgaacgtctggacctcaactcctccctgagtctagtcccaatccccaccgttgaccgaagatgacctccaagaatattgactctagtcaccttttcacatggtattccgaccgcacaaga

SEQ ID NO: 69675 - DNA, 8042 bp, Oryza sativa
aaaccctatccttttaaagggtagaaaatcatatctcaaacacatttttcaaacgtgcccataagctttaaacccttatgctcgcaattaattatacatatattgatatatttttatttgaaattgacactatctgatttgaagttggttcgccgtttcttatgtgttaaaagaggcccactctgtaccatgttcatatgtgtcttcctatgatcatacgcaaaaaaaaaaattatgggcccctttgatttagaggaaaaacataaaaattttggaggagttcaattctataggaaaatttcctatgaagccttttgaaacaaaaggttgaatcctattcaattctttgaaattcctatggaatggacaattctatagagattttggaggaaatttaacaagagcttcaacctctttcctttgagtatatctctcttatataattccggtgtttttcatgcggttcaatcaaacagtcattcatgtgttttttctgcattttacaatcctctgttttacacttacatttctatcaaaatcctatgtttttcctattcctacgttttctcaatcttgcaattcaaaggggccctatatttgatagagaaacacacctagtgtggtatgctacatagattcaaatcttagcgaccataattatactcataacgacgacgcgtttacaatatgagagtttgatgatcataattacctgctcgcaacgtcaaataatttggtgatctctccctagccacaccttccatatgaaccactaactgaacccgttctaatataagtcattttattctttgtttactactccctccgtttcacaatgtaagtcattctagcatttcccacattatgttaatgaatctagacatatatatctatctggattcattaatatcaatatgaatgtgggaaatgctagaatgatttacattgtgaaacggagaaagtataatattcgagggtgtatagatcgtaagagaatcgagtgcatatttcaacaacacgggcacaatatcaaacataaactttcattcattccaaaaggttgtgtcattcagctacatgtatatatagaaacactggccccccacacacacacacacatataaataaataaatatatatatatatatatatatatatatatatgtgtgtgtgtgtgtgtgtgtgtgtgtgtgtgtgtgtgtgcactggccccccacacacacacacacatatatatatatatatatatatatatatatatatatatatatatatatatatatatatatatatatatatatatatatatatatatatatatatatgtgtgtgtgtgtgtgtgtgtgtgtgtgtgtgtgtatgtatgtacatacatatacatatatacatacatatatatatatatatatacatatatatatatacatatatatatacatatatatatatatatatacatatatatatatatatacctaataagaaaatacgtaaggtttccggaaattttttttcgtccgtctcttttttttctcttttttcgctattttcaccgtattttccttttttttccgtcttccgcttttttctttccgccgccttttttttctccttttccgttattttttttcgtctcttttttatccccttttttccgttccttttttttttgccctttttctttttctccgttcttttttttactccctacttttttatttttttgccaggccgaaccctagcgccgctgccacatcgatctgccttccatgcgttcccttcttcaattgattacaaaaattgattatccactactttctcatttattttccctatgattttgcaaagtagagggagataacaggttgggctagtactgaaaagacatgaataaatgagattttggcacaaaactaaagagtataatgtatagcgatccaaaaatatttttacccgttgttgaaaagtgcagcgagctatgcgagctgggcctacaactttacttgtgagctaggtcaaaaagaagtaggcaagcagagaggtagcgagctaggctgcgactgaaaagaaatgaagaaatgagctttcagcccaaaacaaagcgtataatgtatgcgatctaaaaatatttttacccgttgcaacgcacgggtatttttctagtatatatatgtgtgtgactcggttgtttacattatctctgcaaaaggaattaacgtacgtatgccaagccagtacactatttggcactttaatttattgacaccaaggagtgaaagagaacgcgaagtcctctctctccctctctctcaagacagtacattcacacatgcacagcgtcatacactcgctgactcacacgcacacaccgacgcacacactgcgccacacacaaagctggagatcgaaacgagcaaaaatacaacgcaaaatgatctatagcgagatggtggagtatatgatgatcgatctctagctcagtgatgctgaggatccggtcctccggggctgagcctcttggaccccgcgggcacgacgccgccgtcgtcgccgtctgccaccacaggtgccaccatctgggccggctgctgcattattggctccgcggccgcagccacgttcacgaccggcgccgccacggcgtcgtcgtccctcccgctccccagcagccgccgtgcaggcgcagccgccgccgcgtcgacgacggacgacgtcgtcatacagaccagcaggacgcacgcggcgatcacggccgcaacaataatgctggcacgcctagccatatgtagttaactttgatcgcgtttacgtgcggtttcgcttgtgcttgacgacgacggctagctactactgcgtacgtcgatcggtcgatcgagacagttgtattatctgtgtatatcttccagtgatgatgatcaagagctagccccctacgagcttatatatagagggaagcttggctcgagtgcgagaattaatagaccctcttgcgttgagttaattagtttcttatggtcgatcttccacgtcgatttgcgctaacacgaaacttgattcgtcttcagaagattctcacaatctcattgatccacaaccgtgtatttctggtttttggaccagaagaccgcttgctttccgttcgagtggttaatgtcgttgtgacgttatttgcataaaccggtctggttcgttggttgcatgtgaggatttcgataatgccctagctagtggctttcccagactgtattactaatttttgtgggtaggtgtacactacagtcctaaaataattgtacacgattctctctcagaagaattcactactattaagccgccatttgaatagttccatggccacttgctccaatgagtggtttgtttggagtttggaccgccacagtttaagaatccttgtgctaaagcctcaggcaattggtgcatacaaaaatgatctgcacaggactaccggttttcctttttttttcttcacaaacataatgccgtttcgacaaagccaagtggaatgttacacaaagaaactcggaccataacttgcattttagaggtttaatcgaggtctactaaccaataacaaaagaaatgagatatactaaggaaatgaacaatggttaaacggctcctgcctatataacctttctacatcatatcaagatggtataacaataagttgtctataatacaattaatgatttagttcttatatacacaaagattgtatacatgatacgagtagtaagccatctattagaccatgttggatattaaccattgttcacgtcaataggtggttccaataggtagccgtaaaagtttgatttaccacctaaactctaatacgagatatttacaaccttaaactttgcaaaccagacacacaaccactgactcaataagaggcagttttgctccgattcgacaaatgatctgtccacatgcatggcaccgatatggcgatccaatcaagatattttcaataaaaaaaataaggagaaccatcttccacctctcgcttgtactctctctttcttatctcactctctctttgcgaggagcctgttgtgttctgtaggtagctcacaggggagaccgtggatggtgatcttgcaatgcttgccacatggacgaatgcagctagccatcgtgctccacgagctcacctcgtccggcagccatctcgacctcattctggatgccatctcgagaacgcacggcatgtgcggcccgcttgtcagcgttattgggagcactgtctcctcgcagaagaccaccaaggccacgctgctcacggcatgtaatctcatatccgccagcgaccgtgcgcttcattttccgagctcggcgtagtggtgttgcggagcttcttctaaaggcatcctcagcaacaagcacatggccgcctagacatcacaccggcgaggcttaacgctagtaacttaaggattactactaattaccccatgcttaattagcacagttgccattccataaaccaagccttgtattccaggagggatttgggatgagccgaggaggaacaggatgacatgtgagggggcgacaagtggaccatagtgccatgtagggttaaaaccaccaattcagtttgaggggctaattcgctcagtttgcatagtgttgtggctgttatgcaacactttcttttacttcaactctaaattcctattgcaatgttatgttttgtcaacataacaccatgtgttgtaaatactaaatttgatcttgagtggaactttcaacttccatagcgttccatttatggttgggatattattgttagaaagagcatcatgcatgggatgaatggaaaaattcaccattttgatgtcactaatatgctataatggtatggaagtaaatgaaaatggtcaataacattttctaagtcagtgcatatagagcatgcaagtacggtcacctgcatgtctacaaagacacagaaaattccttaggtaactcttgagttttcacttcgttccttctacacatctaaaatttgcttcatgtagcatatccttggttttcattttaatcacttctatgcccattttattagttgatcatgagatttttccaaaatgacttataataatgcctcctcttttatacttatgtgctagctattaaaaaaacataagatccacggtggaaaaataaattataaaaaaatcaaatgggtaaaacaatcttaccccaaattctgaaaccaaaatttgaactttcaaaataattcttaaaacaatgatgaaattcataagtttcagcgatgattgaaaaccaagattatttttagttcagtttgaactttgaccaaattgttgtataaaattcatcaaatttgattatagtttcattccaaaaaacaaattttgagaaggggtcaaataatttaccccctttaatttttttaaatgaaaattttcaccttcagaattatatttcttaagtagctagcacataattatgatagaggaccaatatagtattttggaaaatctaggcttaattggattcatgcaattacaaaattgtccggttgaaaaccaaccattcttattcgcattatcggtgtgtgccactgaaatttgtaaagtttgaactgtgacattgaagctgatggtggtggcaagctcgacagggggacactcatcagatgaagcttcagatgaatcggatctagaccaagagcaagacaaagacaacgacacaacgtagatgtggcggcactagaggaggaggagagtgggcatgacccacgttgttacaatggacaatggtagtgagattgacgaggggaggcttgccggtgaaacctcaaatctatacgtgtaatgagtgttacactcctactttggaaagtggatggtggaagttaatggagtttctaatatttttatttggtcatacgttcggccgcaagcaatttcataaagaattttgtcaagataaaatcatctccaattagtattttagtataacatgggaagtcattagaaattatccaccctcaaacgaagagattccaaatgacacgaatttgcgtattatgaacatatgtacaactaatccgaaagtactactagccagtcatccaagcgtataagatgcatcggacgccgcccccacttcgaagtttccgtccacatctgtcacagatcatgctcctcctttttttctctctccacatgtcccgcgcaccacccccatttctctatttccttccttcctgacagcttcctatacacttccgttcttccctcggagagcacggtagtagacaagcagtggcgaggtagcaccgacaccagctctggcagtgtcgatgctcggagcacccgatcaaacgacagtcgggcttgagaaagcctgatctggtgctagcgaggcctaaaggcgtcagatctagcgattccagcactcggggacgctcgatccgatgctggcaacggagctctatatgtttctccttgtttgtactacttaatactactagggataaggaagaagatgaatccagccagcagagtagaggaacaaggcagagaataggtttgttgcagatcattgttctctctttgttgcactttttcgtattggagtgttttattctttcttttgtcggatgttgcaaatagcaagaatttgatgtttcaatcatttttctcaatgttgcatttgcttgaaacacttttcattaagcgatgaaatatttttcattgatcaatgaagcatctaaaatatttttttgttgagacattttttattgaatggtgaagcatctaaaacatatttttacataagttgaaacattttccgggtttcttttccttttgctcggagggttaattcgaagttattctttaggactttgttgcctgaagaaaattatcattatcttatctctatcatttatccattttgagacgtagaggataaggtgattttaaatgtttacttcacacgtagtactgttcatcttatcctcaatgtcttaaaatagatagagatagaggtgagataatgctaatattatccagccaaaaaagtctaaattaactctctatccaaaaggggaaaaaatcaaaataaccctatcccagcattcagctataacaggcttaatcaccttttcttcccaatacacaaatggctaaacccagaattggcaaacaattaatcctcataaaactattctaaattatttcctactagtaccttctagagaaaccccagcatctgcctggcagccacatcgatctgaagtaaaacccacaacgaaaatttccccccaatttcccgatccctaaatccctaatccctaatccctaatcgctccccggtgccccgatccccaatcggttgatcgccgccagagacgcgcagcgtcagagctcgccgctcaccggcgacgggcggcgccggatttcgccgtcagccggcggcgcgcggcgacggtggccaggctccaatcagctcccttaatccgtaaatttgaaaggtaaggtctctcatggctcgttcgccacggccgccgtggtccgatggcctcccgcccgagcttctcggcgtcatcttcgagcagctgagctgcctcgccgaccgcgcctgcttcgcggccgtctgccgcccgtggcgcaccgccgcggccttcgtcgacgccccgcagcgggggctcccgtggctgctcctcccgtcccgcgacgcgccgtccttcttcagcctccactccggcgccacccgccacctcaccctcccggagggcgtccgcggcgcgcgcctgtgcggcgcccacgacggcggctgggtcgccgtcgccgtggacccgtggcgagggttcgcggccgtcaacctcttcaccggcgtgagggttaccctcccggagaagctgaggctcgaggtcccctacgcccacgggtacgggcccgtgaccgtcaccagccaccaccccatgctcgtccgcaccatcgtcttctccgcgccgcccgcctcgccggactgcatcg

SEQ ID NO: 69676 - DNA, 3705 bp, Oryza sativa
ttctggcagcctgggatgtccaggcactggatcgcgagccggcctgagccggacgtgatccaggacatcatctactacagcggcgaggagaagcagggcttccacgtcctcaccaacagggaggaagtcctggtgttcgcgccccgcgccggccgcgaccccaacgcgctgctggagatgacctgcgcatcctaccagatgcgccgccgcgccaaccacctgccggcgtcgttcatcgcgacgcgctacctggtggagtcccgcgggaagctgctcatggtggtgcgccactgcacgggcaacccccgcgtgcggcggcgcacgcgcatgttccgggtcttcgagatgagcctcctccccacgggggcgtactggctggagatccacgagctgtccgggcgggcgctcttcctccggcgaggctgctccagggcggtcgaggtgtcgcagttcaagatgctcaaggaggacaccatctacttcctcgacgacgccaacgtcgacatgtgcgactccatggtgatgaacaacgggagcaggtacaacatgggcatttacagggatggtaagaagatcagagccggctcccggcaattccctcgtggatttaccgcggattgctcgcctccaatctggcttgtcccctgatccatatcgtgcaaaggatcagtgaaatgttgtggtagtccctggctagtggctagtagtaccttctgctctggcttagatttctccgattctgcatgtttgtgctatagaggcagactagtatctatcaaaagaaaatgtaccttgagttcttgatatggtgcaaacaaaacaatactccatcaatgactttcttttttgtgttgtggatgctccatgcgccttcaccaagtttaatttagtttttttacctagtctgattaggtcacccttgaagtatacttgtcaagtttttgcgcaggtttttagatcttttgagccatctccattctaaggtctcctttggaacataggaattttacaagaattttgaagggaatgaactgtttttagatcttttgagccatctccattctaagatcaactttggaacatagtaggaattttacaagaattttgaagggaatgaactgttatcagttattacatcatgtttgccctttctttctttctttccagcagtaatgggagacagtgttcccagtacaacatgctgaacaaattctgtaaagtacatcagttggcactgcagatttataacgggacacatgtatagtcaatcacacttgacaggattattagaggattattgcctgcctgctctgtgctctccttattagaagctacactctggccatatctcacctctccttggacctgtcataacgcatcctgacgattttgaatttgccagaggttatctgaggaattttattgaacatgtgttgtgtatgtctcattttctaagtgatacatagtagcacacggcgaattagtcatatgctcttaatataaaggagtacaaatgtatcgtacaaaatacactcactacatctcttccaaaaaaactttgggcataacctctcttccaaactgcggcactatccggctctttattggcaggttagagctctcgcgccgctctctctctctctttctctctcacacacacactggcacacaaaactggagaaacgagcacacaacgctctctcgctcacacacacgcgctggcacacaaaactggagaaacgagcacacaatgcaatgcaagaatcaagaatgagcgcgtatatatggtgagatatactacatctcagtgatgctgcgggtctggtcctccggggctgagcctctttgacccggagacgtcgacgtcgccgccgtccgccaccaccggtgccaccgtcgtctgcgccggcatcattgcctccaaggccggatcagtcacggcggcgtccctcccgttgcccagccgccgtgccgccgccgccgccgccgcgtcgacgggcggcgccgtcatcccgaccaccagcagcacgcacgccgcgatcacggccacaacgacgccgacacgcctcgccataagtaaatcaagtgctaggcgctacagttagcttaatttcaactgcttaactacgtcgtcaggtgcgtgtgtgcgacgtcgacggcttagctagcgagcgagctactgtgtctgtgtgtaggtacgtaggcgtgtacgtcgatggatgtatgctagcctcgacgacgagctttatataggagatgatatcaggctagtgattgctcagggcgtacgtgcggtcgctcatcatatcgatcggtcgatgtggcgcgcagacggagccgtagattaacaagccctcttgtgtttaagttaatcagttcttgggatcatcgattccacgtcggttcgccacgggaactatgcctcatacgtcttggaagatctcacagattacaagttaaactggctggtaccattataccaaaagaactctggtgctattcttgtatagttttaaacagcttggtcggaaaggcaggttggatgtggggattcgatgacgcactagacgcttaatttgcgcgatcgtataactgtacctatatcggcatcacaattctctgtataaagtatgactaatgtatggactttgttagttatagtggatcttacgtggtagcaaacgaggggttggctagctggtacagtaccacacgcgggatatattagggaggcagttggttgttgaagaggactgtttgattccaaatacatgtttctttcgctattgttgccatctaatttggactaagcagcaggtagtggcctagagagaatcatggctacccgatgcaaatagcaaaagccgatgcattatctgacggagctggaggaagttttttagtccattagcataattaattgccacaaatagaagaaacagggacaagaggacaggggttggtggtacccagtacaaatgtacaatgtttctctcatattccgaaagggcaaggattacccaaatagcttattattcgtcaaacaaatgataatatacatggtacaggaacaaatattgtgtaaagagaatgctcattagttgtaaatacatcagcggtaattcagcattctatcaaccatactaggtgcaaatgaaaagtcttatcggcaagattccgtcaggaggatttccacaatactagggaacagttcaagcttcaaggaggaaattcagcaatctatgttgtgcaaataacctttgcttttgcaactcacctttagctgaggacatgactgccatagtcttgattgaatttttcgtatctatgtacatgaagatgagcagatggccgtgtattccttagtgcaagctcaatgtcttctgtcgttactggaccaacttcaggcaactctgcaacatttccccccaaaataagtcctactgtatcactgacttcgataatgtgagcagcaggatcattttttgtgcagtgaaattatagcatacttttatgtggcattggaggcgccatggaggaatataaattcttcttttgttgctactgtttctttatacgggttcggttttttcagctactgaatgcaaacatacaagtctacagaacttaaactcactgaagttgtaatgagtactaattactaaacaaagaaaattaagtctataagttccctggtaggcacat

SEQ ID NO: 69677 - DNA, 2489 bp, Oryza sativa
agggggctcggcattgggttttataggtggcgaggatggagcttcgaggggaaggaaggagggctcacgggcgtggtcaaagggcgtgggcgacgagctggctcggcgtcagctgctcctctgccatggcgctggaaacgagcgaggagagctggcgtcggcccgagaggggaaaggggaaaacggagggggagaaagggggctcgcgccttgccgatttcgggagagagagggatgggagcgagaggcgctgcctctcggttttggacggacgctggtggagcggcttgggcacgcgctgcagagctcgcggcaggcagcggggccgagcggcagcgcggcgcaggcgctgacgacggtggcgaccgggcggtcggccacgaccggcgcatgcgcgggaaccaaaggcggtggggggttcaaatggcggcggcgggaatcggcgccagggagagaggaagcagagagagcaagagagagagagagggtggcgctctctctcggctcgggcacgacgcacgtgcggaggggaggggaaacgggctgagaggagggatgggccgagggagaggaatttggcccacaaaacagagggatgcaaatagacttttgcagaggaattgaattggagagaattggagtttggaaatggaatttggatatctttggagtcgggcgaatatttagcaaggttttgagatttggaatttgaatttcgaatttgattacttggactcagggaaacagggaggggtcaaggaatggattcaaggtggactcggatatttgtggaatcgagacaaatattttggcgatgattcaaaggaggctattgacctttggaaaaattgaatcggaattggaatcttgaggtggaggattttgatggcgatgaaagggaacaacaatggagatttgaattgagatcttggcacaacttagactctcacacaaagaacgaaattttcacatataggattttgccgaattagtttttaacgcctcgcgaaaagcggagcgttacacgattctaggactctgaagccgatactgagtctaggctgatgataactcgaggcttaccaaattttggcgttaacacgcggccgaacgaactgggttggtgcttggtggggctagcttgggttcattaggtgagacgtcgttgccgaagcaacaagcaagcgcaatggtaggggtcggcattgactcggccgcgacgaagcacccattcttgatgaacccacacagcagcagcaatgtcgacgttgccgccgtgtagttagctatccaccagcacggcagcaccacgaagcatttcatgcattcgacggtgccaatgcagcgttcagcaacttgagtggaggaaggctaggggctctgcctctcgcgcttgccgttgctgcagcagctggaaatggtgaagcaggcggaggagctacgggtccgatacgacgtgctctacttcaactagcaacagcagcagacatcggtggcagtgtcggtgcagcagctctcaatagcattgcacatccaggagatcgtcggtcggttgatcgcggggaggagctcttcggtcgcgggctcgcggagtcggaactcccactggccgccaccacctggcatgcgaggagtgagaataggaaaagagggatgtgagcaaaaagaaaaagaaaagatattagtactgacatgtgggtcccatgagtgtcacataggataaaaccgatatccaaaatcccaagggactcgattagctccgattttcgaagatggaggccttatatcaagtattgtgaaccgttgagggacgtgaatctatcaggggcaagaattgaggaaggtaaaatagacttgttccttttgtttgggacataggtcattgttaacaatggaatttggcatcatatttggagaaggaaaaggaagatcgaagcggatttggtgttgaatcgaactgagcttggagttggattgcgcatcggctggatatcgtatcggctgaaaatagggtatagagttgatcgaggttgaagaagccgatggtcgatacaagccgatatgacatgacttgggctcgatatgggtctagattgggataaccgtctgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaatatgaatcatagcaatccttaatataaatagaggacttatttaccttaacttaggttgcagctcagacagcccgagaatacaaccgacgacacggacgaggaaacaccaacaacagcagcagcagcggaaccaacggactaacacccaacaccacaggcgacggctgggaaccaggacgaaaccctaatcttcacttcactttatcttctcttcagggcggaggaactatatatatatttat

SEQ ID NO: 69678 - DNA, 8104 bp, Oryza sativa
tttgaaaatgtatttggcgaggattcaaaggaagggattgactttcgaatttagatttcggagacttgaattgggagaggagatttgaggcggaggattttgatttcgatgagagggaacaacgggatttgaattgagatccttggcacaacttagactctcacacaaagaacgaaaattttcgcaattaggattttgccgaattagtttttaacgcctcacgaaaagcggagcgttacagatccaccccccttacaagaatctcgaccccgagattcgaaggtggaccacacacacgaaaccaaaaagggatcttcagacttcttcacagcttcagactctgctagtcgttcttcaactttttgttgcgtgcttgccgcaaaacggtctggtattctgactcacttagcattcttcatcttactgtggctctgctcttgcctgtggaacctgttcttctcctgctccttcaacttgctcgagattcacaacttttccatttgtttctacttgcacatggttcagatgactttgtccaataggcggtgacgtcagtgagatagatccactgttcggtgccttcaaactttttggtctagatacgttgggaaggcctgtcgttggttgaactcgctttgacttgactttctgagggcaataccacgaatagtgtcccatctcatggcagatgaaacattcgactcctgccttataaccacgtctttttgaaggtgtagggcatggtacggagttgcttccttcatggctattactgttgatcattgtggcttgctgaccaggttctgacatagtcgaacgagacgtagaaccggaaccatttgaatgctgagatgctttctgatagtattgtgctggcgagtttgtttttcgacacaaatcttcttttgcttgaatctctagggacattactttgcgtctcttgtattcttgcatctctttttctgcatcttctagtaacaaggacttatcgaccatttgctgaaacgtcggaaagtcgtgagccaaaagtttcactcgcagtttcgcgtccattccttttaaaaattttctgatcttctttttatcagtgtctacatcttctggggcatatcgggccaatctattgaagcgactcaaatactcgttgatgcaagaggatccttgcttgatatttgcaaattcttccttcttcaaatcaattatgctttcagggatgtgtgctgagcgaaaggctcctgcaaactctgtccagacgatggtactagcatctgtatgggtagcacagtagttatcccaccaatctgcggcaggtcctcttaactgatgtgcggcgtaaagggttttctcttgcggagtacactgtaccagatttaatttcctttccatatctttaatccaatcatcagcttcaataggctcatttgtttgggagaactccggtggacgagaccccaagaaatcattcagttttgatttgccatcatcttgaaccatatggggttgacgctcttgtgtgtgttgttgttgcatagcaattatattctgaaccattccttgtattatatgcgtttgcatggccaggatttggtgaaggtccacgggtgggggttgattacctcttgcgacatcattaactgatccggaagcaaccgtatgatcactctcggcttcttgctcatctgtccggttaactggttgatcggggatttctgactgaactagctcttcctcaaaaccaaagcggttaggggcacggatctgacgggtggagcgacgtgccatctgcttctgagggactgagatctgactaacgcagaaatgagataagaaaaggaggaaaacaaaaacactacatcaaaacggttttcgaaatcacagaagacataggtggtgtgttccagccggtaacccaactggtctaacacctgaacacggactaccaaacaaaactcacacacgcacttagttcaccacaactcctaccgagcgggtgacggcactaaggttagcctaccaacaagggcttaactaagactcctagaggcttgagcacacctttctttaactgggcgtgaagacaggtttaccctaagataaaagtcaaaacgaacgactagctcctacttttggacaccaaagatctttcgcaaaactagagcaaaaggggacaacgacaccttagctttcacaaatagtttttgtattcaaataatgccatcctattcaggggtttcgatcctagggccaactaatgctctgataccatctcttgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaatatgaatcatagcaatccttaatataaatagaggacttatttaccttaacttaggttgcagctcagacagcccgagaatacaaccgacgacacggacgaggaaacaccaacaacagcagcagcagcggaaccaacggactaacacccaacaccacaggcgacggctgggaaccaggacgaaaccctaatcttcacttcactttatcttctcttcagggcggaggaactatatatatatttatagagcaagggtgagtactttcgtactcagcaagtcacgggaacttaggtgtttaatgcaagcttggaagagaggcaaggttgttttgcaaatcttttgtttgaaatcattttgaaatcactaagtgatttatttctttctaagtttgggccgaaaagagacttgcgtctcgattcgactttaagagatgcttttcaacaactcaattggtaatgtaccgacctcccgggtcagatcattacttctcggctcccagagccattccacttgattaatcggctcccagagctttttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaataaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataggccattttaggcgtgcacaaatcaaactccaaccacctttgatcggtaagtgagcaagcttctcgtccttgccttacccggaacccggtttgtccgaccccgccccggcgttcccaactattggcatgcgaggtttccctgaaccgactagttacttagccagggtgtcccattccaccttgtggttgcacttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacggataccgaagtaccacaagggtggagcgacaaggattcagggtagtacgacctacagaaattagtgcgactactgggtaggtccgtcggtttggcacgcaaaccgaggccaagcaagttaagtgtgtgaatctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttacggaattattggaagtggaacggagtcaatcggaagagcggttgggaagatatgaattttggaagtttaatttggattttctggtcaaggaaaaggatttattaaatcctttggaaaaaggaaatggacgagggatgtgaatcagacttttctcgggtggcattggcgcggcccgagggacttgcgcagctcgggcgagcctaatgggccggcacggcctgcgaggagggcggcccaatggggcgcgggggagagagggacggcccggtggaccgattccaccgcgcggggtcccgggtggggcccgcttgtcggcggcaaggttcacggtggggagagcgcacgcgggtacggtgctagggtttggtgggtgcggtgtgcgggcggtgcgccgggtggatcggatggcagcgggcccacatgcagccggttggcgcaccgtggaccgtgcgcgcgaaggtggggaagggaagaggcggctgacccggtcgcagccgacgtggctccgacgtggctgccacgcgggccaacgggaggaggaagaaggggaggccgggaatgaacggcggacggcggccgagttcaccggagcaaggcacggcctcagtggaaaaagggagcacaccggggaggagggaagggacgagacgaagcgagccgacggctcggattcgccggaggatggccggaatccggcggattgtggcggcggcaatcgccggcgagcaaagagggaaatcacgacgagacgatgagggttcgattcaaagggggtggagcatctccggggttcaaggaatccgtttccggtgtcggatggggcggaaaatcactgaggagggctggcgacgagcagcggccttcgggagcggacggcaatggcggcgaggctgtgccgggcggcgacggcgctagggaatggtttggggagaccctagggagctcaaggacggtggtggtgcgaggtattggcgagagggcccacggcggctcgcgggcgggcgcggcggcggcgaagcagagcaacggcggggcggcatgtttaaggggacgagcgagcaaccgaatggctcggggcttatccaagatgatgcagatggcgagaatttgggcgaggagctcaccggcgtgcgggaacggtatcggcggcgatttggggatggaaaggggtggaaggccgatggcggcacgcgaccgagcggcggcgcacggcggatgacgccgaggcggcgcggcgtcgaggcgagtgcgccgggggagaagagagggagaggtggcgcccggagctcctcgtcacgcgttcacgctcgcaccggctccctcggtgctcggcgacagacggcgacggcaaggacagcgggaaggcaacaatggcgcggtgaaggcgagggaaaaacgagagggatatggggaggaggctcgggctttataggcgcggggaatgtcggtttggggagggaggaaaccgacctcgtgggcggtcaaggatgcaagggcggcgagctggcggtcgttgacgcgtgcagccaaggcggcggcaggtgatgacgccggcggtgtcgggcaaaaggaaaaagaagggggaaaggggcttgttcccttgccaaaacgagaaaaaggaggagggtgagtgaggaggaggaggagagggagagcagctgcttctcccactcttggacgggtgcggcgtggagtggcgggggccatggatgacgttgacgatgacggcggcggtcggtttggcatggagcgggggcaaggcggcagcgcgtggcgtcggcggcgcaagggctgatggcggcggcgaccggccggtcggccacctcgcgagcgcgcgcgggaatgggcgaaggcggtggaggttttgggcggcgacggcgggaagcggtgtcggcgcgagagagagaaagagagagagagagagagaaacagcgagagcgagagagacagagagagcgagcgacggctctctctctctcggctcacatgcgtgcaacgcacgtgcgaggggggggggaagatgatgggctgggaggggagatgggccgggggaggagaatcggcccatccaaaatcacagggaggtaaggtagacttttacagagaaaactgatttggatagaattggagagatttagggtttggattcgagttcaaatttgatactcgaactcgagggtttagggatgtatcaaggggaattcaaggagaagtcatgggaaagattcaaaaggaaaacttgggtatttgttctcgggaacatagggtggagtcaaggaaaggaaacaaaacgggggtttggacattttgggatttggaaatgtatttggcgaggattcaaaggaagggattgactttcgaatttagatttcggagacttgaattgggagaggagatttgaggcggaggattttgatttcgatgagagggaacaacgggatttgaattgagatccttggcacaacttagactctcacacaaagaacgaaaattttcgcaattaggattttgccgaattagtttttaacgcctcacgaaaagcggagcgttacaccgtcattgccaaatagagatagagctcgattaaggcaactgtatctaataattagggtattgagtcggtttgttagagatttggtaagagatcgccgtatatggtcttgtttgtttcttaactttagaaatgtttgagtcgtgtccataatggactaagtttgtactcgaggtataaatatgagccccatagcattgtaatacggaagccaatccaatacaactttggcgcatcgccactgttttacttttctcgttttccagcgagttcttcgcaagaggtaactcgtctcaatggcccgcgctgacgtgttaggctcgacatcgcgagtcattgctgtcatatgtctttaatctattcttagcttctcaatttagctctatcggctgttgctcacttcagggtttgtgttggttttagttaaattgtcttgctagattagattagctaaggcacctaccatcctgaaaagtgtctaatttcttgattgtctacactgtatgtttcttttcatactttaagatgcatcatcccttgcatgcttagaaccatgcaaactagcctacaattaggcataataaggatagtatcgggtttcagccgatcttacctaatatgcatgtttcacccccctgtttcatgtatattcgccacttatatagatagatcgttttatataagcatatcaagttttagtcagtatcggctagattcctacaccttcatgcttgatttatatttgatatgtttatatggaccaatctgtttatataagtttgtactagagtattagctagtacgttatttttcttggtctaaatattgtcacatcggctactttcataatactgtcttaaatcaatctattgaattccatagattgtattacagtcgattgggcgtgtttagggtttattattatttcatatatccagattatagccgatttggtctaattctatcggctgagaccatcaacgatatgctatcatcctatcggccgatcaactatcggtcgattgattatgcttttattcttttttgctgattgcaggattaaatcagctggcacacccttgacacactcgaggctagcattggacctgcactggagttaagcagatctcccatgccaccgtattttcacatcaaaagtcgtttactagtccatttcaccatccctgggccacatcctattttgcccgttcgtgctatgtagtgcagtcattgagttgtaatctgcgataggcagcctattttcaccagtagatatggggaatgttacatgatagtatcccattcggatgggatgatacctagctaggtataaggcgatacctcgaaagtatcatcttctccgaacgagttatcagtcgatacctactaggtatcagacgatctct

SEQ ID NO: 69679 - DNA, 8827 bp, Oryza sativa
  unsure (1)..(8827): unsure at all n locations
cttaggagtctcaaaattaagtgtactgcatacatgtgaataatgcactaaggaaaaaaaaggcaaatcatatgatagaatcagtggctaacactgtgccttctttcctttgtatttttgcagcttaagttactcaaaactcggagaggttacctgcatacacgactgtacacgaaatgcttatcccgctgctgctactgttctacggtgttggcaacatcagtggctcaacgcttcctgataacagcacagatatgctctctcttcttggtttcaaggaagccatcaccaacgatccgtcaggagtcttgagcaactggaacacaagcatccacctctgcagttggaacggcgtctggtgcagccccaagcaccccgggcgagtcacggcgctcaacctcgccggccaaggtttgtccggcacaatcagcagttcagttggaaacctgacttttgttcgtacgcttgacctatccaataataacttctctggccaaatgcctcatcttgccaatctccagaagatgcaagtccttaatcttagcttcaatacactggatgggattattccaaacaccctcacaaactgttccaacatgaggaaactagatctctatacaaacttgctagagggtgcgattcctccgccaataggtcggcttagaaatctagtttacattgacctttcccggaataatctgactgggatcatcccggcaagcctaaaaaatatatccctattagaaacaatctatcttcaacgcaaccaacttgaaggaagcattcctgatgagcttggccaattttcaaatatttcgttgatggccctaggggcaaacaggctatcaggtaatatcccagcaagccttttcaatttgtcttcccttcgaatactagaattacgtgcaaatctgctaggagggattctgcctagtaacatggaaatcatctcactaatctacaacacctcttcatgggccagaacatgttcaaaggtcatgtaccagcttccttaggcaacgcttcaatgctagaaacaatagttttacaatctaacaatttcaccggcagaatccctacctccctcgggaagctatcaaatttgtataagttggaccttgaactaaacatgcttgaagcaaaagatactgaaggatggaaattcctggatgcgttgacaaactgcactgctctagaagtgctcgcattagctgaaaatcaactacagggagttataccaaattcaatcggtagcctatcgaacactcttcggtatctcgtgttgggtggaaatgaactatctggcatagttccctcgtgcatagggaacctttctgggttaattcaactgtcattagatgtaaacaagctcacaggttcgatcagcccatggattggaaatcttaaatacttggaatatttaaatcttggaaagaacagattcactgggcctattccatattctattggcagtcttacacggctgacagagctctatctggaaaaaaatgcatttgaaggtcacataccaccctccttgggaaaccctccactactcttaaagctggatcttacctacaacaatcttcaaggcaccataccttgggagattagtaatcttagacaactcgtctacctgaaacttacatcaaacaagcttactgggaatatacctaatgctttggaccgatgccaaaacttagtgaccatccaaatggaccaaaactttctcacaggaaccattccaatttctcttggcaacctaaaaggcttgagcgtactaaatctttcccataacatcttatcgggcaccatcccagcagtactgggggatctacctctactcagcaagctggacctttcttacaataatctccaaggagaaataccaaggattgaattattcagaacatctgtttatcttgaaggcaataggggactatgtggaggagttatggatctccatatgccatcgtgcccccaagtttctcacagaaaagaaaggaagagcaatttgaccagattgttgattccaatagttggtttcttgtcactcacagtgctgatatgccttatataccttgtgaagaagacaccaagaagaacatatctatcgttgctttcttttggaaagcagttccctagggtttcttacaaggatatagcccaagctacagggaacttctcacagtcaaacttaattggaagaggaagttatggttcagtatataaagcgaaattaactccagttaaaatacaagttgctattaaagtttttgacctagagatgagatgggcagacaaaagcttcgtatcagaatgtgagatcttaagaagcattcgacatcgaaaccttcttcctatcctaacggcgtgttcaacaatagactatagtggaaatgatttcaaagctctgatttatgaatacatgcctaatgggaacttggatatgtggttgcataaaaaaaataccgctgttgcttcaaaatgtttgagcttatctcagagagtaaatatagccgtggacattgctaatgcactgtcctatttacaccacgaatgtgaaagatctattatccattgtgatttgaagccaatgaatatccttcttgacagtgatatgaatgcatatttgggagacttcggaatttcaagcctcgttcttgagtctaaatttgcctcacttggacattcctgtccaaatagcttaatcggattgaagggaaccatagggtatatagctccaggtatatatggttattgccacatcttcaattcatgaaaggcaatttgttttctgaattaatacttagacgttgcattgtactaattagtgtgattttatcttttcttttagagtatgcagagtgtggcaatgcatcgacctatggggatgtttacggttttggaatagtgcttctagagatgctgacaggtaaaagaccaacagatcctatgtttgagaatgagctcaacattgtcaactttatggagaagaacttcccagagcagataccacatataattgatgctcaactccaagaagaatgcaaaggcttcaatcaagaaaggatcgggcaagaaaataggttctataaatgcttgttgtctgtagtgcaggttgctctttcgtgcactcatccgatcccaagagaacgaatggacattagagaaatagctattaagctgcaagcaatcagaacatcctatgctgaagcgaccaagcgagacgatatgcttcgaagaagggagttacaatgtaccattgaacttgtgtaattgtgttgtctgttggctttgaatacaacgtgcataaaacatgataaattggccatcagcatacactggatgtgtgtgtgaggaactactcttctgtactgcaatatatagttgtgggttaattttatcatccttaaaaagatattggaaagtaacatattttgtaggtaccttgagttactttctcaagaatcgtaaaatttctcatagttatgtgtgcgactatggtggaaagcagtattggtacgcactgtgcattgacactttgatttgggtttcacaaatttggggaacggttcctacaggctacagtttatgtaactgggataatgggattgtgcatgaaggatatatatttttaagccgggccggcctaagataggcggacaaaatttacttaagaaaggagtatggattgtgaaggatataagctaggtggttctttggacagcttatcatggcgattaatatttaatactccaggaacataaaccaaaatctgcataattggtgtcagattgcatggaacaacacagctaatccgcgcttatcattcaggagttaggactatcacaacctaagttgggtcgatccctaaatccaaatcccaacctgcagttactgatcactagaggagtatataagattgaggaaaccctcgggtaccttacctgtaccgtgcagtggtatatgcccattcgacgaaagccgatccgtgcgctgccgcgacgtcttcctcttcccgctaggagaatcgacggccttagccaggacgaagtgtctgattccggtaacgatgagggcccgccggagcctgcgcccccagccaaagcagaatgcgtctcccgagctcaaggggaagaagaggaagacgccgccgcgcgaggtcggtgagtcttccgcccggcgccaacgtgcaccgccgcggcgcctccatcctcagctcctgcagggttgctcggctgctgatagctttgctttgttgggccatatgtatactacttgggccgttctaccacttctagcaggaatcctatcttacgcagacgcgctagcaaactaactcgcgcacgatttggatccactaggcccaccctatcctaggctgcagttgttagcatttttttctctttttcccgtgattttctctcctcgtttcatgtgcaacctttttttctcgcctgatttttttcttttttattgcgcgatttttagctctttttttttgcaagattattttttccggtgtgctatcaggctaggtactcattttattttcaaaaatattgatgcaaaatttaaaaaattctaacacaaaaattgaaaggttctagctcaattttgaaaactttcaactaaaaatttgaaactttcaactgaaaatttaaaactttcgatcaagatttgaaaactttcaactaatatttgaaactttcaactcaagattgaaaactttcaactcaaaattgaaaaactttcaaatccaatttgaaaactttaaaaactttcaaaccaaatttgaaaactttcaactaaagattaaaaactttcaactcaaaatttgaaaactttcaaatccgatttgaaaactttaaagttaaaattcaaaactttcaaatcaagtttgaaaactttcaactcaaattaaaaaaaaccatatccatttttttactttcaggtctaaattgaaaattctcagttcatcttttaaaattttaattctactaatttgttcgttattttgctataaataattacgcttttacgctaatctaatcgtgtttagcgctaagcgggcgcttagctacgtgtggcatggcgacgcgcacgcgagttactttagcagcgcgtatgcgtgagctagtcgtgccccacttctagagccacggcgcgtgcaaaccctgcgttgtaacgagcttggcaccagggggcaacgccaaagaggaatgagttcactggcctcttaactttacgtcgagtttgcatgacatccttaatcccaataccagaaatcttcacccctaaattatacaaaaccgtaaaatttaggtcctagggcagtatggtctctggtttcattaacgtggcatcctagtaagcaaaataaaaaataaaaaaattacaggatccacatgtaagcgagtaaaataagaatatggggcccttatctcttctttctctcttttcttctctcctcattttcttttctttcttatcttctcttctcttctcttctcttcagcaatcttgggaggcaggtggcgtgagagaggggagatgtagctggtgagcccggccaagctccgccgccttgagcgccttgcgacgggaggagggaacggggtagaggggacgcggccggtatgagatgggaggggagaggcacggtgattgggatggcgaggtgataggggacggggggcgcgtgcacgacgacagggactacgaggcgatgggggatggagcgtggggcaggcaggcgttgtgatggcaactcggtgcctccttcacgggggagccgtggtgattgggacggcaaagcgagcggcttggtgacggggaacagagtgtgggacaggcgagcgagcatcatgaaccagcggtcttcgtgggcggcgacctgttgctcgaggtggagcggcggtgtgacccgcggtcaccgaggtcaccacctgcttccaccaccttttcatggtcaccgtacggcgtcgtccctaggcgtatactatgagatcttgcacgggcacatcgcccgtggcttgctatagtctccgtagcccacactagaggatgactcgccttgcggcttcagtgtttagacgggcaccgatagcggcgacgcctgctgcgcctcgncggcatggctccggctgccccttgtgcccctggtcccatcaccaccacaggcttgtcgagggtggtgaatggtgctccatgaccgcaccttgccacccactacacggtgaccatcgtcgaacactatcgagttgtggatcatctgtgacatgccacattttccgctggatctgcggcggtcaccgtgtccaccaccaccaccacaacaacaatcaccacaagcgtcggcgtgtcgtagacagccatgggggacgacgagaagggcggcacgaagcgcgcaagaggagcagcctcagcagtatgaggcgatgacgaaggcccctccatggtgcagccgctccagagtgaggtggcctcggcggtgaccgccgacggcaactcgcagcaggtgcagcagtggcctgcgcccacaccgggctgatgttccggctcgtcagaggagtcgacgacgctgacaccaagtgagcgctaacatgtggggcccaccgtacaccacgtcagtgaaaccagggataaattgggtctatactgcctcaggaccctttttacatggttagggatagttgaggggtagagatttctagcattgaggattggggatctcatataaattcgatgtaaagttaaagggacgtcaggtgaacttattccacgccgaagacgcttcctcgcgagaagcatatgcagccactagcccactaccttaagaggggaaaaagataagaaaaggaaaatcttcggcggtcctggcggatttcattcccatttccccaacacgcaaatcagagaacactggcaagaggacaaactactggcgacgaaaaatcgaagtaaacagtaaacaccaaaggagtcgctctctcttctcttctcttctcttctcttagcaatgggccatggcagtggatgcaacactgctgtagaggccgtggaactgcgttttaaaagttctgtatccaggggcctaaacccgctgtatatgcaagttaattagtatctctagtctacggcaaaccgacgattacagggagagttcgccgtggcggtgctccctgttcgagcagaggttcgttaactttctcttgttttgttttctgattagactgtatgcataaagcactgcatgtcttatttactgcgggctctggcttgaataggcctaaccactcctagttcccgtctacctacaatgacaatataatacttgtgtgtgcttgacttatgtgatatatctccacagataacgatgtgagagagaacgacggaaatagtgacgggagtggcatggttttaattttaaaaatttacagtggctactagccgataacgtaaacagtactatagtagtgacatttttctgatttgtcacatttacagtggcatggatccaattaaccctatacagtaccatattcactcgtagattttattatgagacagataaagcaatagcgaagctttcttttctagccgtatgtgttttacttgggccgtacaaccactgctggtcactttgtacgttacgcacgcgctgtgctcaacctctttgtggacaattgcgcgccgcgactgacacttcgacggtaactgctagatatctgcagcatgtgaagtaaaactttggcaagaggacgtaatactggtctactgcctccggagatggaaaatctggatcggtaaaagcggtcgagaactcgagatacggcagagaaatggacgagggcgccagatgtgacactgctgtagaattgtgttttttaaggccattgtccaaggaccaactgcccaatctggtactacttgtcttcggcaaaacagatttacagggagaattcgcaaccgctgttcgctccgagtggagattcccgtcgattcctatcagtatgccctacgcactgcctcagcgatttcatattgtgcacatggacataaaatacatcatatgcctattcattcatattttgcaggtgatatgtgttccgagcaagagcaacccgtgaaactcgccatgtttatacaactggtgttgttgctgctattttatggagttggtaacgtcgtccattgctcaactgtccacgagttcagcatcgatctgcaatcactgctagatttcaagaaaggcatcacggaaagatccaagcggagccttaagttcttggaacactagcactcacttctgttggtggaaaggtgtcatgtgcaccactgcacggccgtttcgcgtctcaacgctgaatctctccgcccaaagcttggcaggggaaatcacctcctcccttgcaaacctcacgtttcttcgtgcacttgacttgtcctcaaatcgcttctttggtcggttccctctccttaaccacctacagcatctgggttttctttacatgaatgacaactcactcgatgggattatttcggacacacttacaaattgttccaaattgacacaaatagacctctctaataaccagctgcagggtgcaattcctcctagaataggatccctagagtatctgaaccttggcaataatagtctcactggaatcatccctgcaaccattggaaaccttgtcaaatttggatatttgaaccttggtatgaataatctcactggaatcatccctgcaaccgttgaaaatctcaccctgttaacagttctcaggcttgaatacaatcagtttgaagaaaaaatccc

SEQ ID NO: 69680 - DNA, 1362 bp, Oryza sativa
cttttggcaccaaactttggctatgccctccaaagtatccaacaggtaaaacaagtttgaaggtcacatttcagcagtgttactgagcaaaacatggcatcagtaattcagaatcgtcgcagtactaatgtgctcccaagtgcaaatgcacctataattttaccatttgaatcattgcaataagataacatctataatcctcaggaagcttacatccagcaagaccctttttgtgatgttatcatgttttttttcttgaatggaatcagcacgagattatgctatttcattaaatatagcgagagaaatgtacaacccccctaggagaagaaaggaaaaggctatacaaaactatacgtgtgaaggatgaaactctctaagctttttagctccggccagaacccaagttcatgcttcttcctttattttggccaacagcctaggatgtgttattttccatggtttcccaacccatctcctttgtttttcgcgtgtacgtttttcaaattgctaaacgatacatattttacaaaatgtttatatgggaaagttgctttaaaaaaaatcatattagtccattttcaagtttttatagctaatacttaattaattttgttttaatctatcgctccattttccgtgcggagaggaggggtttccaaccccttcaaaagaacacaaccttaaacttatgttcgaaaacacgctgatttctctccttccttgatgttatcatgttaaatatgttcaaatgacaacacctagagaagtagatctatcgatattggtatatccatctattcgtctcctagtgacaaaattctggcataaaatcgtacccgttcttttcatctctaccctattaaaattctatagaataaaaacttgcaaaaactttgaccacaccaaaaattccagtggtgtgtttggttgggttgatgagcctgtataggagatggtcgtccgagtttttgtagtgtttggttggagggcatggtggatggagcggtccagaatagggaatattccctcaatatgctggatgagtgcatccggccgatttggctggatgaagccatccagttttggactaggtgatgtgtcctattccgattggttgtggttggtttgatttcctgttaagcaagctccaaatgattttgtctcctaaatcgtttatctaatttataatttgattacaccattatatttgttatagttaaatctttaaaacaagatctcggatgattatattttgataaaaaatatatatgacaaacgggtcccactaacttttgactttttccatccatgatatatctctccaaccaaacaagaaattggattgttatatccatataa

SEQ ID NO: 69681 - DNA, 3613 bp, Oryza sativa
atccaaatttttatttggtttgtatgaatatgacgatccaatttcttgtttggttggaggaatatagcatggatgggaaaagctaaaagttagtgggacccatttgtcatatatatatatatatatgatacccatataggactccatggtgctcgggctccaaggtataaaacacacaaattctctcaaatttttaaaaattttcaaattgtgagtatatacctaggtatatgaatttgattcatacaaatacctaacaacaaaacaactcaaactcaattttatttcacaattcattattacatacctaacgaattatatgtttgaatgttatatacctagaaccgaaatctaacaaaaaaaaagttcaaactcagttcaaacttgtttgagcttgttagtaaagaagttaatgttcatatctaaacatttaaaaaaatttcatacttattcaaattgggtatatacttaatttgaatcttggagcccatactccatgtagcaccagttaatttacctatatatatatatataatcatccgatatcttgttttaaagatttaattataacaaatataatggtgtaatcaaatcataaattagataaacggtttaggagaaaaaatcatttggagattgcttaaaaggaaatcaaaccaatcacagccaatcagaataggacacatcacccagtctaaaactggatggcttcatccagccaaatcgcccggatgcactcattgagggaatattccctattccgggccggccctatccacccttccctccaaccagacactaaaaaaatcggatgatcatatcccatcaagtccacctaaccaaacacacccggcatcaaagcaaaccaacccaaaatctctgtccctgtccggttccggatgaaacatagagatggaccaaaagtaaagatctctgattgaaactggacatgccacaacaaacttgccagctcaaacagtgacgagcagcgacgggtgacaaggtgaaattttacaacaactggcaagtttgacggactcaaggtcttcgttccaacggcggcaaagctgagataaggcttgagcttgagtgcttgaccatggcatatgcaagtcgtggatgtgaggccgctgaaaaaccagttttaagcccctgcaccctgaggcgtgagccagattagtacccaactcaaagttcacacttcacacaccacccagccaaacaaagcagaatttccatcatgtgcactctgggcaagcagaggggcagaggtgcgctgctcttttatgcctggttatttggttaatacttggcttttttactccatcatctttagttagtacgtattaaaattagttgttgcgagtgagctgtgaaacatttcagaaaaaaaatttagaggactttcagaaagttgcaccttgtttttttaatgaagtactttctccgttttatattataagactttctagcattatcctatatatgttaatgaatctagacatatatgtgtgtgtctagattcattaatatctatatgaatgtggacaatgctaaaaaatcttataacctgaaacggaggtagtacaactttgtgtttcaaattacatttagactgcattcgtttctcacttctcccaacctctactctctcgttttccacacgtacaatttcctaaattgttaaatgatatgtttttttaaacattatctataaaaagttattttaaaaaatcatattgatctattttttaaaaaactaatatttaattaattatgtgctaatgagactctccgttttacattcgctccatttgcagcatggtagggactaggacttgcgaagttgggattgtaagattaccagagttggagcattggagggtagggctgattgcgtaaccatgaagtagctccagtagcgatcataatatgtcgcaatatttatgtttcactaattgcaggcagcgagggcctgatgtctgtcaacaaaacggtgaaactgaccatgcccgttctattggcattgttgctgttgtcctatggaactggaagcattcgttgcacgacgatcgctgggaacagcacggacgtgctctcgttgctcgatttcaaagccaccaccaacgatccaagaggagccttgagctcctggaacaccagcatccactactgttggtggagcggcgtcaagtgtaagccgaatacccgagggcgagtcacggctctgaaactcgcgggacaaggtttatcaggccaaatcacctcctttcttgggaacttaacggaccttcacacacttgacttgtccagcaataatttctctggccaaataccccctttaaccaatcttcagaagttgaaataccttcgtttgggccagaattctttggatggtataattccagattcactcacaaattgctccaatctattttatttagacctctctaataacatgctagagggcacaatccccccgaaaataggtttcttaaataatctctctgtattggccttccctttgaattttctcaccgggaacatcccctcaacccttggcaatcttacaaacttgaatataatgctcctcgcaaataataagattgacggaaacattcctcaagaactggggcaactgtcaaacttggggtggttgtccctaagtgaaaacaacctatcaggtggttttccgcagggattcttcaaaaatctatcttctcttcaaatattaagcattcagacgaccttgcttggtggcacattgccatttgacattggcaatacactccctaatctcacaaaacttttcttggctgataacatgtttgaaggtcatatcccagcttctttaggcaatgcatcattgctacgagggatagatctatccttaaataattctactggccatattcccaactcttttggacggctttcaggtttgtctacattaaaccttgagacaaacaagcttgaagctagggacaaccaaggttgggaattcttagaagcgctcagaggctgcaacaatttaaatgtgctctcactagctgacaacctgttatttggggacgtaccaaattcaattggtggcctatccatcaacctgacaattttattgttgggcggaaacaacctaacagggatagttcctctaagcattgggaaccttcaaggcttaatttcattggggctagataataatggtttcagtggtacgattgagtggattggaaaactgaaaaacttgcaatctttatgccttcgaaataacaatttcactgggcctattccatactccattggcaagcttacacagctgacagagctctatctgcgaaacaatgcatttgaaggtcacataccgccctccttgggaaaccctcaactactgttaaagctggatcttagctacaacaaacttcaaggtaccatacctttagagattagtaaccttagacaactcatctacctacaacttgcatcaaacaagcttaatggggaaatacctgatgcattggggatgtgccaaaacttagtaaccatccaaatggaccaaaactttctcagaggagacatgccaatttcttttggcaatctaaatagcctaacc

SEQ ID NO: 69682 - DNA, 12180 bp, Oryza sativa
ttttttcgtcaataagttattggtttttgttcacactggagcctcactaagtaaatcaattactcgtgaacatattgttagattaattcgttattgttgagtaataattttactatctagttaaatatagttaaatagactcaagtatttttcacggacacttattagcacatggtaaatgttttacaataagcctacacgatatgaatacaatgagaaatatgagaatagtaacttttttacaataagcctacacggcatgaaacaatcatacggtgtgagtaaacattttactctatgacaatataacatagatctagagaccggccggtggttggtggcggagatgactggcgctggctggacattgacggcgtcgcggcatggaggtggtcgttgctgctcctccatggcactggctagcaaccggatctgaaaatgtacttggttgtattcacatgagcataatgtactctgctatacctgaaaatgagaaagcaaaaattaaatccggactatagtgttcttgggctcgccttactcccagcctacaattaaacattgtgctactcagcggaatgagaaaacaaataccaaatccagaaataaatctatttggtcaagatgatcggaataaatcattcagctgcaaggttcattttctagattttctagttcaactgagccgaatgaatcattccgctgcactatattacagatgggcaaatggcacagttctagaagggttaaaactagagggtgagcatttaagtaaaaccaaatagatccgtctaaaacaatgataaattctcagatcatgaatcatgacacatcagtaaataacatttgaaaaatagatttttttcctccgtgatgcaaaactgggataaaaaatggctcattttttccttcgcataaataaatgggaatcaaggagttttaatccttcactgataaaaaacgttaccatcatcacgttaataggttgtagattattttattcaaacacctatgctctgttgaaccacaaaatttcagagagcagttcagagaaaatcaattgatatgctctgttgaaccacaaaacttcatagaactgctaccgaattgagcttctagagttttcatttatcaaacatatcagagaacctgatgatgatgctattggcagttttccaaatattgcacgcacaaatatatcactaaacaaatgaaattcacatgggaacacttttctgaatatattgcacaaacaactcatgactgaacaaatgaaaattaagatgagagcatggttcttcatgcgttgcaaaaaaaacctctggtatcagggctattcactcatgatgcttgatccagcaaaagcagcaatcatcacaacaatacatagaaccaaattcactaagaatacatgatcatttatgaaaatatgtccaattacagctatttctgaaaatgcaagctctaacagatagcaccggtggtttatacaagttttgagttgtataaatttgagattactgtcgaaattcaaacatacacagatcatatcagccatgacatcttaatttatgaataacgctagcacaagtggcttggataatttctgaatcatataaattttgaacagaacacatgaacattgagaatttagcaggcttattacaaactacaaagatataaaggggcaaatttttcatttaatacctttatcgctattgatttgtaatacttggttactgctaagcaagggaataatattaagatgctcttagaacagctctgttcaactagatcgagaccacaaaaagccaaaagcacaatagtaacaagctcagctcagaacttccatcgatccaataaaaaaaaggaactaaccagcgccgctgagggtgcagcagcaccaaatcccaccgttctccagtcaggcctggcaggactagtcgctggcgcctacagcaatgcgatcgacgagcactgtctgtccacgggcagtggcggacctgcaagcagcaacctacacctctgcctgggtctctgctatgcttcgacagcccaatggtcgtcgatccaccccagatcaggcgagtcccgagcctacattgactgcatccagcgggggacgccggcggcggctagagagggaggtcggagtcatgggagaaggcagcaccagtgagcacgaagccttccccggatcagccgttgcccagtcgtagccgccggatctggcaccactcaactcgcatgccacgggagttgggagcaggtcccggtcgggtccggcacgagcagtttgcgcgccccgcccatcacctccaagacgctcgcgccctacccagcggcgccgatggcctcggcgagcgcgggcggaatggcggcgaatgcgcccgactggaggagcacgaagcctcttccccctcgcctcccccatcctccaccgccgcaagccgtcgccgtcgccggccacaccattgccgactcctccgctgggctctcctcccgccgccaccgggccgccgccgccggatccgggaggaggacggccgcccgccgctgtagccgtcgccgtcgcaggccgtcgtcgtcgccggccgcgcccgccgctgccgcaaggcgtcgccatcgctggctaccggaggaagcccgagccaatagccgcacgccgcccacgcgcctcgtcatcaccggattcaccgcccgaacctcctcgtctccgagccgtggctgggggggggggggggggtgctggtctggggtaaggggtagaatgtgaaggggagcattttagttctactttcaatattccttattcttttaatccgaaattttaattatgtctaaattacattctatatagactcttatacttttattttaatattccttattttttaaaatttttaattttagatatttataaattatatttctatatggactctaacctctacttttgttcttttttttaatttcgaatttcaattatttataattgtatacgtatatgggctctagccttctatttcaatattcaattttttttaaaaaaattcgaatttcagttatttttaaattatattcctatttaaactctatttttcctttttcttcgattaatatgagaatttttaagccgtgagagcgaacatagaggctcctttttctatcactttaataatatcatcgaatagtccgatacaatagctggattttttgtgatttcagtgctatcatcgaatgccttgttctctaactgtacctgagtgctagcacgcatatatgaaactgtcccattcttgatgctatgaattgttctcttcgacaaagcctcattaaaattatgtatgatcatggcaaatcgaccttgtgttctttttttttttttgaattttcaacgccggggggggggagcttccccgcctgaatttacagggatgaaagggcagaagcgaagcaacgcttccactgcgaaactatgggacgtacattacatttcaatcgttctgaccaaagggatgcatcttcaacacatcggcgaaggatccgctggagggagggggattcttttctgaagaccacattgtgtcggtgattccaaagacaccaaaagcaaaggaggtagaagcacttgaattctaccgtcgagattatcggaggcggcttgagctgaaataggagttgtgctaaggggatattcgggtgaactcggatcacagaccagaaagctaaagaaagggacagtgtaaaaggaggtgatcttcgtcttcatcttggcagaggcacagctcgcatgcagcagttgacaatattgttttcttgtagaggtttgcgcaagtgggcagcctgttttttttcatgagctaggcgaagaattgcactcttggcagagctgcattgttccagacgaaatcccagttggcacaattaggtagattggaagaggaaaggaattgatatagggagctggaggagaaggtctctgagtggccatttggggagtagatccgctgatccataccacttgagagctccagttgttggatgatatcctgcacttctgctaagtcttctcgggcggctgaagagagacgaggggtgagtcccagagggagccccgcttgcttcacttggcggactgagcagtgttgtctagttgagtgcgacaacagagccggaaaggattgggaaagaggggcgttgccatgccagacatcgagccagaaggatgatcttctcccgtttctaattattactctggtgattcgcctgtactcggggagcttgtctgcgatagatttccaatgagtgccgaggagtctgctgggttggagggcttcgtctcggaattgttcccaaatccaattaatccatgcagagttttccgtgtggagggtgtggattttttcgtgtgttcttcaaaatgttcctagtcaacagctgaaatcaacaagcacttagttagtcctaagtgacccacgtgcctttgaagaatcgttgcatttagatagcagcctgccatccaactattttcatggatcaacatcatagtagtatttgacgagtgatggtcctctgcagtactgcacatatagtgctgcccactgatatgtgagtcccacagaccctcgggtccacatgtcagtctgcagtacttgcatgtgcatgtgcacacgcagaggatctgaattgatatttgactaacctgcctgattgtcacaggtcccactagctcttgcaatacggcctgaaataccacttttacaactcccttcacaacagttcaccatagtgactttgtttttttccccctgcacttcttggtgatcttatcagcagatccatatcctacatattcctcattgatatgtactactggaatcaagcagcgttgtggaaggagaatttgacatggttacattgcggcactgctgtcaatggaagctttcaagctgtgctggttccagatgttggctaattctaaggtttgacgcatgctcttaaaatcgttgcctcttacaagccttttcactggccacctatggctaattgtgcagaaatcaactgagccatcaataaatgacccactgtgcaaagcgttccgtgcattgcacctagacagcggccttacgatgcaattcagctacatgacaactctttactcctcgctagctttgtgttttcagagttggcattttgctgttgagttgcattcctgattgctttgccttttctaagcacaagatatatcactatggataccttcttttctgcagttcttggtgatcttctcagcaggtccatatccttcatggttgacagttactaccagaagcatcagggtgttgaggagaatctacaatgcttacatcgcttgctgctccggatccaagccatcgttgaggaggctgacagtaggcacatcacaaatcaagctatgctgctgcaacttagaatgctgagcaatatgatgtacaggggctactacttccttgataatttcaggtgccgaatcgttcaagcgcatgctcaagatgaggtgcgtgatcactctcttgccctgtcctctttcaatccattaaagcagttttgcttctccactacaacaaggaaaatggtatctgaagtttcggagagaaaagagctgcataagatgcttggtcacctggaaagcattgtttcagacatgcaggagtttgttgtgtttgtgagcagctaccctcgtatgagtcgacaaccttattgcagctacttgttgctagagaactgcatgtttggtcgccaagaagaacaggaaagggtcatcaacttcctgctagcacgacatcctcccggcggtgaagaagttattgatgtgcttccgataattggcccaggcagggttgggaagagcactcttgttgagcatgtctgccatgatgaaagggtgcgtaaatacttctctacaattgttttctatggccttggtagcattgagaataatggagacatggcgtttcttccagataccggcgcagtcaaatatcgaaatcctgtctcaggcaaacagtcattagctatcattgaacttgttgatgagatggatgatgaaacatggaagaagatattgcacagccttagaggagaccacatagcacctgtgagtaagatcataataatgagccgatcaaacaagatagaattgtttggaacaacaaaggcactccaattagattttctcccaaaagaagttttttggtatttcttcaagacgattgcatttgggagcacaagtcctgtagaggagcctaagctagcatccatatgtatggacatcgcggctttggtgaatagatcattcattggattaaacgtccatgggagcatactaagatctaatatatgtgctcaattctggtacagttatctcaaacgtctgaaatattacacagacaagcatgtccgtctgtttggtgaacacccaagagacacaaataaaaataacggtggacttacttacgtttggatgcataaaaacaaacatggctgcagtggcctagcgacatacaaactttatcaagcaagttctataagtcaaaataatctaccaacgatacgatcaattgatatggtttctcgaaatgttaagcctcgagcgaaatatgaagtcttggaatggcaatccagcatacctccatactatagctacatcgcgcaatacgagatacttgcacaaccgaaactcatgctacctcctaaaaggaagcgatccggggcgctctcagaagagttagtttgatctggaatggaattggtgttgtcaaactgtattgtaggtccatccatatggcaaagcaaacaatttggatgctataacatcaacagtttagcaaatatgttagtccattcttatccagttattttaacttgttgtttgccccatgttttccccccttttgatgatgtaaacttacaacagttatgtacatccctctgcaggaatgctgtgtcatcttccgttatccgatcttttaatcatatggttttgttttcttttctgaaggttggatgtacctttttcgctttatacatttctaaaaatttataaaagttgaatctgcatatctctatattaccccctctgtctgaataacattgtcaactattgacatctcactcactgcaaattatatttgaacaattagattttgatgaatggaacttgcatggttatatttgaacaggagcaacaagaatgcctcctgtttggtgagcatttgagctcaggggagggcctcaggctgagcccacagcactgggctcctggagcgcaccatggttgtgcctgagcttagccgtctcacatgcatctcgaacaaacacaaagcagtgataacaaacagttaaacatgcagggaatagcaatcttcaacaaaatggtaaaagctagcctacaaatttagaggctaattctgagtacaagcaacttcggtatacaaagtagagaaacaggatgaaagaaaaccacatgcaacacaccgttacttgctctgattaactatgacatgattcaaatccgggcaaaatttaaaggtgacgccagtaaaaacaatgcttataatgctcttataccgttcacatccttgacttttcttttctttttttttttgtgaaagaaaacatccttgacttcccaccaaggattatattgcctttgtccttcagtaggcttcaagagctaattgatgctcacatgttagaacaaagttcaccagactgaacacatttttttcaaaaagagagagagagagagagagagagagttagagagagagttagaatcattcacaaaatctatagttcaccaacaaaacaattatacccaggcgctctcagaagggttagtttgatttgaaatcagggggtgtttagatccaggagtgtaaagttttggcgtgtcacatcggatattatatagggtgtcgcatagggtgtttggacactaataaaaaaataattacagaattcgtcagtaaactgtgagacgaatttattaagcctaattaatccattattagcaaatgtttattgtagcaccatgttgtcaaatcatggagcaattaggcttaaaagattcgtttcgcaaatttattatttaatacttcatgcaagtgttaaaacgttcgatgtgacagggtgtaaaattttggggtggaatgtgaacagggtctcagtgttggtattgtcaagatccagagtaggtccatcatatggcacaacaaaacaatacgataccgtaatggcaacagacaagggtcaagtaatttgattgattcacttcttacttcttatagctaatgttttagctattagcatggagtctcccacttttcgaatttgcgctactattgtacattgcggccgtgtttagatctaaagtttttcttcaaacttccaacttttccatcacatcaaaactttcctacacacaaacttttaacttttccgtcacatcgttccaattttaatcaaacttctaattttggcgggaactaaacacagcctgcatctaggacggagtacaagttggccgtgtttagttccaaagttttttttcaaacttccaacttttccatcacatccaaacttttctagatacataaacttccaacttttccatcacatcgttccaatttcaaccaaattttctgtcacatcgttccaatttctaccgaattttcaattttgtgttaactaaacacgaccgtaggtgtgatctaaaaatatatagcaagctagaaggtctctgttacggaccatgtttttatgttggcttttgtaacttgagcagagcatgcttcttcctgtttagttcaagatttcctgtttgggtcataaaccagcagttcgtacggctgtgtttagttcacaccaaaattgaaaatttagttgaaattaaaacgatgtgataaaaaagttgaaagtttgtgtaagaacattttgatttgatgaaaaggttataagtttgaagaattattttgaaactaaacacgccgtaccaccagacaccccagacacccaattctgactagctcgtgcaattgcggaagagaacggaccattctgcagtttgtccttgagctcaggctgtgtccatagctctgggctcctggagcgcaccatggttgtacgctgaggtctcacacagcgtaggacatcatcacacgcaaacacaagccagcggcaacagcagctaataaacatgcaaggaatgcagatttttaacaaaatggtaaaagctagcctacaaaattagaggctaattctgacaagcaactccggtatacaaagtagaccaacacacgatggaaaaaaggcacaggcaacaccattatttgttccgattaaccgtgacaatatgattcaactgcgggcaaaatttaaaggtgacaccagtaaaaacaatgctgcgatgctcttagaccgttcacgcacgcggcttcccaccaagggttgggaactgagcctgatcttcaatggatggtgcagatgtagaatatgggccacgttggtaaccaccaccatatccacgaccgccacgatctccacgcccccttccacgaccacggccgccatagtacctttctccttccgcaggcttcaggaactcattgatgctcacagactggaacaaaatttaacagattagaaacctgagtttttttttccaagataaattgagttgctatcaatcgcaaaatctaggaatatccaataattacaccataggcttgtttgaaaatttattagtagtcattttaccaaggcatccccatgttcttccaaacagatgtcttattatcatatccatctacccaacactcacaaccaaaacgaatgtgtacaagaacctcaaatttacaagattttggcatccagactgacctacgaagaatgtgtaaaggtctgccaattactacgtatgtaagttaaaataccttcttggcacgctcatcgcgctcagcattttccttcttcttatccttgtcagaaccctaagaaaatggtacatttaatcaaaaaaaaattctagaatcagacaactgtagggattgaaatagagcacactgagaaatataccagcttaatgaaaatttcatcatttcctttcttggtagaaagtggctgcatagactgcaggtccttatcgacctcaaccttcctctcttcagccttgaaagcaagaagagctttccgcttttcctcccttaatttctcaaactcctcaagagtcatctcctagatagtagaatataataacattgggaggtcagtgctgatcttattatacagcaaatgcattagcagaagcaataatcacaattaaattcactgggaaaaccagaaaagtgtaatagctgttcaaagctttcaatgtaactatatatagcttgttccatgggctgaacagatagagcatagcaaccaagttcaagaaataagcggtaacaataaggtagcaacattactagcaaagtaaattagttctagaaaaatgcacaggaaaaaatgacagtaagatgaaatcaccacatcataatacacaactaccaatctaccatacatctactgggtgtgttaatacaaaacattaccagcaaattggcttcaagcaagatgtatagacaaaacagtgtagtaagataaaacgtctatattctggaacccataataccgcacatcaaaagtgtacacaaacacttttatcccattgtattacacgcaaattgattaagaatgctgtggttgaaattaagtatcgcttgagttgaaaaatatacagtccatcagcccagcacaatcctgttaacatgatatgtgaacatgcatgtgcagatagtagttaacttgggttgataactcatgtgtaaacccaaccaccaactgaatttgcaactacttgtcacatccagggtgatggaattgcatcattttgacagtagaaaagtatcatatagtaagcaatatgatggcgacatgccaaataataccagcaacacagaacaacaatagactcgtaaaagtgacgtagcaaaaatagttccaaaatgtactattagacacacaagaataaattttttatttcagcaaacctctaaaatagcagtgcagtttcctcaatttagacagagtagagaacagatgaaaatcattaccttatcctcttccttctcttcttcctcatttgcagcaccctccttgttatccttctctccagttggagcatcatcctgctcaccctgtttctcagcaataggagcactctcctcaaccttcaaggcttcctcagtctccctacataccaagaataacactatgagttatctgtgccttcactatccaagacaagaggcatcataaacagataaaattcccctactgtgcaagagcctcatcagtagcagttccccagttcccacgccctgcaccatcacgcttcatctcataaccacggccagtaccactgtggcgctcataatttctccggggcggcctctcagaatcatccccatattcaccatttcggtagccaccacgcctacctccatggaatggagctcgagggcctctctccctgtcaccttctccaccagcagcaacagccccatctccatagcctccaccgtaaccaccctggtagccattggcattgtctccaccaaaatcacggttctggccatatccccgtccacctctgccacggccacgctcaccacggccaaatcctccacgtgatggtgcaccaccaccccgtgcctcccgcgctgaaacaaatacaattcaggcgctgaaatcagaaccagtggtgtttgcaggaataaattctaaaaactgatcgaagattcgaacagcaggttttaagaggggaataaattctactttccagcaatgcaaagctcacgcctttacagatcatagcaacaaagtttacagccgacatgttcctaactccaagattgagcaaaaagaactacaagaataatctcctagcaagtagcaacatacaatccaatcacaaccactaaaccatagtaaaaaaaaactcatcatacaaaactaagtatcattcagtataaacatctcacgacgaatatcagatctaaacactccgcggcaaccacaactcaccagcctgggtgg

SEQ ID NO: 69683 - DNA, 595 bp, Oryza sativa
catctttattgatagataatttctggttacatcatcaggaggtattctacagaaaataagctctactagtttagcccggccaccatgggagaagcacaatttcacaagctggctgctctgattaccaaataatcaagtggtaatttttcttaaaacatactgtacttgaagaaagtaataggtagagatgatgacgggatttgaaccccctcacaggcagtcacagctacttgtgtactgttttggacacagtcggcaggagtggcctcctttgtagtagtataacaccaacaagtacgaggatcttttagctttgtccgagtctgcaactgcaagcaagcgaggttctggtcaaggaaacagtacacaaggaaacgatgaagaacgaaccaaacaccccccataaatcaaccagcaaaccgagagaagaagaaagaaaaaggaaaacagagaggcaagaatcacacatcaactgaacggtgcgacgttgccatcaaacccaaccgtgcgggcatgcctggcgggccaccaccacccacccacccaccccaactcgcacacgcacacgcacacgcacccgcacggttgggtttgt

SEQ ID NO: 69684 - DNA, 5034 bp, Oryza sativa
cttctgctactagtgcggtgcctgagcgttatcccagccgtgcgatgggatcatgaacggccgagattaatccctggggattatttgtgggactttagggcaaagataagcacgccctcagcctcaaaaatatctaaagtataatttgctagtgacaaggatgaaaggtgcagttattactactagagatacagtagggtttttttttttaatacacgacaaacacacatgcgcacacacccaataccaacacttacactttatgaatgtgcccaacggaaccagaaatacatctttgatctcataaaaattatgttgaaagatcacctacttgtacataataatatatgttaatcataaataaaatattgaattataggtagcacattttttagaactaaattttttttctcggggatgagattcgtcggttcattgaataaagtcacttaagaaatatctttagcatctcgccgaagtgggcaaggaagaggcagatggagagaacttactagctagggattgtggatgcatcttctacaccactttaactgtgacgaacattaagtgcaaaccaaaccatctttattgaatcagcaatggttgggtttagaaggagactagcataactatgtctcaagttaggcgagagagaatgagggcgatcataagggtataaaataggaactcaagttgattaggaagatgggtgattagtggggtacagaggtgaggaacatggtatcgtaacagagagaggagtggtgaatcaaagagggagcgataaaggatatataagggttaaggggcataagtagcagaaaaaggcttatccactggatctcttcccggatacccaaaaggaacctccctctcacaaataaagaagacaccattgctcaagaaggagaacaaattacatgaagcacttgtaaactagatgttattacaatattgagagagggagggagaatatctcccaccaaacactaatactctctaaaatcttttacataggtgtgcttctccgtcaatataaattaaaccttttatctctttgtaataaaaaaaaccccaaaatcagcttaaccatatctacttttctcaagctacttcatgtgcttttagcaacaatgtgctatggttagagagcgcgcaacatgctaatcacaaaaattaaaggtatcaagatttctttttaaatatagaagtttatctcatttcttgtggattgaactaattcatgtgaaaaaaaaactataacttcattcgtccccttacaaaatctaattgaactattccatgtgaaatcatgggttcctatggagaccttaatatatgttatatttaaattaaggtgaaaaacttaagaattccttaggacatgtgcaaagtgaggtgataagggaggtgtaattaagaagttttcggtatctctagatctagagccaaacattgtgcagggtgaagctaacatgaaaaatcttggaactaaagcatgtccaaatgttgatcttaattaacaaatacgtaagggcacctcatgtcaactcggaaacaagcacagtgacggtgggtgttgtactttctggttctatttaacataacaccatacttttgaaaaggaggttaaacacaataagaacatttgataacctatgtgactatatgagtgagattaaaaaggttatagcccctcacctcctcttatgttggtaaaaaaatttccatgtcttatattgtatgcggcattgtaaatcaatgtatgagattaatccccgcaaaaaaatgtatgagattaataatattaccagacttttttttatgagggaatagaataagggtgtatttgagaggaggggaaaaggggaaaattgagattatacgtaaaacaaggtgagctattagcatataattagttaagtattaatcattttaaatttaaagaatggattagtaggatatttaaaggaaattttctatagttttttttaaaaaaacacacaccacttaacttaacagttcaaaaggcgtgcgtatgaaaagggataatttttcttcctcttgtgcatgcttctctgaaacacagcttaaaattatatatactccaacccataagaaattacaaataaatccatttcttgccggaagttacattgaaagattataaggaagaatctaataaatgggtccttgccattgctgaagaagctgccggttgaaagcaactatggttgggcctccttgctggctgtggccagaggtggagaatggccgtgcctagaacaaattcaccatcgaagatggaaaaaaaacgtgcgagatgttgctctaccacttttgcagtacgagatcgaggaatacaacttgagtcaaatcaaatcaagtggtagtagctcaaaaggtagctaaacatgaacgctcagcaaagttcgtgaaatttgctaagttaattaattagttcgctacttgtttgggagtacttttcagaaacaatttgcccacttccagctgcattggtcaactactccagaaaagttcatgccttttttcatcaaacttgtggtagatggacaagaatctggcaaagaaaaaaaaagaactactatcatttagtaggagtagtatgattctttgccagaggaaagacctggccttaatcctacgctatctctctcctcctctctctcatctgacgtcaaccattgcgtcatttcggttcaacggcgcacgatctttaatttctccccaatttcctttccttggggaggtagagaatcacacccagaagctcacgcaatccaacctccgcgacagcaacaaatcaggcttaacttggaacaataatccaaggaattagaaagataaggttcttttcgtggctactgatagtctgatactactacatcgagtgcagtatagtagtatactaacccggctatcagcaacacaatctatccaaccactgtttccacgtatgcttttgtttattgggacggcaacatacgtaagtgagtaggatttgataaatcctttgcagtctgtcagatttgattaagcgagagtttgactagtcgattcctggttcaccaaccggctaggtaattttactactggagataaaatgataatgttttgtgtcattggcatcgaaatgaatcgggagcgaatgttcctcctgttccgggtaggaaaaggtcaaggtcagtgcctaattgttcgcctaatcttgcagaacgcatatcaaatattacaaaccttagattaaatttgggaggaatttctgttcgagttcatcttcgaccggtgtattgtcctgtaatgtaattattatagggttgcaatcaaagcatctgggtgcattctagaagttgagatcagtgtcagtccttaatactttgtccgacaaacgacaagtgccagcttttcctcatagagaggcctgatgatgtaggaaagccaactgatagacttgagttgactttacacacacaaaaaggaggaggaatattaatctgatggcgctttatactactattacattaggcgcaaattactgctgctactaaataccacggctttaacgagacagcaacccgtctgcatgattggagtacatgccttgctgcagcctgcatgggtggcgacctaacctggaccgacgcgtcacttcggggcttcaccctgtcggctctcgcggtctcacccgtactactggctacacgaacccaacccacagtgctccgcctgacggtacggtgcgtgcccccattcgctgcacttgcccatgcatatgcttgtctcgcagcgcagctagcagctagctttgctcacgttgtgcacggcgttttttttttctttccatgacctaatcaacgaaacgacgcctcggcttgaagattgatttctggcatgttgtgcacgtttcgccgctgaccttgagccgcttggttgccgagaaaccacagctcgatcgatcgatcgatcgattttgggggaaatggggatggaaatctgtcgatctgataggttccatcactcttggccatagaattatcttttctcgtcgtcgcgctcacggagattgctctcccgtatcttcacgtagcagcggacgcgcgcgcacacggcagaaaatctccatcttgagatttaagaataagatcgataggctcacagtgacactcaattccgatcccttcgttcggaggtttgacccgatatataataattagacagtgtatcattcctgagtatccttccaactttattaccaagtgtttcgagtctgttccacacaagaatcattaaccaatcgccacagaggccgatcgatctatccagctttccagctgctatccgttcgaaaaagcttcagaaaagtcaaacgacaagaagggcaataaaaaaaaaagggtttcagggtcaacacgactgagagtggagttcattggctgtgaatgaaacaaacaatcgggtcactttgtgctgcaaaatcttgaggccacatgaggccacgtttcccagcatttccacatgattttccggtggatatatattgcgccacccccatgctccatctctccccctcctatccatctccacaggattttaagcgactaatttaatttgattatagttaagtttagttaattattgctgatctgaaaaaaaaaagtacacacagagtcgtagagggagaagtaaaagcgagtgggatggccgtctcttccgctatataaagggtcgcttcgcccaaccaaccccctcctcccccgcgcatccatggcgaacctcccctccaccgccgccgccgccgccgcagacgcctccgggttcaagctcttcgggaaggtgatccagcccgacggacagcggggcgtggaagagagcgcggcggcgcaggcgccacctcatccgcatccgcctgcgccgccggtgatggaggcggcggcggcggcggcggggacgtcgcagactctgcaggcggcgggcggtggcggtggcggaggagggggaggagggggagagccg

SEQ ID NO: 69685 - DNA, 737 bp, Oryza sativa
  unsure (1)..(737): unsure at all n locations
gtggtttgatgacagctcgtggaacagnacctcatcaaaaatcacaaaatcactcaattgctatcccaaatcaaaatcaagaatcccctacaaaatcaacatcccaaataaaaaaaaaaccaaaccctaaccctagccacctcccacagcagtcctacccgtggtcgccgccgccgccgccgtcgtcgtctgccgctgtggtcgtcatcgccgtcgtcgttgccattgccgttgtccgcataaccggcttccaccgcgaccagctcccgagcccaccgccgctcctggccgcgtcgccacactaggaatggggccgacaccggcactgtcgtcagatccgccacaggagggaggcgaaaggggtcggatggagccgccaccgtctgatccgtcctcagccgtcaccattgcgggcggatccacctgcggtcgccgtcgccggacccatcacgcgagaggcgtgagagagggcgaggggaatgactgtagggaggaagagagggagataaacttccggtcaccttcgatagaataggattgcattgggccacaactgaaattaattaacaatctcccccttaattctgccgtgggcctagtgaacgaacaccaagaaggtgtctcggcgtcgccagcttttgncgacggcaattctttcgttaatgcattcgcccgctgcttcttaatccggacgaactccacaacaattttgccgtcattcacacacttccgtatga

SEQ ID NO: 69686 - DNA, 9286 bp, Oryza sativa
cccccccccccccacacacacacactttgatacatcagctgataatctgatctgttaatacaaggctcaagtatgccaacagtcatgaagaaccatgatgattttttttatgttaccaacagaatgatgtgttgttaagtactctatgcgccgtttaaggattccccatattttgggagattaggcttgaagtttaacttagtgactagatatctgcagccaattataattttttctgtcttatataattttatctcacttcataaatgaaggtacggatgttgaggaaagcttatcaacaagtatttatgccatctattaatagtcagagtagctttgatgagagacttgctgaactggtaaacacacattggccatctttctagttgttacttccactccatgtatttatttatttgggaatctgtgtaacaggaacgggaaattgagttatcagaaactcatgtatcctatatggtggaatctattcgcatgtcctttggccaaggacgtcgtggaatttgcaaatttagaagttggaaccgctgaaatttctataaactttcaagttttactggcaatttccgagacatcacttaggtaatgcattcaattatcaaactttttgtgttatatgaggtggatgataatatttttgggcaaatgcgatgtcataagaactaacttatacaaaatataatcatggaagagacaatccaactccagaacgaggaaatatcgttccagaaagattgaacacaaccaacaaattgaaaactgcacacaaatgtgcctgaagattgacctggactttcaatcgtgaaagttgaaaccaaccaaaccaacttcttctcttactgcttagggaagtgcatgagctcacataaacatgtggagatacacttcttttcccaaaaagttgcttcctggtgtttcataatttctagaataagttttggattgattctggttgggttgttttggtcctcatgtttattgtatgtttctggttgcaggaagcatcgctcattctttggactgggcatgtttcacatcgtgttcttgaaagaagtcgcccattctttgactgttaaagcaagagtttctcgttgatattctaatacctgaacacaggaatacatcatacagatgttgaatgccccttcactccagatttgaccaaatactgtcgcatctggatataggacacttggaagttgcgtgtcgtttctttttcttttttattttctcttgagatgagatgagtagtggtgttcgtggatgcacaaatgctccttagtcgttgtacatatatttggcgttgcctcggttttgttcatcctgtacagtgtatgtatgtcgcctcctggatctcaggctcgaatttgtattgtctgaacgatgttactgctagtgctgagatggtccaaaatttgcattggtgttcttcggacgacatacagtttgactattaatgttgaatctgcttgcttcagaaaccttcagatcatcagatgtgccggacccaaatatcagttctaaaccttccagggcctatggaccgtatatattgtcattccaggtcttgcgggttcaaatgaatgatagctctcgaccgtacacatttgtcatttgatataatcagcgacaacaataaagataatggccttgtttggatcctccgagctattaaatagtcctctggaatcttgctatttaggagtattaaacatagattaccgataaaactgattctataacccctaggcttttttgcgagacgaatctaatgatgtatattaatccatgattagcggctgattactgtagtatcactgtagcaaattatggattaatatacctcgttagattcgtctcgcaaaatagtctaggggttatggaatgggttttgggttatggaatgggttttgtcagtgatctagcggatccaaacaaggccaataacataaaactgccatcacatgacatgaaagttgctgtggtgtagtggttatcacgtcagtcttacacactgaaggtctccagttcgatcctgggcagcaacaatttttttgttactttttccaataatgttttttttgttgtcatagatcccccttaaccaatatatgaacgcataatctttcaatccaacatcatctattctatctttacctttttttttaaaaaaaaaacatatctcatgcttacttaccgtaaccttgtcttgaatctcgacttcataaattatgataaaaaaaatctcgacttcatcttagatattttttattattaaaatgtactattacagcaactccaaattaacaacacattacactagctccccaaccaaactcaattttcttattgacctaggcagtctcagtagccaactacaatgatattttgagcattgcaaggaagggggtattaaaaagaaaaatataaacatcatcaaacaaaatgtgcaaaaagatatgttgaatagtttcttgcccgttactagctctccttcatgaaggctataaattaacatatttgtttatgcttctatggctattgtaaattaatgatggaaaattgaaccaatataaagaaaaaagaagacaaattcataatcgaaaaaacttatattccctttcgatgaacattgaagttcgagtaccaacattttgtgtaatatgtatccggtacttttcagtatatcaagactagactaatgcaaattgtatgtacaatattttggttgagaagagagagctcaagaataagtaatagtagtagtagtaaacattctattttgtttattctagcatggactgtttttattggtaattaattaagaaagaggtgacaaatagatagtcattttcatattgctaggtcagcatcggtgtcacttatagctaggtcaatatatgatccgagttgcttaatcttggagccaagcagggtatatattcgcacaaattcacctgaccaacagtccagggactaacattgcttctttaagctgccatctagcggcggtgcaagcataagatatgtattttattcttttttaaaaaagaaaaagaaaacaacgttgaattgaaaattatttttatggctttcatatattggtaagggggtaaattttaacagaactcaagataactatgcaagttatcttcatgtcttttagctgacttcactttgatatcataggtgggtcagaatattgtgtgcaatggtgctatactattaaaattgataataatatgtcttttatttcactttagatggtgtagtatttatagaatactccctctgtcccaaaatatagcaaccttatataggataggacacatcctagtacaatgaatgtggagagaggtactccctccgtcacaaaaagaatcaacctaggagaggatgtgacccccctcctaggttgatgtatgtggacacccccatgtccacatacattgtcctaggaggggatgtgatccctcctaggttgattctttaagggacggagggagtatatccacattcgttgtactagaatacatctcatccattataaggttattatattttgggacggagggagtatcatggaaagaatgttttttttaagtcataatttagagaaagttgagggtttgttccaataacttatgttttttctgttaaaactcattggtggtgtgttttatggcaaataaggatatgtaaaccaacttttttgaaatttgtttatgtaattattagaaaatatttacataaacattagttcggtggaaaagtttttataaaggactgtattaattttttatgtaaattttttaaagaaacaccaattaaatagaagagaactgatcttaagccgtggtttattgttttcaatgaatataagaaactttttggctcatggctcaagcttttacgccatgatcagacatgcaagtatgcagccatccggtaccattttagttaactgttttcaccggaaaaggcatcgattttcttaaagtaagttttgggaggatataccagcaaataaatatgatcagctatttattagccgccctaaacgtatgcatgatatgatcttgagttttaaacaaacaggccgatttgtgccttttatctggagttttcggtccacacattctgacacttacggattgcctcagccctagaacatatgaattttgtcatactaatatatatagtaaccaccacactaattcattttttacataagaggaggacattacatctttgacctttgcatttatcatataggatgcacatcacattactatacgttttgacaaagcaaaattcagaacagacaaaacccatatgagatactgaataatgaaattaattaagctagtatacgctttagcacatctcataaagcggatgaagactcccttgacaattaatctattctaaggcttgttaagattgatggatcgattgatccaaaaccatctactacctcagtagtcataagaagttttaaaattagacatgggtattaaagagtaggtgaaattaaataaaaaatgattgtgattgattgagaagatgaagtatatggagaatttaaatgatgaaatgttgtgaatatttgagaaaaaatataggtgaagaaattattatattttacacaaattttaaaagctaaaattttttatgttttgggatagaagaagtaactcctaacatgatgttcgatttgtgctatggcttgttatcatccgttgtcaagtctcttccatagccaaacccacagctcttcttatagtcggtttagtgtgaagacagattaacttgccctgccaaaatgttgccattttggacagtaattttagcaatgtttaatttgctatcaatacttatctatatatactacatgtatgttgctaaaatattagcaatagtaaaccatataagcctttagcgatcgcattgtccacgaaaaattggcagatcgcctcatcatccggaatgagtatggactggatgtccctagagatgaaaacggagctggtaatacttataccatattcgtttttatatttgttgttagatacgaaaacgaataccaataggttggatatgaaaacaaatacgaaatatctcaaatacgaataaggatcaaatatgatcggacacggataaaaacatttttttctcagaatacaaaagccacctcagcttctaatagaaacaaatatcatcatatataattaacttgtttataaaaaatatagtatactttataaaatatttaaaagtttaaataatattaataatatggattggtgttaagagatgtgctactattaaaatctaaaaaggtatattgagggtcacagagttataaagaaatggagtatgtcttatggcttcagcgaatatccgaatagcattgttcaccggatatccgtatctgaactatccgaaaattatctactctgaaaagtatccgtatttgttttttatccggagcggacgttttcatccctagatggccatgtgatagcctggtccaacaaacctgttattgtgtgcctctagccataatttttccttttctttttcggaacaaaccacaaattaacatatacgctcatatacacgtgaatatactcaccctacacacacttattactatgaacatgtacatgcacacactatcgcgctctacgagcacattttatctataaacgagagcactggtatcaaaactgtaattaagagttattagccgagcacctacatcaagtcaacccgagtatataagttcgatcgcaagaaacctaatgtcgctgcatcgtatatcaaggactacatacccagcccttctatttttcatttgacattggtaattcaaaatggaactaagccctgtttgattcagcttaggattattataatctagattattagttgtaaactgaaacaaacaagtagattattatgctagattattataatctataagctagattactataatccaataatcttctctagaggagctttttccaaattattgagtggctaaagacccactactcttagatgcctctaataatccagagaaacaaataactcgtggcttattttatatcagcttattataatccagcttagagtaatctgatttaataatctagattacaataatcttaagcagaaacaaacagtgcctaactaatgtgaaataacaaaaaaaaaaggaggaggaactatgaacatgtgaataagatgcacaataaattgaaatttttctctttttttggaaattaatattatgtctgcaattaaagctaaagtggccaaactaaacatatagccgcgacccactaatattaggttccttaatttgtcagcatgcgctaaattgtcaataacatgtaaatatatacatgtccaaaacataagtgccattcaaaaaagatgaggcaaagcatcaattaataaggtatggtatgtaccatgacataatcttatagggtaattttaccatatttgagaagtatacctggaggtacacatctctaggtactaagtattttaaggtataaaagattttaatataaatttaggtatctcaagataaaggtaaaactcctcaaatatcatatatcactattctttcttcgaagggctaatcctatctatctactccatccttatttattatttatccatctgcagttgcaactttgcacggcaattgaataagatttgctgaaacttcgtatatggtttctagtggacacataaattaaaacggtagcagtacacctgttcaaaatgtgtgatttggagataagatcacaagattttgagacctaaagaagttagatggacttgatggattaggcaaggaacatgctgcctaatatttatgcagtacacaactaaccattctatgctagtctccccaaaaaaaatatgcaattaacattgctgtgacatgctagccaattaaccatagcatcagctacagcaacatataggaaagaaacgatgtgcaagaattcgcatgcatcacaatcacacagctcgtgtatgcattttgatgaacattattggtgtacgagttttgacgaacattatctatcttgtaacatcacaagcagcatggtcgtatacatggtcaactcggtgctaagctgagcggcggccgtgcatgctgattagctggtggttggtgtgagatgaaattaactaataaatactctagtaaattataacaattcaaattggtgcttggcaccttaattatataattgatggttgatcgtatatagccaaaacatgaaacatgagacaatcagacaacagcaatttccacggacagttagtacaacaaccttacttccattggctaattggcttgttctcgcagtagtaactcacgacgaaaaaggaacacggtctttggtcgagaaaccgaggcggctgctgtttgtgaaagaacagcaaaacacatgttgttttaaaaggtgggaattagttaagaacgacagaaacgttcatttgtgtgggtgggtgaggggggggggtggttttaaaaaatccggttttttaacaaattggtccttttcaaaaacttatttcgaaactagtcactgcaaaaaacttcaaccaaaaataggccgtggactcagcgccatagaccttggcgctgagttataacgtctcagcgccaacgttgttggcgctaacatctaatccgaggtggcatgaatttgctgagtcattatagctcagtgcaaagttgtttggcactaaggtcctgacgattcaaatagacgcgcaagcatcttagtgtagcaaaatagtgatagcctagtggttaatgtctcaagtgaggcataaggttccaggttcgaatcctggtatcccccgcctcaccctttttttttattttggattttttccttttctcttttttgttctctcgactactctcttattttgtaattttttgtattttgggttttttccttttctcttttttgttctctcgactactcactcttattctttacaaaatgacagtttcgtttgtaaatttgttttattttgaatttgatttgaaatttcagtttaagttctcaattgccatataatataccactttaatattttttcccaaattcaaaaaaattgcaatttaaacatatcttttgaagatagtatcatgagataaacagaaaagaaaaaataaagagtgagagagagaagaaaaaaaagaaaatgaaaaaaatgggtttttttttctctcgactactcactcttattttttacaaaatgacagtttcgtttgtaattttttttattttgaatttgatttgaaaattcagtttaagttatcaattgccatataatataccactttaatatttttttccaaattcaaaaaaaatgcaatttaaacatatcttttgaagatagtatcacgagacaaacagaaaagaaaaaaataaagagtgagagagagaagaaaaaaaagaagaaaaataaaaaaaatgggagagaaaaaacgaaaaaaagaagaaaagaaaaaaaagaatggggagagatgggggatccaaaaaaagaaaaaacgaagaaaagaagaaaagaaggaaagaagaaaagaaaaaaaaattgggggagatgggaggtcgaaccctgcttcataggattagagtagaatcatgctaccactatgctatcggtgggttgttgaagctgaatgcctcctcagcaatttaaatcattaggaccccagcgccaactcaacaaatttatgccacctcagattcgagcttggcgccaacgttgatgacgctgagacgttatagctcagcgccaaggtccatggcgctgagttcacggcctatttttggttgaagttttttgcagggactagtttcgaaataagtttttgaaagggaccagtttgttaaaaaaaggtaaaaaactggcagatttttggcaagatagtggaaacagattatatgctttcaacatgctctgtttatctatctaactggaaagtaacttttcggttcaaattggccacttgcttgtatcctgttaaggatttgtttcatgttcttatcacttggacggtccacattatatacccagcagctggaagcattatccggtaagattttgatttattttcggatagcattgtcaaatgggaattttcttttttctttttacatcttcagcagttgaactgtcataggtttcctgtacggggctgcaggaa

SEQ ID NO: 69687 - DNA, 11871 bp, Oryza sativa
  unsure (1)..(11871): unsure at all n locations
caataatgtgcgcgtgagaaaggtcaggaatcgcagggcatataattggatccatatatacatgcactacaatcgcttgcgtgcgtgcatacagcattcacatatgtatgtactatattctcgtatctatctactaaactaaaaattcagatatggttagtgtgcatgagcatatacaaactacacaagcaacatgcatggttattgattaactctatgtttatgtgtgtggatgaaacacattgcatcaaccaattggagaaggaaccgtaagaatcttaatcagaacattctactcttgcagctacggatcacttcaaggaagaacacagcagcagaaaatgttttaacatgcaccacatgttttactagtagatcaatatcgattgatgaaattaacgggaccagaccggagtcagtccccattttacctgacgaacttctccaactacgttagatatacgtagagctagcatatagatgacgataatcacgtaggtcatcagatgctactgttttcgtttcacagagaccagatcaacagagattaattaatccttccaattgtttacagtagtcatttggcttgcgacattaccaatatacgtgcttaatgtccgtatcaagtgcacatatgcattatttctgctcatcgtagaccgaagttacgacgatggacactaccgaaaaggcactgactgcaagcaagcgtcacttatcttgctatcttgctggctttacttgtagcggagagtggaaagaccagttcagattcagtagttttactgaacctgaacctgaccatttctaccacatttctgcatttcatttcagaaaaaaaaagtagtaatagtcttaaaatcttaatacaagcggaaaacggaaaagaaaaacaaatactatttttcagcttttcttttttgtttcctgaataattcgacaacagtttggaagtctaatacgcatgcagctaattcagcatctgtttagttatccccagaagaaaagatcatgtggccgagaagaacatcagactggatcactggaactagcgttcttgtgttggaagtcaaaattaccattcaagaaaaaaaatataaaactggttataaaaattggttgcaacgtccaatggattatatgctcatctagataggagcatatacgtacgacgaactgcggtagttgccaagttataatcaagttaggtcctcctaggcctgtagaatatatgatcgctgatcagagggcacaagcaagcgcccgcccatggacattatttctgtcgcttgaccaaagcatttttctatgccgcacatacaccttccctacaagaaaaaaccgtcgagtcgatcttgaaattaaatcctgcaaactcaaataaataactagtcggcgacagggacggactaagtacaattataatcattcttaaaaaaactagacatctcatttttaatttattccatcctaaagacaacaacgaaagacacggttgtctcaccatcggtgtctctcgtaaaatacacagagagacgaagctgaccggtggtggtggttgaagttttctatggcttttcttgacgtctcgcgatgtgagaggcgatgtgtgtgtgtgcgagcgagcgctagctaggtcaactttgctctcagctctcgctcccgatgccacacgctgacgctgtgctcgttataaacccccggcctcgccggggcctcaccaaccacggccgcgcttcgcttcttcctctgatcagagtggggtgaggcgaagtgctcgatcgggagcggtggtggtggtggggagagagagagagagaacttaacgatggggaggtcgccgtgctgcgacaaggcgagcgtgaagcgggggccgtggtcggaggaggaggacgccatactcaggagcttcgtcgagaggttcggcaatgccggcaactggatcgcgctgccccacaaagcaggtgcgcgtctgcatgcgtccgctgcttctttctttttgaaaaccgtgtgctacgctagagtcctagacgagttcgtgcgtggttcgatgaacagtggtcaaaggcttctgtcacttgcaactttttaacggcagcttggtagtatatggagtacttagcttctctgaaatattgctagttgtatacttgtatctctctctgtgactttatctagctcggtctgtcagcgtagggacgggtgagtttactgataactcgctcgtacgtatgcacacgtaaggatgacgtcgttaatgtgttgccatttgattgtcatcgtcagggcttaaacggtgcggcaagagctgccgcctccggtggctcaactacctccgcccggcgatccggcacggcggcttcaccgacgaggaggacaacctcatcctgtcgctctacggcgaaatgggaagcaagtacgtgcatgcatgcgtgcgctctagtctacctgcattcacatgacctctacctctgtgcgagtatattgattatacttctgcgtgcgtcgccgtggatgtgcacaggtggtcggtgatcgcgtccaagctccccggccggacggacaacgacgtcaagaactactggaacaccaagctcaagaagaggtacttggccgcggccgcaacagaagcaaccactcctcctcctcctgccgccggcgacgatgacaacaacccaacgacacaagcctccagccaacccgctcctcctactcctccggcgcccctcgtcaacctcgacgcggccggcctcgacggcgccgtgggcgacaacgacgagctcctgctgcacaagtcggagcagctgtacgccgagctgatgggcctcatcgagcagcagcagtactccacgatcaccgccgccgccgtcgacgcggcgacgacgacgacgtcgtggtcgtcgccgtcgacgggaacgacaagtccgaccgctagcagcagtactgacggcagcagcagcagcagcaacctgccgtggccggccgtggacgtgcacgacagtacgatgatgccgccgttgtcggagtccagcggcagcagcagcggcttgttcttcggctctcacgcgttcggtagtggctcgttccaagacctgctcggctctgcagcttccttcgacgatgtcatgctgtcgcaagagatgctgtactactagctaggattaataagaagaaattaatgtttgcttatctcattagtctagctagcaaagtggtaattgaattatctcaattaagttataagtatgctgcattggctagctagtgacggaacgagacgtcatgatatgtaccgtgcaagcgtgcaaatcaactatgactgtgtgagtgcgcgtaaacgtacgtgtgtgtgtgacacgattgtatatatatggtctcagaagtgtaagaaatagtcatgcggtactggaagatgacatcgcgcgtgctgggtcgccccaacatatagccgtgtactaaggtgaatctattgacttggcactaaaaattttatcttattggcaggtcaattagtttgtcgtcgtcaagttttagattgaatcatcctcatcacaacaccttgcactgtctcattgccttttcatcttgttcgcgcgcgctagctaaagtagttactccgtttcacaatataagttattctaatattttttatatttatatttatgttaatgaatctagacatatatatttatttagattaattaacattaatataaatgtgagaaatgatagaatgacttatatttgtgaaacggagagagtagcaaataatgcatgccatcgcctaacgacgccgtcgtcgcagcattgttattgccataagacgcagcacaaatcctgaagcgtgtgtccttccatgccagcaatgcaccatgccgccatctgatagagtgagtgtacatcagaagagcggctgtttgtggtgtgggagcgagtctgctctgctgctgggccaaaagtgaaatttggctggaccaagttgcggctcacgagtcacgacacgtttccgctcatttgggccaacgagcagcaccagcattacagaaacgggataagctagttcactttaggcccctcaatttgtcagccaatatgaaattcatccctaaaccgaaataccagatataacacgtccctcaactttcaaaaccacttgaaataagaccctaagatgatttggatggcggtttcagttgacatggtatctacgtgaatggtttgactaggttatcgtctcacgtggcgttataatcaagattaaaaaaaaattaaaataagagtaaaatatatgggcccatatattagtcaatacaaacataataaggaagtgggacccacatgtcngtggtnccacnttcttcacctcacccctctctcctctctacttcctccttcccattgttcgcaatgaggaatcagtggcaacggcggccagcaagaaggcagcgacggcggttggcgggaggtgtctattgaggagggagccatgacgttccgaggcgacggagaagaggatagaggcgagctccgaccaaattattcacagtgataatttcaaaaatggcgcaacgcctggcggagatggtgatctctccccgacggacgcctgcctcacggtgatggagctggtgaacatgatctccgtccttatggcgctcaccgctgccatccgccttgacgtcccagccaagctctgggctagaggtgccaatgccccgttccccacgggacaccctaacccctttgtcctcgagcgcctcctccgcctgctcacctcctgcagtgtcttctgcgagcacaagggctccccgcgccacttcgcgctcaccaccggcgatgatgaatcctagagctggccaccgctagagaggccggcggtggcggtgcaaatcaatagcacggaggagctagtggaggaaaaaatcagcgcggtggatatcaaagtcgacgggcaaaggtagaagagccattggaggaagaaatcagcgtggtgaagactaaagtcgatgtctgacaggaatacgagtggcgtccgctccaattcgctcactgaccaccaaccatggctcgagcccttcctcctccccttactcctcgtctcgttcttgctcacgctcgccgccacggtggctgcattcatcggcctcgagtccttcttggtgatggtgtgccgcccgtgactcctccgtcggcaatgaaactttcaccaccctccttgccccggtgttgatgtaaaaacacggtggcctgggagatctgcttaacttcagtgcatgtccaaagctagcctaagtgtgtcaaggcgtgccaactgatttggtcctgcaattagcaagaaagacaaaaagtagagttagtcagccgacagtcgatcggccaataggccgatagcatatcgttggtggtctcagccgatgtagttagaccaaatcggctatagactgggtagatcggtgaatattaaaccctaaacatgcctcatcggctgtaatattgtctatcaggtttaataaagaagtttaagatagtattataaaagtagccgatggaacaatatttagggtaagagagataatatactagctaatactctagtacaggcttatataggcagatcaatctatataaatatatcaaattgtggttggttagtagtttagatagcccagccgataccaatctagcttgatataactgtatagggagatctatctatataagtggcaaatatacataaaactttagtaaagaagcatgtatattaggtaagatcggctaaaacctcgatactacccttattaacaatcaagaagcaagctagagatcatggttctgaacacgacatagtaggtcgaatgtactaatgcagcactaagtatgaaaagaaatatgatatctagacaatcaagtcgttgactgaatttttaggatggtagatgtctaagctaatctaatctagtaagacgaattagccaatactggcagaaatcctaaagcaagaagcagccgatagagctaaattgatatgctaagactagaataacaaagacatatgataacaatggttatgatacaaggactagaatatctaaaacgacatagtagctccgatagtacaagccatcgagacgagttacctcttgcgaagcgaactcgtcgaaaagtaaaagggtggtgatgcgccgaagttgtattggattgtccctcgtattacaatgctataaggttcatatttatatcccgagtacaaaatagtccattatggacatgactcaaacatttttaaagataaaatacaaacaagaccatatacagcggtctcttgccaaatctaactcaaaccgacataactaacctagttaataggtacaattgccatacacgagctctatctctgattgacaatgacagttatcttgatctaggcctatgccgagcctagattataccatatcggcagcttgccatatcggccaagtcaagcctttgtctagtgtttagccgatacgatattcaaccgatattcaaccgatgtgcagtttgacttagagatcaactagattttacacctaatccgcttcgatctttcttcttctccaaatctgatgccaaattccgttgttaacacccggtcctctagctctcggccctgaccccactcctccccacctgcacccgcctcctctccctttctgtccaagtgcccatcactgtccgcctcgccgccgcctccttctcgctcaccgtcggtcagacggacaacgagattaagaactactggaacatgcacatcaagcgcaagctcctgagttgaggcatcgacccgcagacatatcggccggtcaacgccgggagcagcgccgccacggtgagcgggctaaccacgacggctagcaccgttgccttgccgtccctggcaccgacaatggcgtgagggagctcgagaaggggtccacattttcttttaattttaatttttactagcaaaaatgcccgtgcgttgcaacgggcgaaaaaattctaatcataatatacgtttttcatgcataatgatttcaatgacagtgtttgtattttaatgagcggcttgttttttttataaacggtgttcgcgattttctcaaaccattttttagaaatgccgtatttctttctaatattttttcttagcatgttttttttgcttgtattttcgaatgttcctttttgcttttttccaatacaggagaatatatgacgaaataaaagccgtgtagtatgtggcaaaaaattgatggattctatctgactcaagtgtccatcaatttagctttttctaatagttttttcagagcgatttgtttttttaatagatggcgttttttttcttgcgatgttttctcaaaccattttttagaaatggcacatttttctggcggttttttccttgcatgttttttttaaaaaattttttaccgacgatggaaatagcttttctcgcacgtttttttattttttttatggaagatggaaaacatttttagagtgttcttttttgcgcttttttctgacttttttctcacgcgtttttttgaaccgtttttattttctcatgcattttctctttttaaatagttagattagattagagatagagaagagatatatactgattagaaatcagactttgtttcacccattctatttttttttctcgcgagcattttttaattcatacgaaccaagtttttattttttacgaaccatttttttgccactttcttagggaatcggacgaatttttttagatatttttttttcagattttttttcgcctttataggaatttgacttttttccgtttttaaaggaattggatttagcttttttcaccactttttgtttgccttttataggaatatgattttttttgtttcggatctatggtttttttggccatctaggggaaacagacttttgttgttgttgtttttcttttttcctttttttgcggcttttctttttctttttatgcacctttctgtttttgttatctcccttttattatttttttaaaaaacgacctcaaaataccttattgcaagattatagggactaatgtaaatataaaaattacagggactcaaatacaaaagtacatacccaaaaattaaaatcatataaaaatagaatgctctcgacatgtaggttccgtttttgcaaacagatctccaatccgacgcaacaatttttttcaccaagatgtatgggatatcacgggagattaaaaccgagcggagtggtgcgtgggatctcggactcaagcctagaggagaggtgccttttatttttcgtttttaaagaggaatcagatctagagttggatttttttcgtttagagatagagaatcggacagatttttttttaatttttgtcgtccttcttcttacccagagacggattcgtttttctttaatggacagatccggttttcccaccttttttcggccgtttttttgatcggacaggtttaggttttttctcacccggttttttctggatcggatagatttggttttttcgcccggtttttcgttttttcgccttttttatcggataggtttggttttttttcctttttttccgcccggttttttaggacagatttggtttttttgtccggtttttttgacggatgatgaaagcacctcttattttttaagtagtatatagacgttttggttctaatgtcacctcactgtcgtgtaggacgatgaccaagtcaaaccagctacgtaggcaccatgtcagtcgaaactactgttcaaaacatcttgtgatctcttttacactggtttttgggagttgggaaatgcgctatatatatggtattgtggttcagatatatgattcaaactcggcgacaaatggaaggacctcatgtgaacttattctttacaacaacgggaaaaatacaaggcccacagttgtagcgagctgcgggaaagcaccggccgaactactaacatacagtacgtgggaatacgcaaggtcgaaccgtcgctgcagaccgcaaaagtcatcgatgcccaactaggccgccacacctctacacggccccatccggcagcctcctgcccgcgcggcgcgacgcaccaccggctcactacgcgctagctgcatgcatcaggactgcggtgctacgatttgatatgtccctgttttgaatggttaccgtacgcaaatttaagctgcaaattaatctagtagtactactatatatgtattgcatagttaagctgcaaattgatctcgcatataatgccctcgtgcaaacgcatctattgcgaatccgaaatttgattgatctcgcatatgcaatatgaatatatatttggactctggtgttcctagtttctacgtctcctacctagctacgaaaaaatgtacattgtacacgatacgaactcgtgctttggtacctgtccataaaacacatattttacccacgagtgcagcagctcgtctcaggtcggccaccatctatcggcaacgctagctagcccatccatgtggacgatgccgttgccgccgctgcggccgccgccgaggcggtcgccaccgacgacgatcggggaagcgtacccggacgcgcggggcttcgcgacgctgaagtggatagtgatactgctcctcgtgtcgtgcatgttcgccggtggcctctacgccctgacgcccctcgtatccaaggaccctctctacctcgcccgcgtcccgtggcgtctgccggtgcgcgtcttgtgtgactcctacctgtcgctgatcatggtgatccgcgcgtacacgttcatgcacctgccgcgcgcgccgctggtcgtcgacgactatcttatgctcctcggtctcggcgttatcggtggcgtcactgtcgtaacgacgtccaaagttttaaatctccggctatagctgccgctatagagatagctgctgggaacggacggagctaagagatgcagtttttagcgctaagaatagcgggacgctaatagcgccatttagccggcaatagccgctaaactggccgtaatttagcgtagctaaattgtaaaacgcggccggtctggcccaagaggaaaccggcccaactagaccagagtcgagaggtgggtaaagtgctgcaaaccctagctcgtaagctcccagcagcacactatccattccaacttcaaagcgctcactctccagctgcaagaaaagtggaagcggccggcggcggcggcgcagaggcgtccggcggcggcggtggcttcaagcggatcgaccaacgcaggtggctcgtggaggcgaccggcgccggctgctgcttcgagcgggcgtccaaccagcggcggcggctgtgaaggcagctgagcagcggggcaagtccgacgaggaggtccgtcagtgcaacgtctccgaagcactgaagcagcagcaccaaaggtgacggcatggcacaacaatccggtcagttctcacatcgtcctctcttttttgcttgtatgttgcagatcttacaatatgtgaacaagttgtccatatttgttacctgtaatttcagatacttgccttatgatgtagatcttactatatgtgaattattttcttactccctgagatctctcgtttgcttgtttcgcctgtttaggtggtaatgataatacgtgctatatcagtttgcattattttgatgcttaggcagctttgacgctagcattaatgtgggctaagtttgctttttatataggtaatccgtccagtgctgcctctgtctcagtagaagctggaccaaaacaagctggtatcaactcagatgatcctgcatgggctcactgtttctgcccagacataaccaagaaacatcacctacggtgcaagtattgtgacaaggtctgcactgctggaattacaagaattaagtaccatcttgctggaattaaaggtttcaatactactaagtgtcagaaagttccaagtccagtgcatcaagagatgtttgatttgcttaccaagaagactagtgaaaaggaacagaaaaacaaagaaaaggaagtggccagagctcaagttgacatagaaaattcagattgtgaaagtgcagtgaaggttcagatcatggcaataatgttcttgtggtgaagccaaaggagacaacaggatctagtagctctagatctgtagcaggtggtcatactattgacaagtactacaagcctccttctatagaagaatctgccagtatgacacaaagagtaattaagctaagcaataaggttcaaacagcattgacaactcagaaaagagaagagaggaggaatataacttgtgagtacatatgtcagtggttctatgaagctagtattccacacaacacagtaacccttcctagctttgctcatatgttagaggccattggacaatttggtagaagtctgaaagggcctagtccctatgagatgagtggatcgttcttacagaaaaggaaggaaaaggtgatggatggattcaaggagcacaaggaatcatgggagctcacaggttgttctatcatgacagatgcatggacagataggaagggtaggggagtgatgaatttagttgtgcatagtgctcatggggtactcttcttagattcagtggaatgctcaggtgacaggaaagatggcaaatatatctttaaacttgtggacaggtacatagaagagataggggaacaacatgttgtccaagtggtgactgataatgctagcgtcaacacaattgcagcaagtctattgacagcaaaaagaccatcaatattttggaatggatgtgctgctcattgcttggatctcatgctcgaggatattggg

SEQ ID NO: 69688 - DNA, 2137 bp, Oryza sativa
ctttgtttcaactgcaaaacatcccactctgcttagtaaagaccaatagataagctacatatatttgattctcaaggtacatgtcactgattttggacaatggagttcctcaagtgtctgaaagaacgatacccaaacaaacaactagaaagaagagtgatatacctctagatattgctcccttgatttagctgccaatacctcagggtctccttgctgccctcttgactttgattcccttagtatgacatcctaaagggggacaaaagaacatagaccaaaactatgaagtaccattatatgcatgctaaaaaaagagagaaacagttaaaagactatcacatgtagtatatctcaaaaaatacctacatttaccaataaatcagtgacaagattacagtgacttacactgccaccagttgctgccttagctgctcggtcccactttgcttgttcccggcgagtcggaactagcctccatctaggagacgcaacaccgttgacagcctacgtacgaaatccacaaaccatagcttagcaccatctctggtacaccataacaaagggaagatatttgaacaatgagatcacaggctgtcacctcagctccaatggcccgccccctccaggcagcctcaacctgggttttcaagattggcctggttggcgcctgaagctccttgctcagatcaacatccacactgcaatagaaaccacaggtcactaaacagtcgcaacaccaaatgtgagcagagaattcgataggagggtgaggtgaaagagtaacctgtcgaggctcattgcgcggttgatgcttaggaaccctgattccgagtcctcatccacctgctcaaacgatttgctactttagaaacaatagaccagcatccagtgcaggcaaaattctacgctcgatttggaatttcgaaacaaacgatgccacggatgcaactagttcagtcactagatcggagcagataggcacaatcatacgcgcgcgattagagatgagtgaggtctggggcttcgtcgtaccggggtgaggcgggtgatggtggggggcgtgtctgcgccgccgttggcgatgacgcgctccatgtgtgggaggaagtccttgttccagatgaagtcgtcggtgttgcccacggggtcgcggtcctccttccccatccagtacttgcgcggcttgggcgtcgccggcccgccgccgtactccccgggcgccatccccgtcgaccacttctgcggcttcttcttcggcagtatcaccttcaccggcctccgccccgccggctgatccgccgccgcagcagcagccgcctcccccgaggccgccgaggcgcgcggcggccgcacggaggcggcgcggccggcggcgagggcgggcagcgacatggcgcgcgaaaatatctctcgcgcggtggggagcggagagtggagagagtgatccgggaaggatacggacgggtgaacgggagagagacacacctcgtggcgtcgcgagctgcgtctcagtttattatatacgcgaacggttgcgttctgagctccgaatcgcgccgaattggagtttaaattggagcagttttgtatagttgagtttaaatttgaggcggttttgtaaaattgagtcagtggaactctggaactaaaaataataaaaagcgataattgccacttgtcttccctgtagaggggtataccaacgtatacaacaaggaacacaagatattatgaaatgcctttcttttcttctcgcagcgtaaaatactccacagctttcaaatatctcatgttcatagagatccatgaaagagcagaaagcagcacacactaccgtgctatttacacactgcggcaccggcagtaacagctaacaggttacaagtaacaacgctttctattggtaaaaaaaagagacggcttaaacagatattcatgctattccaaaaaatatttccgatggtggtccgtatggacacggtttgtcatgctattccaaaaaaaaaaattacttgccaatggtatggactcctgtcagatcacctcagatttgcatactgggcatgaaatcctcatccgaagccatttgtcaatgcactgtggaagagaaggcagatattcagagaagatgcca

SEQ ID NO: 69689 - DNA, 6071 bp, Oryza sativa
tagtcagaatacatatacatcagcatagtaacagcttcagtaaaagaagcaaaattttaggagagcaccatccagccatccctattgcaagacatatgggtcaagccacgttagtgttaacctaattgtactttcacattatgaagcactaagaatgtaataccaagtgcatagcatatgatgatatgaatattttataccaaaaggcaggagtaagctcgcaactatgacaaatttattgcctggtggcgaaaatgtcatcagaaaagcattgttataaaaaagctaagtacttactcatcagattctgacataaattcctctccgaagtttccaaatgcttcttcgagtgaatccagtattgccatgcgctgcatatttttcaaaaagaaaaaatgtttgctgtaacacaagtgttccaatgtattgacccatcagaagaaaaaaggagttgcttcaatatcgtataaggggcattaaataaagtgttttgcttctataataaacctatctggattgataagatgaatgccaaaaacacataggagcacttttggtgttaatgcctgtgcataatggaaaaacacaagggaatgataacatggcggaatgctaatcaactaggtaaaaaaagccccttgatactccaacatagccatatcatagattagagagtaatgaccaaccgtttctagatccatgttttcatctctgaagcatcctctagtcaattgggagataagcatctgagaataagcaaatgtgagtgcacaagtgaaggttgaagaaataaatttataaggattcacacattctgttgctctctgtcagggcggttgaagcttctttgcgaaccccttctgcttggaattggagtcagaacattgatactgtgaactggtgagtgccggccaaatgaatacaagtgtgccattgaacggtccctttggctctgagaagaacaatattacacctcttaataaagaaatgattggatgaagcttcagataaataatggaagtaattaagacatgggatgccatagcccaataggccaccataagcacaagatagaaatacaagtaaagaatataagattacgaacaacagttgataatcaagtgtttttggtcttatgttttatcaagaacaacagtggataattaagtgcttttggtcttaagttttgctatctgaatttgttttacacaccattgctacgttttttatgcttgcagacagatatgattgtcatgcctttttatctcaatgtttaattagcaagaagtaattggcacttgcagctaatttacttgcaaggcgccaagtttctcaatgaaaataagcgtggtagctgtagttttcaataatgtcagacatggttatcacttattaggatcaacataatagtcataactgaaaccatggcattattcataaagatgaaaacaaaattgttgcaggccataggtgattttcacaacggatgcatcaagccacaatgacaacttacagagctagattggccctctctgacagcatttctagcgtgttccacatcttcctcttgcaatgtccaggctagtgttgtatcaacctgccagattccaggaataagcgagtttttaaaaatgagaagaaaaattcaacattcacaagatggccaactgaagattgggtggggaggttaaaccactcgtgaccaggcaattggcatattctcaaagtaataagtccgtcatttcttaagttagtactgaataatcagaagaaaccacaatcatcacgtagagacaacaaaaccaactactcctataacaaacaaatgatttaaattggcaccaggatagcaagattgagaagtaaccatgagtaacaacctcttctaagttttgcgagcctggctgctccttgtttaactgctcctgaagcctgcgtgcaaactcctcatcggattcaatttgtctggttcttaactgattctcatcaagaagtgggtagttgagccccttgatcctcgatagccatgtggagctaccatcttccatggaaacatcaccagctccagtaacttcattagtggctacagagcttggttcatgcattggaacctcatcttctctcttgccattgtcccgcgaatgcgacagtttgtcgacagcaggatcagcgggcctcgcaccaagaatccccttccacttgtcatccggcgtgccggaaccactgtgaagcagcccgtgctgtccatgtccctcctgcaaccccttgctgtctgattcatcctgaggcgcggagattgatccgccatttcccccatctccaggcttgctttcgcctcccgctcccaatgtacagccacgggagccgatcaaaggatcaacaggcgccgacaccgctctctccagcatctccccctcgccgaccttctccttgcccttcttcacttcctggctcggcggcggatgcggatgcggatgccgatgcagcagcctcgccatcctctcccgctcgaggaagctctccgactcggttcttggatccgcctcgcaggcagcgcgcttccgatcgggcgagtgcacgcgcgcctcgtcctcttcctcggactcggagtcggacgagaccagatcaaccacctccattccctgcaaacaaacaaacaaaaaagagaaaacattcaagcacagccatgacgaggggaacatgccagtgagatcagcagcatcatccaatccaataatcattttatttattattcgaggtacttaaaaccgaagtaaaatgagggatttgaattgacacgtacacccgcgacctcctctttcctcccctcctccccgcttttccctcgctcgcccgtgcacaccccacccctcgcgctgccgcgtcgccggccgccgacccgcccctgctcgccgcggcccaggtcgccgaccgcctctgctttattgcgccgtcggggtacgtgtcgctccttcgcgtctcgctcgcggaggaatctggggatgggggcggcgtgagagaggggttcctctccggtggaagccggggggagacgtggcagagagggaggaggaaaaatagaagggagcaacagaagcgttagaggcagggccaagggaggcccagaaaaccggggacaaagaggaagaagggtattacggactattcacttcgagatttcgtacttagaaataaaagagaaaatggaaatacgtgaataatggtagggcctacaattttcatacaacatagtactccctgtgtaaacaaaaggccaactgataaggatgaaacatattgcatttttttaacaaaggagcgtggagacatgtgaatggaaaaaaaacgcaaatagtttgtcggaaagaaaattttgattttaattcctcatttctctagcaagaaaaggagagaaggtaatattattttgccaatctaggcaaaatttagtaggctaccataactgatggagaaataatcatcggaagagggtgtcgtgttttaaagggactagagatcataaagagagaaaatgttcttgaacttgagatgaatgagtttggctcgaaaaaataatgaagaaggattatatataggtgagggaggaaggacagacatgcaaaaattgtactaatattatttccttctaataattagattatctcacctttgccttttggaggttttgttttctcgaaatagctattgtgcgcctcatttgtggcaacagtggcgattagcctccttgatggatgaggatggtgattcttcttctccttctctagtgatagcaataggcggtgatgaatctaacaagctaaaatttttatgttggagttaaaagaaacatagattaggcgtttggaggaacgactaaggtagcatgccaccggtaatgttgttgaatccgtcgggaaaaatggtgggacaaggcaaggcaacaaattcaaaggtataccatggtggtgagacaagaacaatgatattatagagataaacggtgcaaaagaaaacaggaagaaagaaaaggcacaagaaaagatgtggtcaagtgttgacgaattgtgttgcactagagcaacaacaaaacaatggtaagaagaatcgccacaatggtgggggtaggtggagtggtggctagggtttgagaagaagggaaggggatcgattttatatggattgtggggttagaagagtcaccgcaatagctaggagagggagtggcggctagggtttgttgggaaaaggaaggcatgattaaaggggatcaattttatatggattatggtgaagatgttttcacataattaaaatttaaaatatttaaacttattcaatttaaacttacggatgtccgtaaatttaaaaaattaaatgcatatatgattatagtattttcataatcttataaacttattttaatataaaacaaagtaatacctcaaggatcataaatcacaaattcgagtcttatccccaataggaattaggattttgtgaatggataaggggatagttatccatccaaatgtaatataacttagtcctatgaatctagacatatatctcatgcagtcttagttactactccctccgtactcgtaaaaaaagtcgttttggacaatgtttaaatcaaaccttgggaatataaatcgtgaataactctcaagttgttaagtttgaaaatgaaaaattatatgaatagatttgtcttgaaaaatacttttataaaagtatacatatatcacgtttcaataaatattgttatagaaacaacaagtcaaaattgtgttttggagacagtgtcgctgtccaaaacgatttcctttacgagtacagagggagtatattttagaatagagtgaataatgcactaaattaataatgttagtttcttggacttggttattgtttaatactcagtttcaactttcaacacaccgttcaaaattggcttcctaccaacatggatttttaacactttggccctttatgaaaaattatttcacaaatagaaccacggataaacttgttcaaggaattatcctttttctaggcactagtgaccttggtgtcgaggtccaatgtctcagcaccaatgatagcgtcgataggcctggccctaagaagggtcgagctgtgccatcgcactgagccctcgaagtcaaggggcacaaccccatatatatatgctatggatataggagcccataggccataagaacttagatttagaaagcccaggaaagaaagatatataacttgtttgataggaatgtttttttatgcattacatttgttagaaacatcattatattatcagagttatattaaagggcccatctatcgagcttcgctccgggctactaaattgataggaccgggcctgagagccgacatcttcgctccgtagcaacaaagatatagagggatcgtcgccaaagagattggtgtcgaggacccatttaatttttcaaaaagggttcaaaggtaaatatttattcttacaactatgtccttggtgcaaagtacctatgtttgaccatttctagacttcctacgattttgtttacaaataggttctcagtgctaatcattctagtgccaaactccttcatattagcaacttagctatcatggtagacgaggggtgttggcgccagtataattagtgttgagatattaaacattgacaccgagaaaaatagtttatttccaaactgattttttaaagatctgtttatacaagataagttttcaaaaagagttagtaacatgtaaaaaattatatcgtgccgatgcttcgtgactcaacttttgcttgtaaatacggtttcagaaattcagacgggtcatgaacagatatcggacccattttttttcttacttttccatccatccttagaaaaaccaatctgtcccgaaaaaaaaaaaacctacttctaaattgttatattttctaagatggagagagtatgcaaaacacatgggatattaatgctgaacgcagtttattggttacccgcaaattgttaatttcagttatgggttagaacttagaatcaacctga

SEQ ID NO: 69690 - DNA, 4831 bp, Oryza sativa
gatctaagctttgattctctttctgaacagcttgtcatggtaattaataatacgaaaatgaatcataatatgcacatctgttgtcagattacatcggagaacactgccaatcgccaaatccactttttttcacttagacctaggactatcacatccccccggcataaaaataaggactatcgcatcctactaagttgggtcgatccctaaatccaaatcccaacctgcagttggtaatcactagaggtcagattgaggaaaccctcggcctcgggtacctgaaccctgcagcggtatgcccactcgccgaatgcccgtccgtgtgcctcttcgctccgccctctagcgaagtgcgccgccgctgcagcgcctgcgcgcgagacgtggactgtggagtggtcgggtgctacggtgctacctccgcgtccgccgcaacgtcgtggagtcgcgctgttaagtggaaccaaacaagacagggcaaagctactccttccgagttccgtcaaaaaaaaaaataaacatgggagggatgtgatattttctaatacaatgaatctggataaaaggccatccagattcattttactagataatgtcgcatccttgtctaggttatgtttttttaacaaaggaagtatgttgcgacgaagatggataggctcttttaggctcctagtagaatggcagtttggcaaggaaaaagtccctcaacttatcatcgagttacaaaatcgtcccccaaccacaaaacaagatatatagcatcctcaacttacaaaaccgttcactttaggccattcggtggttttgaccccggtattgtccgacgtaacagctgactcggcgtgggacccgcatgtgtcgcacatgtcagactgccctcgtcagccacttcttaccctcccccatcaactcacttcctctcccctcccctctccatgggcggtggccaacggagagcagccaggacacggcaggacggtgtggcgggcacggtcggcgctgcagaggagcacatcgcggtcgggcgccgccatggcctcttttgtcttcgtcatgccttcgtcgccgctatggccttccttgtatcctctccccaagggtcggcggcggcgagcacggcacgccgcgacgtggtgtgccctgttgaagtcaccccggtcgacgaggtcggcacacgcgagcggggaggggcgtcggtggcaggaccataggggcagagcgaagggggagctggaggggaacggtggtggcgaggtggaggaagagggcgccgcttcgacgaaactcccatccagggcgagggaggagcggaagacagagaccgcggcaacgggagggaggtggggatggaggcggcgaggagagagtttgccggttgacgcgctgtcgtcgccgccgttgtccatcctgcccttgctcatccgcgaggctgtcctcaacgagtcgccgcctaaaagtgctttgttcatagtttctagatcaaaaaagagatctatgagtccaggcataccaaaggcgtggccgccgctcatccacatacgccatcagtcgctcatcacgcgttcacgctccgccatccagcgacggggcgaccacgtcaccgcctggcaaatccaagaagaactagtaggaggggctgaacaaaccgtataaaactatagtcccctcttctaatgaatgtatgacataataaaattctagtggggttttatggggcctcttatgattacaataccggaagtggaggctcgagaccctatagcccccatggtagatccgcctgcctgcaagcctagatcgagtgtggcggtcagcggagtttggtcaggtgaagcatcgatgaatacaggcagtgtcgtttcttctgggcttggtgatgctgcaccatttctccctggaaaaagtacaccgaaggtccctcaacttgtcatcgggatacaaaaacgtcctcaaaccgcaaaaccagatacgcaacgtccctcaactatacaaaaccggtcacaataggtccctcggcggttttgatcccggttttgtcttacgtagcggctgagtcagcgtgagacccacgtgggccccacatgtcagtgtaatccacgtcatcaccctccctctctccccccctcttctctcccttcctcaaatctctctctctctcacttatctgcaaggtagccgacgcgagacgggagaggaggggggcggcgccgcgacagcggcggcggtggcggccgccgccgccgcagtggggaagcatggcagaggcgcggggaggccggcgagctcctcccaagtacaaatccgacgtcggcttggcggtggcggcgaggcgggaggaacgcggtgaggacggcgacgccatgagggcgctcgaggaccggtgccatgacggcggggaggcgcgggaaggccggcgtcggcgtcggcttgttgatggcggcgaggcgggaggaacgtgtcggcgccgggagccggagcggcaggaagcaggtacaggcgcgatggcgacggctcgccaggaccaagcgctgtcgtcgctgggagctggagggggaggagctcgcgggagttgttgaatcgaatgttcgatggcgagcgcgccacgacggggtgatttcgcaagtgttgcgtgaagacggcaggtcggtttatatagagaagggtcgcttgatcagggcgctcgcacgatctctactgcgcgtaaccgaaccggataagtcgcgcgtaacttatccggacttcacgccgtttgcacgcaccggatttttcggaacgtttccaaaacaaaaacgaatccgaatttgtagcaaaacaaaactgcaaaaggaggctgcatctgcgcaagggtgaggagccaatttttcggaccattcgacgcgtacgtcgtgcacgcgcgccgccggcccggcccggcccggcccggcccggcgagcgagcgcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctgatactagaccgtctgtagactacccctcgggtggagcgtataagtcatactcctaggtctttagtaagcttcctagaagattcacccaaaatcttcatagactgcgaccaacagtcaagctcacaaaggtgagttctttcaaaaatgctctgcaggacaacatcttcgctaattaaagccaacagaactcattaaggcatagccaacctgccttgcagctcacgagagtatatgcatcttcacttggagagggtatatatattggtactctcctttagtttattaatggtttgttcttcccaggatctaattcacgggatctccgatcacataaactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagccattctgcctcaacagtagcagtatccagtgccgttagctctgcttccatggttgacctcgtcaaaatggtctgtttgcaatacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccaatgatcatctcccggattagaggtaaatcggcttaacttgctcacagcaaaggagatatcaggcctagttgcactagccaggtacatcaacaagccaatgatttgggagtattccagttgattcctagcaattctcttgttcttgcgaagcaacaagctaggatcataaggtgttggagaaggcttattatcaatgtagccaaaacgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgacctt

SEQ ID NO: 69691 - DNA, 12917 bp, Oryza sativa
taagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctatacatgtaaactacacagtataacatgaacagatcaaatatgcgcaacatattgaacacgtaccgaggtgacgtaaagaccggttgcttggttgaaacttttcgcaggtgtctacgaagacacgaaacacgcgagcgaagaggaaggcgagccgtcgcgaacaaacagggagcagtcgcgcgaagcgcttcccaaaaaccttattgccgccttctcccggtgcaggacgtcgaaggcagaggttccggagacctgctctcccgatcgccggtgcacgccggcgagcgggatggagtagtctacgagcgacggcgcagtacagagtaggaggcaaaccccagattgatttcgcaagtgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagtcaatttttcggaccattcgacgtgtacgtcgtgcacgcgcgccgcctgcccggcccagcgaggcgagcgagcgcgcgcgtgtgtttcccctcttctctccaccacacatgcttcaagtggctaggaggacatcctcccttttaaggagatccccctctcctagaataagcaaggtggtactaaactccacatgcatgccatcccatgaagtgggcttttgtgattttccaaagaattaatcttcgagtgggctaaggcccattcattaattccaacaagaggtacatcgagcactacgagaaggagatggggaagcctgtgttcgccgtcgggccggtctgcctcgtcaacggcgacggcgacgatgtcctgaagcgcggacgccgcggggaagcgggcgctggcgtggctcgatgccgtcgacgagcggcacctgctgctgcacggccgccgtcgccgcagctgttggtatcagctcggcgtcgcatgaacaccacgcgacaggaagccgtcgacctcggcggctgtcgacctcagcggccgtcgaccacgcgaggaggttgctcctagactgcagcgcggcgcggaggtcgatcccaatcccgatcccagcgccactgtgccaccgcaacgcccaccgcggcgactgacgggggagcccgcgcgctgctcctccccccgccacccgcgcgccgccatcccccgccgcccacgcgcagctcctccccccgtcgccagcgcactgtcctctgccgtccgcacgccgccccttccccgccgcctatctgcaactcctcccccgccgccgtctcgtgggactcgtgggtggtggccggcaggggagcccgcgcgccgctcctccccccaccgcccgcgcaccgtcctcaccttccctcccccaccaccacctccaagaaatgctttccccgccggatccccccgcggcgcggtggccggcgtcctcctcctcctccgccgccgcatcgacggtgtgccccactgctccctcccggccgcctccgcggtgtcgtccactcgtccctgcaagtgtgagagctgagagcgagaggaaggaaagagaaacagagaaagagaaaggggaagagagagggtgacgtgggcaccttacatgtggggcccacgtgggtctcacgctgactcagccgccacgttagataaaatcgggatcgaaaccgccgagggatctattgtaaaattttgtatagttgagggaccttgcatatcttggtttgcggtttgaggaagttttcttatctggacgacaagtcgagggacattgagtgtactttttcctttctcccttgattttgtgggccgtttgtcgttaatatggcccattatttgttggccagttcgttggctgggccttggcctgggtcataaggccagtttacctgagtgaaccgcgggcggcgcctgaagagtgaagacaatcggcagtggcgtgacacggctgaaacttcgccggtgactgtttgctttccgcatcgcgtgtagtagtaaaattttggaaagcggacagaatactggtctactgctactggagatggaaaatccgagtaataccgattctgatcagtagaagcggtcaagacacggcagagcaaggcgctagatgtgagtcatgtgacactgctgaagagttgtgatttttgaggccactgtccaggggcccaactgcccaagccggctgtactcgtcgtaggcaaaacatggccacccgctgttcgctctgagtagagaggatatcttcgattcttcattggtagtatgctatgcccaatgccctacgcacaggctcagcggtgttcatcttgtggaaagagatataacatggctgttttattcatattttgcaggtgatatgtgttccaagcaggaacaacccgcgaaactcgccgtgttcgtacaactggtgttgctgctgctatgctatggagttggcaacaatgtcgtcgtgacgtcgtccattgctcaactgtccgcgagaacaacatagatctacaatcgctgattgatttcaagaagggtatcactgaagatccaggaggagtcttgctctcttggaacactaggacccatttctgttggtggaatggtgtcatatgggtggtgtgtggtcataatagtactggacaagtagccgtatagatgaacaaagagcttaatccacataccagttaacatgggatggaacgccacggctattctacataaactccctagcacaattttaaccaaactaaaatcaatttcctaattcaaatttagaatctgaagcggctaatcacgaacgagtaaagaccgatgagatctaggaaccacggaatacctttgggaggcggatggtcgttcgctggcggcgtctcaccgtcttccctccggcgacgcgcgcccgcgcgcgcgcactggcagtggcggatccacggttggggctggttggtgccccagcctcacctctaccctgctcctaattaatcattaacaagtctagttagtcattagtgaagaaatttccagatggcaaggatgcaggctgctgcctcactgcttctactgcccaaactgataaaacaaaacatactccgagtatacataacaacataatcacagatagagaaagtattgggaatattttaatatagccaccaatcaaaatagagaaagttcttttgatcgtggttttcattggaaaatactttagttgatatatctttatttgttttaatcatattatattttttttacactagtaccccacaatttaaatctggattcgccactgctcactgcggaacatcgcgcggcagtgcggataacaggagaagctccagttattcgtgggaagtggccagtggtggcgacgcgtgggcgtggcagactgtgacattatgggcctgtggccttccaatggacctgttcgtgtggtctggttgctgtccttatttgggccatcagctgcaacaggcctcctgagtcctgacggcaaccaaatgtctggactgaattatacctgcatgtttttttttttttgaaaactattacttgcacgttctagttcgacatcaatcgtgacagaagaatgcagagtctagacaggaggaatacgattgctcggacggaaacggcatctagagcgagtagatcacgaccaacaaaattgatctttgtcgttgtagagccgtctcgactttggcctgttctgtattgcggtcaagctacggcaaacgttaagcatatgtcggacaagggaattggataacgaatttacaaccacacgctcagattctaaatctaaacaatctagctttgtacaaaattgcatgaaaaatcagctgaactaatacggccattgcaactgccgttaattgtaggggcgaaaacagtgaccgagccactgtccgactagaccgggcagccatctaggttcgtcggtgaaaactccattaaattttaatattaactaaaaaaacacacatgcgttgcaaacttgcaatatgtgaaagattttttttttacaaaatcatatgctgtaattaggagtacgattgtctcaagttagcatgtaaatttgtttaaagagatttcttatacaactctttctgtatttctaaaagcgtacgaatttaaaaaccgaatcaaatatggatatgtatttccaaaagaaaatagacttcaaaaccaactcaaacacggatgacatactaaagtactgataaaatattttcagtttttataatagtaaagatgagtaaatttatgatgaaatttttataataaataataattatattgaagtttgactgaactcaaaaattttctagctctaccaatgagcacaaagacaaaatatacacttcctttcttatctttcttatgtcactcatcaggatagcattagcataccacccaccctgtttcctgggtgatgtcggtgatctatctcggtatgattcccagtgaccactggccagtagcccagtagtagttggcaagaccccctttcgtgctccgcataaccgagctgtacttctggatgttctccagcacgggaacgcacggtcaccgaccaccattattggcgaacaacctctcgttgcagtttgagcctcctgtacgtacgtgtggctgtgcccattccgaaacactcggggaggtctccaaactgatcacggccaaaatgatctccctcgcgcaacatgggcatccgcacatgcggacggcgagcgccggtttgcgcccgccatgcgtacaatgattgggaacgtacgttcgttgctccccttgccgccggagcaccgcccgacccgtgaatccgtgtcgcgacgagtcgcgaccaactggcgtctgtcgcgtagtgctctcccgtgtacgtacgagtatagtgggccgaatcggcactgtgccgcggtacgcgtaagttgtttattctggtttctccaagattgggattctagcagctttggggtgggtacaacagtgttctgcacttgttctctcgtatattcctacagtacatattctgttctccggtacaatatgtgattcaattgtggggctacttgcacgcggtacacaaaaataataccctgaacaagctgctggggaaatccagagtttggacaatatgttttaggccctgtttaatttcccaaaaaaaaattacaccttgtcagatcgaacggttaaacacctacatgaagtattaaatataggctaaaaaataatttattgcacagattgcgactaatttgcgaggcaaatcttctaaacttaattgttccatgatttgacaatatggtgctacagtaaacatttgctaataatggattaattatgcttaataaattcgtctcacggtttactgatggattatgtaattagttttttttttattagtgtcaaaacaccctatgcaacactttatataatatccgatgtgacacgccaaaattttacaccctaaatctaaacacccccttattcataggtacacctggcataacatgcatacccactagggtactaggtgttcctttttaatgacgatttaatggatcatggacatgtattatgaagctaaaaattatggttgatggattatgtgtgtgttattggtgccacaatttcaaaatcaagatttttatgcgcatgattaaacataagaccttaaaattaaaaccacacataataaaatgtcactacactatcaggtgtgtatcggaagctcagagaccatatccttaattccatttattgatctccagtctccacctaagcctctctaaattcttcattgttgtatacctcgacaggcacatcacgttgaaattgctaatgcgcggctagtcgcgcgcgccctcccgcgcggcgaggcacgtggcgcgcgccgagagggccacggcggcagcgcgtgcgtagggtggggcccgcacgattttcttttttttttccttgttcggtttctcctttccggttttctttccttttttttctttcccttttttccttttcggttttttacatatacgtatacaaactttttatatatatgtatacaaagcttgtatacgtgtatataaagtttgtatacgtatgtataaatcctttgtatacgtcatatataaagtttgtatatgtgtatagaaactttatatacacgttcgtatctaaggtttgtatacttgtatacgtatacacatgatgtgttttttttattatttttaatacgtacatctacaaagtttgcatatttcatatacaaagtttgcacacatcatatacaaagtttatacacattgtatacaaagtttatatatgtgtatatttttttatacataaaaatatatatttgttagtagtagtagtatagtagtcctagtagtaatagtagtatagtagtactactactagtagtaaatactagtagtactagtagtactagtgtactatactagtaacagtagtagggcgacgcgcgcctaccccacgcgcggtcagtcgcgcattaggcgcccgtagggtaatcctaatgggcggtgatcgctcactcccctccccagtgatcacgtgcccctccacctgtactactttacctcccctttttctcttactactacaccataaaaatttaaattaaattcaaatttgaaacgggtatgtaaactttttacttataaactttgggtctataaactaatatttgaatttaaatcaaactttagctgtataaactttagatgtataaaaatactatatatagaaaatatttatatttgaattcaaattcaaatttgaatcggatataattcaaatttaaatttgaatcgggtatgtaaacttttgacttataaactttatgtgtataaactttagatgtatagaaatactgtatataaaaaatatttgaattcaaattcaaatttgaatcggatatacaaacttttgacttactataaactttgggtctctgaactttagatgtgtaaacttgaggtgtataaactttagatgcataaatttactaaaataggaaagtaatgcggtgccaaaaaagaaaaccaggtggagggagggaaggggagggggggaaacgaattgatcgctatccccgtcgccaggcgagcgatcgcccattagccgtttcgcattacgtagacaccaatctattaagtttggcccaaaataattttatctggccttgtgcaaattaaactatgtatggaagtctaatgacattctttgccttctaacatttttttaatcaagtttatgccttaattaccactaccaataaaataaacagttacacatattcatcaattgaattttttccgttactttttctttcatctccccttctgatgtcctcaattcatcgtgaaacccgtttctagccaggcaggcagcaatgcaaatcatcgtggaactagttaatagctggtgacctcaatttgttttcgcgcgcgaggcagaggcattattctttctactgaagttaccatcacgggctgtcaccgatggttttcttgatctttcgctagctaccgtgtttgctcctcatatggtgcgtaaataactccttccctaggcttattagtccattccaataagttttaattttactcatgaataaatactcatatgctactattttgtcccctcttcatgtgttctttgtttctctggtcttctaactataatctgacacacttcaatttttgcctatatcataaacatatatatatatatcttgctgatttttttatcaatgttcctacggagtaggagtactaccttaatcactgcaaccaataaaatatttttttcagttaattctcgagtaatatatcttgctattttttttatagaaggcctgaaaagcctaatttataagcatggaagtgatgaatgtcatcaatctttctttctaatgacctggctcaaaccaagagcacttggaaacacattacccaatccaaccagcaattagaatttttcaaagttatagaaaaaagttgaaagatatatttaaatcacagctattagttgcacctaatgttcaagtgatgtacaaatttagaacaatatatacgtgtatatagtacaagcagttagatgcatgttacacctaacgtattctatctatcatacagaagtctcgcagcaacacgcgtgatctctcactagttatcctatacaatccattgcaccaaggtatgacaaaactactccctccgttttagactataagtcgttttgactttggttaaagtcaaacaactctaaatttgactaaatttgcaggaaaaagtagtaacatttttaacccaagacaaatatattataaaaatatacccaattatagatttaatgaaactaattaggtattgtacaatattacttccaaacttgataaaacttagagtgtttgactttgaccagagtcaaaacgacttataatctgaaacagagggagtacataggtaaagattttgtattgtaactcacggtgaatcttatactccctctgtcccaaaatataaccatttttagcatagtgtcaagtcaactatttttaactttgactattaataaaaaaaataaaaaaatatcaatcatgtgaaattgatgttactagatttatcattaattaaactataataatataccattctttttatttaaaacaccttatttttatagatattattggttaaaatagcatctcgaaaactgtgtcgagtctaaaaatacttatattttgggacggagagagtaagttttttatttcatctttttttctaaagaaaacaaacccatgatcctcctacggctgccaagttcattgcggtggcaaaagcactccttatggtgcccggccacgttatgttgcagcgatggcatatggcacgatggtagtgttcgagcacatcatgaacgttgctttgggggaatggtctacttggtggatttcagtttcaatgcgtgcttaagcgtggtttgcgccaatacgataacacatattttgtgctatgctttgttttatttcgtcaaggaacgagatgatgcattggatcggagatgaaataggatggggttgaacaactttcattctgatgtttaatttatagttcggtttagcctttttttgctaactggtttttctcaatttagaaataagttacaataacctatcacttcataagatattttataaaactgcattaatagcaaacaattttatcagaaagcttatactagtaactagtgtatatatccctgtatatatgtgtatatgacacatgtgcctaacttgcagaagcatgcatgaatattgcatatgtaacatgtaggtccaaacttgtaaaaagaagatgtggtcctatgataaatactgttgcttgtttgaaatgtcttgcaacaaattgatagttttgatgaaatagttgtagttttctaaaattttgacctaaatttcctctgtagtgaatggttttggcatggcagaagctaactaaaatttgcatatttggacacatattatttgatattttagattaatataataaacattgaatccatgaggatggtggggtggacaccagcatacctaagaaaataaaaaagaagttatggtataaactatgtatcaatggcccaaaagatttgatgggatactgcacaaactgaactacaagaggcacgaaccagctttgtgggcataatagcaagaagaaaaataaatattaggcaaaatataaaaagaaaaatattaggcagatttcacgagaaaaaaagcaaaaatattcggccttaaattttcgaattaacttggtctaattttttttttgctaccattatatatggcttatgatggtttaaaaaaacgtgaatattaaggaaagacctaatatcaaataaatataagaggtgatgtttcgaatctataccaactagtccactaccttgtgaagctagccagaagatctctgggcgtttctctgtcttacgatggttaacacatcgtcgtcatggcaccaaaattagctagacaatgtttgctctagtcactcgaaattattatcctaatagagaaaaaaaagaaagcattatatcgtgtgatataaatagttcatattacaatctggttgatcgatttatataattgtatataagatgtgattgtacttaatttagttagcataatttacatgatactatctactacctaaaatagatcttaacacgcatttgcacatgccacgctgctagttaaagtgatacaataacaaaaatatttcttgtagtgtaacacttaattgaattcaatctccaacttgattgtgaagtacaaaaccataggtccagagtagtgaaagcaatataagggacttggaaaaaaaaaaccaccctcgaaaacgtttgctctagtcactcaaaattattatgttaatagagcaaaaaagaaagcattatatcgtgtgatataaataattcatattacaatctgatagatcaatctatatataattgtatataagatatgattgtacttaatttagttagcataatttgcatgatactacctactacctaaaatagatcttaccacgcatttgcacaggccacgctgctagttaaactgatacaataacaaaggtatttcttgtagtgtaacacttatttgaattcaatctccaacttgactgtgaagtacaaaaccagagatccagagtagggagagcaatataagggacttggaaaaaaaaaccattctctcgccttttcttctcctgtcattaatatgaacttgatttttataaatgtgatgaactacgccaagactatgcacgcaactatttccagacatctggtattgatttcatattcaaaccaacgtgctttcgacctgttcattgggttggtggtcacggctgatatttcaccacttcctgagatattcatataatcagtatggtgacatagccgtggatgacacggcattcgtatgtagcactgctatccaaatcgaatacatacaagtttgctagacccgctgctctgtcaacgaacgaatcctgaccgcagaaacaaattctggaagaaccaaaatgaatttgtggaacgagaatcttgaaaggtaaaccgttcatgtgctcaaagcttatctgcatacaagccttcgagaccggtcgcggctgtcgcatatcagcgcagaatttctctgtccggttccggctgaaaagtagggggatagatgaatagtacggccatcggattcgaggttcgagctggacatgccgcaacaaccttgtccagatcaaacagggacagcagcgtttggtgatgagccgacgaggtgaaaagttgcagtaactggcaggtttgacggactccaggtcttgcctctagtggcggtcaagctgagataaggagtgacaattaagtgagtggatgcgacaatgctgtaaaaccgtttttaaacccccgggacctgggagggctgctgagcaaagttcagagttcacaaaccaccacacccagcggcaccatagacaccaagcagaacaggctgctgagctccggccgaccgaaggtgctccattctctctcctcatcattattgatatttgcaggatcgatcacttgaggtaaatcatagaagctcaaagtgaagtgcgaatatttttgaaaaattgagttttgttctgcttttaagctttgaaaagtcagatgtgttcgtggatgatcacataagcgaccatttgcctcgatcggttagcataggcagcatgccataatgttcatggttgtatatttttgcaggtaacatgggcctcacgtgtgatacacaaactgcaaaactggccattatactactagcattcatactgctatgtcatgggattggcaacgtcgattgccgtgggaacagagccgatcagctctcactgcttgatttcaagaagggcatcaccaacgatccatatggagccttggccacttggaacaccagcacacatttctgtaggtggcaaggtgtcaagtgcacctccactgggccatggcgcgtcatggcgctcaatctctccagccaaagtttgacaggccaaataaggtcctctctcggaaacctatccttccttaatatacttgacctcggcgataataacttacttggctccttacctcgccttggcaatcttaagcaacttcaggcactctatctgtataaaaacaatttgacagggataattcctgatgaactcacaaattgttccagcttaacgtacatagacctctcaggaaatgccctaactggtgcacttcctccaaatttaggctctctgtccaatctagcttatctttatctttctgcgaacaagctaactggaaccatcccgcaggcccttggcaacatcaccaccttggtagaaatctatcttgatacaaatcgattcgaagggggcattccaga

SEQ ID NO: 69692 - DNA, 58767 bp, Oryza sativa
  unsure (1)..(58767): unsure at all n locations
tggattgaataggttaaccagagatttttatcatcaggggtgcttgtggtgtggccttgacaagaacacctgaacaaccagagattccagtactgttccactagataatgataacaatgctgcagctgttaatgtgtgctaccgctagctcttcccccctttttttttgcaggcctgcagttttaagtctctattgctcactgacaaacactcacttagaacaaatgtctgatgatggggatattcttgttgtataaagtctggtgaggatttgtaggacagaggtgagaaataaaaagtgacctttaaaactaagtataccagcacacattcatgctctttttgtcatctcatttgctgttttctgaattttgaagtacatcgcccttcttttcctcgtcagcttaagctttttcggagcgatctggctggtgtacgcaactcgatattgaaatcagtaccgtgagtcaactaagtatacctgcacacattcatgctctttttgtcatctcagttgctgttttctgaattttgaagtacatcgcgcttcttttcctcatcagcttaagctttttcggagcgaactggttggtgtacgcaactcaatattgaaatcagtatcgcgagtcgtgagacctcacccttggtgtgccgcatttggcatcagcacaggtgagactgacatcatggtacggtggattcctacaactgcaagttgggcaccatggattttattttctgaagcttcctctccttagatgcaacggcagcgtcattgtgcggccggcaagtggtcagtccatgtccatattgttcggtgctcttcaagttcaggaaatggccatgaagttacagaaaatcatatacaaatataactactaattatgccaggggacagcaaaaaacccaattggctttaggtgcaacaaatgcatgaagaaagatttctccttgcatgatcaaaaatcagcacatgacaaatgtgccaactgatcggagcacctgcttgaaagagagctctgataatgtgcatggggcaacaaacaggtttagttcagactgattatcatagacagagaccatcagttcgcctgttacaaccaataggaattcaagaggaaaaaaggaagggcacgtgtcgaacgcagaagctcaaattctaattctgaatttagcaaatgctcataaaacatagctgtttaagccactgtagccagacatttcaactcatggttgcattgaagcttctgatttcaggtggcgcggcagctcgaaagcaatcaaatgctatccatgactggtcagaatcatgtactatttgaagaaggagatgattagaagttctttttttttaagtaaatttcacaaaattacaggtattttgactaaattgtcacaaaactatatatttaaggcgttgtatcacaaaactacagatttagtaccaatgtatcataaaactacagatttaaggttaagtatcataaaaatgcatatttaatattgaagttatcacaaaactacaacttttggagtttaaatccatggcaccattgttacgttggagctatatacattattgctttgtgactaaattggttctaaaccagtagttttgtgacagtttagttactaaacatgtagttttgtgacacttcatcttaaatgtgtagttttgtgataaatttagtgttaaatgtgtagttttgtgataatttgatcatagtatttgtagttttgtgaaatttatgcttttttttccttaaacacacaggagatccctgcatcatcattatattaaggaggacaaggatgattcagaagctcactatcttgattggaatccatgcaatggggcaagagcatattgtgcaaggctgcaagcataaattgtgtggatatatcatcatcgtcatgatcatctgattgctttaaggctggagaaccttaaaggctctgaaagcacttgaattggaagaattgccattttgcactccagcatcaacttctgaacttgaccctgactgaataaacataacaatttcttcttgtcaatatgtacatctgatgcaagaaatcagaaaaaaaaaatcatgccactcttttcacttcacaaaagactcttttattgacaatggcatctcagtttttcagtggggccttctttgcatgtttatgaactggagttataagtaccttgttaagggataatccatgctaattaaaatcacctgaaactgtgcatcagcaggtgacagaaactgaaagcaggaaaaaaatgcagaggccatcatcaatcacggtgtcacatattgcaggggaaagttgacacattaacacccaaaattgttgaagagatgctatgccatctgcaatcatccacatggtaatagagcgctgaaatcgactccacattgtacaagctttagcatgcaggaattctgttcccagacatgacggcttcatagagcaatagtctctgtctgactagaaagtttctgaactttgaaaaggcgaaaatatataagctactactaccagggaggaacacctttcatgttagaaaatgaaggaatatcttcaccatcttccatcattcttcacttctatatgttgcttaggatgctacctgctgcttgcgtactgattcttgttcttttcgttttcatttttatttggttttctaaagcgggttctttttttttaagaactcatgccttttattaaaccaagagattataaacagacataagcggatctaggggtggtcccggtaccactcaaaaaatctagcccaatgcatatatacctatgtgtaaagattttatttaccaaaatacatatcttattaatatattatgatgcatatttgatcaatttatacttctaaccttattatatttgcacacaagcttcctgtgcacactccgtgcacaccaactagcaaatgtcataaaaaattgtaaaaaaaaaattggacatttactcataatagtatttcacatatctaaaaagtctcatattcaaattcattatattttaaccgtaacaaaaaagtgaaaaaaaattgataattttaagggtaaaaatctgtcagaaatgtttctttttggtatggctaaaatataatgaatttgaagataagatttcatacgtaggtgtaatactgttggaagtatgtgcccaattttttctagaatttctatgacatttgctagtttatgtgcacggagtatgcacgggaagcttgtgtgcataggatatattctcatttaaaaaaggtatataagttggaccacatatataaacattctagatacgtcactggaaactgagtacatgagttatgcttgcctattcaagatacaggtttgctagagcacaaacagtttatatcggtatcttttaggtgacaactgtgcattctagaaatcttataggtgcataaattgtgcttcattatcttaaaaaaaaaagatgctacctgctgacataatatatcctggtcatcatcctgtcacgacgttttatcagtaacagtgcacattatctatgctcagctaaaatgcacaaaaatatatgaatttatcgaatttatggatttgccgctgatttctgtttctttgaacgtatgttagggagtcgcattcacgggtctgtgcatgtgcagtggtgtacgagcatatgcgtattgcatggtaactaaatccctgtctagtaaggcctataaagttttggcgtgcaaaaaaatctaataatccaaaaaatatttgtctttcactttgacatttgatcagccagatgctcctatgaaaccatagggatcatttttttttcccttagtaccttagagaaatttacgagtatctgataaacttgaattttgagttggtgggctggcatggcctaataggccctctatgtacagcccggcccaatacattgcagtctttgagataacaacgttttacatttaatatgcaaaacctaagtaagcagccaggctcaaactaagagcatatctaacagagttgttacttttaactctccaaatacttatttgaccaatttgtaaaaaaaaaaataagtggcaaatttacctatcactctagtagactcgccacatcccactctatataccgacggccatacatagaacccacctatcattctcctgccccttctttcttcttcctctcactttctctccaattcactaccatgcggagctccctgccatcagccgctatcccgtcaatccgtgcgccttcagctggccacctccctcatcaagctcctagcggggttcgactctatgacacgcaagcttgatgacagcctccccgttgtcgttgccgagatgcttctcattttcgccggttgtccaccatcgcgggtcacatcctcgctgatttgaaggttgcggggtggcggcccctccatttaattcttatccatgatttgggagatggcggtgtgatgaccagtgacagtggtatgagaagtggcggcgtgatgaccaatgacaggtccaaattcttctgtgttataggaggcggtgatgcaggaggtggtgacacaacagctagcggtaaccggtgacggtggtgggctcacacgggaggcgtcgatgctgttcgagagagggatggggagaggagagagaaggggggtggtgggacccaccatttggccaacgattttggcttgctaaatttggcgagcgaggtgggaaattcggccaacgatttggcttggccagtcacatggaaaatctataagtaaattcctcgtgtatccctaaaaactcactcaatccctttcatacctctaaaatttacctgatcccgtctatacccctgaaatttcaacttatcccttccatgtccctaccgttacatttccttcatttcactattacgtttggttgcaaatgtattttttttgcccttggtactttatgtttgaatataaacttgaaaaagattgaaaattttgtttgagtgtacagtatgtgcgttgtatgaaactaatgagactaaataattagagcagaaaattttgacataaattttgaaaataaaaaaatgcaatgaattaaaatttttatttgaaattttaataggacaatgaatttttttatagggagcattcataaaaaaaatattgtgagcattagtagtcctattttttatgaatgcccctcgttttttatgactttttaaaaaataaatacatattttttatttcattatccaaaaataatttttttataaataatgcattgcacaacaaactcataattataatagtctcatgcgacaaacttttacatttttaataatgtaattcataaatttttatgttcatctaaaggataaaacgatcatttttatagaaattagacggtcaactgacgtgaggggtatggaagggatcaaaatcaaatttttgaggtatataaggaagtaagcaaaattcagggacatagaagggattagctaaattttcagaggtatataagagattttctcaaagtctattggtctacagatacatgaagaaggaaaaacgaagctataaaaatgacctgggttacgaagatagccggaagacctcagggtggagacctctgcattacgaatctgcacaaacaaaaatataaaaacattaacactagtccctctccagaaaaacgacaccaacaacattagcatatgctctgcaatacacgtactactagatttgacatttgcaggagcaaactgaagcaagctgctatgccatcactcactgctgcttgctccgggacaaaggaggccgggaggctgaggaccatctgcaagcatgatgcagatgggtggacgcacagagagattatttcacgaatctgccgttgaatatttgacagcgtacgtttgtactctaatccctgaacattatattagttgtacaggatattttagatttggggctctaacctccgaagaatttggcccggtttagatttcaactttttcgtcacattgaactttcctacacacataagcttctaactttttcgtcacatcgttctaatttttttaaatttctaattttagcgtgaaactaaacacagcctttgaaggagagtgagtgacatgtcgaatgtcaagagatgattctgcgtggtaacagaggactcaactcaactcctcactggtgtccatttacaatttccgtggtcattttttatatcgaatatttctgttcacccatagaaatacttttttttgacgataaaatgtatttttacgacggtttagcacctagctaggcttattccgatgtctgatagtgcctctgcaataggaatcactaacgtgtggacccttaagtaagttgggcccatatgctagctagtcatagtactgcagaggatattgttccataacaaagggaaagaaccacattagtgcatgcctctttgccaaatggtttggtccaattacacgcatatgtgagagaaaattccttctatacccctgaaattttagctaatcttttatatgcctctgaattttgcttacttctttgtatatccccaaatttgattttgatctcttccatatccctcccgtcagttgaccgtctaatttctataaaaataatcattttaccctttggatgaacatagaaattcataaattacattattaaaaaatgtaaaagtttgtcacataagactattatagttatgagtttgttgtacgatacattatttatcacaaaatttatttttagataaataaataaaaaatatgtatttatttgtcaaaagaaagtcataaaaatgaggagcatttgtacaaatataggactaccaatgctcacaataattttttttgagtgaattacactttgggccatgttttattattaaactttcactttggaccacccaatacataatcttttcgctttagattaggtaactttacctttgttgcacaatagactaccctaactcttttcgcttgtgatgtctagcgtctcttttgacaaaagtatgtcatgcatataggtatgaaagtttgctggcatgccgttaacaatttgctcgaagtcatcgaagaaatgaaaatgtgttttggggtggtccattgtgcaacaaaggtaaagttacctagtccaaagtgaaaaaattagataaagggcggtccaaagtgaaactttggcaataaaacatggcccaaagtgaaattaactcctatttttatgaatgctcccgatcaaaaatatccgttgtcctattaaaatttcaaataaaaaatttaatttattgcatttattttattttcaaaatttatgtaaaatttttttgcactaattatttaagtctcattagtttcataaaatgcacatactgtacactcaaacaaaattttcaatcgtttttcaagcttatattcaaacctaaagcatcaagggcaaaaaaaaaaaaggcatttgcaaccaaacgtaatagtgaaatgaaggaaaatataacggtagagatatgaaagagatcaagttgaaattttaaggtatagaagggattggataaattttaaagatatgaaagagattaagtgagtttttaaatgtacacacggaatttactccatatgtaacgacgaccaacttcacgaaatacctagttactggtcgagacatataggatcgataatgacaccatcgtacgtaccgaaaacactggcatttggtgaccttgaaacatggcattaagcatataacctctagtttatccaaatcctgcgtatccatagctcggattaaatatatgtccttcgactatcttaagtcattttggatatccatatggtccaaccatcatcctctctacgctatattatcatcactatggttacactagtgattccttcaccatgaatcattcattgatataaaactgtgttttgagtctggcactaactactcatccggtcctgtcaatttagtggcccggagcaaagagaaagatgggtcctttaatacacctctgataatataatataatgatgtttcaaacaaatataatacataaaaaaatattcttatatcaaataagttgtatatcttcctctcctgaactttctaaatctaaattcctatactctatgggctcctatatccatatcatatacatatgagattgggtcccttggctttaagagccgagccaggtgcggttgcacagctcgacccccccccccccccccagggccgagcctgataactcgacccatgtcgctgttacacatagatttacagctccaaagtcacctgcagtaacgacgacgcctattccgatataatctccatgcgcgatgtggacaaggaatgaaaaccaaacactgtgcctgccagcatcctgcagccgatggcgtcaggatccacgacgcatctttccccttgcttttcgatcggcttaaagctatgctaccacacacagcgatatattcagatatgaaacgaacggtccaagcaagcaagcacagagacatacacacattgagatcgacagggagacgagggtggtgagtcccacgcggtctgcattgcagcaacgacatgccctacaaccaaaggatgtcggtatatatctccatctgtatagtagtatcttgcgatcctataccaagccgaaacaatatcgatcccatatagcatcttaattttcttagtttctcgatcccactatccgttaccacacgatcttacaaaatcttagatattatcctgattctacggttctacaaaatattatttaaaataagatggtttaaaaacaaagtaaataagtatgctgcacaggtttatataaaaatcagttaaatataacaaaactaatatggtttttcttgataaaatatctctatttgcatgacatatattattactataaatttttatatagaatggctatatgtaattaatacaaatattaattaaacttaaaaaaattaatagtatcctaatactgtgatacgatactattttgaacaaaacgatactacctacgatcctgatcctaataaccctgtggtcctcgcctacaactgcacactatagtgcattgcagatgagcagagacgacatttgccatcgccatgctgtgcgtcgacagtgtgcgagtactgtgtgagggagtgcaaattctgcagagatgatgcagcctttggccgtgtcgcctttagcagctagctagtgcccatatattcttcttctacctcgctcatcatcatgcagacaacccagaccaacccaagctaatgaagatatatatattgtgtgtgtgtggactgtggagatgaatatatatatacatggaggcatggtatgattgtactgcgtcaggatctcaatcagtgggcgtaaagtgaataggcaatttggatatttttgtatgcaacccctgatggtgctgatgctactggtaaaagtaaaattttagtcaagatgaatataaggttataatgaggaaagtctttgaaataagttatcatgagaaagacagtaaggttaaacttaagctctgcatatatcatgcatgggaaagtagctgagagtgtcgctgattctaactgaaggtcttatttatttgtgttttctgaaaaaaaagtgtttgagaatgtaaaatattttagttatctgaaaagatatactaatgctaaaaaaatgtggaattgctaaccttcattttacattatttttttagtatttacgggagggaatggggagagatttttggaccatcagattcgagttaagattcttacctggctctttgtcatccagctccgacgagcttctcgtttttttcggtaccagcgacaccccaacttcagtagaggtgatgaagggaaagacgatgcgccggacagggcacatcactgccatctatcttgggtaggaggctggtcgggacggtctcgtcggtgctggtagcatgggggctggttgctctagcgtatcgattatgagtgaggagaaggtgagggagaagataaacgaaggcagtatagctgcacgaatctcaaaatgatctggactgttcaaaaagtgaccgagatgcgcgagggtttttttttcaaatataacataagcactcccttaaaattgttagagacgctaaagtattctcattgtattgacatattcatagaattagtacattagtagatatagctagtgatatgtcgatttgaacttaatttggtgaactctatgcactacacctgcacctttagctcacacaggttagctttccagccaccatattatacatagttttaaatctccgggtatagctgtttgagaagtgtcctaggtatttgctctaatgtacaaattagtcattatagtttcatttagcccgttgtagctgtttgagaaggtgaaccgctaaatgtcttaacatgctatttacaaccataattatatctggtcaacaatcttatatttagcattaacagctaattatacattgacaatacaatggtcatgaaggcaaagcgtagtgcttttcgttggatgaacaattattgaagtcatatattataccatctgtttggacagacagttatcccaactagataaaatatcccgtgtattatagcaataattcgtataaataatttaagcatatatgtcacctatctggttttccctgccatccatgcatcctcccccacctagtagtggttctggtgtccgacgtcaccgaatctagcctggtagtctcttcttccttaacatccatgatgctcaatctagcacatattttatatgggcaaagtgataaggtatagtatatttctcctgtttcttctctccatatatcgcatattctctcttcaaggctgatactacctttcttccaaatgtttgatgttggtcagttcaattttaagctaacaaataaaaaagagtaaattacactcgtagtgtatcaacatgacagataggtgtaatttggtgaaagaacttaaggaatgagtatcctagtacaacaacttgataaatggatgcaatttagtgtaacactttataagtgaatgtatgagtataataacttgcaaggtagatacgattttggtacaataaattaagaagtgattcaataacttaattagttcaagaattttttggtatacatatttaatatttattttaacaatatactaacatggattagtgtaggcatatttaaattttcattccaataactgaaagttaattaaactttatttttcagaaaaatattatatttcgatttagattcgagaagataaaaaaatccataccggtaggcaaattggaagcacaatgtaattcttaaaaattaaattctaatatcggtaggattcctatgtgctgacatattaacatggagaaaaaaaactcacctagcactcgttaaccaagacaacacatgcttagccaagttgctacaccaaaatactaaattgtcaatttcttatattagaatgtacctaactgttatatcgcacccatgtgccaagttatttaaccgtagatacaattgacttaaaaaaataaaaaaattatgccatgtactcctacaaaacacaccgaaacatttttgtccgccctattttcttcttctctcttgttcaccatggctcagtttcaacggagccaccagccaagatggagcgttgtaaaaataactctaacacaccccaaggtcaaaaaggcaaaaaaaacgaccattttgcccccatacaattttacatcatgaaactacgcctttaaacctttttaccctgtataatccccaaaaaaaaaatccctcatctcaatactgacacgataagtggaaggttagcttgagcgacaatactgcctgcaaatcgatcaattactgttccgagtttcgactgtcaatctgacgacgatcaacgatagctcttctttttttcctcaccgtcgtcagaaaaaaggagaggacggggtgtgggcccggccggccggtcacatgtggccatcagatccaataataactttggaatgtattacacctcctctctcatgaaattactaaggccaccactaacaaagcacacgaacatgtgtacggctgacactacggattcaactaatcaaaccgttcaaccgtagtatggattaagaaaatctacatatatttttcagctttgtaaggtgtactagatggccgtgacaacgtgcgagttaaaggcagaaatggtacagcagttaattttgtgacgtgcattcgacccgtagcggatctagaaatattttggaccatgagtagacttcattatagctaatatttactgtagaaattttatttttatttttttctaattatattggattttagtggattagccgccgacgagcccgggcggctgcccggggtcaccgggtggtagatctgcccttgcatttatctgctccctccgtgcaaagacgtagtatttttagttagtttttacacacaaatataagtcatatttaatacctcaaatacaaattaaatgtgtattgctccttttatttgtgccatatggctaaatatttaagttttagtgcttctttgaaacacaagtgttaaagttggtgtcaaatacatgtacaaaatcggttatagtttaggacttggatttgtgcttggtattgtgatagaattataatcggtctatatccgctccatcttaaataaagaggatgcagttcatggctgttttagaaattccaaaattttcacatgaattggttcacattccaaaggagttcctaaaaaaaacctctgaaattccttcattccaaaaatatctcccctttgggctgctgcaatgcaaaataccagcatatagacgccctgcatttgtgggtggaggaagttagaaagtaaaatttagcatttggccacttcattcctaggatgtccgtaaaatagagttgcattatgtcctaaccattttgcctatcatcatagtaccactggtataaagcgatcacttgaaattgaaggcttcaaaatttattgccacttgttggaaaactgaaagttagtaatgacaacaattggatgcacatgtgagtgattgttggatatatggtaactgaaatcaaaacatcaaacacatgatccattctaactttaacttgtgcccctgctctattcccctgtttcatgccaaaagaaaaaaaaatgaaactgaaatgctgcctacaaaaactgaaatatgcaagtaattaaacttatgatataatttgaggtgctactgaacatcaaaatgagcacttacatatgcacaccaaaaaatgaaattaaaacaatgacatgtgcagcactatgatgtgtaccaccataaataaacacaactcaaaaatctatgtatacataaaaacaataagataaattcaggctttgaaatacaaatgactattcatacaatgcattgttttattcatcatttgtatatcaaattttgaggtgttctttttttggtaacacatacaaatacaattatgtgttgcgagacttaaactcaacctaacctaggttgatataggtagtgcacattccattttctctcccattgtctaatggaaaagaaccagtttctcagcttaaagtagctttccacaccacaacatctacaaggcaaagcgatttccccaatggaaaactggtacacaagcatggcacacacactcaactaagcttgtctcttgcaccccccccccccctaaactcctattttaaacaaaacaaacccaaaatcatctggataaacaaaagatcacaaataattaaacaaacacccaaatctaactttacaccatcttttgcctaccttttacctttacctttgcgaaatcatcatcagaacccaaccaaatggagctaagctctgctctcacttgaacacctggtcccatggattgcctatagctgattaattgattataacccataataataaattatagataaatttttcacatatatgctctcggcgacttaaaagttaatattaaaaagaatatatcaaaatctatcaacttcaaaattaaaatttaaaatttgacatcagcttataaatatagggcaaaagatgagagatcgcttatgcttatgcttatcagtcaaaatttaaatttttaacttatatttggagctgattttagggtttttcagtgaagtttatttttcagcatttgtttttagatcgctaagaagaactatataaatttttttcacaaattatgaataagtgaaacgttggggctatgtttgacaaataggatagggaaataattttccacccatcaaaagatatctttaaatcctaaccatttattctcccccttcatttaatcctaacccttcgttcattttactggggcacgaggcctgggattaccctgtccaacctatttattgccacctatccttatctcacctcgctgcattcgctcactcacactcacactcactctctctctctctctctctctctctcgacatgagaggcgccattgctgcggcggtgtgcgccgtgctgctgctgctggtcggcggcaatggcggcgggtggtcggcaatggcggcggccaccatggaggaggacaggatcgtggcgctgcctgggcagccgaacgtgagcttcgcgcagtactccggctacgtcacggtggacgccgccaggaggcgggagctcttctactacttcgccgaggccgagctggatccggccaccaagcccctcgtcctctggctcaatggaggtaaaattaaattaagctaataaatttatgtactgtacatttgtgcagtgtgcatgtagctgcattattggggggaggtgagattgctcgagcattcgagcaagaactgtgcaaggttgataatgtaatgtgggggaaaaaatgtgaaatcgagaaatgatagggagattagtttctgtgtgaatgagcctagagcaaaacatgtttaactttagttaattgagttaaaggaaagattttcttggtttgctgcaaaaatggggggagagagctttgtttttttttttgaattgtatttggtaattaagcttgtcaaatgaggaattctgtaaccagattctcattcaaagggagaattcgttcacaccggaattattggtggttaagattaactttttggtgcccatatgcaatgtgtagggcctggctgttcatcagtgggagtgggagcattctcagagaatgggccattcaggcctagtggcaatgtgctggtgaggaatgagtatagctggaacaaaggtgagaacttgtatgttgtaaaccacaatagagcaaactttttttcttttgtgccctcttttgctttctattgttcctttttttcgccgcgaaaagattgcgaggaacgaagaaaatttgaggcatctgttggatggtttttcagaggccaacatgctgtatttggagagccctgcaggagtgggcttctcctactccactgacccttccttctatggtggtgttggtgatagcaggacaggtgagttctatatatgcatttgccaaattatggctcaattttgcgcagagttagatttaacatttttgaggggcttttgaatttcttaagctagggacaacttgagattcttgcaaggctggtttgccaagtttccgcagtacaagggcagggacctgtacattacaggagagagctatgctggtaatttaaggccactccactgtattgtcttgttgctttgatcaattgtgaattttgttaattcattccctaacttgcactgtaagtgtttttcaggccactatgttccgcaattagcgcagcgcatggtcgaattcaacaagaaggagaagctgttcaatctgaaaggcattgctgtaagcaaatcaccacccccaccaagctacatttcactcaaaactcatgagatctgtcttggaattcctaattacaagatgttgtcatttggttcatcctgatcagctgggcaacccggtcctcgagttcgccaccgacttcaactcgagggccgagttcttctggtcgcacggcctcatctccgactcgacctaccactccttcacgacggtgtgcaactactcgcgctatgtgagcgagtactaccatggctcgcttagctcggcctgtgacactgtgatgacccaggtggccagggagactagccggtttgtcgacaagtacgacgtcaccctggacgtttgcgtctcgtcggtcttgatgcaatccaaatccctcgcccctcaggtgagagtacatggcatgcattttaattactgtgcaaaccgatgagttgcatgcgccaaccagttcagccaagagtttaagctgacaaggaaaagagaggcagttaaggcttgttgttttacatgttttttttttgtttttttggcgttgtaaggttgtcaaaatcgtgatcctgaatcagcaatcatagaatcgtttacatgaaaatcgtaaaattgttgattctacctatatagaatcgtggaatcaggcaccttaactaggatcgtaaagtcgtaaaatcgtatgacggaatcgagattctgacaacctattgtgcgtgttgcgcatttgcttttgcagcgagggagcagggagctggacgtgtgcgtggaggacgagacgatggggtacctgaaccggaaggacgtgcaggaggcgatgcacgcccgcctcgaaggcggcgtgcccaagtggacggtctgcagcaggtgcatttttcctcaaacttttatcagtaatccgcaatatgccgcattgctgctgctgctgctgctgcacttcagcaagctcactcagtagtcagtactgtgttgcattgcaagagaaattaagctaacattcagctctgcaatctgcatttgcctctgcttcagcaagctcactcagtactattgcattgctagagaaagctactccctctgttacaggttataagatcaaactgcttcaagtttgactaagcttataaacaaatatagtaatatttacatcatcaaattagtttttattaaattaataattagatatttattatttttccttattaatgtttttttttccttgaacaacaatgcacgtacatcgatgcagtgttctggagtacaagcagctggacctgcagatcccgaccatcaacatcgtcggcggcctcgtcaagtcgggcgtcccggtgctggtgtacagcggcgaccaggactcggtgatcccgctgacggggagcaggacggtggtgcagcggctggcggggtggctgcggctggggacgacggcggcggggtacagggtgtggttcgaagggcggcaggtgggcgggtggacgcagtcgttcggcggcggcgcgctgtcgttcgccacggtgaggggggcgtcgcacgaggcccccttctcccagcccgagcgctcgctcgtcctcttcgccgccttcctcgccggccgcccccttcccgactccttccagtgacgtcgtcccgaacgacgatgatcacgtctcatgtcaagcgcggaggtgcattgttgttgcgttgcaaatgcgtacgagcgatttcgtgtgcgccaccgctatatatagtactccgtattgttgctgggaatcgaattgtttctcggagaaaatctcatctggaaaatgctgatgtggggtggggaagatgactccatgccgggtttaccttgctctttagttcaaaatagaagtaactaacgtttgttacggagagtactccctccgtccaataaaaaaccaacctagcactagatgtgatgtattctagtactacaaatctagatatatctctgtacatattcattgtactagaatatgtcacatcgaatcctgattcgtttttttatttggacggagagagtatgctataagctcttgcagtttgggaagtgtgtgtttggcgaatgagggaaatttctcccagtctgcatccgctgaacacagcctgagcaggaattctaattttatccttttttttttctctttataatgaaaatcaatccccagcctcggcgtccagtacgtgtattctatatcatatactccctccctccatattttttatgacgtttcggacatcttggtgaaaattaaggaagcagtgatgttaccgttttacccttcccttccatcgctgcttttttcacgccgctgccgcttttcatccctacctctcgctcaggccgccgaggccctgcacggcacaacgctccctcaacgccggcttgctcgtcatctccccctcaccactgcatcggatgaccccggtcgacggtcgtggaagcggggcgaccatggaggacggcagggtgggcaagcgtagaaaagtttgtcactctatggaagaaggctgcacagagtggcggaggtagcggcggatggtcatctgatgcagcggcgccgttcccacaactgcctcggatgagcccccagttgtcttctctgtccccgaggttagtctttctctatcccacatgggcctcagttgaaatgcgatgaatttgaaatcttggtctaagatggtgtttgttggagtagataatgagcagatgacctcttcttttgaatctttcacaatgtcagcaccattagagtcgaatttttctttcgagaaatgttgtcaaatgacaactaagttcgtcaaagaacgtggttcacacttggttgaaagtaaaaacaaagcgtattaatattggatttttttagatccccattacatgctccttagggacaatttatagtattggtagtggtacaagctcatgcatcctaggattaataaatacagggaaatttacatggatacctttatgatagggacattttataaggacaactaaagtctatttggccacgggacccttagtgggccctaacatgagccttacttggtgaacatgcccttttaggctctctgtcctttgattccgatggcgaagatgccctggcttggtggcgaatccctcgtgcttcgcctagcggcttcgcccagggtaatcgccctggtcaccaatcagcacttcgcccccggcgtggttgtttcggcagtctcggtcgaaggctctcgtggcatgcctccaacagaaccactttgacaaaataaggattcacatgtgtttagattccctaatactgctgcttggtgttgctgctatctgctactaaatgatgttcctagctgctggaaaagctgctaattgatgttgtttgctgctgctatatgtgcctgctaaatgctttcatatttgcatttgttttcatatatgcatgatatgattcaaaattcagaagcaatatatttactccctgtttgtaggttagttattgttcacatttattttactcttttatgcaacataaatcttctagaatcctaaatattgttgctcctgcaggattactatctgttagagaattttatactatgtgccacctatactctccttccatcccttgcaattagatagctttttgcatgcaagttctagttgatgtgttcattttcagattaggaattcgttacacctgattccatttaattcacactttgaaattgccatagtttagtctaaggttgcttacagttaaatgatgtataaattggcaaggaattaactaactggttgagatggacagatggtctttatatgtggaggttctcaggtgcattttatttgcatatttgctcattaatagcgtgaatttctgcattttcagggtttctttatgcttctgaaattgaagacaatcgaaagttttgagaaactcccatataacaaaaaattggagtactccctggagtacttctcaaaactgactaaatgttgttgacacacaaattaaagtcagcatttcgctatcgccctggaaatttggaaaccgaatcccttggtcagctccagagagctgaaactgaaatggattctgatgacacccctgaataatcttccttgccaacctactccaagttacaaaaagttactatcaccgacataattccaagttacaaactcacttttcatgtccatggctctcaatccgtcactgttaccccaatcaacaccacgagacagtatcacaacctgaagcttcctaaattgaaacccaaccttgcatgattatgaatctctagcctctgaaaatgctattataattccgaagtccaattcctggaagaaaaaaaaaagaacttctagccgcgctcttcggttcaagttcccaacctcactctctcgtttaccgcgcacacgcttcccaaactgctaaacggtgcgtggtttgtaaaaagtttctatagaaaatttgatttaaaaaaatcatattaatctattttcgaagttttttaagctaataattaattgatcacgtactaatccatcgctccgttttccgtatcagaggtgtcacctaagaacacagccttaagggcctgttttgcacagctccagctccagctctaggagccaaacagtttcagctccatcaaaaaaaaagggagcgaagttggatggagctctctcatgttctgattctacacagtgatttgctctagctctagacggtgtccctgcagctgcaggttcaggtgaggcaaaccgtggaacgacttggagaggccgatcctgacggcccaggacggctggaccagggcccagcgtgaccggcccagcccatctcccctctttgactcctcttctccttctccactccatctttctctcttcggtatcctccacacctcgtcgccgatctcccaccccgcgcggcgccggcgcccgtccgtcctctcctctcctgcctccgccgcatcctcgcctcgcctcgccggtgaggaacccgtcgccgcacatccctctctctctctgtctctctctctctcgtctctctacctgcccggacctgtggaagattttttttcttttctctttggcgttaaacccctcctagatctggagcacttgagagttcctgctgtttcttggatccgtggaggccactactcctcctctcccgccttagcttttgtctcgtggatctgggatgggatgggggtggcttcttcacagccgagatccgtgtgccggatacgacggtgatcgaccgggacggtcagattgcatggttcttgggttcagtttctgtaaccaaatttgcgtggttctcgaaccaaagcttgtcgcggggggattcgcttcccgttcccacagagcgccaatcaaaaccgacgggatttattttaagcttttcccgattccggcttcgcccccgagttgtctcttgctcgcgtggtgttgtactacctccgcatagatgttaatgaatctaggcacacatatatgtctagattcattaacatatatatgaatgtgggtaatgttagaaagtcttataatatgaaacggaagaagtactaaatagcagtctgtttccaagacaatttgtgagtaaatttgcatttcaagtttttgcgccagtgtccggcagatcaggagctgtgtaaatttgcatcctcgcggctcttcaatccggtagctgccagcatttttcatgcgcctatacttgctgtaattctgaatgctagaggagcctcacttgttattgttatagtgttgaattctgaatgctagggcctcattatgtttttattgtagtgctgaaaaaggatctgattttgatacctagctactgaagatgtagtaaactttactggttacatgaagcacagattcagattaatcataagtaaagcaccagacctgttttaagagaatcgttggtaatcgtatttttgaactgctccatgtagaacacacaagattttgaggatgccgagggccacgagcgatgcgaagcttctaattcagtccctgggcaaggcttatgctgccacaccaacaaatctcaaggtattagttggctttttttttatctataagctgtcatcttaaactattggctaattactgatcatatttctgcagatcattgacctctatgtggtctttgcagtcgccactgcccttattcaggtaactcaatcaattaccaggacaccttgaaacatatattatctgcaaaatattttcatgctttcatgttggggatttttttctttgcaaaagcaaacatgagataaaaattaagtaggcaaccaaatgatagcttaacacgagggcggtacacagcagatgggcacgattaccctggaaatttgatgctttcctaatgctatataccgttttgtttgatggaaaacattcctatttgttggtgatagtgatatcgtatcacttattgttgacaaggatgatttgtcaacacagaaatttcttccacttttttatgcagagaaatatgttctagttcatcatctagcttacattttttttcatatatatatgcagctgttatggattactgttgtttgggttgatagacaagcacatgacctgtatttttttaatatgatgttactgtgtaatagagggtcagtcaatattcttaaagcttggtgcaattttttattaagctcctaatttactgagtgaacataagtttctgttcagttcacaagtcccttcttccatcactgttgcaaactagttggtatcagccttgttatgcttacagttccatttgcaaactattgaaatgctctcctctgacaaaacaggttgtttacatgggaatagtggggtcatttcctttcaactctttcctttctggcgtcctctcatgcataggaactgcagtcctcgctggtagggatttcttaaccccttctcaattccggttaccctttttcggttgtacgatacataactgtcaatgtttcgtgcagtttgccttcgtattcaagttaacaaagataacaaggaattcaaggtaactctactttcaccttagtctgttggggccattaattcttgagattctggcgtaacgtcgcatgccaaaacactatctgcaggatcttcctcctgaaagggcgtttgcagatttcgttctgtgcaatctggtgctccacttggtgatcatgaacttccttggttgatgtcctgcccctacaactgatcaaggttttgtagccccagtttatggtcactggtcagaacaccctgatgtttgggagtgtcatagtatgagatattcatatgatctttcacacttcaccgatgtaattcgacaatttttcgagaaactataagttctctacctgccgttcgctgcggcttatctttatatctgtgtatttagtgtttaacaatcttagaacatgtgatcctgttttcttcaagtgaccgaaggttggcaacatgctattcgaccatgctgttaactgttgtttgtcctttgttccaacgttgcctacgcatggattttacaggattttaaaatccctccattccaaaggaagaaatttgattgcactactgcaattcaaaacatttcttgcacttgcgcaatcccagtgacccacatgtaatcagaagaagtggagtatgcattgttctggttgtactcaacgagtgtttgccatccaaattatgtcgctagtattagtagtagcatatgtcgtgcacgctaggcagaaaactgaatactaccatgtgctgccttggtgagtttataaaaatcaccatttcatccaagaacacaaagctatcgtttccctcgcaaaaccaaaacgaagaaaaaaaaaacagaaaacctgaaatatctggcaggaccgactgccaggccaccatgccttcaaatggtaaacgaaatcgaaatgacaaacgagaacagtcattaaaaaacattccaattttccacccttggttgatctggcaacagtcactagtaaagttgcaactgacaattgacaaaccaaacaaaaatcactcttatttcagatcattatatattaatgctgctgggtggccaggatgccgtagcatttacctacacttcaaagtaagttacagccatgtgtaaaaagtattggaagccatctggtgcgaagtaatgtacaggtacaacagtgcagcgtttatcttactgctaccaaaagaataaatacacgtacttgaaggagtaaagcttctgacatccttttaaaaataaaagcaactcaagatctagcatacagtttgtttgctaaatgcatctctgttgattcatttccataacattcctactgcctctgttggaaaaaaagaggaaaagtgaaagcacctaaatgaagggagaatttatgccatctagttttaccatcatgagcgccccagctgagagaagagaaaaggccataattccagaacgacgatattatccttcaattagacactcagagcaggtgccagtggttccggaacaccactaccaccgttaagaactatcaccttgccctctgaatccacatcaacaatagcagagtcaccttccttgacctcgccagccaacatcttctccgccaagctgtcctccagaagcctcataatagcacgccgcagaggcctggcaccatagcttgggttgtaaccttcgtcgacaactctatcccggaacttctctgtcacctggaggtcgatgtcctttgccttgagcctgtcaaacacttctttgagcataatatcagcaatctccttaacctccagcttggtaagctgccggaacacaatcatctcgtccaatctgtttaagaactcaggtcggaagtactgcttcagctcttcagtcaccaagctcttaatcctattgtagctggtgtctttctcatcatagtcaaggtcaaatccaatcttccgtcctcccttctcaatgacactgcttccaacatttgatgtcatgatcaacagtgtgttcttgaaatcaacagtccgacccttgctgtcagttagtcttccatcttctaagatctgaagcatcatgttgaagacatcaggatgtgccttttcaatctcatcgaagagaacaacagtgtatggtcggcggcgaactgcttctgtcagttgaccaccctcagtgtaaccaacataacctggaggtgatccaatgagcttggagactgtatgcctctccatgaactcactcatgtctagtctgatcatggcctcttctgagccaaagtagtaggctgcaagagcctttgctaactctgatttaccgacaccagttggtccagagaagatgaagctagcaataggccgatttgggttcttgaggccaacacgagcacggcggatggcacggctaatagctttgacagcctcatcctgaccaatgatacgcgtatggagtgtctcctccatcttaaggagacggtcagactcatcagatgagactttctccacaggtattccagtccaagaggacacgatatgctgaatatctgcctcagtaacaaggggaccgacttcaccggattcagtctctgctttaaccatttccttgctcttgtcaataatggctgtaatttgggccttcaattccatttcccgatctcttaattccccagcctgtcaagatataacaatgatgagatagcatgaaacaaaatttggaagcaatagagttgattcaaaattgatgctaagtacctacattctagttgcacaagaatgaaggaataaaaggatggcttatagctatgatttagagtcactgggcaactttacaacacaaagtgcaaaaagccaaatcaactcaataggtttacaagtaaatagcagtgccagtaatatttactataaaagatcatttaagaactttatatgatttctgcaagaagtctatataccttttcaaaatcttggccacgtacagcctcgttcttgtctttggttacctgtcgaagctctttgtccagctccttggcttcatcagggagctgcaacataaaggaatcatgtctttagacagaaataatacagtgaatgagactgcaacatagaataatacaatgtagtacctgtgcatgcctgagcctaacacgagatcctgcttcatcaatcaagtcaatagccttatcaggcaggaagcgatcactgaagaaagaaagtaaaataagtttattagattgaaaatcaaatgattatatgtcaactgctgagaatttaaatcccatccaaaagttctgcaaaattaggggcatgtttggtgcacaccctaacattgccacacatgcgtgccaaaggtgtggctaacaaatcaatggcaacaattaggcaaggttttgcaaaaaaagagaaaaaaaaggagtgcatgatatttggatcctagggttaaaaaattgtggcatagcgcaaatgtggcaatgaaacaaacaatagcctcatgatagtttggcaaagtgtggtagtgaaccaaacacccactagatatttttatttgcaaacttataaccatatatcctttctagtccagaaatctgaaatggatccaagtcaatctttatgttgttcagcttcaaatagatcactgatatttaatttgcttccaggaagggatcctaaacagcatcatgcacagaatataaaatatattttatcttccaaggcattttgacagtctaacagataaagggtgaaagtcagtaagtactatcgtagtactcaagagttcacaggacactactcctggaccattaaacaatgcgcttacctgtgcaagcacctagttaccatttcagaaataagtatatgcttctcttcagaaaaaaaaaacagatatgtaaaagactaaacatccctatgcacaagagaaatatagtacggttaaaaatgatgccaattaacaagaataggtatgaattgatatagccacagtaaaggccaaaaattaataaagatgaaacatattagctaagaatgtgctgcatagcaaacctgatatactggtatgacaattgtgctgcagcaattaaagaatcatctgtgtatcgcagcttatgatgcagttcatatcgctcacgaagtcctcttaagatttgtattgtttcatcaacagttggctctggaaccttaactggttgaaaccgtcgctctaaagctggatctttctcaatatgtttcctgtactcatcaagtgttgtggcaccaatgcactgaagacagaagcataagaaatgtggtgaattaggggcaaaaacaggtaacaatcatatattgttcatggataacatgcaaagtggacaaattagtctctggagtcaagaggctttgaggcattctccggattaaaactataaatatgataaaaacataatcatggaagcaacagattcaaaattaggcacatatacctgcagttcacctctagcaagagctggtttcaagatgttggcagcatcaattgcaccttcagcagcacctgctccaattagcgtgtgcacttcatcaataaagagaataatgtcatcattttgtttgatttcctccataagtttcttcagtctttcttcgaactctccacggtacttggtaccagcaacaaggagccccatgtcaagagtaataacctaaccgagtaaaataccaatcagtattctgaaacaatactatgataattagaaagagaagcttcacaccactcaaaatcttataaattgtgcaagtctcattcaaatcagacgatagccttgagtcctcactggtcaggacacaataccaatgcaacaacattagttgcatcagtacacgatatcgagtgaaaagttgaattcacaattacatctggacaatgtactagagaaagctatccagaaagctagtattattcgtaaatgcaaacttatactataattacttgtctagttaatgaaattagcgagtttacccaaaagggtgataaaccctggaaaaagtgtcagcatgatggtactcatttgcatgcatatatgcaaaacaatggtgatgcacaggtgacaggatggtctaagctaaccttctttccttcaattgtttctggaacgtcaccattggaaatacgttgtgcaagcccctcagcaatagcagtctttccaacaccaggttctccaattaggcaagggttgttctttgtccgccttcccaaaatttgagttacacgctcaatttgatcctgcctgccaacaactgggtctagtttaccctgcagatgaaaatgattagtttcttgtctttgcttatttatctacgcaatagagaatgcacaaacaagtctgataaaatacctcttctgccagcttagtcaaattagtgccatactcttcgagtgtaggcatcttctggccactgcttccgccaccaactccagcaccaacagcttctgtgctttcaccaaccattcttatgacctgaacatcatatcaaatgtcattccctgcataattttaactgaaagtagattggctaagatttaaggaacataatagtaaagctatttacctgggtacgaatgttgtttggatcagcaccaagactttccagtacccgtgctgctacaccttcaccctcacgaagtagccccagaagtaagtgctcagatcctatatagttatgccctgaacaataaaaaatgatgaatattagacaaaagaccatgcatatttttctaaataactagtctcacaaggcatagattcaaaactcaaatgtgaatactttcttgaccttagcatcaagtcaacaacaatgccattgttaccttttcactttttttggcatacttgttgtacagtataagtgtaataatatgcatattaataatttagtaaacagtgccagatctgatgcatattaataagacctctagcatcattctaaaccagtaattattcataggagaaagaaagcatatttgtacatgattagcgattaacccaccacatgcagattctcaaccaatttagcactattattttgcatacttaatgtgaagtacgaaaattgagagcaggataatagcaatatgaaaccaaagcacatgctggtttgattggaaactagaggtatgtaagcaatatttcaggacaaaaaatgctataaggaaagaattaaagtgtccaattataaccaaatgaaactagctgaatctttgaacaaagagaggttatacctagctggcgagcttcttcaagtgacagttccaagacacgctttgcacgaggcgtgaatgggatctcaacagccacaaacccgctaccacgtccaatgatcttctcaacttccacacgggcatccttaaggttgatacccatagacttgagaacctttgccgcgattcctgtgccctcaccgataaggcccagtagaatttgctccgtcccaacaaagttgtggcccaggcgcctcgcttcttcctgtgcaagcatgatcaccttgattgccttctccgtgaagcgctcaaacatggcgcggaccacccctcttgaccccaaccctcgggggcgtgaaatctggctcgcgacaatagagccgaagtcacgcttaatcaccgacctcgagtccaggaaattcgtctgccgcaggccctggaaaccccccagggtgagggtccgtgttggcatggtacgcatcatcgtggccctcgcgcgcacgcggaaccgcgcggtgccgctcctcctgtatatggtcggagcaatcgcggactggactagcgacccctccataccgacctaccccaaaaggaaaaccccgagccacctgcccaccaatccaatccctgcaaaatcaccaaaatcgatcaaggtcaaacacataaccaaaatgaaactaagagaacaacactttctcccacggcctacatggcggtgagaatgattcacaagccatccgcgcatcgccgcaacgagaaaacctaacgttcccttccccccacaacggaagaagacctcacgtccaaaactccaaatcattatatacataataagaaaaaacaaaaatcggagcacacgtcgcctcgaaatggctccgctgccatttctccgacgagaccacagctctccccctccgcatcacgcgcggattcgattcgaggcacctcccatccacccggccgtccgggccggcggacgcctcccgttacccacccccctacatcgaccacgcgcccgcggcggccaccccatcccacatgctcgccggagtcaacccgagaaaccacccacccccaccccacccaaacagataaggccggcacccacaagcccggaccgcggccggaggaagagagagagagagagagagaacgcgagggctcacctggccggacctcaaccgcggcggcgacgagggggcggccaccaaccctagcagcgcggggggagggggggacggggacgcggaggcggcggaggaggaggaggaggagatgggagaggaggaaggggagacgcacccacgcgaggggaggagataagaagaggagagagaggagaggagagagccgcctcgactgacctgacccctccccacctctgcacgttatctccaaatataccggctttcccttttttttttcttttcctccttttatctttaccttttattttttacttttacttttgtttttttttctttactctatgcgggcctacgaccaaggcccgttggcccgttcatttgtgcggtgggccggcccacctcgtcaactaactatttcaacaaggaataagttcaccggaggtccctcaacttaacagcgagatttttttgagatcccttaaccacaaaaccagaaatcttcacccctaaactatacaagactgttcactcaaggtccctaggcagtatatatgggcggtttcgctgacgtggcaacctagtcagcaaaaaaaaattaaaaagtacgtgggacccacatgttagctgtacctttttttttcttctcttttcttctccttctcttctcttttctatcttctctccttctcttattcagtgagggaggccggcggcaggcggagcagcgcgcagatgcgggtggcgcagcagagggcgagcgcggtagcggagcggcgggtgtgagcgcgagcgcggcgacgggcgagagcggccgcgggcagagaagcagagggcgagtgcggcagcgaagaggcgatgggcgagcgcggcgacgggtggagcagcagagcggtggtgggcgagcacggaggcgcatccaccccaccccagccaaccaaagcacgccctttgccctcggccgtaagcctcaccgccaagtcgctgtcctccccgtcgccatcgaccggcaacgacgacttcgcggcgctcctcgacacggagctcgagctcacctccgtcgctgactcggcctccgccagagacccctccgccactagcgacgactacaaggaagacccctcccagccttccctccttcctcctcgagctccctcgcgccggcgccaccgccagggacgggaagccgacagtgatggccgtcgtagtcagctcgcttgccgcggcaacgctggtcccggcgctaaccggctgatgcgtctgcggatcgatgccctggctcaagagcttgcgcttgatgtgcgtgttccacctgcagaaccaatcaatcagcaccaagaacacaagaagagctaaccggagcagatgacaacacgttgaaatttgttttgcttacttgttgccaagaagggcgtggagcttgatggtgagctcgtcgtcgtcgtcggtgaagttgccgcgcttgaggtcggggctgaggtagttcatccagtggaggcagcagctctttcggcagcggagcagccccaccgccttggggagggagagagggtcgatggggagagcgcgccgcttgtcggcaggcggcggcggggcccgtggtcgagcacccggcgcgttagaacatctccaccaccgagctcgccgtcgcgccggccgccacctctcctcctctcccgccgccgctatcacgtcgaccgtctctctctccctctcccgctgccggccacctctctccccctctgtcactgcgcctactcaagacttgagagaactcggagagaagagaagagaaaaagaaaaaaaaaagaaatgcggaacccacaccattgtctcacttacatgtagaccccacatatttattttattttattttattgctgactatgatgccacgttagcaaaaccacccatatatactacctagggaccttgagtgaacggtttcgtataatttaggggtggagatttctggttttgtggttaagggacctcaaaaaatctcgatgtaaagttgagggacagccggtgaacttattcctttcaacaaaactgtacaatcctgtccagcaatgtgtcatatccaatcacaatccctcatattttaagataaaataattacttctataaattaaagttattattatagagaactgcaactgataatccctccgtttcatatcgtttcatattgtaagactttctagcattgtctatattcatataaatgttaatgaatctcgacaatatctatatgatatatgaatgtgaataatgctagaaagtcttatattctgaaatggagaaagtattatcggaatattgcaagctttggttgtcttgtaaaattaggcctaacatgtactacatatatttgtagtactcatggtttgtcaagttggacccacatgtcatatgtacatagcgcataaaaagttacagttttctgataaatgttttttttctattgttgcaattttgtgaaaaatataaagttaacgttgtggttaagtgatagttttgtttaaataattgcagttttctctgaaatttactgttgcttgttttaactccatgcgggcctaggaccaaagcccatggcccattcaattgtgcggtgggccggccatatcgtcaccgactcggaggcccactccgagcgcgaggcgaaccgcctccaacctgcgcggctcaaataccgaccatctcccaacccaacccaaacccttgtacaaatccaaacgaggcgaggcgaaccttcgagaagcttcgagaaggttgtggttgaggtcgaggaggggaggggggggagatggcggcgggaggtggtgggggaggaggaggaggaggaggggaggggttcgaggagcgggtgaagcggctgttcgggtcgaggctgttcgacgacgtgccggggtcgtccttcccggcggcgtcgtggtcggtggcggccggggacgtggagcggcggcggtgggcgaagccgtcggaggcccgcgacgaggaggaggcgagggagggggccgacgccgccgaccgcggggacacgccctgcgcctccgcgttctacgacgacaacgggtgcctccgcgcggggacgcggcggcggcggcggagtaagcaggaggagttcgagggcgacctcgatgaagaagacgaggaggaggaggaggaggagaaggagaggggtggcggcggcggcaagcagcagcaggaggaggacgaggaggagggggttagggtttccatcggcctcgacccgactctggatcgagaggtgagagggttaaaaatcactttggctcttcttgtttatttgtttattttattcattaatccacacgattagtagttcaactttaccatttcattagtctagactagattagggcgtggattaggaggggatcaactgcttgttttgttatgttcatatagtctatgagttcacacaattgaaacatttcaactgtaggtttgttcatcggttctcttagccacgttcatttctaatggagaattagagatgattgggggggtattgtagccatggcctgatcttttattcatgctaaattttgcctgtgctgttgttgcgctggggttgtgtcaagtgaaactctgcagctgaatctgatataacaaataatatagtcgtcgtttcaaagggaacacctttttattttcttcactacttaagttctaatatgagctgtaaagaaagttactacatccatacatttagtcagtatgtggcctgacttaatggagcgctaaattgctcaaaccagattctggatgagaattttctttttgccggttacagtttgttattgtggagtgttatatctaacaagatttttatccttcaggaagaagaggacaagtatgacagagaggcatttggtagagaggatgcttttgaccgtgtatacatgaatgaaatcatggatgatggcattaacatgagcatcaacactgtggtgcctgacatccttgatgattccgttgaggagatccaccgcttctcaagggatcccagagcagatatgggtgcggcatccgcaagactcaaggagtacgatagttcagctaaaggtggcacgtgttctctagctcagccaaatgaattcccaagtggcaggatacaagcaatgaaaaccgatgatgctaacgtgaaacctatactgaagcggaaggaggagcaaggcgattcaaagccaaggaaacgtgtcaagtttgctgctgatgttaaggaccaatcggcagagctgcctgaacaggatgaagattctcccatggttcctcaatccatggatttggtcatagggaaggactcatccactccatctgagtctcctggggttcctgactatgttaagaaccctgcaaagtatacacgttacactctggacactccagaatgtaacgatgaaactaacaggagagcttttgccgacctgcatgatatattaaggagaatggaaccagagcctgaggcaccaccagttgagatacctacttcagttacgttcatcccacggaagaagacaatcgatgcaatgacagtagatgagggtcccaaatccaatgatgcaaactcatctctcattggtctggcggcaggtgcctctgatgaaactgagcaatgcgaaatggatgaagatgatcctaaagcattgttaccgccacaggtccaaaccaacacgaagatgaactcccgtcgttacagatcaagtagaactgatgatgagtaaaattgacggtacccttgtctcttcagtttaatgttgtaatacaatctacaaatttgaggttccaatgttggagtagttgctatgcaagttgaggagatatgttgatgtacttttgctttgatcttctgatctgagctaaccagttataattctactgtggtacttattgtttaattaatcttgtactgggagctactgtggtcctgtggatgttgatgtaaacttttactggtaagctgactttactgaatcatctctttctttctcatgtcaaaaatagtggtttctatcgctatcagttcttcactatacattcagaaaacaactttaacagttacagagaaacctaatgagactgcaggtatgcacttgcaggtgacctcacttcctcagaaccaagatccatcttaaaacacaatgttaggtcatcgtatgtacagataaaaaagatcgtttaaatgctgttggctcatacatctcccaagagaaaaaaacagctcattttcttcttcagaaccaatggcaagagagagaaactgaattgcaaaagaaccctatatcaatctgtacattctgaatataaccccatgcattttccttctttttcttctttcagggagtaatgaattatttaccgagctcaagacatctacagtggcggctacatcttatcagcgattctgtatagggcatcagccaccttgccaagcacaccaagtaggctgctcacttggtccttcctctgctccctgtccagttggcagttgatgttctgcgcctccagctgggctgcaaccatccggctgctccggtctaggatttcgatcagctgcccctgcagatcaggagcttctcctgaggcgtcgtcgctgcgctgcctcttgtgcgcgccctgagctggtgagtcctcgacaatttgttccggttgcttggctctggacgtccccgctgtcaagaaatttagatggttagataaatgcagtttttctgactttgttgcatgaatgtgcaaagttctagcatcaaaggggctttcaatgtttcaattcaagataaacacaatttccctttttataaaagaaaaaaaaaggctactataacttttgtttcttctcatgaggtgatcctgaagtttaatactcctgctgtgtatcctactgctgttgatttatgtttttgttgcatattagactatacaagtatctctgaaacacacaagtaaaaactagcgaggaacaggtcgctgatcatgtttattcagtactgtatcaagtagggaagatagcataatgtaatatggaaaggtgaagtgaacaggataaatgcagtgaaataattatacttcttccattcatttctttatcacaatacttgaaaagaagctttccaccttgctgggcaaaagttaatgatggaatatccactgccctcatacaatttctgaaaaaagggtcactatgcgctgaatgatacaatcagttcgctggtactaataacaaaaggctcctagtctgcatcttttgcattttgggcatttattctgaaccagcactgcgtgaaactgagtgtttctcggaatgtcgcaaacctgctaaaatttgatgcttcacatgtatgttaataaattcaacagacaaactttacgatcgaatctgttgactgccaatttattcattttgttgtcaaatgaagacaagccacaattgctgcctgtgattaattagtagaaatatgtttgtgctttcacccaaggtccttgggtcctagattgcttcatatattcgggactgtattgtaagcaaagtcagatacagttctctcatagaacaatttgacaagggcacaacacacgcgtttaaggtataatttgatttgatcttttagggatgataattaccattgagttctctttttgtgttcaggctccctacaattctgttattagttaatttctattttcatatctaaactatacgcagtgacacaatgtttaaatattgctgccaagaattatctgatcaaagcaatggaacagtaaaaaattgtggaagatcaggggatgctgaagcacatgcaaaacgtgagcggggaaaaaaaaggggagaactgcaaggtagaaatccggttatttatcagtaccttgctctgaggcatcttgcctaggtggatcactcttcttctctgcaaccaacaaaccacaggagcaaaaacagtaatcagccaaccaaaaacaaacctttgccaggtgaaaataaacatattgatcactttttttttaaaaaaaaacagaagaaacagaatatccattaggttagcaacaaagaccaaaaacacaactacttgcaaattccaactcttcagagttcagaccaccacaaagaactgaacaagaaattttctgaaaaaggaagatgggcatcaagccatcaagtgattgaactcacagggaaattcgatgcataacatgaactgttaccataaaaaaaagaacagttgttttgcaatcgaaacgtcaatttttataggcaactaacccacccatcacacaccccaaattcagttctttgaagtacacaaattcgcagccttcttcttcttctttttgtcaaccaagaacacaggaaagcctcaatttttacgtgcaagaatggagcagccgcgctcaccggatgtcaggacgggcaccgccggcgccggagccggaggtggggccggggcagcggccggggtggtcgccggcggggtcgcctcgtcgtcgtcctcctcttcctccgacgacgagaagagcccatcatccccgccgccgccgccgccgccggccgcggcgcggccgctgtcgaacaccgccgccttctcctcctccccctccttccccgccgccgccgccgccgacgcattaccgccgccgcggccctcgaggatgtcgtacacctcccggtcgaagaaccccggcagccgccgctcccgccgcgcgtcgttgcgcatcgcccagaacgacaccttcttccccatccccgccgccgccgacgacgacgacggcgacgacagcgagcgctcccactccctgatcttcttgtagtcgccggcgaggttgctccaccgcttccggcactgcacggggccccgctccagcccgtgccgccggcagtacttcgccaccgacggccacttggtcggctccgcggcggcgccgncgncgncgncgncccgnccnctnccccctccctcgcccctccaccacccgcttcccctctatcagcaccagtatctcctgcctcgtccacctcggcagccgcggcgccctccccgacacctcgccgccgccagacatcgcgccgccgggagacctcgtcgaggagagagaggaaggaggggaggggcaggaagcaacagggataggaagaagaagaagaagaagaagaagaagaggaggaagaaagggtgtggcttaacacattaggagggagtggccttaattatgactagaacaacacaagattatgcctttagttaagccttaattaagaggattagtgggtggtctctctctctctttctctctacttgtctttctcctcttcccaaagagggaggaaaaggaaagagtggttgagggaggattaacaaggggaggcttaattagtcactagggtgtgtgtgtgtgattagaggaggactaaactagtttaggagagagtattaactaactattaatattaagtagtgggtgtggatgggggagggggctccaatgagagtagccacctactgttttcagttctcagcaagagggaagaagatagagcactgttgtgatatgatatgcatcactttttctacccccttgatgtgcttgttaattctaaataaggaggggaataggaatattggcatttggtgtggactaggaaaaaactttagtggtgagcaagagcaagcacagtttgacacttttttggtgctttctgtccatgatatctttgcaaggaaaatccttttcttttcaagaaagaaataaaaaaatcttttacatgcaaaaggagaagaaaaaaacactggagaatagcacagctgaatcatctttctgtttattttcttctggaaattcacattggcttttgcttgctgtgtgacagggacctattaagggcaggcactggagcagaaaggagggatctttggtcggcaatggccgtatgggcatggtgtttgagacgcggaaggcactactgtgtatgaaggcaactggccatgtagagtttcagttaaggcacttcgtttcttgcacaactggggattgtggccaaccaggtatgtgtgcattgccgctcctgggtcgcattcctgtccaggtctgtgtcagccaccccatccaggtcccaaccatgaattggattaaccggataaggcctctttgaaacgcgggatctttttctatgtttctatgaaattcatgcacgtgttgcaaattaggtcctaaaatgttgtaattatcgcaccacacggtttagagtctagtttttttttttggaaaaaacataatgatcattttgccaagttcttttgtaggatatttcccgtattctatatcattttacactcagactatattggtgagaaatctagaaagacatgtctccctaaattatcattatttgtttcatgtgagaaaaatatcttctttttctacactaacatcaagatgtccaacttggttcatggtttttgccaaccttccaccattgagagtacatgcatgtaaatttgatgaatgacacatgaaaaacttaggtagtcacagactcacagttgttgcatggtggagcatgataactgataagaccctatttaggattatttatcttcaccaccgaggattgtataattcgaccttcattgcaaaacatttaagtctaggaaatcttcaatacaaagtatttctagtgaaaaggttatgataatagaattcacgctttcgcttttcttgtgaagaacttctaatatcttgtgcttatgctcgatgggaaaatagaaatcatatcgtatgagaatcatgaagggaactactatgatatattgttcaaacttagatcggacgaataggtttttatgcacacgcaggatcatttctttttttcttttttttttcaatcagggacctgccaatatgaactgacaccgaaaggcttaagggcaaggaaatgctcaactggaggagattattgttgctaactagtcatcgttcgaacttaaacagaataatgataacacaagcataattatcagtagatgatggtatcgcatcattggatatgaacaacggggaggggagttttaatttctttttgtgtgttcctatcaaaaaaattggttttgctgagctctcttgcttcgattttgccccatcaaatcgatttcaagccaggccccggtttttgcaggcaagattgtgtgaaggacactctctcaaaaaagcaatgatttaatgaggatgggacggaggggcaagaaacgtctatttccaccttttggccctccaatatatatttcaacaaatatatcctttgcttaaggtacttttgacaattttttttagtgattggtcttataaattttgcatgtctttttagtttttagtggttggttgtaggtcaagatgtgctacagtgatgtaagatactccctctcttattaatttgatgttgttttatttttagatccttgagttggcattgataattcactcaagtaatttcacatcacttgaatttatagcacccatagattttgataagtcatccatattcgactttcatagtttaggatattgtttcaccatacaaactctaaaatgtcaaatagtagaaaagaagtccccatgtggattgcttgctggtacaacacaaggttcaccatatttaatttggttgcaaatattctctaaaaaggaccatgaagttgatatattgtcccatataaatttacctacatgtcctattagataggatggattgagatcagacgggagggaggaacgtggtgcgcggtatctagatgatataggtctgactagcatgaggactcccaacatttgttacttcttctagtgtaactttcatgtcaacctctctgttgggaccctaacttctcctttgtgatggccaaaggggtcactgccctttcagccacaagaagagattgcaacccctgtggtgtggataggtggatggatgcttacatttcccattggaaggaccatgactggtgactggatagatggggttgagattggcctctcatgcaatgccctataggattctggtagggcctcaatctttgagaggatatgttgttgattggtggtgcctccctactctcctagtgtttttttttggcgctgctatatattttgataattcgctgatgggtaaggttttttcaaagttgtggataggccaatgactttctagttaggaggttgtttaacctcccttccctactcatggctacttcaaccactgtttgatggatgctagagatcttagcaattttcagaatatattagaaagtgttaaagtcaagcctacatatttatttatcaaattttatataataggtgtcatacatacatagatatgttttagccacattggataacattgggtagtcttcattttccccttatgtattagcaggaaaaaaatattttagcgtttggtacaatctccaatatgacccatcactccatcaccttctgttgttgtggatgtgtagctgtgtaaaaaaaagtataaattattaagtattaaaaaatattttatgacaaatctagctataccatttccaggagaccaaatctaaacatacaccctgcatcaaaggggctttccttgatatgtgtacttgttcttgtattgtcatgatgtggtgaactgtcatttctctacaatttcttcttattcccttaggcatggctagcatttactaaaggctagctagttgtaacacagaaaattgtattacctgaagaaagcaatatcacacaaaaggttttgtaggaaataaaaacagttgggtgtgttagtgcgtactgtggtgtgtccactgtggaggcatttgattcctagctctcctccataattaggatataaatcctaggtcatggggggatcaccctctctgtaccccacaaccccacaacaaaagtgccttgcattaccatagtcatcgacaacatcagggagatttggcatatcaattgtagggtcaacttacacaatcttctttcaatatgttctctcgaattttgtacaaaattgtcaattaggaattttgcagataagaagggatgacggtgggtgaggacgtgtctaaagagcaattgtagccccctttcgaaaagctaaattattttgtggttcctaagaaaattttattggagaacgaatttggaaacacaaaccaaacaagccaggtatatgaaaaatatttgttttcacagaaatatatgcagaactattacttcctccacttctggtcataaaaacatatcgtggtggacatcaatgtttatgtaaaatggttcattgacaactaatttatgtagtactaatatatatatttgtaaaaacccaacaatactacaaaagtagctttcgagacatatatatgcatatattctttatatttctgatccaaaaatatatttcaaaacaattaattctcatatgccaaacataactagtacatgttttgtgacataggaatccctagtacatatttttgtgacacaggaatccctagtacagatgtggccacatgacacagatagcacataacttttagtatgtgtcccaacaactaccagagatgcatgctctgcccatcaccgtggaaatgacaatcaaaatcctaataccacactaacacatacttatgttttccattgcaattggtgcacaactcccttttctctaggccaaagagaaagaagaaacagcataggccaactaaacaataacagtatcccttcgtctttttcttcctttcatggatgggtatattgttgcctccctttcaaagtgcaggaaagcaatcctatccatttgcactcatatgtgaaattaaaatagaaattggcaccactgctgtggtgcaagaaaaagccatataccggctctctgacgacgacatgacactgcccttgtgtaaggctgatggcttgctgatggtcatattgctagtgtcctaataacaatgattatatgtgtgaagttgttaaccagttattagtactaaaacttgcaaaagaagctgggtgtacatgatacaaaattcagatggggctcacatgatcaaagacagacagctagggaggaaaggattagagaaggtcttgcactctaggggcaatcaggctgaaataataatatgatgttgatgatgataggtacacctgaggcctacagttaaagggcttaaatgaaatatatgcttatgggtgtgcccttatttcttttccatgattctttccgagtggctttcggttgcaatgatcccttcttttcttatatatgtcttaaagaattgtgttattctctacccataaaaggaaatttccttgggggttattttgactgatcttgaaaaaaaaagttcatttatacataaatctgcaaagcgacaagtggatttattgggaacaaagtgtagcaaccagggtttaccaaccccaaaaccggcgatccaaaaccagcggtcggcagtttccatccggtaaaatctggtcaaatttcataaaaagattaatttcagtttgatcttttctcaatttgattgaagaaccgagtgggttgtattattaagccagtctgggaaatcgattttgcgaagatggaactggtttttgtcggttttgtaaaccctggtaacgactaataacaccatgttcggcttataatcatcccttaattccccaccacttaatatgagccctcaaaaaacattctggggcacttagaacaaactttggacattcacttatgacaagaacacttatcattaggtttttcttttttcttccactgactgaagctaagaacaaaatctaagcacacatggacaagcagcgaccaaagttctgcacgttgtgacagggcttcactttgttatactctatgcttttaaccagagcatgctacaatcgcagtgtgctttcttgttcgatcgttaatttcctgatgcagatttgcagagttcttgctggtctcaccgtctcgtttctggcttcttttcaccattccctgttcatcttcatcttcaggaatcaggacagacagctaactacaaaaacttctgcagtgcttgaagttgatgttttttttagctttaccagattgtttttcaggtaatcatagatacatgaactaaattaagtaagcgtcagctgatcagcttatggcctcgtggagaaggctatgtttctttcagcttgggattattataatctagattattaaatcagattactataagctagattgttataatctatagtagaataagcggttagttgtttctttcctagattattagagcatagattattgggtttgtaagtctaaagagggagtggggtggcatgatgggtaatttttcatccaataatctggaaaaagctcacctaaggccctgtttgattcagcttaagattactgtaatttagattatagaactacattactataagctggattataataagccgacatagaataaaatgctagctatttgtttctctagattatcatctgtttgttagttgttagccacccaataatctaaaaaagcacctttagagtggcttatcagattatagtaatctggcttatagattataataatctatgacaataagctatttgtttgtttcagcttactcctaataatccagattgtaataatcccaagctgaatcaaatagggtctaaatgagcttatcagattataataagctgggctctagattataataagctaattcaataagttgtttgtttctttcagctttaccagattgtttttcaggtaatcatagatacataaactaaattaagtaagcgtcagctgatccagaagtagagaagatttagctgagtaacagagcaagatactggagtgataccagattcagaaccgaaactctacaccactaaaaagcaaaggatttttttttttaaaaaaagaaggaacaactaagtgccaaagtgatgatggttaactcaagtactccctccatactcacaaagaaagtcgtttaagatagcgatacggtcttcaaaacacaaatttgacttcttgtttctataaaaatatttattgaaaagtgatatatgtatacttttatgaaagtattttttaagacaaatctatacatataatttttatattttcaaactcaacaacttgagagttatttataatttatattctcaaggtttgacttaaacattatcctaaacgactttctttatgagtacggagggagtaccagcaaactgtcagttcaaagcacaagtagcaacagtattgaagctctggaattcaaagtttgttgctagctgcgagctgtaactttcgaccagatcactgttgccaagccatgcatggacccacatatctattatacattaattttgataatttgatcctttgcaaaaactaattttacaaataaaccaccgccaaaacttatttcaaaagtgatattttttttcagcgccaaatcgtgtggcgctgaatttagacacctcagcgccacgtcacctggcactgaatgccgtgccaccgtggatggaaagctgagtcaacgtgacaacgtacattcagcgccacgctatttagcgctgaggtgtctaagtttagcgccatacaatttaatgctgaacaaaagggtcatttttaaaataagttttggcggcggtttatttgtaaaattagtttttgcaaagggtcaaattgtcaaaattaatgtctattataacgattgcagggtgctgatcctaacatgttattgggccacgtggcttcctataaatgaagcttcacctctctgtaaatctgccgcatgtctccttgctctcctcctgctacacctcccgcatcatttcatcgagaacctacgcgcaaatgctgattagcacccgttatcctcacggttgtagagtttttatgaggtcgggttcacttttaggaaactgtgagattagcttttccacggggtgaggcccacgtctcttggacgatgcatgatgcatgatttaaaataatgttaaaaaaacaaatactcaatgactcaattggtacaaccacggtgcacatacatttccgtacgcctttttcacagaagttaaaaaatgataatgtggaagtgaaatacatttccatgcacaatactccctccatacccataaagaaagttgtttagcacaatgcttaagtcaaaccttggaaatataaatcattaataactcaagttgttgagtttgaaaatgtaaaaattatatgtatagatttgtcttgaaaaatactttcataaaagtatacatatatcactttttaataaatatttttatagaaacaagaagttaaaatctgtgttttggagactgtgtcactgtcctaaacgacttcctttatgagtttggatggagtatatattatactgataccaaatgaactctcagataaatttatatcaccaaaaaaataatcatttaaacatatagtagtgcatacaaacattcagaaatgtaatacaaatatgatcttcaagataagtacattcaaattccagagtattgcatagaaatgatttcttcaagaaaaaaaatggtgtacttcgagttttgaaattcgttgtaccacgagtactagttgcttgggttcaaatttagatttaaattgcaacacttatgaattgctcaaaaggcaaatatatgtacgacgttgccagaaaacacagaatacatttatctctacagcatcatacatagatgcattaagtgtgttctatgtacattttgcacaaggaaaaaatgttgaatgcacagtagtatacacgtgcattcaaaatgtaatgcgttatttctcacaagaaagaaatgctactacaaaaattcatttgaactgcaccatagtatacacctgcattaaaaattagtacattattttcttatagaagaaaaaaaatgccctcataatacatttgaactgcacaacatttatagacagatacatttgaattgtgttattaaaaaaatggattttatcatttttatagacatacggaggaagggcagagccaccgcctgactagcccaagtggccgcggaggctcactgacaaaaactccattaaatttataagttattgaatgaattgatgatgaaatttatataacaaatactagaagcgaagtttgctcgggctcaaaaatatttctcgctccgccattgtgaggagagataaaatgggaatactagtttcattactttggttcattggaatttgtgcgtatatattcgacttccaacttatgtccatgaattcaatgttttgccgctttgaataaatatatgaataaaagggtaaagtttcacaatttcaggcattaaatagataaaaaaaataggtttacttatcagatcatatcatttactccctacattccatattaattattatataaatttttcaccaagaccaagaaaaggtattaactttcctatatttcatttagtgtgagtatgtggtagggaaaaatcaagaaacatgcacactttgggcttgtttagatctcctggcaaaagttttcaccctgttacatcgaatgtttggacacatacatggagtgtttaatataaacgaaaaaaataactaattacatagattgcatgtaaattgcgagacgaatcttttaagcctaattgctccatgatttgacaatatggtgctacaataaacatttgctaatgacggattaattaggcttaataaatttgtctcgcagtttatagccgcaatctgtaatttgttttgttattagtctacgtttaatacttcaaatatgtatccgtatatctgatgtgacacgccaaaactttacacccatggatctaaacaccccctttaactcctgctgggccccatacataagaaattttcatgcttaaatgcaataatattacaagtcaaacgaaggggctatgattaaatgtaataatattacatgtcaaacgaaggagctatagttacatgatggtcaatttgtaaattttaatttgtgttaagtgatgatcaatatgaaacggatggagtatttcatactggctggtctattttctagtgtaaatgaatgtatgagatttatccacgtcaccgtaagtaaaacatctattttattttgtacggtagttttcatttttcactacatgaagttgtggacggacataattccttcgtggaaagtttgctcttttaagaacgctagctaagtagtactagtttctcttcaaatagaggaattcggctcgatttgaagatccagttttgcaatgccatcgagtggtttttcccaaaaggtgcaaggaacagccactgcttcacattttgtcagaaactggtcttggtttatgaactcaaaagggtcttgagcgaccaaaaccagcgagatgctcatgaagaaaagccactgctttcatcgaaagaagtctgagcacacaagttttcagcattacagtgttttgaacaaactagcagagccaatcccaaccagagaaaaaaattcttcagaaacgggaagtagacctctggactttattcaagattcgtccaaattgaccgactcatcgcatattgtaagtgattcggtgatctaataaccccttaattagcatcaaaatcatgagtttaatactcttactatggacatggaagtagtcactgagccccagagtagaagctaaggccctgatcgaaagtgctggctgcagcagctgcagccagtcagccccaatccaaaccaaagagcggcagctgtgaatggcttgcagcagccagcacaaccgatcaagccctaaatgttatgtttgggaagcttctagattcttccagaagctccaactccctccaaacactattgcaccttcttccagaaacgctcgagctctcctatccagaatgaactaaaagctaagagctgggtttcttcttcatattcttagaagttgactaccaaccaactgtttctcagaattgctccccaaacagaatcaaaacagaatcaaaggcttgtagcgtggagcgaaattcgaaggtggaaaaaaaaatcagtgtaaaatcctctcagggctaatcactatgagcgtcattcggtttgtaggatagaagtataggaaaggatagaagtataggaaaaattaaaggaaagttttctttcctacaagatgtatagaagaaacataagaatttttgtcatctactcaaacctcctggaaaaatttctatggattgatgtgtgcaaacatttatattcctctacttttcctattcatatggattcaaattcctccgaaccgaataataagtcattattatgcttggcgcctctgtttcgcgcagaaaaaaaaaaaaggaaaaatccaattcgtcgtgggccagttgagccgggcccggcccgttaaggcctcgcggttcggaagcccatcatctcatccggttcgttatttttatttttctcagggaaaaaaaatccgaaagaagagaaaaaaaaatcccatctcagtccgccatggacgcggagatggacctcctcgccgacgacgacggcggcgaggccgagaggctggaggccgcggaggcgcaggccgacctcctccgcgatcgcctccgcctcgccgtcatcagcatcgccacctccgaaggttaggcccgctttctttggttcttgggaatgagggggggggggggggattggggagggaggatcttcgcgaatgcttcaactgaatgaaaccatggcgccgccgtgcgatttcttgccaggaaagaaggcggggatggaggtctccgaccccgtcgtcgcctgcatcgccgatctggcctacaagaccgtaggtacgtataaatatgagtaaatatctcccaaaaccctagactttttcttgtgttcggcggcttgttcgtgccaactgtatcctgtttcatgatttgttttcactctaaattgttttgtatgtgtgtctgtactccatcttcaatgatctgcattcatgtccatgtgcataggtttgctcagatgtctcctgtaaaccattccaattctatcaactacagtgcttaggctgtgttcgtttgtgtgagatagggtgagaaaacaccacgttttccgcgcgcacgcttcccaaactactaaacaatgcattttttgcaaaatttttctatagtaaagttgctttaaaaaatcatattaatccatttttgaaatttaaaatagtttatactcaattaatcatgtgctaatggctcatctcgttttgcgtatcttcccaatcttctccatcccctatctctcaaactcaccgtgtagagagttattggtttttaacattttcagcttgttctctttaacagtagtatcagtttcttttgttcttgatagttgcgacagtggagctttgttaaataggagtaggtgctcgttgccgaaatgcatgtgcagagaagatgaaattagggtgaaatggtgaaatttatgcgtgatttgctctgaatgactggaaatctggatctccatagctaaagacctttattagggcatcttcatcaataaccaaaagggaattccattgcttctgttgtcttatcattcacctgcttctggacatattctacattctaaacaactcctaattcgagtaacctagaatgtattcatagtattttctctttgaatatggggaagttaggtattagttcaatgcatccggagtcaaatgtggtttatatagatccagctatttgagatatattctggatatgtgagatatgaataaattgaggaggccctttcctgcttggagattgtttcctgtcaccgtacgggggtatattttctgggcctaatatacttgccagcattaactttaccgaaaagacctaaaagctctgaaactcaaggaaataaagtgaactctttaaagaaactctgcaatatgtcgatgaatgcgctatattcagttgaagcagaataaaacagattgtcctgttgacatccatggcttttaatcaggtagttccaaactgttggcaacatacataacaggtaactcagttgcagcaagtttcattaaagatcaaccccatcctgtccataaacatcagaatcacatctttttagtgacaccacatgaagatagaattatagaaagcaatggttaaccacccaatcttgtaccccaggcctcttcagaaaagtacatttcttgccagttgccagaaaagagtgattttgtgatgacagtaaagcaggggcagcaggttaatgaagcagtagattcaaaagtaacatctctgaaaataaagcacatataagctctactgaacttctagatgatatagatggttatgggtcttgttagatctttgattttttttaatcatggtaattctaattaacatctcttccgcaatgtgcagagcagctggctaaggatgttgagttgtttgcacagcatgctggtcgtaaatccatcaagatggaagatgttatactcacaggtacattacgataccgtgctcttctgatcccaaaagaaaacatttttattttgcttcgtaaaatacttgtttgcatcttacttgctgtgattgttgcgacgtaattccagcacatagaaatgagcatctgatgggcctcctgcggacattttctcaagaactgaagggtaaggagccttccagcgagaggaagagaaagaaatcttcgaagaaggacgacaacgtgatgcaaatctgatttaagtcatgagataaatcttcttcccatagaacaaagtggtaggttcaagcaggaaactctgcaagtaactcaggctacccactgatcctgtatttcacacatttagatgtggtatgacacaatgttgtctgtggaaagtggagatccttcacacctgtaaattcactgaggctgttgtgtcaagtagtaaatggcaaaattcagagtttggttcttacacgggatcatgtgctgtcacactttctgataatcctatgcctcctgctgatgtttgctcaactgaaatgtgcacagaaaagaaaggataaataacaaaaaacttccgtgtaagtttagaactagtcactaatcagttctgtgacaatttgtgatgtttggttaaccagggaaaagaaaaaactgatggccttgaagctgtataagatgaacctgtcaaactttgatgcggtaaaactctcactgaagggattctacagatatcgtggtattatgtcagaataagttcacttaaggtcccttaacttgtcaccgaatctgaaattcatccctgaaccgcaataccagatataacacttccctcaactctcaaaaccagtgcaaataaggtcccaaggcagttttccaggtgatgtcgtcggcactccgtgatgactaagtcgttcaggctatccgggcgggccgagcagtggttctaggagagcgtcccctccccatcgccgccgctgttcgccgatggcctcgaccccatgttcgtcaccacatacgtcgtgcacctagacagccgcaccgtcttcatgctggaggcaggagcggcgtgcgacgaggagaggggcggatgccgccggcagtaggcccgtgggggtgggagtagaggaggccgtgccatccttatctccgccgacgagaggaggaaggagaggggagagagatgaagacgggagatggggagaggaaggggttgagaatgacagctggggcccacgtgggccccaccatcaattattattattattatcgaattgccacataagcgccacgtcagttaaaggccaagccaaattagccagtaggtgccacgtcagctaaaaccgccatctaaatcaccataggacctatattgcactggtttgataattgagggacccattgtatcttgttttttagttaaaggatgaaaatcggattcgttgacaagttaagggaccttatatgaacttattcctattgtgtctgaacctgaacagatggcccattgtgaaaccaacacattgggtctaaaggccaacatggagcccataagcagccatcaagcagggcccataagcccatgacactgctcactttgagcccatatcaggcccatttctatcatatctttctgactgtcttcagagttcagaattcctcaagctgcagcaacaaatgggcgcgctaccaggttccaaccagtcaaaataacccttttttttctctgcaaacttcagaattagtataagcatgcagtgtgccggtcttctctatctatattaatataaaagatggtatcaccaccaccatccaactaccatgcggaacccatgaactgaggtgcttgtcttgtttcttactttccacatgccatagatcccgtcgaaagaaaaacatgataatagaatattatgaacatttttatctttatggaatgacaataaaattagcataaatgtattagacaattgggaaaaagaaccgttgcaactcacgagtattatgctagaataattataagggaaattcagactgatattttccagggagggtttcatttgagcaagcgttcttggtaagttatacagagaactaattccagcaatgcaaatttcagaacaaagtttgtttgaatactgcacacattattggacaaaaaaaatgcaaagtcaggttgaccatttgaaattcgcacaatttttttttgtgaggaatcttgtactagtacaaattattgggatgcaaactgcaaagtcaggttgtccctttgaatagtgtacacatcaatccctttcaaaataaataaattttttatatattaatctgaatggaggttatgtctagactcgtgtataaaccttaatttattttgaaacatagggagtacacatactggataattctgagagcaccaacatacacgaatttgtgcctgtaacgtctctctgcagcggcaaacagcaaactactctactcaattctggtcaaagattctgagtctttgatctgccaacctctccaaccacacacataaatactctatgattaaattaggctttgtgtcactgttaacaagatatctggtcgtctgacccaacttgctaatcaggttgattttgtctgttttttcaagtcttagccacagtcagatggagagttgtcatcgtgccatcggttgattatttcattggtctcttctgtgttgttggaggaacgtgatgaaaagaaaagaaaccccaaattaatattatgtttgaccaacacggtccccatatttaaattttagacgatccattcgaatttgataatgttttaagcgatgttgtgtagaaggcgacgaccgaatcgggtgtcacgtaattttcatcctaattaatttagattcatttgaatcgaacagatagactaatgacaaagctctcattattgttgcccctccctccaaagtttgtaaaatatgtgtaaatatatgatagagttagagttaaattctgtcctaagctctcttaaatagggaggcagacctgttgtaactgcgtgacaactaacataggtgagcgggaacggctaccggtgacattcgaccgaagattgttgtatagctctgataccacttgttgtaaaacgagctccgaaattgacaatggtagctaaatgcggaatagctgatttaaaatcccgagcaacaacaggtcaaattcgttgatggattcaatgagttgtttggcagtacaaggtatatctaggatatgcgggttggcatgatgggatataaggaaatttgcgtcactgaagaggaagagcaaacattattatggtaattttttcaggtgattcgaggcgatggtgattttctaatattatcatggattcggtctaaagaagctggaagcacggatgttgaatttgttagctcggttcataagacgaaaggaagaaaatgttctctttgtgtccggtgagtttaatttatttatttggtgatgacattagttatttggctatggattaggtcaagttaaattaaaaatggaagataaaggttaacatgatattcaatagtctgggatgtaccagctaggaaggaatcaattttgctttgtaagatgtttgcgatgatagaagagaaggtagagcactttgcaggtagagtcgagagaaaaaggtcatggggatagtggagactcttgattacggtgagcatagtgaaggcttgtcgtgagcaatagaaagaaactaacgcaagtccagatacacggtggttcgtcaaggaacaaatcatgttgccatggcatattcgtcaagatgaagattgttagaatttatgttgaacatgtatacaaagtcggctgcagtttagatattggagttgtaataggcgtaggagagagttggagttatactttgtcttaagcactctcttaaatagagagacagacatgttgtaatcgtatgacgacttagcataagtgagagaaaatggctgccgacaacatccaactaagggtcgttataactatgatgcgctgtaattatgttggatcaggagaagtattcataataagtgctccaaagatgtaaattatgactgaactccattattaaatatcatgtctcgatgttgtcgttagttttgtatatgctatgatgttcttctgagtttagccaccgatgtaagttgtgaagctggttttataacatatacaactcgtctactcctttggattactatatacttgtcgctgttaaccagccttgactgttaaccagccttgatttaattataatcactataaacttttaaattatcgaatttttgttgagcaaaagttgtatggttatatttaacatatatatgtacaacctacttcaacgatattcatactttgcaagcacttacaaacttatgaaaaataagaacagtcaaagtgaacatatataatagtctctgatgacaaatactccctccgtttcacaatgtaagtcattttagcattttccacatttatattgatgttaatggatctagacatatatatatatatatatatatatatatatatatatatatatatatatatatatatatatatatattcattaacatttatatgaatgtgagaaatgttagaatgatttatattgtaaaacggaggaagtatttaagaacgagggaactaatatagcacaggagatcaagacgaactccgcatcttgcaccacaaagaagggaataacaatgcaattaatcatacaaatctttgttgctttcatcgtcacacacatgctgacatgccatcggccttgcactacgacagatgagctgagaggttgtttgattggcatattcatattgctaaagctgatcatacttctattagctaccatgcctaacattaagtggtcaacaaaattaaaaccacatgaaggagcaagcttgtcacgcttttgtatgccaacaggatggatctacagtgtaaataccgtgtcagttgacattgatgactttgataaaatctacggttaaattgtttgtctatatattataacactacgatctaagtataactaggtgaaaccccgcgcattgctgcgaaaattcagtatgataacaataaaaagaaaacgtgtaagatagctagataatatcagattaagtaaattaatgtggtttatgataatttaaatttaaatagtatgtagaatagtgattcaaacacaaaaagtaaggtggtatgactttatggaagaagaaaagtagggagatagtttggaccgtagattaatcatctaaaggctaaaaacaattaatgtgatatgacttaattagagggaaaaaaaggagaaatataatttggaccataaattaatcatttaagcactaactaagtgaggatgaactatataagtatataggatatcataaaacataataaagatatacattgaaacattatgtgaattatgttggatgataatttaacatgtttgtatttgaaaagctcttgaattataaaaactataaagatatagcatgtttgcataatgtttaaatgtgatgattgttagtggatgatgatgtggcatcttgttagtgaatgataatgtggcatctttgcatgttaagcttaaggagttagtgggggataactttatagtaagataggattagcatattatgatatcgataggcacgttatgacaccaacgaaccaattttttttttatccgccactgtgcaaataacaaacacctaatttgcataaaacctgtttaacttaagttatgacatggttaggtaaattgcaaaaagtgaaccacacaatttcaagcttgctgaatgatgagtgcatgcatacacatagcatgtatgcgaatgacacgtgggccacccttcgccaggaaaaccacccaatcacagagcaacacgtacccctgctgattcctagtacctgcataacctctgtagagagagagagagagagagagagagaggacaaaagatgagaaggcaagtcataaaaagcaacgacgagctcctgctatacttctcagctgcctctgccttgtgctgtgtgcatcgtgcagctaagcacaagaagcaaacaagcagctagcacaaagtgtgattgatcttttgcagtttgctacgctacgtaacgtaccgagtagatcaaggagaaagaaagaaagaaaagcttctttaatttggtcgtggatcccagtaaagttcagtagatcgagaggtctggataaggatgtcggaaaagataagagatgaactactcctatatacaactaccaagtgtcactggttaattgtatactccctccgtcttgaaatatagctatttttagcacagtgttttgtcccaaaataaaactatttcttcacataccttatcctctcaaccaatcacaatcacaaccaagctggcagtagattgcattgcattggctgcaatctccaggtcagccagagcatgcatatctctctcaagattgaatagccagcaattagtccacgctctaatttgcataaatcactactataaaagtgatttttctatacgagaccccttaattcttacaaacggactataactagtggcatctgcaaaaatcgagggtcatttttgcatgcggcccgcgcatagaaaaatcgattttcccatacgggcctctttaagacggcccatgcggctcacttaagcgcccgtatgaaaaaatcgatttttccatacaggccacttaaggaggtgtatgcaaaaataaaatttgaaaaatttgaaactagtgtatctcactcatatgaactacaaattagatgattcttttttctaaatgtttctaaaatcatgctctatcattgtgttctt

SEQ ID NO: 69693 - DNA, 2410 bp, Oryza sativa
tatggttttctatgttgttgtatagatcatttatgggcatatccacgatgacaacttttgtaaggactactatccagtgatgtaataaagcagtcactttcattccacatttattcgatgtgtaccagatgatgcggacatcactaactcggatacacacaacaatcctccaacggtcattcaaggaccgatatcaagagctcgtgcgcgacaattaaatttagaggtgagctcgttcctatgttcttctttgtatgaattcgagaatagattgctacctaatgattatattgtgattaggaacaatggaggggacaaggagacacttggagaaggacttagagccatggaggatcatcgaggacgtccaagtcaaggtggaggcccaaaccaagtcgacgtcgggtgcaattcggagtccaggaccagtctgcactaaaacgggcgcccaggtcgcatacgtactcggattggggcgttctttatatgtatggatagctaagaagataacatttccaatggttttggtcccacatccaaattctttccgagtcaacgggaattgaccgaacaagttgatgtccagaatctgttccggtgttgtgtcaccgtatttgggcctttggcccgtgtatcgtgttggaacccattagggttgcgtcgagagggggttgcacgaccctaaactctatatatcagtatccgccaccatctttaggtttttgggttttgcttagattaatctgtcgagaacagtttcgccgctagatcggtttgtaagaccccaacttgtgagcttaatcattcatctgcaattttggttgtttctatctcgttcttgtttgtgttcttcgattggcaaacagggattagccttctcggcgaggtcatccgcatttcggcacgggtgataaccagaggagatgtggtgctgcgattgcggggctcaagagcgtacgcgttcaagaagccggatcgatttgtgtcgcgactccgcccaaatcgttgtttatcagaacctttcggaagatcgggaaccctagtgcacatcaagtggtatcagagctctagattcaccgtcagattcgctcagtttctttgccctagattagtttttgtttttcgcaattatcctagagtctacagaaaagccaaaaaaaatttagttgttagttaccttaacctagaccgtgtttagcctttgcgtgattctttttcagagtccgtagtgttgagtttgagtcctagtttaagttcatgttgctggtctagtgcgtgttttagtctaatcgtgtgtttgtcctttgtaaccctagccgctacctttcatcgtgtgttagggttcatcctttgagagccgttttcgacatcataaacacccatccagatcaccacgcatcaccagaacaccctacaactccgctgccaccatatcccaattccaccgcataatagactaggttatatcccccctggaaaacctagccggaagcagaaacttcaaacagccataacttttgcatacggactcagaatcaggcaaaatttaactttttggataagagaaaaaaatttgagctcacgacgcgctccgttgagcttatctgccaattcggttttgtagtttttgctgaaactcgccgaagcttgcctgcaagtccttctttgctgcttactagtgtcatttttttttcttgagccataattgttaccactactgtctaggacacgagtaggccagcaactaagggcaagtgacttgggatttttattcagcattactatctgtcattggattgtgtaccactcatatacatatatttggccttcctagctccacatattacttctggacagcacaggttcttgatccctgcaatcgctgactacgccttccaggtatcctttgctttgctggtaagaaccttataagagcttggttaggaactccatattgctgagaatcgttgagaggcaccactacacctgcgtagtagattattagggataaccttcaccgttttgtttctgttttggtgtttcaatgtcaggtaacgaaggtgagaagagtccccaggattttgctgactgtgtcagccaagagcaactacgaactctccaagaaaatactcaaaaggacatcacggaggctgttgcaaagtctgtccaagatgccttcactaaaatcggcttcctgaaccacatggagaggttggacaagcggatatccacgctaactgatcgggtcgccgcgttggagacaccttccaatgaggaagtggtgagtggtgacgacgatgctcatcctgaagacacggtgtatgattccagtggttatattgacgcactggctacaaggcaagcacggttacgacgtcgcctacgcacaaaccgcacaggtatgggtggc

SEQ ID NO: 69694 - DNA, 4330 bp, Oryza sativa
actatcaccaccgttggatgtggggtttgacgtggacgtcccagatgcatccctgatggcggttggagggcatttcggacatttcccctttgccaaccgtcatacctacccctatataaggacctcatctcactcacttcaacacacacttccaagcttgacctgaattataagaggctctattgtactatattgtatactagaataggaagagagtagagtagaaggagtcggaagaattccggagttgtcggtaatcttctcctattttttttattctgttattactctgaatttaatataatgtttctcttgagtaatttagatttatcttgtgagaattatctcttggttagttcctaagtagcatacggaattattgttcactataatgaactaaaatatagtgattgctttggtgagttataaacactaaagtagatattaatagcttagacgtggtgtttaggtaattgttatccagtaattgctgcgtatcccacagtacgtttgaggtaggtgtagaggtggtgatagccctcgagatcacttaagtcctccctgtctgggtacgtagtagagcgacatctgagaacagcgggttgccagtgcctgaagtattgcattaggattaaagttaagctttccctagacactgtttctcactagtaaatcctctctatcctggcctatcttttgcttggtgtccttggatgaactggaggaagatttgaccacacacgttcccttggattcgatacccttggaatactccgtaggggaagtgctacatcagtatatccgtgcgcttgcggattttatctgtgactgtattaaataccaacatggagccgagccgctgacagcccgatcccacgcctccttccctccaacagcagccaacaggtgggccctccctgttgttgtccagtgttggaatattcccttcccgttaataaattgatttccaatattctatcaaatgctttaatctttgaaaatccatagaaattcaaccgtaactccgtttgaccccgttcaacttcccaattttttttctaaaaattgagatctaccagtggcactgttgtttctctgatttgagattgttttattgccttttgttggttagttttacttttcgtgtatagagcccgttacgaggaagctccggacgccgcttttgagggagaagatccattggatacgactaccgaggtagttttgcttagccatgcttacgttgtatagtcgtgtgggaaaattggattattccaattatatgcttaaaaatccggtacgttgtaccgatgtgttgtgaaataaaatgtgttgtgaaaatggtgatgatgcgaagtcatacctttgtcgtttggctatgtattgtcattaaggaccgttttctttgggaaatctatccaaacacattacagtgcgaccacatgggtgtttatgagatgcctctggctaagtaaatggttatcacatgggaatttggtgtgccaatggttgtggaatgccgaggatgaggagatgaagtttggatctttacagcccttttgggcatctttattgcctctattgtggcacacgatatataccagtagaagtagaagacatcctcggtatttcctgagtggatgaaggctgaccttgcctgatactcggctaagagacttagcccaactaggtggtgtcgacgagtgatactcgtggaccagatgagttgagtattggggtacgttggaacgagggtctacgtagtacgacatcaagcaaacagaagacaaggattatactggttcagaccccttgtcaggtaatagccctagtccagtttatatagaattgataatgatgggaacatattacaaagagagtagtcgaagcagacgatatcgacgagatcgtagtcgatggcttcgacgagatctcccggcgacttggctccgtgtactccgcttcgtaaactatggtgggtgtgttcgcgatggaattggatgcttttcacccctccccgggggtcccttttataccgtggatcatcttgacccccaagaaagatctaagtgtatttgatctggtacagcataacagaaactctatcccttccaagtaggactttggaaatcgcttgactcgtagagatattttccataatttgggacggatttcaaacgatatacatgggaacaatccgtgtacgtgaaggtataccttatcggtatattccataagtcgtaggatagaaggtatgccctatccgtaaccctgacaggtgacatgcaattttcatgggttagctttggaaaggccttatcacgaacttctgttgctgacgggtaaatggtgtcaattttgtgtcgtgtgggtaaagtgcacaacctctgcagagtctaataaactgttcaacaagctgtgcccatggtcaagggcgagtgcaaggtgtttctcatagcgtagttttgattgacaaaatatttgtggaaaatttttagtgggaagggtaacgtttccagagtctgcttatgtggcagatggctaacctttgtggttaggaacgggtctcttaagaaaatagatgcataacggagacacgaattttacgtggaaaacccttacgggaaaaaaccacgggcgccgaccgcaatgatcagtatagaggagttggatacaaacacagtggatacattggactatcgcaccctccccgtgcggcttacaagggatatatataggagaaatcaagaagtcctagtaggcaaagactcgaagtcctaatagtaaactaatcctataatgcagagtcctattagaaaactaatccgaatatactgtgagcccaaaattcggatcacatatttaacaatctccaccttgagacgaatttcccttgtagcataaaaatcttcaatctccaaacaacctcatgatgataatatcaatgtgcgccaaatagtcacttggactataatccataataacacccttgatccagaagagttagaccatacttcaaactcgccattgggaacaaatcctgaatctactggtataatttgtggaaccctagcagaaacacgaaacactctaagtgtataaaatgaagtgcataaaacgaagttgatctccgtataaacctcctggtaaatttggcttgtgaatatagcaattgaaagtgagttggattcaccaaaacataaccggaagcactgcaatttaattgatatatggtacgaagaacgtgcacaatctgaacaggagtgaattgctccaaatcgacgactttggcttttcctgtcctccaggtgcatgcaactagtagtggcttcagccctgtatatttttttttctttcccagcgaacaggcgaacaagcagtgggaggacgtggacaaacagatcgaatcgatctgtagttgcggctaacgtcgacgaggaacgaggaacaacacctcacgctgctgccggggtcttgacgctggaacgatctgtatgttcagccatgcatgctgcctttattcccttattttattttttttatttttaatgcccgagattgatctcgatgacaagccgctgcgctgcgcccccgccaactccgcatcaggatgatctcggcgacagaaaacaactcgacaagaggacaaacccaacggcgactgggaatagtagatcgatctccaatgctctgataccacttgcaacggatagatttcttctcatttggtaacttcatcaattcccatttttttcaagtgactccatctcattatgtatagcagttataaatctatctattgcaatcatcagaaacaatagcctcaggatacgtagaaggttctgtattaccttcaatttcttctgccacactaaaagcataagcaactatgttcgcttcttcaatatatcttcgaggaggtttagtatttcttttgagcttatcttttgcaatagaatgttttgtagactgctcaacaatagaagaatctgaatcttcaataacaggtgcatcttggttaatagcaacatcttcgttttcttgtgcacctggggtgtcgtcaggcaccaaggtgttgttagggccgagatggtgttttgatgtgttgatatagctaggttaactatgagaaatagtgttgttgtaataatattgctttaatctagttgttgtgaaagtgaaaagaaactaatagaggaaaacaagtaattattgttaataatcattgtgacaagttgttgcaaagtaacttgtgaaatgagacgaggagtgagcctcctcccaacagcaaaaacttgactcaccagaagttttgtaaaataaatatatt

SEQ ID NO: 69695 - DNA, 2841 bp, Oryza sativa
tgtccatatctaacattttcgttacagacctcaaacagccttcaaagcagtacgtatgtcctttaactattttacatcctctagaattaaacagaagctcatgagagcttgactgtccaaaaaaaagtgtaggtaaaatagcggtcaacactaaacaacaaagtgcaagaaaaagtgctcttgccgggaacacgcaacactagttacacagcatcttttgtgatgcgaactactctagctgattctctccaccaaagagcagctcgcaccgtcagctccatgagcttgactcctactctcctataatcctaatctggtgagtggtgactcctctcctataatcctaggaataatctggaagaacagaaactaatgataatcctaggagtaatctgctctcctataatcctaggagtaatctggaagaacagaagaacagaaacaacgataatcctaggaataatctggaagaacagaaaccaatgattaaacggcagtaggagtacataacactacaagcaactctgacaatcagcagatataatgcataactgcagagttaatcaaaatgacatgcatcctttctcttggatggaactatgaggaaactcaaaatgacaagtttcaatttgatagaacaaaacagattcatgcaacaatcagattttacgatgctcataccagagtttaatatttttttagttattgaactaagtaatgatgaaacttggcttctctttttgcaaaactggaacaatcatactgaaaccagatctcttagtaccatgggtaaaagaacaatggtggtcacctattcaaatacaactaattgatgtgtcgttactacaatatttgccaaaggtagtgaacggtgactggtgactggtgagatatgctatatgataattaatctgagcttgtaagtaatgcacatactgctctagttcaggtcttcaggaatcaggataaacctaacctctaatgccctaactcactcaacaaaggcacaaaacctgttattatgtttatagttcagttataagataaactaacaaaaataattctagaggatgtaaaaaagagcaaataacaaacatcaatgcatattaaatatagctaaaaaagttgaaaatatgaatagccatagaagctaacaagacagataacaatgcagtaccaaactacaaacgcctaaagcaaagccacaatacaccgcaagacacaccaacatatattatacacatataatcaaagttgagaagcacaagtattgttcaagatgatctttaaccagtgaactatctcacagtgcaagtcgagagcataccattagtaattttaattccttacctcagacaattaagcacaaatcctattatgaactgatatgaccgaaatgaaagcaaaacccagaaacaaaaacctagcacaaaagtatagagatgtatggccatctgatcagggctagcccaaaagaaaattcctagcacaaaatacttgaacattaacgagtcacaagtcaaaaatccagaaccataaacatacatagtaagagatcattagagcagatgaatatctaataagaaaacccacttgccggttgccacaaattccaaattggcaaagctaaagcatgaattcaattcgactgtataatagaaaatttatcagatcataagtgcagatgagagatcatattagaatgagtagaagatccctcttgccaatatcaaaatacagccaactagaaaggcgtacagacatcaacatacacataacccagtctgatttagaatggtgaggttgaggcctgcattttatgatgaggtatactccctaatattatagtgtgtatatacggccaagtaattgaagcatgatatgaagaaagctaattgacagttgaatttcaaacttagtaaacctcccaatctgaggagatatcaaccaggcattgccaaatttaagcacgctggaatatctgagacagcttaatataaaggaacagtacccatataggaatcgcatgaaaaatccactacaggcctaatatgaccaccagtccaccacaatataaatctgagaccaaacaaatctttacctaaactcttgttcttaaattatcataggtaagcaggggtgctgaggaacgggagcgcggcgagagacatgagcatctccgtggcaccatcaggatgcttcccgtgctttgcctttgcaagctgaagctgcacgtccacgaaagcctgcatccgcttcagctccagatccttgaggaacttgatcctctgcctctccatctcctccgcgtgcctctgcttagcgaattccatgcgctcgtacatctcggcaaatgtttcgactgccctcgctagctccccgaaccctccgccgccgccgcctcccctcttcctcttgctgctgctgacgccaccaccacctgcacctgcagctgcaacgccaccggaacgagacgacacggaccgcgacgccgactgctgcgagccgtcgtcttcatcgtcctcatagttgttgttcgggttgttgtagccgtcctctgaatcagattccgccgcggccgctgcagccatcttattgaagaggaggcccgcggacgggaggttcgacgcctggcggtagtttggcaaggggagggccacggccggcgtcggtgacggcggcgagggggagcgggagggcgattccaggcgcctccgcatcatggggagcccgcggggcggggacggcttcttggcgctaccgccaccgccggcggcggcggcggcggagagggtagggccgacgagcatgtcgaggtccctgtagaagtaccaggacgag

SEQ ID NO: 69696 - DNA, 616 bp, Oryza sativa
cagagccgatctggctgaagtagtggagggcagggaaagggacgtgggggaggacagagactggaaggcatcagggaaacctttgacaaagcttctcagccttataaacaattgctagatgctgagcagtgtcatttccacagaagcaattgtccctagcctgaactgttgctataggctcctaactactgtttcaatgcccagccagttacccatcacccacgtgcccttcacaggacaggtcttatcaaagcgtaagtctgtgcctaccacgcctctgcataaaataccacaatggctcccgaagccctcagaatgaacgtctttctgagatctagcctgtaacactatgtacagtctcatcccctgacacccacccctactaccatcttgggccatttttgttctcgtccatactaactggattgtgggtgatctgtcatacatcctactgttctcatctctccaggcctctgctcaggctgtgccctctgcctggaacaccgtctgttcttcggtcactgcgagaactcctgctcatcctccacaggaattcattcattaagtcgctattcactgggctcttattgagtaccaagcactgttccaatttcta

SEQ ID NO: 69697 - DNA, 8571 bp, Oryza sativa
tatcagaccattgcggtgcaatctattatatcagttatgtgctacctcaatttcccctcggaaaatgttcttgacctcaacataacattgcgcaatgaacgcccagatagatttgatgaagcttcaattctgcactgagattgagatgggaaattttcatcttgctcaaattaaaaactctagattgttctatcaaactaatgttaaaattggaagtcagcaagaaaagaaataaataaaatacaggacctgtctgattttttaattctactactttccacagttgtactacttgaaatatccataagtgattttgttctgttcaatttctgtatatgtttgatgttgacacttaaatcatggcaacaaaaaattctcagagtcaaatgttctatacatttccctttatttcactgatgtaaagattgacctatgtagccagtaaactatcaataaggttccaatcaaccacctaaaacaagtgagggccatatatcaacatatcttacaaacatttttttcctaaatgaaacaaatgcacatatgctagaagaatacttgatgttatagcactagaggaatatttgatgttatagttttattacacgactttgtatttagaagcacttctaccagcccaataatgcacgcaaatgacaatgatcactattcagtatagtggaaaattgccttgaaaaaaatatggatctgttgtttttccaataattaagatagcagttcagccatggttgacttgttttctttctaaagtattctgctagacattcaacatggaaactaaaatgttactatggaccctcgcaaaaaaaaatgttactatggaccatcaccaattacattcattattttctccaatgatcgaatcattaactatcaacatagtcaacaatggataaattacaatattggaaaaggtcgagaagaaccgaatcagagaactaagaggagaaatttgacatatactcatacccttcagcttcaactttatctgataatccatacagaggactgttgggctcaagaggggaatcacatgagtcattttcggctgaatcactctcgccagcagcagagatatgcgatataaagatagccttggctgagaacgggattaattgccctggaaatcgcataagatcaactagcagttccatagagttcagtgaaacaaccacggacatgtgtttgtaggaatccacaaatccaactccaccatcatcaggtagaccctatgaaagacatgaatgcttgatttacgataaagaacatggaatatgcagaagaatgtaaaggaagtcaacataccactacaagtttactctcaagaccaacagcatctgcaagaaccttaaacaggatagctcggggtcggcatgatccatgctttatctgccctagaagttgtgaccctttgtttccaaagaaatgattatcttcagttggagatcttgcaggacttacatcaggatctaggctcttgaagcagtcaaaaacctgttccagaataacttgcaagttttaagacaaataaattcagcacatctgtaggcaccaaaagtgcccaaagatgttaaaataatattgaccattgatgattcataaggtgagctcatagtgggaaattgcacatgtgggaaatagaaaactatatccactttataatttctgaaaaacttaccaagccagctattttctttatcaccaaagctggactagagtttaatcctttcacaagtgcgccactaagctgtttcaacatgaaaagcttcttatctctctcaacgtccacaataattatgtcagccttaagtccatctgcttcaagagtttgaaggtcatccaatgatggtattgttgggaaattttccttcagctttttatcctgtatgaatgcatcacaggacagagaacttcataacaacaaaaatgagaatatcaaagctcacaaagaaatgaaacaaagcaacacttcactaaaactctgaatttaatgattaagagaagaagataaccattctaaaacataacatgcatattcttttttctttccttgatccctagtctatatgaacttgcttcctcattgaagttaaggcatttgaaagatttttccttgaaacataaatttgttctgtttcctgatttggcaatgataaatcggtgtacaatgctaagctaccaaaaaatgttaaccaagatctacccaacatagcaagaaaggaaactatgtagaatagaccatctttgaaactgttaacttaaacaaaaccacaaaaacacctggaggcccagaacaataaaatatgcaaatcaagcccaatgttaacaatttagctggagaactaaacatcttttacagaaaatgcatggcttacatgaagtaacaaacatctaactaaaatgccctatgacatgccacaggtaatctagggtggttattttcctaaaatatgtccccaaggaacaaaagagaattgttcagagaaagttccttaccggaattattgagtagaaaccattagggatgaaccctgaataagtccctgttgaccacagtaattgagaagccttccatgatgaggatcgcaaattgcttcgaggttctttatcagaaaatacactttgttttctagataaggaaacagattctatctttgccaaaaagtctggtggccaccaactcggttcacatgaattcacttcggatttccccgaactagttggtgtatcgtccatttttcagataatggaattactcatttccaagacgtgagagtccccttatgcatgtttccaaatgttatatgataaaaacttcgtatttaacaccaccactgatcaaactagtctgtatctgtcaaacaaaacagatgttaatataaaatatcagaaaattatgaaccactagaataaacttctcctagtgagtccatctaaagagttctcttgtctatttcatcctcgttaaagtaccaccaaactaatcagcggctccaaaacaaaaaaaaacagtttcaatgtatttataactctgcttccttaatcaagttccagcagtaaattttgtcgcctattaaattaatgaagcaacagagaacattgttttcttaataataaaaatgaattaactcctggtaggccgtttaccaatacagtaaaacaagcaaagttcagaaagaaaaaaacaactttttaattttctcaaaatcaactgagcatttgatagtaacatctaactgaaaaaagtgggagcatgtgaactgcatgaggtctttgtttctcccaggagaaagggcaacttttgtcattggctcagttgtcaacttgatggtctacaatgatgcattagaaactaaacagaagtggatcacatacgcgctttatcagctgatgtgcatccttaaggcaataagagtcccaaacgtatcaacatgaaaaattgtgattccgcttcaaccttatcgcaatgttccaggataacatgcaaatatgttgcaaaaacatcaagttgttagcaagcatggccaacaattccacccacccactgttatcccagtaaatgtggccattgtgcctgctgtcggccaaaacttgcagtcaattattccaagggatcattaacagggccttatccatgaattgagcaccttagtaaaaccaccagtcaaaaataaaagtagaacgcataaaacaactacagtagctcagctccttggcacacagtaacgaagtacggtcaataattccgtaaattacgacgcaattgtgtaactaactatagcccggcaccctcgctgcagcggctgtttctgcccccaaaaacgagcagaatcaggatggacgcgtcacgcgcctcgcatcctatcccacggtgccacgagacaaggacgccgagagatcttttgcgcggtgtgaagcacaagggccgaagtcaccgaaccagcaaacaaatcagcgacagaatggacgcatttgcgctaattcaaaacggagcaccccccacggaattggattcagattgctcacagcagagctcactacgcacaagctagatcagaggcgcacgcaacgaatccaagcaggtcgcggaggtgtggcttaccgacacggaagagcggtcgggacggatctccactccactcacgctccgctccacgacaatccagcagatgggatgaccgaccggagcacgggctggcgaagattccgaggcgtcctgctccgcttccggcggggaggaggcgtgcgctctgcgctgcggcttcggattcggagaggagcgcgggccggtcacgtcgcccaggcagccccccgcaggctaggccgcctcgatcgctcgcagtcgcagcgcgcgatttggcggtaggtgggttggtaggtgcggtggcggaggcggaggcagaggattcaagggaccggggagggtgaggccacgtgcgacaccccacgacgaacccgtcgctcgcggcgtcgccacttgaccagggttaggccggcgcgcggcgtgctcagccgtcagcggcggtggcgcgcggtcagtcgccgagtcagccgagacgcggacaggggagtgggaggaggaggacgacgacgaggagggaagtggttgagagttcgagactccggagagaaacttaacgagagcgcggcgagagaaggaggcggggcgggtcagtgagaggagagaggagaagaatgctggctgcgacggaaggaaggaaggaaggaaggaaggacggacggctcctccagctgttgggggaggcgtcggtacgcactggggcaggctactgtggcttgcgacccgcgggccagtgactcggtgagcactgcagactacagggaggacgaaccggccggccggaggttgggtgttgtatgaaatgaacctgcgtaggcagcttgtttgtgtaggtttaattgcaagtacggaatttttaagtgggtttgtatttgtgagattacttttaaagagcacacatgcatacttatatttgagaaaggggagtagttaatattaagttacattagtttttattgcattattttttatcttttgtgacagcgagaacgtgaaatttcacgagattagtatagggagaaagatgtatttggggaataggattactggctatgttttgctaataatagctatagtatttgaccgttgtgtgttttaatagtgcaagagagtttacgacaagaactttttaatgataaaatcacaaaagtcgtaatacatttgtctttgattatcaacttgagttggcatccaataccacgtcatgaatatcaacaagatttgcgtgtctcgtcgaaacgacagatatggaatcatcgtaacactcagtttactttgtttaatattttttcatctaatattgcgtcatgaatattgaagagatatgtaaggcatatctttgttgtatctcacatcaggataatagataatagatgtgcagagctgtgcacactttcaaaatacttcattataattgttgacgccttacaatggattcacctagctaacaacaatcatgaaccacacatggttatctgaatcaccgtatgtttgtaacctgtcaatccactatgacactttatgtttctagtttatataatcacatgtttatctttagattgtttttaaaatagtggggacagttgaggaaacgttgtagtaacttgtttgtgatactattgttgcagatgccttttaagggacaagttcttatagacgatcgatttggagcatagtttattttcattatagtgttttcttttatatgagatatgagatagctttctattttggtttgtttatagactatgttatgcattagcaaagaaggaaaaacatgtttacgggggtctagatgcctgattatgagataggataagaagattgtacgtttgagaatccctacggtaatcgggtaaataactctataggttttgtattctctatgaaatcattggtttatttgttgttaataaaaccaagaaggcaaccaatataaagttcgtatcataaacaccaaaatggtgtaaggtgatctgatacacatatctcttggtatccaaatgtaatgttagatatatgtatgatatttcgtatacttaaatttacttttcattttaaggcaaaatttgctatatgacactcaaagttggtggcatttgctatgagacacccaaagaacgtgtattagctgctgtacactgcaaaaatgtggtaattagttgctagacacccacctcattatatattgtttccggtagaaatagagagagaaacattggttaaagacaagtttgcccatgggcacacttgtcaatctcacatatcatctctttctattttcctcttcttcctcatgccgctctcttgccgttactcatgcccctcggtgaagacgacgaccgccgtcagcgccgatgagccacgatcgccctctactttctgcattcctcaatcttcgcttgatgccatctccgttccatctaattttgtcccatcccatgcagcggttgaacgggaacgcggatcatgccctcgctgccctggagcgcgctctgagcatcgccgccgcgacagcatcgccgttcccgtcgatcgggtgaagctaaggccgagccaccgtaccatcttcatcacgacgacctcctcttcggaagccccaaagaaacctagccaatggtgcagcgagcttggagatcggcatcatcttctccaactccggccggcgagctccatattcaattccacccgctccagtgagccaccattcaatccatcgcacatagaagctccctaggacgtccataacaccatccgtgtgcatacatggcagctcttcgagtagatcgagccgttgtcgtcaacacggagtttttcctcgccgtcgagccattccaaccgaagccgctgctgtccaagcctcgacgatcccttccaataactttggtgagcctcctggacaagcgcggcaacggggcggcagagggggtagatgctaggcgggacggcggtcggtagagcggcagcagtgtcccatcggtgacgtccttcatcgccgattccgagggccgccgcgagagactgcgagggagcgcgacgaggaggcctgggagcacgggccggagcgagcacagcagggcggagcagcgctcgcggtaggtggcccgagagcgacgccgctgaagaagagaagagaagaaaagagaggagaagaaagaaaagagaagagaagcaggaagaagaatagtgtccaggggcatttcggtactttcaacgctctttctctctccgtttccaccggaaataatataataacgaggcgggtgtccagcagctaattaccacatttttgcattgtttaggagctaatacatgttttttgggtgtctcacagtaaatgccacaaactttgagtgtcatgtagcaaattttgccttattttaaacactctttccagtttaataatttcacgttgttttcaagggtggatgtagagtatattaggggggtgcctaggaacccgatcaagaaaactttttagctatacctatgcacttcctcgatacaaacttagacacccgcatcaacttaaattcgatataaagtagagtaaattaagcaagtggcaccaccctccattccgttctagctccgccctggttgttttggacaataacgtagtcttccaatatgattttctattataatatatagtaaatatatttttaattttattaaagcagattttaggactaatctatatattccttctgtaaaaaaaaacaagagggcaaacctgactatgaatctggatatttggacagatggagtatgttctagcgcactataattgaataggcaggtcagatcaaatccatctttagaaaagcaggagtgcaaaggaataaaaaagagcagagatgaaaagagttttgccatgcttcatccattggatcctcatcatccaagatatttgtcggtgcggtgatgagcatttgcctacgtgttcaccagcttgaccaatggcaaggggtttgaccgaatgcacggtgcctatcatgtcaactggtcgatcgacatagcagccgtacgacctgcttgtctttagccctcgtccaaccatcattttttttccccacatttgcacagtgggagtacgaatcaaactgtgcgcatcattgacaagcgagtcaatttgttaggtcagccaggtgcacggtgtcaatcgtcagtacgtctgtacgtgtgccagtgtacgtgctcgcgctttgtgttgtgcagtgcttgtgcctcgacccacttttgccatcgagtacacgctctcgcggcgcccggcgccattcacggccggagcgcgtgagcagagcgaggggccggaagcgtatagcaagcgccatgtttccaaagccgtcgtcgtgccgagccccgtaccgctatggcgcgggcgcatgtgcgttgctgtcaactttgcggtgccgcgggcgcgcgcgcgtgacggcctgtgcggcccgggggggggggggggggga

SEQ ID NO: 69698 - DNA, 14336 bp, Oryza sativa
acacctctcgtgccttttcctctctctctcactctccctgtcgtgccggcggatcggcgagcggtggtgggctccgtgagctatcgacctatcgtcgcgcgcgcggcgcggtggggtggcgtgcggtgcggggccggaggagcgggagaggtcgcgatcgcgatcgcgccggggtggagctgtcggtgctagttgtaaagtccgtggcttggcttgctgcgcgcgcctgcggctgcagctgcgggcgagggtcacgtgcctcgtgcggttacgtacctttgctttcctttgggcgaaggtggggaacgtgggagggatggggacgccgctgccggccgcggatcgtgccgtgtgattcatgagaaaattgcaatattagtacggtaaacattggggttttgctgttttgacactttaagtggatgacaaataagtctatttatgtctatgaaatatgggtctaatatctttatagtaaaaattaatgtttgcagtgtcataattgcaaatccctggtgattcaacaggctgccccggccctcaaggctagaacaatattctgcttttcgccggttcggcccggccaggaccaaaatatgttttttagggtacgtagctggtaatcaagtggtgttctagctctccgtgctgtttgattgtctttttgaatggataactttttttaatacaaacgagaggagtcggtttgtatccggtgaaataaactgccccgttataaagcgagctaaaatacgttacaaacacaattgatggttttatttcacggcgcatgggcaacataagaaagaacttaagcagatcacattgtcagtcatcacgcatgtgcttccgtaggaaatcaaggtaggttcgtgaacgaccggtcgtacatacgtttgctccactaataattgatgacacttcttaattactagctactagctaggatttgggcaatattatgtttgatttgcatgaacaaggaatcgtcctgtgcatgatgaggattgccaactgcgcgtggaaaagaacctcgtctgatcttaattaaggaatcatgcgaaaggccttgccatgtttgtagttcaggcaggcaagcagccggcagctaatgcatctatatgatctcatggcgctgaggccgcgaatggctgagcaatggcaccaatcatcaatatatcatgcaatggaatatatgcgcaagtcccctcgtgactccgcgtgacgagacaccatgttttacctggcattcagcctgttggtcgtcggccgggatgttaaggcaccgtacagctacttggtttagttgcactgccactgccttgtcacttgcgttttaaaagaaaagatcaatgcattgtcattgttgctgatcatctccctggatttaacttaagtactcctagttgcaccgtgcaagtgttccgaaacaaagaagagtagtttgcaccttgtttgcagagacaattcggattgaatgttagtatggatcgaagcttcgccggcaccacgcgcacttggatgaatttgcatgttcactgctcaccggccgcagcttgctgttggcctgttgctgatgcagtgatgtacatgtcccattggcacatacggagtactccagtccaactagctttggccagcgtaggtgaaaagttaccgaatcttatctgtttagttcacgctaaaattgaaagtttgattgaaattgaaacgatgtgacggaaaagttggaagtttgtgtgtgtaggaaaattttgatgtgatgaaaaagttaaaagtttgaagaaaaaattaggaactaaactagatatgcttctagttttaccgttccagccactcctggataaacctggctgccacagcaacgaaataacatgtgcttggagatcaaccggttgacggagcaaactagctattcccagatcaaacatgattactggatcttaaatataggcatgtttaggctgcatccatgggtcgacacgtgtgctgtactggtgtgtaatgccccggttgatccatgatccctggctcccttcatgggctcatggccttgtccgatccccacccatgtacaaacacacacaagctgctgccaaccgggacctcccggaaagctggcaccaacaaagcgttcccgttgtgttgcgcccgcgcgcggcccacacacgcgcacacgcgctacgcgtgaccggcgctagcgtccaccacccagcctgccgcctgccggccataggcggagatgcctgggcacacggccggcccgccatggcctacgtgacgtgacaaactggacaacccgtctcgtacgccctcgtctgcagggtacaggctacagcccgccgccgtcgaattgcggaacggcgtgtgccccgtgcggccgggtttcggcacagctctgcaagcccgcacgtacgcggcacgcgcgatcgatggtttgtctacccctacctaccacgagtagagctactatgcggccttggaagtttgccttgtgccgttgtgctggtgtcccggactcccggttggccggttgataggcatgttggggagttcacggttcagtgtctcggagactcggataatgttctatgcgtgggcatgatcattaaacgggctctgtccgtgactgggggacatccggcccagtacggtccagtagcggagctctcggtgaaacgctgaaagagagagcccacggtcagatagtttatgtaagtgcaagagcgaagaatagttactggagtatctccgttacaaaataaatttatttttcgtctatctcacacataccaatacaaaagaaaaaaactaaaatactattgttttatcaaagcttaatataactttcttactttaactactcccaatacaattattacctacttttacaaacttcaatgcaatgattactctaaaaatgaacttattttggtacaaatagaatgagctaaaaatacttaatatgaggcaaaggaaataacatccttgtacgtgtacaacctacatacacatccatggcccatgtacattggttgtacattggattagggccgttgtagtatgttttttttttttaaaacaagtttatttaattatcatttattttattgtgactaggttctttaagcatggtttatatttttagatgtttgcagcaagaattaaatatgacaaatggttaactgtatgccaaaaatcagtgatgttttatattaaaaaacgaaggcagcatatgaattaattgtggtggtgttggagcgtgtacctacaaagtaagtggggtgtttgcaaactgagggcctgtttagatcctccaaaatagcaaaagttttgccgttttggaccactttttggcaaaatgatctaaacactagtagcaaaaagtaggcaagttgacatttgtaatttgggagtccatagcagcaaatttagcaaaaaaaaaaaaagcatcgggcccgtgcatgagagagacagcagcaattaatggcaaaactttaccatgtatctaaacaccaacttataaaattcaatgctaaatcttttgctaccaaaacttttaccaaaaaaaatttgccgcagcaaattgatctaaacatgccctaatttgataaactgaacaatgaacctgataaaatatgcagtaatagactgtcttgtgatgtgtgatgtttgctgtctgcctctttgggctggcactgaagattggcttttgttgatgcctgaagatggaagctggattttgggtatgttttcaaactgtattactgcaatgtattggcaagctggaatccccagccgatcctactagtctagttagatttctgtttagttcccgtttgttgtttctgtataaaaacctttttgttttcttcagtttcatgcaaagccgggtaatgaaaattgcatgttctctaaaaaaaagtagaagtaataatagaagtaaatgtgcgcttgattgaacaaacatgcatgggatgttggtttttaggaatcaaatgtttgattctgacattaaggttcatcatgaatattagtagaagtttagaatatagggtatctgggcatgtactccctgttgccttaactttagcttgagagttgagactggctcggttatacttaagtaccagctaacgtatcactaaattaaggccgagtttagttccaaaatttttcttcaaacttctaactttttcatcacatcaaaacttttctacatacacaaacttacaactttttcatcacatcgtttcaattttaaacaaacttctaattttggcgttaaaaacacaccctaagtggcatctctgccctggctctttttttagtttttccattttagcttagggccatctttctttctgtagctctctatagatgcaggaacccacgctagatccaatctgagcaacactgaagaaattaaaggtgctcccatataaacacctgagtcaactcaagatgccgtgaccatgcgcatgcagtgacgcaacaggacttgatctactcaggccaagtacagtgcacatccctcctcgtatgaccttatcattattatacagtaatgaaacaagtctactttacatttgtctaaatcttcagatcaggtggaatataatctccgccgtgtttagttccaaaatatttcttcaaacttccaacttttctatcacatcaaaactttcctacaaacataaacttctaacttttctatcacatcgttccaatttcaaccaaactttcaattttagcgtgaactaacactagtacggaaaggctttttgcatacgggcaaaaagcatctttgcatgcggttggggcaaccgcatgtgggagaaggtctgtaaaaatcacccttttcgcatgcggccggcccatccgcatgcaaaaatcccattttcgcatgcggttgcttatacgggccgcatgcgaaaataaattcagcaaacaaaaaaaaataaaaattcaaaaaatcctgaaccctagaccgccgccgcacggtgccggattcgtcgcccccgccgcccgccggcgtcattggcaccggatccgtcgcccacgccgcctgccgtcgttgccggcaccggatccatcgctcacaccgcccgctatcgtcgccggcaccggatccgtctcccccgccgcccgccgtcgtcgctggctccggatccgtcgcccccgccgcctgccgtcatcaccggcaccggatcggccacccccgccgcccttggcgccggatccgcgcggggcggcgccgcccgaggtcgccgtcgctgcagcagtgaggaggggatggcggtggcgccgctgcccgaggtcgtcgtcgccgcgggggtgggcgccgccgtcggatccgcgttggaggagggcgggggagtcgccagcgacgacggagggaggtagaggcggcagatccacgcgggcggccgctcccgcccgccgtcgccgcgtgccgccctcggccgccgcctcgcgccgtgccgccctaggccgccgccccccgcgtgcctccttgccgccgccgcgtgccgccgcctcgcgacatgtcgccctcggccgccgcccccgcgtgcctcctcggtgttgctgaccccgccgcgaccttgctgtgtgtgagggggagagagagagagggagttgaggagaaataatggtggagtgaagataaggttggagataaggctgctgaaattttgaagtggtggagagggcgaggaggcaaatcagacttttagataaaaataaacattaaatctaattttgtggtattaaatgaattcatgtgaaaaagttgtcaaaaacaaagttgtagagatcattgagatctaccaattttcttttggtcatttctccatctaagtttgattgagctatataaaatttgaaatttaaaatataagaaattcaaataatattttgaagcaataaatgatttcaaatggaaaagttgtgaataacaaagttgtataaattatcaagatctataacttgttttggtcatttttctatatgactttgtttgaacagtttgaatttgaatttcaaattataacaacttcaaacagcattttcaaatactaatcgatttcaactgaaaaaatcatcaataacaaagttgtataaatcatcaagatctataacttttatattggtcattttttcatccgacaaagtgatttgttcacaaaatgtacatatctcttatatagtttataaaactataagagagatatatattttgtaaacaatcttacaaatatctttatcggatgaagaaatgactaaaatagaagttatatatcttgatgagttatacaactttgttgttgatgactttttcagttgaaatcaattactgcttcaaaatattatttgaagttttgaaattcaaaattttaattgataaaataaagtcaaaagaaaaaaatggccaaaataatagcagtaagaacacaataacatggtagagcatgatcttagaaacatttagaaaaaaaatcatctaatttggagttcatataagtgagatacactagttttaaatttttcaaattttttatttttgcatacgcctccttaagtggatttttctatacgggcgcttaagtgagctcatttttgcatgcggccgtcttaagaggcccgtatgggaaaatcgatttttccatacgggccacttaagaggccgcatgcaaaaataacctacgattttttgtagacgccactagttatggtccgtttgtaaaaatcaaagggtctcgtacggaaaaatcacttttgtagtagtgtaaacacagccctcgattgatactagtattatttgaactttgcggagtactgtcacatgatttcaaatgacgacgtatggatgtttattatttacatgtacatgagttatcttcaaattgtatatacgtcaagcaagtactactactagtaaggttacaaggcaaaaatcaccctgaataatacgttccaccattattgaggttagagttaatcaggggaaatgcagagaataactatctttatacagttttggtagtataagctttacctttaatcaccaaaactggttgttaatttccagcttcaaaataaatgaagtctaggtgcactagcttgcatggcaaggcgatgagccgatgaccagcgtgaggcagtgaccacacggagaagcgcatttccgggtcacgggtgtggcaggggaatccactaataagagtttaaaaaaccatgcggttattatgtattgcaacattctcagtttttaaaaccactatataactcacggtaaccacaagtcacatatttatcgcggtaaccatcaaacatgatgtgacgagaaccccatctagaagatttggtaaacctgacactgacacaccgtgccactagcccactactatccatctcaaggacgtattctacgagctttgtttgttcttcgctccgtttatactccagtgtaaactcgatcttaatttcatttcgcttaatgacttcactttgtcctcggatgatttgcgtccgtccgtttgttcacgctctactacacgtacagacgtgcaagtcagcaaacctgaaggctaagcaatcgcgcaactgcgtggttactatacgcacctgtgaggctgtgaccgttcacgtgaggcgatccctttcgaccggccggttacgtaaaaagaccggagaatctcgcgtaaacggttatccatttctcacgggaatctttcggccctggccttcctgtccagtgcgacccgttgtgcgatcttttatctgtgttatattaagtcgtttgatttttcttagttaaacttttttatatttatttaaatttatagaaaatataatcgaatttttaacataaaaataaacatattatcataatatatttaatgctaaatttaataaaactaatttaatattttatatattgttaaattttttgatatactttatcaaatttatcaaagtttaattaggaaaaggagtcaaataacttataatattaaacagagagagtataaaatatcatacgttattaggtttgtttatatttatattttgtaagtatagagggagcggtagtagctgccagcctgccaccgcgacgagattgggtttcggtcgtcgtaccgtgtccgtgtcgctcgaccggagacgcttgaccccgcgggcgcgcgcgaccccagtcccgacccgcatcgcacatacatgtggccacaggcggagcctccggcccaacccctcctccaagtctgaccgtgcgccgcgcgtgtcgtacgtacataagcgggggcctccgctagctagctagccggagggatcagcacgtctcccagtcgcctccagcaacaagctccgtctcattcattcgccagtggcaagcttatcgccggccggccggccacccaccctcgcgcgatcaatcgatcggtacggtcaagctagctaagacgagctatggccatgctcgggaggaagagagggggatcgtcgtcggccaagctgccaccccacgccgaggacccgcgtgcggctcctccgccgccgcaggccggcctcaccgccaccgacggtgggcaggaggtggccatgtcgcaattcgtcgcgcagctaggcatgtgcgaagcctccgctcgagtagcgaaagcattttgtaagttgtaaccaatggatggatggttgaggaatttgatttttttttcttctttttttgggtgcgtcttggcatggcagacgaggcggcgcggaagaggctggacagcatgaaccagaggctcaggtggctggagcagcagatggagacgctggaggcggaggtcgggaaagccagctccgccgactgatgatcacctagtacatctttgtagcaacacccttttttctttagtcttacagatatgtagttcgatgatgatgatgatgatctgatcgccttttctagcttaatctctcttttgttcgatgcgttggagcagcgcctttttgcctggaacctctgccacgttttaggggtgagtatttgatcctgggtctaacgtgtttgcctacgattcattctgacatggaaaagtatggccgttagttcatcacttcatctcgtcgctttcattttctgtggaaatagcctaccgttccaaccacgcatgctggacttctgacttctaatgttctacagtacctgggaccaaaaccatacactctgtattaaattaaccagtactaatccccactgtctgcaatcactagtacatatttgtacgcaaatagaacgaattgtgccgaacattccacatctaaaagtgaatactctctgtcccaaaatcttaaaatataagagattttaggtgaatgtgatgtcccttatattttaggacggagtaagtatttcatctgtttagattcattgtattagaatatatcacgtccacttaaaatctcttatattttgggacgaaagaagtaattcttagtacttctattaattcagatgtaataatattcttaaatcattcaggagaggcactgttcacacaatcaccgaagtttgcctgtatggtcctttgacgtcttacagcaagcttgtgcaatttcatggtccgacagtccgacacctttatacgcgagataacatggccgtgtttaaattcaaactttcaatttttctatcacagcaaatgtttagacatgcatgcatggagcattaaatgtggaaaaaaaactaattatacagtttacatgtaaatcgtgagacgaatcttttgaacctaattacgccatgatttaacaatatgatgctacagtaaatatttactaataatagattaattaggcttaataaattcgacttaaaaaaatttgatacacgagctaaacacagccataacagaaagacagaaataagcgagccaatctattcatacaggtacggagtaaatgtccagccaaaagtaaaaaaggtatcatcacttcatcaagaacttatgtacaacagactgccttctgctttcacttaaaaagcaaaagttttacaacacaatttccttctcggagctaaatccatttggtaaaatggtacatttcccgcacaagaacaggatatgaatagtaccttgatatccagagtaaaaaggaaagaaatgaaagaagaaaaatgccgggaacaaccacaacggcatgcatccacaaccacaaccagatggcaatatgaggacatcaaactatgttgctattcacaagctagcttggtaccaaagctgctgaggctgatagcaaaggcttgaaacgctgagagtggctgccggtaatccatcgtgaagatattgtcatcgaccttaccaaactgcaacagaactgtttcctcatccttcgagctagcaggatcattgggatcagcagcagcaactagttggaaattcttgacagatgcaactgtcacccgcccatggaagttcaagcaccagcactgcaagtgctcatgccagcggggagctttgtttcttagaactgtgttccctgtgggttttctgaacttcgtctttagacagttttcccatgtctcttgagttgaagggcactcaagtgcacaatacattctcctaggacctctggatttgagcaggttgtatttataggaaacctgtccaacttcatagtttcctgctgacacttggggacttatccttctacttccaaaacgccgactggatcgactacttgatgctttagcgccatcatatggtggcttgctatcatatattttgaagtttgtcccccaaaaatcagatctaaacagaagcacaataataccaatgaataaaaattaagacaacaaaaatccaatacaagcacgaaaacacaacagatacccaaccagtccaaattatctgcacaccataaggggaatcaaatcaaataaggccataacctaatctaggacagtgaaataatgtctcaaaggaactgccgtgagacttacacagcaatcaattgcaaggaaataaatgaaatacttttgagcacaaataaaggaacaagagaagttataaaaactgaagagcctgaaaactccccaaagagtaaaggctaagacaaaatagaagcattcggcagttttaagtgcaatttatgaggatgcaaagtacttcggcagtcaattgcaaggattatgattcatgttgactgttactgttgcaaaccacaaaatcaaggaatggaggaggcatgtgtgacaccctaccctggtttgagtaagtccacacatgagggtgtgaattagtcccaccttgtggccttgtttggcaaggctaaaatcccaggggatgggccgggtctttcccaaacaaggcctacttttgcaggcttaccaggtccaaggtatcaatccctcaaaacagaaaaagtccaaggtatcaaccaaacccttgaacacgaacacaaaggatgaaagtgcaagtgtgttggtgtgagtgtgtactctatccaaaatggggttagaatttagattatagacttaaaaccagttcagaccttggggcatcacagcatgccaccatgttaaggggttcaatcttacaacataaggatatactccctcctttttatatatatacgacgttagttaattcaatattgaactaacaagcgtcatatataaaaaacgagggagtaccatttgaactataaaacagtccaatacctcattgaaaaacaagatagtaaagaaacagatactatttagaactcagaaggcttatattgtcttatggtatgggtacccaattttttttaaaaaaaaaacatctgcagatcagctaaatacatatttttagtgcattagcatgttccctaattgtaaatatattactgcaaccaatttgttagcactaagcaggatgaataacagaatatgcaagaatgattaagagtgaactatgcagccatgtagaacctcacctcagtttccccatgtatgcattgcttccttgtgaaaggtcatcagcatcaagggatacgatgtactcggtatggggaccacgtctaaaccttctagcagccatgaggaacttccctttatccacagttgctatcatatacaaaaagtatatattaatcatcaagcacatttgatggtgaaaaagtccatatggcattgcagttggtacaaaaaccagaaggaaaaatatacggtgtaactgacagaacccccatcctttttctttttcttttttttaaaaaaaacacatatccgcacatgttagatgttacacttgaacagctgagtgtaagcctgtaaggagagaaaaatgttgcttctagatacataatttgagtgctgttggatctgattgtcaaaataaaagaaatttgaaaacacttgactaagcaggccatcaaatgtaatggaacaagtagacttccagtcaccctaatcactatttgcaggacacgaagactttggtataattcagctaaacccttcaacaattatgtccaaactagccaatccaaataaataaacagtgttaagtatattcgggcccatatattctaggcccattggcccatgaggacataacatagtacataatcccgaaggggcatctcttatcaatttcttatcagttgtttcacaaaaaataggcaggtacaaaacaatattagttcctaattcaagtaaaatgctgtaggttctaatccattaggtgctccaatcctccaccttatcctcccaccatcccataccaattatgccaaaagatccaaatgcaaaatatcacatggtcctagaatgcaaacatactgtgcatttctgctggtttgacagataatttgaatctatagaaaaaaaatgaaagccaggaagcaaatgtgcatgggactgcccatgccaaaagttgataggtcaacatcaagccatcaactaggagaaacaagcgatgcatctccaattaaagccacaacgaatttgagttaaatctaaaagcattcaacttgactactgctaggcatcaagtgtcaaccacagacaagtaacaaattccaagaaaaacagaacccgcacagcaatcataaaacagcatgtcacatgccttacattgagatggcaaatcaaattgattatctagatgcacataatcaaattgatgcctgcacatatgcagcacaaaataaatgagagtcaaggaagttctcatatcacatcacgtacagtcatacacttaccatttgtcaaaccaaggtagaggtagaacgtagagttcttcttattccgcttaatgaaacattgcattgggaactcccttggccctggctgcttgacaaaaggtgtaagaactccgattaatttgcatacaaatactgtgtatcaaaactacgacactcctctgcaagactgcaactaaaatcctacgtagacgaatcacccaaaacaaaactatgctactcatctcatggggaatttcagccactaaactcccacttataagtgaaatcaccctctgtgtgataggatagtaaatagctaaacacatatggccccgttcgaatctgattattggatgaagattaagtgcgcatgtaaaacgagactcattagcgcatggttaatgatgttttaattattaaaaattaaaaaatggatttatttgattttttatagcaacttctatatagaaagtttttgcatgaaatacaatctttagcagtttgaaaagcgtgctaacggaaatcgaggaaaaatctggatgttgttggagcttagaacgggactaagtaaagctagactatatacatgctggaatatggtcctaacatcaaatctgtagccaaaagcatgaaaattcaaactgctggtgataagattttccaactattcattcatagcggacgaccctcctcgggtttgtttttccttccaagcctccagtgtgctatactgctatctaccaacgatgtggtgattttgccaaagccataaaaagaacaagtgcgatataaatcatccattgtactaactaaatctagttgctcccgagcctagttttaagttaaatccacaaactcttataaaaaaaaatactagtatcaaaatcgattgaaagttaacttactccaaaaacaaatagctaggactagacataaacaaattaactaatcccacgaaacatcgcgaataaaaaaggtaaatttgtaaacctcaaaaattaaataatcctctaaaaatagcatgagcaagtgatctcagcatcctatggccagaactgagggaacctaaagacgcaggctccaaatttagcaatcaaaagcatagaggactctctaaa

SEQ ID NO: 69699 - DNA, 8050 bp, Oryza sativa
tataaaaattgatttgttcacatcttctcttggccatttggctcgaatggcaggcaacactttgtttaccatgaaatctctaatcacatctcttgttattgaagttattggcttgattactagttctccacgaagacgattctgactacttctcacagcatgttcataagtgacaagtggaaaacaaccaattttaccatcaaaaacacattctccattcctaaaccttggccgagcacaaacacacaagaacatgaacctagggatgtaattcttgttcttacaagtgcgatgtggttcatcttcctcgggtagcaagtaatacttctcagatttttgagagaggtagaaccatttttcatcaatgaacacatagtcaaaaaaatccttaaatcttggatcaccaaccaaacttcgatcaatcatgtcaacacaccacttcaacctagtcttcttgttagcatctgtgaggtatggtttgatgctactagagtgccgtctaagcaaaccttttttcaaatacctttgtactctagatttggaaataccaagtttactagacacatcttctatggtcattctttgcttgagaggaatgttgcgcaattgttccaaatcaagagggattgccttatgaccagatctacccttcttgtgactagcaaccacaaccggaatgttatgagtaagttggattttacctcgcttccataagcgctgaactgatcgaatgtgcactccaaattgatcagcaacccttcttgtatctttcttgcctagtttcccattcttgttgtccttcaacaatgcttggtacacttgttttgtgacttcttctgtcatgtccttccttcgatgctgtccttcaacaggagcttggttctgtacatcatgttctagtcaaagaaaaaaaaacaagcacattcaaaaaaactagccacttctttaataaaaaaatgaaaaaggaaagaacaaactgagatcaagattaccagcgtggttttgtaaaaaatctaaatcaactacaccaaattcatctagtggcatgttcaaatcaaatcctgtcggaaaaaggaaagaaaaaacttagaatagaaacttagttgatgttgttgctgtgaatataaaaaaaaggaaagaacaaacacattaccattaacgttgtgatcctccaatattggctcgttgagatggaagggaacattgccgtcctcatcttcttctaggcagacattcaaatcaaagccagcaacagctggaacagccattgcatgcagtagatggaaactctcgcggactaaaagtgagcaggttaagcacaataatggaaagagaagaagccgtttaaataggcatggcgaaactgaaacggcatctacccgtgaaaagaacgaaaaatacgcgcccaaaaaacacccccgagagcgccatgcaaaatcagaaaaaaaaaacaaagtgcccagacgaaaaaacgaaaaatacatgcccaacatacgcaaaaacagagtgcccagacgaaaaaaacgaaaaatacgcgcccaaaaatacgcacgcaagcgccatgcaaaatcagcaaaaaaataatgagcccaccaagtatcgaacccaagcactcaaccttcaaacatcgctgcactagcgtttgcttctcaaatgaatgtacccgcaccctcatttaataggggcaaacatagaagaatagcctcaaattaatcactccttggtaagcacaatcttgtcctaaacgacttgttttgtgggtatggagggagtacgtacaaagtatgtatacacgtacgggatggatcgacatagaatgtgacgcattctaatataaatctatttggtattttttaatatcagatctaacggttaaaaaatatgggttcaaacagattaaatgaaaatcaatggttagatattttagtttttcttagaatttctccaatttattagagcgccacttggcagcctaggagcatttgtagagatgccatgtggtggcttagaagcgtttgtaggaagttatttattagagcgccacttggcggcctagaagcatttgtagagatgccatgtggcttagaagcgtttgtagaaagtttaatggacttttagtatataatagatagatggtttataattatgtgtcaaaataatatgttggagtcttggagagggctaggcactatccatcccctatcacagtcaccgaacaagcaatgtactccagaaaatcctgtcacgctaacgcaccatgcgaattggtctgaaatcgaaaaagattgacctaatttacgagaaaaactgaaataattaactatttgccactcttacgagtggttctaaagaacttgcgacgctgaaccatatatcatagacacatgagggcccacatgtcatagatagcgagtgacaaattcttaattggcatatttcaaaagtggcaaataattaaatgtcccagaaaaactagaccaaaaaccatacatggttaatttaaaagaaactgataactgtcacaacatcctaaccaacccaatcgaggatcagaatcatctaggcgaaggctccaagaggatacaacctcaaagatgttggtaacatctgtcccaaacaacagataacgctttcacctgaaaggaagagagaactatctaagaaggcctctaaggagaaaaccgctgcccacggaagtcgacataatccacaccagacacggagcaaacaagacttttgccataagctctcttaactattgatcacctctgcattgattggctcgaggtattaagggttatcattgcccagctctcgtcaccctatgaacagttatgactccgtcacaaaacaaatgtcaccccccacctccggcgcaagcaccgtctgggacatctttagtttccaaattatacattgttcttctggaacaatctgtgatatttccctgacatccaatttgtaaattgttgccatatatttccaattaaattacatcaagcattcccaacctgcaggtaggctaacgatgcttaaatctgtccgctgctgatcgagcacatatgctgaaatctctaattccgctctttcaatctgttgcaacatgtgtaatatcagtaaaacaccatgccaatattagcatgaatcatgcgaaatctagcatgcaatgcagctcgtttgcatgctaagctagctcatggtcgttggcagattggagccaattaattaaggttcagatagaatacactctctcgatcgcttaatactccgtagctttcaattcagccattgcaatatatatagagtacagtgctttggccttcttgtgtgcatcctctctcaccttacagtgcttttcgttctcgatctcggcaacgacgacgacgacggcgactgccatggcgagcccactgccgacgatggagaccgcgcacgccaccgtgctcgccatcgggacggcgaacccggcgaagtgcgtggcccaggaggagtacgtcgactggtacttccgggtcaccaagagcgaccacctggtcgaccttaaagccaagatgaagaggatgtgtgagatttcttaaacgatgatatgcttcatcagatgtttttaatttaatgttgagacattagattccttcagtttcaagctattaatccactaaaataacagagaaatactaaaactattaaccttttattaatccttttattttatgttgaaaccgtttctccatcttttaattccttcagtttctctgttaatgttgaaacattttcgcttcattggcaggtgacaaatcaggcatcaggaagcgccatttgtgcctcacggaggacatgatcgctgcccatccagagctcctcgaccgcgccgccccgtccctcgacgcgcgcctcggcatcgccagggacgccgtgccggagctggccatggccgcggcggcgagggcgatcgccgagtggggccgccccgccgcggacatcacccacctcgtcgtctccaccaacgccggcgcccacgcccccggcgccgacgcgcggctcgcggagctcctcggcctccgcgccaccgtccagcgcaccgtcctctacatgcacggctgctccgccggctgcagcgcgctccgcctcgccaaggacatcgccgagagcaaccgccgcgcgcgcgtgctcgtggcgtgcgcggaggtcttcctcatagcgctcgccgcccccgacgaggcccgcctcgacgccctcgtcgccgcgtcgctgttcggcgatggcgccggtgctgtcatcgtgggcaccgacggcgacgacgacccgggagcccccgtcgaacacccccccatcttccacatgttgtccgcgtcgcagaccaccatagccgggacccaccagagagtctccctgcagctgagcgagcgcggcctcgactacaagatctccggcgaggtgccggcgctggtgcgcgccggcatcgagcggtgcatggaggacgcgctggcgccgctcggcctcgccggctgcggcggcggatggaaccacctcttatgggcgatgcacccgggcggccgcgctatcttggacagctacgaggcgggtctccggctggagcccgggaagctggcggcgagccggcgggtgctgagcgagtacggcaacatgagcggcgccgcgatcatcttcgtcctcgacgagctgcgacgccggcgccggcggcgggatggtggggaagaagaggaggaggagtcggacgagtactgcgagtggggtgccatggttggggtcgggccggggctcaccattgagacgatggtgctgcgtgccagtgccaccggcggccatgtcggcgacgaagtcaagaagtcgactactgcttgagcctcgaagctatagctaagctagcgagctcgatccattcgctgctgagcttgaagcgtcttgagtgtgggtgcggtcgtgcagagtatgcaagtaaaaaaaaagacggaaataagatactataaaataatgggaaataactaaatactcccacagtcccgaaatgtgtacttttcgcatgacgtttaataattcgtcttatcgtaataagtaaataaatattatttatctcgttgtgacttgttttaccataggagaaattatggtcttaactcatactttacatatttatactaaatttttgaatatatatatttacactaaattttttaataagatcgatggttaaaacgttatgcgaaaattaggattgtcatgtattttggtatgaaggaagtaagttatatggcttacagaactttgggacaatcaggaacaagaagtatcatgatgccatctcagtttatataaaatcagtatttgaaagactagtacgcttataccatgaaatgcaaatttctagcttttctgctcaaacttcgttaagtttgaaaactaatctgcatatagagtccaatacaggatttatttgaaaataatttaaacaacgaaaagacttgaattaaatattgtgtcttaatatttaaaatactaggtaattatccgcactttgctgcaaaaattactaagcaattctcaatatattttttcgataatcaagttaggagttaaaaaaaaacagaaacatcgtggtttatcagtatttatcatgaaacaaacaaatgatacccaagctttaatctgaatcatattaataagtatatgttaaatattataaaaaaatgatagataaatttattaaaatattatgcaaatgacgcgaggggtgatgattagatatgctttcatgttgatttatagaattaaataaattatagatgatgttgtatacttgcatgaggttaaatatgtaattattgctagtgggtaatgatgtagtatggttgcatgttgagttttaaatttaatggactataactatatagaaagtatagattggtgtaaagttatatagtgactattttagatgatgaaatttattccggtatttgtttggaagaagctacatcgaattgttacaaagtttgcagttcaaaacgactacaaatcaaaaaatacagtatgatggaaaacaaagaactaactgaaacatcagcctaaaagcagagatgagaacccataactaaaaactctgtgctcctcagccacaaggtctcggatacgttatcgcccaagttctgaaattgaactgaagtcttgaagtcacagagaaagattcatcgagatccatgctagattccttaaaaaaatcaaaatccattctcgatcgaccagatgatcagatgatatgcacatctccgttagctccagaaaatgatgggctagatgatctatattcgaagcctcacccccttctaattatttgatattaggtacttccctaatattcgtatttttttaaccgaaatatggaagatgggtcaacttgaagggtcataaaataacttaattgtaaaatatgataatacgctacaccaaaaactgatgacaagtcctcgcaaaaaagaaaagaaaagaaagaaaactgatgacaagggaggctacaaacatcgagatcaccgtcgtctacttcagtaaccacatcagtgacatccacgactacgacgtcggagaagcaaaccgtcagctgccatccaaccaaatcagtactcctcgctaaaattctgtagaatggaggaaataaaatgagcaaggctacaaactctgaatatgttcaatgctacctgccatctgttcaacttccatggatatttacatacatacgattcatctgctcaaaatgtgattcatatccctcaaatacatgcaggcatgggatcgaacagttcacatgtacacagctacaaagcaagcgtgcaacgcaaatattatctatatatcatcttaattacatgaatagtacccaaactaacaaattgtataaattatagttagctcaatataagttctaaaaaccctaggctcaattgggcacgcataaaaatccatatagctattgagccattttaggtttgaccaagtttacataaaaacataagcaatattttcgacacaaaataaacatagtttcaaataaatatattaaatagtagttttagacaaactaatttgatgttgtaaatgttgctaaatttatctataaacttggtcagactgaaagaagtttgactagaaaaaagtcaaagttacttatgttatctttatctttacctattataaaaaaagtttaagatgtttttgtcagagatttttgtacgtcgtcgtgtccgattcactggtggagaaatgctctttactcctggtttagaaccctttatagtcccggttttctaaccgagactacgaatccgggactaaagatcgctatctttagtcccggttatttgaaccgggactaaagatcgatctttagtcccagttggtaacaccaaccgggagtaaagaggggaaatctttagttaccaaccgggactaaagagggcaagcgacagttcctcgagatccttttttttttattttgttgttgatttgcttaatggctagggttaatccacgtattttctcccgaatcgaataggatgcacatccccaaatcaacatcccaaatattaagttacttatacacacgaatcaaatacatcacaaatcctacacatagatcaaatacatcacaaatcctaaaaaactaaacacaaattaaatacatcacagattatacaaattatacatatcagatccatacgatgcaatgaatcataaaatctaaaaaattatacatccagtgaaacacaaattatataaaaaacaaacaaacgagccggcgccaggccgccgcacgcagccgcccgcctgcccgccgccgcctcccccttcatggccacgccgccgccggccggctgatagaagacggagtaaaggggaggaggaggaaggagaggggaggagaagaggaaggggaggaggggaggaacacaggggatgggaggaggaagaggattagatctgagaagaggaagagaggggatgctctaatcttatctaaatatctgtctgggacttaaccgat

SEQ ID NO: 69700 - DNA, 8477 bp, Oryza sativa
atcttcttcagtgaacgagcagcctaagcccaaatttgtcttcggcttggctcggccacaccttggtgagtacccttggaggcccaacaacgcatagattgtcggcccggcccggcccgtacgcggcaaatatattcgctgcactagacactacacaaagtgggctccaccggggggagtcgccacgacggcaccgggcaccggcggaggaggagataacgcggaggcctcgcggcgcaaactccccaggtactcgcgctccttcctccccgcaacccaccagctcgagcctcgccggcgctccgaccagcactcgccgtgcgtttctcttgcggttgggaaggggtttaccccgctcggagttgctccgccggcggagaatgtggtagccacgccgcggccgaaacctcgtggtgtgtgtgtgtgtgtgatggcggcgccgccgccgagcgcgacggtggggctgattcccaacctggcggggcgcggggtcttgctccccgcctcggcgcctgattcgagcgcgtgccacgggttcgtggttccgacgaggaggaggaggagggtctccgtggcgccgtttggttggggtttggcgaggagaggccgggtttctgacgcgagagcggatggttttggtgctatgtgcgcggtggctggcggcgaggctggtcccggttcgtccgagttgcggcacgtcgagaaggagctgacgtttagcccgactttcaccgactatgtgaagatcatggagtcggtgaagttggacaggagcaagagtttagagagcacagaatcggatggaaggagctcgaggaggaggtttacaggcgatggcgatgcaccggttgttcggcgaggggacgagaggtcaggtgatggaaggagtacatcttttgataggcaaaagggatctcagaggaacagaggggatgtgaatgagaggagcatggcgaataatgatattcagaacaatagtattaggttagtagagaaaaaaaagccaggtgatgttgaaaagcgtcggggaagacagggaaaggtagatgaatatgtacagagaagaattgttcgaggtgagattagtgaagatgaaggtaatgttgataaaaatgagcgcaagcagtttacattgcagttgaagatgaaagatactagaggtagtatggttgctcatcaatcagagagaaacatgcatgttcagtcaaatgcacggaagggtttgcaaagacagtcgacttcgatggtaagccatatttctagcccttcaaacagcagaattatattggagaacaccaagtctttggtaaaaaggggaaaggagaactttagtagcccagcaagaagcatatatgagaacaatttcaaatatcccagagaaagaaaatttaccaactatgatgtcaatgctgatgataaatttcaaagataccagcaaacaacagaaaattcagggagaggtgttgtagtgggaaggtttggagagggtgatattgattataacaaggctactgtaagcaaaagatatggcaataggcaggcaacgtctgggcatgatggtcatccaacggtcagcttgaagcgtggaaaacctgaagcaattcgaatgcagagaggggaaaatgtccaaacagggaagtttattaggagagatgcgaaagctatagacttggacgatagagctgctttcaagacttttgaggtattcactgatgtcagaaacaggccacgggttcttcaaatggaactggaagatagaattcagaaattggctagtcggtaagtctttgtatgattggttttacagcctgtattgaatttgttgagttgtcttggttttgctgttgtataaattcatcataatagcctcttctaatttgaaaaaaaaaaaactcatgacggtattctgtcccatcaaaactacttgacactgcctctgctgcaggttgtttgatgggcattaagtattttttacaagagggagttgcctatatgtagcccttagcatgagtgttacttcgtttgaaaatctcagggcgttctagattctatttgaacactcatgtattcaccaattttaccatcgttgttcacatccaatagaagaggacactgaccacctctttttaattgatcacattaaactacatgatgtacttccagtgacatgaatttcgttttgatagataatgagtaataacactgggcttctatcaagactgctgctcaaatatattgtatcaatacttgcttatttacaggctcctgaaagtgagatgttacaagaacaggcatatgaaaactgttgtccgataattcccactctaaaattatgtgtgaacttttttttttgtgatcatgttatctagatgctacttgcttggagaattctttcatgcatgtaagacaatattacatgaatgggacttctagattgaacttagaaaatactttcattcgttgatgagcatcttgctttcctatacattttttgttgcttcctagacaagtcattgagcctatggagtcttcgctgtcttagttaattctttatggttatttattttgtgaaggctgaatgctacagatgtaaatactccagagtggaaattctccaaaatgattcatgatgcaaaaatcaaattctctgaccactctatcctaagggtcgttcaaatactgggtcgatatggaaactggaaacgggtcttgcaagttgttgaatggcttcaatcccgtgaaagattcaagtcctacaagagcaggtaatgaaacagttacccatttatatgttaatatattattgtgaatcttaaagctgcagtgttagtttatatatgtatatttcattttttaccgctgttatagacttatattgttgtttatgtagcagagtataatgtgtactaagttgtctgtgatgaaataagtttgcttcttcatttgttcatcttgtagtttctttttttgtttctcttgggtaacccgtaagtccttaagaatcacattaaatgatttacaatgcttatcatatttaatgcgtatgatgttcatgagagaacatatttgttttgtaggtatatttatacaacagtgcttgatgttcttgggaaggcaaaaagaccttttgaggcattgaatgtattttacaccatgctggtataactagcgctcatctgtcttatgtttggatgtacctaatctttccatttaaatgatgtccttatatttcatctgcaggatcaattgtcttcttatcctgacatggctgcttatcattgtattgctgtgactcttggccaatcttgtcttgtaaaagagctatttgatgtgattgaccgcatgcgttctcctcctaagaagtttaagctaagtcctattcagaattgggatcctaggttggaaccagacctcattgtgtacaatgcggtgagtgacacttttagcaaatgttctatgtaagtgagtgcaccaatgacaatgagacatgattgtttaatattgttggtaatttagtattcagtagaatgtaactgactctactgctatgtaggttctgaatgcctgtgtgcaacaaaagcaatgggaaggagcattctgggttctgcaacagttgaaagagaagaacatccgccctacaaatacaacatatggtcttgtaatggaggtacggtaatcttgattacatattctctctgtcctcccctaaaccaactgtgctggtcatgcagaaatgcgactgcaaatcttttatgattttatggaattaacacgtaatttgcggccgtgttctgcgtgcatgggactatacatatgactcatgacagtttcagagaccatttctgcatcgatgtttctcttacctggattctgacaagcatattatatctatctacagcagatagaatgttttgctcatatgttggtcttagggaaaactgttgcttaacttggttccatacgatttccgtagtattgattgtattttttttttcatatgtttggcacaattctttatgcagcgtaatccattttttgttataattttgtggtactgtaggtaatgcttgtttgtggcaagtacaacttggtgtacgagttcttcaataaggtggagaaaacgtcaataccgggcactttgaactataaaggtaattaagaaggtttgaaaacagttgaaggcaaattttatattatatctcatatctcttgctgcttgcagttctcattaatgctctttggagagaagggaagattgatgaagcagtcatggctgtcaagggtatggaaagtcgtggaatagttggttctgccagtctttattatgaccttgctaggtgcctttgcagtggaggccggtgcaaagaggcacttctccaggtttgcacttgcaaaaatatagttatatcttgtacatgacacacttgctgtagctgttgttgcaactgaaaatacattttgccacctatagtcatcttgaaaagtaaacgtagatctataattctatattggacttagaacctcagctgcaaactgattcttcatttttttaataaccgatagcagttattctgctggttttaacaatttatcggcattttactgtcattagttgctttcgtgaccataacttttactctaatcccgatttctcactagatagaacatacataatcacaattgcgaaaagcatattcttgttgaattaggcactgtgtgttggtatatgagactatatgcatatatatttttgatagatgaaccaataggctggaatttagttcccacagtataattatcggtgtgagcttcaaatccaattaacttactttttgtaaaacaagctgaaaaaactttatcaaacagccaggcataagaactcagcttgaacttgtctatctgtaagcgccatcacctgtctatgcttgtctcatgcctctagatgctttgttttatctcttaacctttttctgatggcaactgtaatgcaggtcgagaagatttgcaaggttgcaaacaaaccactggttgttacctacacaggactgatccaaacctgtatagacaatggaagcatggaaaatgctaaatacatatttgacgaaatgtgcaaatactgctcacctaataacataacatgcaacatcatgctgaagtcatacactgaacatggaatgtttgaggatgcaaaagatctattggagaatattctcagtggcaggataaggagtaaagtggaatcgagtcaaaaggcaattgcagacaaggttactttcaatattttcatggaggcctgtgctgaagcaaagaggtggaatgattttgagtatgcatttcgcaaaatgttatctagtggctaccactttgacgaacgaaggcaccttcgtatggtgcttgatgcatataggaacgggaaggtgcttatctcatattcctaactctttaactatccatgaatctccgtaaatgtagcttataaggatagaatattcattgtgcataatctttcatatctgaagttgaagatgtttggttcataacataggtcatgttattgcaatgaatggaggatgtttgattatgctgtttttcccccatatgtatgtgatcataagattgcatggtgactgatcttagtagttctgaaatctatacatgtgggccttttagcttatatttctatgccctcagagagaacaaacctcactagatttaaaaggaaatttcaactacaagcacagcataatagtactagccccagtttggcaacaatttgagccaattccttcagtattttatggcttactgtcaatatgaactatgcttagagttcagattttatggacaatgatagaatgcaagatatatgatcattttcccattaaactgcttcgttaattatttggtgtagctattcttagccttactgcctttcactattcaggagcagttattggaagatgtatgggactacatgtgccaatatggccgagttccgcctgcccccatgataatggaaagattttgcctgaaactgagacaaggggacacagtggcggcgatgtcctgcatcaatacctttcaggagagcaagatacgcaatgtttcatccatgtcctggttcaatctgctgaaccgtaatggggatcgcttgaaggaggatattattatcaagctacttcatgaactcaacaaccttgtaagctcaagtggtcactctgattctttgtatcaaaatattataagtagctgtacagaattcctttctgtttccacctctgtagaaaaggcgtcttctgatcagcagatgcttccctgtacgtcatagctactatatattaatatgccattatctaaaagaaaatcagagtttggtcattggtcatttggttcgtgctccaaaaagtttgatcatcaaatccatcggtttgctcactgcatcatactattctacgaggataagtgatcgtatgcatgtagcttggtgggctagttatttgttgggattgcatatcggcagaagtaactaactctgaattggtcgtcatcctgagatgcatggcacttcgcctcgttttaaacatcacctactccgctactcactacccgtgtttctcatgttgatatcaattttctcatgtcagtatgtcagctgcttggttaggttctctttggttgttccgacaaaactttgatactttcagctggtataccaaagaacacatggagaagagctacaggtgtgaaaatttctgggtcaattacacacatagatgtcctcgcataatgaatttacgcatgcagccgattgggaactctcgagcctgacgagtagtccaacaccaggcacttgtttgctcgcacgttcggacaggtctgaatccatcctcttgtctggactctgaagcctccatcttgcgacagtcgcctgattggcgctaccaaccgcgcgagataaggttagctcaactttggagaagaaaacgttgcatctgatcgtcgtgtcagtctccatgagcagtgtctctgtacccctcttgttcttttgataaagaaagaaatttttgaagcttcgtggatatttctattttccgtcaggctagacatatgttaagattaactataagatttcggtaagaatttcaaataaaacactctaattttgttagatgtttgaaatttttcctggagaatatatacaggtgatcagacagcaggaggaggatggcgcgcacgacgaaggcggctgcgcgacgtgggcgcggcgacggcgtcgtctccccaacagaagaggaagttattattaagctggcaaagtggcaactgatgaataaaacagaaaagaaaaaaaaagaaaagaggaaaactaacagacggacagctaggcccgggcatcaaataaaatcgtcggaaaaaatcaccaggaataaaaaaattccccttcctttgcgcgtcccacctgtccccttcgtgggccccaccaccgcacgtctccaccttcccccacctcgccgccggccaccgcctccgcctccgcctccgccgccgccgcctccacatcccattccccgtgccctcttccccaacccccctcgcgccggggggcctctgcgtgaaggaagagggcgctgcgacgccgaccgcgcgccggtaatgagctacccatccaccaaatgcgatctgttcgttcgtctttagatgaatcgatcgaggcttagagccttagacccggttttgctggccacttcttcgttatggaagagagattgttttatttttgtttatcgttttcgagtgcaagcatttggcgccgctaagaccccctgattgcaattggtcactaaacaaatgtcaatgtgaggaggaggagggtattaaccctattttaattccatgtgtgatgatgagcacgaaagggattttttaaaatgcgacgaatccgtcgccggcgaagctgaggcccctcgacagcgaccttctcgggcttcttcttcttccgcgcgtgtccccatccaattctttaatccggaatttcgtactcccggcgtggaattgtcctacagttgtcccgtggaattccgtccccgctttttatttctttaagcaacaatgcaatcttggtgatgggagagattgcaccgtgatttttctttgtaattttcgatgtttttttattttataatcgatttcaatgtgttgttgcgtttctttgatttcgccaactactacttgttcctccaagaacggacgaacgctgtttgggctccatttcctctctgctcatctcctcctccgttgccccaaccaccgggtgagcagagcagccttctcttctcttcttctctcgatcgaatcctccttttcggtttcttgattcgaatcgcgtgcggtgtaagctagataggcagtggtggccaatcaggcagagagaaaaagtagctaaagctgtctccttccttgctttggggcgatgcaag

SEQ ID NO: 69701 - DNA, 18870 bp, Oryza sativa
ttagttccaaagtttttttttccaaacttcctactttccatcacatcaaacctttcatacacacaacttttcagtcacatcgtctcctatttcaatcaaattctaaactttgggccgaactaaacacaaccttagttccaaactttttattcaaacttccaactttttttatcacatcaaaacttttatacacacataaacttccaacttttccgtcacatcgttctaatttcaaccaaactttcaattctggtgtgaactaaacgtaccctttatgtgtgtaagaatgttttgatgtgatggaaaagttaaaagtttgaagaaaaatttagtatctacaccaggcctacctaaatagtggccatcattcagtacatcgccgtctacacgtctagttgcattgtgatcaagtcaactaactctgtcccatattacttgtcttatatgatactaactctgtcccatattacttgtctttttgagttttttttatcaatgtttgatcattcgtctcattcaaaaaattttggaattattatttattttgtttgtcatttgctttattatcaaaagtactttacatatgacttatctttttttatatttgtactaatttttcaaataaaatgaatggtcaaacattacaaataaaaagtcgaaaaggtcatctattatgagacggagggagtacaagagcttctacgaaagcagtaagctaggtattattataggctaatagctgtggataacccttacggcggcgtgcaaagtaaggtggtcaggtcaagcttctcgcctggtcaggtctccatgcatgcatgcctgacgtacaaaatacaccatgtgtactatcctagtcatgtctatgtcgtatttatacgtatgtgttcatttcagtatatatatccaaaactagctagctagttgtgtgtatatatatcgatcagcttccaacaaaggcctacatgatgatacgatgcctcttccggtcataaattcaagtatgtttacagcaagatttaatcatatactccctccgtccctaaatatttaacgccattgactttttaaaatatgtttgaccgttcatcttattaaaaaatttaagtaattattaattcttttcctatcatttgattcattattaaatatacttttatgtatatatagttttacatatttcacaaaagttcttgaataagacgaacggtcaaacatatttaaaaaagtcaacggcgtcaaatatttagggaatgagggagtacacttttgatattttgatccggcattaacttcttaaatgcttgcgcatatattttctttaaaagtgttatcatagcatcataaatttaatatatagaatttttaacttatatcaaatatataatgttgatggttaaacttttaaaagtttaactaattaagtcttgtcttaaacatcgaatatttgtgattagagggagcacatatttgggagcaaatgtgtctactccaagtaatgtttttacaaaagaaaattagcaagatagctgcctatgcgatcaaaatgagaatacaaactccacattaattgtctatgtctatctataagataattttaccatccttaaaaagataaaagatacctagaggtttcatatttttttagtgtaaaatttagtacctctaggtactaagtaccttaagttacttaaaaagtttggtgtaaaatttagatatctgatagtattttttaaggactataaaattcctcctatctatatataaacttacacacatgtccacagttgttcgatgatgtaaacttgcatgtatcctaaataagccctgtgttttttatctctattaagctaaattaagccacacaatacaattaaattatctctctgctaaactgacaatcaagttggttgttcagtacctagcttgtcgcttaggagaccgattgatctgaatatatcgaacaaattaagctacagtcagtcagtcgacaggttcttgtcgttccaagtcatgatcgatcagttgctagcttttggcgagtctgaaagaaataaatcctggtcttctggttgtactacaaactttgacactgcaaactctgatgcgtacagctaactaatgctatctatatagagagctaatttagtctatttactccgattaatgctaatatgccgtgtcaacaaaacaagagatactacctcccattcaaaacaagcccgtacttatataaagctttcaggtgcaataatgtcgattagttcaatatcttacgaaatttcagcgattcagagtggttgatgtctcgccggtcaagatgcttttgcgtacataatatgctgatctagatcagttacgttagtcaatttggcatcagctttgaaaagaaattaaacatgtagtttcatgacttgagtaagctagcattcatttatttattattatactatagttatgtaaggagaagccacaaaatttaatgtgcaagtcattgcaaccacagagtcgtccaaaaaccatcagatgttggtcacagtaaataacttgtggtaccaatattgggtgcttttgattcaaaggattagaattgacaaaccatggcaattggcaaacaaataccactaaggtgattttcatgaacactctttctagatatatacggttttggttctgttgtagcaggaggtatactccaatgaccactttgcaggagatctagatatgtgcaaattgaaatttgtcatttctttaactttttaggaatctgttgttttatttatctctcagctccattattgcgaaacatgatttttttttacgaacgtgcaaaaaaaattacatgtcaatatattagaagaagaaagcaaagtttagttacacaatgcaaaaggttatgaggacgtagccaggggacaaggaaaaaaaacccaaaaaagtgcaaacaaaaaggttagctattgagaaggaaaaaacttctattgcgagggagggtgaggttggggaaacctcaatgccagcagtgctagcagcagataatcgcagacggtctttttggaggatggactcaagaactactaaccgaagagcatggaacatgtataataatgtacctttgatccaacggccggtttatccattatctgaaaaataccgctaaaagaggccaatacgaacaggtaacctgataacggtgctccataaatcaactagcttttgagtcatagaaagccactagaaatagtggcgcgctacgctgcgccggtcgataatgtcattgaacaattaatatataattgctctaaggtccaagagaactacaaactaaacattgaattaagcataacagccacaacacgtcacagaggcttactaattaccatcaacctgtatacaaaacaaaaggttgtaaatttgttttattagttacgaaataatttcagcacattttacactggtacactccagcaatgaaatgcactcacccaacatctaaactactcttccccactgatggaaagtatattagatatactttgtgttgcatatattactgctgaaaactccctcccaagtagtcctacaacagtaaaagaaagaagattagtctatgcttgctgatgacaatggtttgaaggttgacaaattaagcaatgaattttacaatcccataggaaagtatactacagttatcctacattcagtcaaaattacaacaccttttgggagctctgttatctctctgtcatatcaagttatcaatagtagggtgaaaggaacaaccacgcagttgcgatgccaaaataacttttcttgctcaaattttgaggtgctagtgctagtaaaagtgttttccgcatttaagagaagaaaatggataggcatatggttggattggaaaactttagctatggggtaatttactctacatatttgagaaaactaattaagtaacaaatttttatttcgatgctgaatttgaaaaatagaacatatcagtcggctagttcgtacaattgcttccatgtaggaaaatacaatatgtcaaacaatagtgaagtattatcaaaacagctttaagttcagttaaccaataaatttgaaagtagcaacagtaccaaaacacatatgtcctgacagtataagttggcgatctgccttagtatggatttgtgccctcacacgtgctctttgcaaacacctagaacattgtccctctttaaaaagcacattatgcatatcctccttgcagccaagtttagaaaataaattgctgattcaatattaagatgcaaaattgggatcaggggatattcatagattgatccagatttttatttaatgatggataaagatggtaccagtcagtagctgcatgatgtaggagacggtgatggccccagcagctgagttgatgaactcggcagactgtttgtcgaagtaatgaatgacgacttgaactatgtaactgaacaaaatggtattcatgcaaatggggaatgatggagtgagggtgaagtagaagaaacggggttggaagggaagagtgggcataggtgttcaccttgaaaggagagacggtagatcagcttgtctaaacaacagcaacgcctgatgatggagacggatacgccttggatggttcaggagttgggatccggaaggctcaaatgattcacatgagatggggaaacaccacatctcaagctcaagctcgcagaccgtcgagatgatgctatgtactccctccgtttcacatctatctagattcattaacattaatatgaatgtgggaaatgctagaatgacttacattgtgaaacggaggaagtattgatgatgcccctatggcaatcgatgtgggacgaactgccatcgatgggccgacgacgatggaggaaaaaacctgcgagggcgcgagaagagtgggaagaagagaaggggagggaaagaaaggggcacgcacgccatgccctcactccgttgcgcgaggcggagagccggcagcgtgcgccgatgcgtcgctgtctgcccacgagagggctacggcagcgtggcggcggatgaggccatatgcgagcgggccgcgagcgctgctagggttttggctgtgtggggatatgttgggaagatcttgaccgtctgttgtcctctcgtcgatctgatggtggtggaagagccggcaccgtaggccaggtggacgactggatcgatcccaatgcggcatcgaacagcgccatggtaggtgaaactcgaacgtgattaaccgaaagaacggggttcgaacgcgattaaccggaacaaccgggtgtttttttggaaaaaaaccgatgacgtggcgccctaattttccagcactcccacgacgtttagagagattaatatgtgttaggctctgtttggatattttggcttattgataaattattttcttaacgttgcaaatgataatatcgttgtgttctaaaactctggaataattagtacatgaacgatagtcatataaaattatatgatatataatgatataatccttttttatttttaaattgtgttggcacacatcaaaacctcttagattttagcaatgacctccatgaaagctatcacactctggatgtgtttagttcacgctaaaattgaaagtttagttaaaattggaacgatgtgacagaaaagttgaaagtttatgtgtgtagaaaaattttgatgtgatgtaaaagttaaaagtttgaagaaaaagtttgaaactaaagacctctgtacgtagcatatctagcaagaaagagtatgttggtgctagcagtcaatgctagagctagcaaggcccaattatcgtttgaaacacacacgaataatcttgacccaatgaacacgctgcgttaatgatccacacggaacgatcgcaatcggggtttaaagggacgcaatgtatatagtacgtttgactagaaaaaatatgctactccctcagtttcataatataaggggagtttttgtttacattgtttgaccattcgttttattaaaaaaaattaaaattattatttatttttttgacttattttattatccaaagtattttaagcacaattttttgttttttatatttgcacaaatttttttgaataagacaagttatcaaacagtataaataaaaattcaaaattcctcgtattatgagatggagggagtactactcctgtacgttcacgagaggttaacacacatgctccctcgaatcgaagctagtaataacccagcagagaaagtgattgtgattgacggcgatgcttgatttctgctgaccttgtagctgatcgatcagcctctaaatttgaccggccgccggcgtgcacacggtgatgtgcctgtcgccggcggcgtctgatatgcgtttgttttcctgtgtctgtctgtggccgagtttagttttaattttttttaaacttttaacttttttatcatatcaaaacttttctatacacataaactttcaatttttctattatatcattttaatttcaaccaaacttctaattttagactgttgacacgcaaaaactgagctataccaacactgggcagttcaactgctcactaattcctctgcatttatttttttttttgggggggggggtgtggggggtaggacgagtacagggcaaattaaacagagtgcatggggtcataagtccataactttttcctagcagatgtcactacagttcacattggagtacagagctcttctatcataataaaagaaaatggagaaatacgaatgcatttacacattaatcgatagagtttttctccaagagatttgaaggcttgtccggatcgaagggtttacgtgaattttttctacgactcatgattcctttggattatctattgttcatgagtttggtttgtaggaatcacccaaaaggaattttcaaggaatattgtagcattctaataaaaacacaggagtttcaaagaattccaaacatccactctaaccactttttttttcattattagctgccacaggatggaatcatatattctaatcctctattttctattcttgcgtcttaatatccaatcctaaaaaaaatcctctgttttctaattctcatttctcacgtgcaaccctatcatgtttctacttttttttcttttctgttcctgtgttttttctaacatgtgttctgaatgagccctgagtggacaagtaattttctttgttttctcttcacaacttgtatgaaaggaaatttttctttaggtttcctgtaccttattcttacaaattgaatgacacttataagaattaatccttataaatccaaatcatttgcttttcccttagaccgaagaagctccaagttgtgagttgcagaggaggatagcttagaaagaaggtggcttgggttatttgccaactgagtgtactaaattatttctgttttgccattttaactagccaagtcagcaatatggatgagaaatgatctttctgttctcatcttgccctgttcttttctccaacaaaagttggataaacttttggatactcatagcacgctttttaaactactaaatagtgcgttttgtgcgaaaactttctatgtgaaagttgttctaaaatatacaattaatcgatttttcaagtttataataattaaaactcaattaatcacacgttattaccacctcgttttgcgtaaaatatttaatcttcatattcaggagattcaaacaccaccacgtttagtgcataattaattaagtattagttaaaataatttttaaagtaactttaatataattttttttataaaaaatgcaccgtttagcagtttaaaaagcgtgccgtggaaaatgtttaacactgttgttgacttttttaaatatttttgaccgttcgtcttatttaaaaacttttatgaaatgtgtaaaactatatgtatacataaaaatatatttaacaataaatcaaatgatacgaaaagaattaataattacttaaatttttgaataagacgaacggtcaaacaatttaaaaaaagtcaatgacgtcaaatattttgggatggagggagtatattggtaccggataggagacaactatatatacgctgtgagggacacatatatgcggtttacctccatctccggcggcgtctcgatcatcgaccaccggcgggatggatggaatcgacagagagatcgacccggtttttcaacggcgaatacggccgacgacgacttgttcccatccatccatcgggatacggcggacgcgttgaattccggggccgattgtttgaccctcaaactcgatcgcccccacacacaccacatgcacactctcgtcttaggtagtgtttgaatccagggacttactatcttcgtcctaaaataagtgtagccgtgaatatccgtgcccaacatttgaccgtccgtcttatttgaaaaatttatgaaaaatttaaaaatatttagtcacacatgaagtactattcatgttttatcatctaatagcaataaaaatactaatcataaaaaattttcaagtaagacgaacgatcaaacgttgaacgtgaatagtgtaaaactgcacttattttgagacggagggagtaactttagtatatgtatttagacactaatttagaatattaaatataaattgcttacaaaactaattacataaatgaaagctaatttgcgagataatttttttaagcctaattaatccataaatagagaatgtttactgtagtatcacataggctaatcataaattaattagactcaatagattcatctcacgaattagtctaagattatggatgggttttattaatagtttacgtttaatatttataattagtgtcaaatatccgatgcgatagggacttaaaaataaattttagtcctatctaaacaggatcttagttctttcagcttaattaattactggtttggactttctctgcgagcttgattaattagtgtgtccgtggacatcgatcatatgtgagttaaaattaacttggtcgtcgtactttggatcaaagatgatcggggataattacggtccaatcaacgcgtgtttctttcgtttatttaacgttgggttacgtaccatggaggagatcacgtcagtaaattgatatactacttatcatgcatggtctggatgtggttaattattcaaaccacttttaacttatcctcttgatgaaactctaggtagctagcactagctacgatgcttaattaatcccatcctctctcactagcttggcgaacatttgagataaaggagggtgagatgtggacacatgcacgcaacaaaatacttacggcatccgtctcaaaataaatacaattatacatttaaattttagagtaaattacatcgtcggtacacaaacttatcaggtgggtgcaatctagtgcacaaacttataaaatactcgttttggtgcacaaacttgtgtggtgcgtgcaggggaagtcaaaaagacactatatgactaatcctattgatttaggggctgattaggatgctatgtaaacacacacacacacacacacatatatatatatatatatatatatatatatatatatatatgagaaggttaccactagacatacacatattcaataaaatatagaatataatttagtgatagtagaaaaacattaaaaatatcaagcactgatataagggttagaaacatataaaattcatcatctcaatgatgaaggataaagtagagactaaatttataaatattgcatgtcttatgcatactcgctacaggtatacacgtcgcatcctaatcaacatcaacttcataaaattgacattgccaagttattttgatcctcgttcgcacgaactagacaagttcatgtactgaaacaagcattttttacaagtttatatactaaattacacccacctaacaagcttgtatactatcaatgcaattttatctcatcaataacatctgagtcctcatattactctcaatcaaccttataacttcctaccatcctcatttaatatgggacacctaagctgtaactatttttctctcccactcctaaaattgcacttatattgcaattttttttactaacagttttttttaaaaagttaataagcttagtactagctagcttacacagagttaagctttactatatcatgaactacatatctatataccatatatatgcccctacaaagagaccatagaaaagtaaacaaaatcgatcaaaaaccgatggccggccggcaagcacgtcagggtatattaggaccatgcatgcttcgtacgtacgtatagtacatgcctacatggtagtaatatatatgcacgatccactggtggagaaaccatttatacttccagttggtaacttcttttagtcccggtttttcaacccggactacgaatccgggactaaagaccggttgaaataaccgggactaaagatctatctttagtcccggttggtgccgggactaaaggtctcttttttttcattattttttagctagagtttaatccctatattttctcccaaatcaagtgggatacatatccccaaatcaaacctcaaatcaaaataacatcccaaaacattcacatcacaaatcttaagttacttatacacacaaatcaaatacatcacaaatcttaaaaaaattacacacaaaccaaatacatcacagattatacatctcagatcatgcaacaaatcacaaaattatacatcttagtgaatcacaaattgtaaaaaaaaaaagatgccggcagcggctgccgcctgccgctgctcgccactgggcccgtgcgcggcccagccagccgcctgctgcgtgggaagggaggagggggaggaggaggaggagggagatcgatctgagagggaagaggggaggaggagagggagatcgatctgagcggatgggaagggaggacggggggaggagagggctggggatgggaggaggcggagggggaggaggagagggagatcgatctgagaagataagtgcgaggcggttgtggaggagaggatagggaagaaggattatatattaagcgttgaattttagtcccggttggtgttatcaaccgggactaaagatctagaagttgataacaccaaccgggagtaaagttaggatcttaaccaatcgggactaaagatcccggaggacctgacaaggcctgacagatttagaaccaaccgggactcaagatcaaatatgcccactgtagccaccaacctcatctttagtcccggtttttagtggaaccgggactattgtggatttcggccaactgaccaaagatggtttctccaccagtgatccatcgatatatacaaattttcggctaccgatcgagacggaacaaattaagagtataaatcccataacagctatttgaattacttctttcattttaaaatatagcaacggcccagtgacagagaaaaaaatatgaatttctctaatttccacctgattgtattgatctctaaatcctactatatattgttcttaattacaatctagggagagagtatagtgttttgagagaaggggccttaattatatccagtttggctagctggttacattggctcatggaatcttgtgtgtatggcatatatttttcatgtttggcagtgatcattcacactccaatataggttcacctggacgccacaagattttgtactactctatcactattacatactatagaaaggtccctatagattgcagatggaccaaactaatcatgcctgaaaaaaatcgaccttgatttttgtacgcaactctttgagaggcctgcatgcaaaaatctattttcacatgagaacctcttaaaaagcaacagtatgcaaaaataaatatattttctaatatagatctcttaaaagtctgtctagaattctgacttacctcatcttttttccaactcatcatccttatctcctctcctcctctctcacctcctctcatattaattcttcctctcctccactcctctctctctctctctcaatggtcggcggcgggtggctacagcgaactcgagtagtagcggctagtggcggcgcccggccaccctgggagacagcggtagtggcgaggctgtcccctacccggatccacgcggatccatcagcggcggtgagaggagcccaacggtggactggatttttatttttacgtgcggacgacatatgcatttgcacgcgtatgcaagtacgtcacccgtatggaaagatagatatttttgcagatattttcggacagacagacggctcaaccgcacaaaaaatagtttttagccgtttggaaaaatgcttttttaagtagtgtgtacttcaatatatattttaatatggtaggatatctagtccaataataatatattacaagaaaaattatagtcaaattttaattcaaaagaacatgacaaagtcaaacactgtatacataaaaataggcaaggaaatatatatttcccacccaataaaaaccaaacaatccaatccataacaaccgctgcgtttttagacttaagcacgctccctgaaatgctagcctgctaattcttgtaaggaagaaaaaaggcacgcagatgttgaagctaagctatagctatagcctgttaatcataattaaacttgagttgctatcctccgaaaaaaaatattagagttgctgaatgcctctagcatagttaagaatatatagtggcctaaattaatggttggagtgtccaacttgaactgtttgatacctgagccgaaaaactatagctctttccatattaggcacatgcttagttaaagccttcgagttgtgtgcattacgtcacatgcaaacaatgcaggccaattaattgcacgtgaaaattcgaccgaatgaatcgtgcaacgttgaaatcctattctcaagcatacacaaaagaacttcaatctctacgaaccgacgatactttagttgataaggtttcttggcagaatttgttcattggcagctcaagttctagagtgagtacaagtactcatatttatgattatttatttttttttagtaatgagcgatgtactaatcagctacaagacacaagtaattttatcaattttaagttatatcaattatttgtataagtacatgtaagcccctactcatgagccaaatgatgatcagtggtttgcaggtcacctcgggctcggttcgtttcacaaacgagctacgaaagaggcttgagcttagctcatttggctttcaagctgagctgagccgagttggtcaaacgggcctaagctttttatccacctatgttcgtgtgtaacttttagtactagtatatttatgttaccgctattcattccaccacagatctaatggttgaaaatggttacaccacatgtcaagtcacaagtagggagataaaacattttgggtagtaaaataggatcccatctcgctcatgacgattagtccttttacttagtcatatagcccattgccccacatgtccttggttttgctctcgcggggatgagaagacattgaattaggttaggcggtgaagaaaatctatggaaggagactcctaccaagaaatctccttgctggtagtctcaagaggtgaacacggagcttaaaaaaaacattgctaaaggcattataagagagatgatggttcttagagttgaagaatcaaggaaagaaacgagatataggaaaaggctaaccaatggagaaagatgatatagagttagcgatagagaaggctatgaaagggaggcaccgatacaccagccactagaaacgaacaaggaaagggaagagtattggagaaggtgttatcacaaaagtagaattgagatccctctaccttctgtctttaaacgcactgtgttttaatcactgacatatgggtcagtgatttattaggcttacacgtcagtgacaaaattaaagtcgcgtgacttcaaaactagaggagcttgatcctcatagagtgataccttggaaatacccagagctacctcctccaaaagcaaaaccccaaaaacatttttttaaaaaaacacgtatacagccaaaatacgttacacggtggcctagccagtatataagttgaattgaagccttgaaggtatataggcaactggttagacttttttttccctttgcccataataaagccatctctcataaagccatcgacctcatctcctcctcctcctctctctgtctctctctggctgttcttatcagtttacgttgtcctcatcgtcgccggcgccgccctccaaagcttcatagatagctcgatcgatcgatcccgtcgtcgtcgatcgtcgtcgacgcagcagcctcgccggcggccggagactggggagatcgatcgagagggagggaggttgagtaaggtggatccacgggtcaggcatggcaagaggcccctaccggccggcgaggaggaggaagaagaccagccaccgccttcgacaccaccagcaaagcaggagcagcaggacgaggaggagctcgccgcggtcgtcatcagcggcggcggagcaggagcagctccggcgccggagacgtacgcgcagtactactacgcggcgcgcgccgaccacgacgcctccgccatggtcaccgcgctagcccacgtcatccgcgccgcccccgacctgcacctcccccaccacccatcctcctccgcctccgccgccgcccacccgcagcaggcttcttccttctacccgaccgccgccgccgccgcctcctcgccgtccgaccagctcgccgccgccgccgctgccgaagagcaaggtaccagctgatccattcaccgcacaagtaaattcctctctctcaccgcgccgcgtgccacgccccgattgcgaaagcatggcacgcgcgagcgcgccataatttggaagcttcgcatccgccaacgccaacgcccacgccgccgtcttcctcgtcctacgttaatccccatggctctagctagctaattaccgggttaagtagcttcgaagcttgcaatgcatgcttaattagcggtaattgatccataattaattaattagttgaaccaaacgagggttaataagttaattaactcccaaatcgttgcctatttcgtgccggaagatacgctaaattaatagcgccatgtgagtattttatgcacacaccgtattacgttatccctgacgatcgaagggggagtccgaattagtcacggattaattagcaagttgcagtattattattattattatgggattaattagtgggaattaattagcttagtgtgttttggtgggtgcagggaggaggcggcactacagaggtgttcgacagcggccatgggggaagtgggcggcggagataagggacccgaagaaggcggcgagggtgtggctggggacgttcgacacggcggaggacgccgccatcgcctacgacgaggcggcgctccggttcaaggggaccaaggccaagctcaacttccccgagcgcgtccagggccgcaccgacctcggcttcctcgtcacccgtggcatcccccccgccgccacccacggtggcggctactacccctcgtcgtcgccggcggcgggggcatgccccccgccgcggcagcagcagacggtcgtgccgtacccggacctcatgcggtacgcgcagctgctgcagggcggcgtcggcggcagttacatgccgttcggcggcgccgcgacgatgtcgtcgtcgacggtgtcgtcctcgtcggcgccgcagatactcgacttctcgacgcagcagctcatccgggccggcccgccgtcaccaatgccatcgtcgggctccggctcggcgaccgcggcggcgtcgtccacgacgtcggcgtcgtcgcccggtgcatggccgtacggcggctcggagcgcaagaagaaggattcgtcgtcgtgacgtcactggatggatcgatcgatgcatgaatatgccatgcatttgagaggaagaggtcaagtttttttttaagcaatggaaatggattacatcttcggcctcggcacgtggacagaaagagatcaagtgatatggatcgagaagaatgtttagctgatctgctctttactctgcacgatcgaggagatgaaaatgcatgcaatatgcatggaggggtaagtgttaagtggttaattggtgatttttgcgggttaattaattacatggacattaatttttcttttgatcaccttttgtttattttttctctgaaaactatcttcttttgttcatttttattttcttggaggtacttaattaattagctaggttaattagctggtgatttttagtttgttgtttccctccttttgttcaagtgtgaactaattgtgcaaaattagtccaagtaaagcaaagagagaggattcttatttaattattggttaaacattacccttttttaagatgaaacatgatgtctttttttaaaaaaaaaatctgaatgattaccacctctttgtctacatctttggattgtagtggaagcttcttcttcactggtgatctctttggcagacattggaaatgtccaaaggataccataaatggatttcagtatacctttaggaataacattttgttgtttggtagcatgcatgatgggtatcaatcaaatttaacaacctttggaaaaaaataagggggaatcttctccatcagcttctcttattaaaagatttgacttttttgtttagatacttttatcatggttgcaatattggcatctgttctatcgatttatcatctacttaatcctccaatctcattctccgctgtaatgatatttaagcatgtgtcatagtggtatggatgcctttaatgcatgtagcatatttcaaactcagaacaagatgtacttttagaaaaattaaagttggaaccgtaacaagaatctagagaaaaccagaaaaacgctgcagtttggtgaggacattttacttttgcaatgatgctttgaggtgatgaagattatccacatacctaataattattcagttgtaagaaattaaaatagcatgaagtcatccatttctttttttttcaaacgcttttgtacataagcaacatacatattccatccccaaagcactatagccacatatatatatatctacatatgtcttatatcataaaaatgcttatagctagcttcaggtttttaatgacatgaacatgcatatgccacgtagatcttgagttaattatagtcagaggtgtggcgtaatgatctcaaagtttctagtgtaaatcataaaatatgtagatttgtgatttggtgccatgtgtcgagatttattcgatcaacttgccggcatgtgatgatacgaaataaggagagaacctctatcatgcaagtatcatccccatcccgtgcatctagaagctaatatatatgggcgatgcatgcaccaattcaatgccaaatcaaatgcattcaactgcatttttttgtatttacgcatttttatataccagtacatctgtccacccatctatccagctacatatatgagtgacaaaaattacaaccacactagcatttgtagatacatgtgtgtctttttctctatagctagcttgtgatgagaaccaaagagacagatccatgtacaagtgtcttgatgtaacagagatcatcattatacatgatttgtttccattaggtacgtatctctttcttaattttctctactattggttgcatgaaacttattatatatataactattccaattaactaggtttatttaatttatacctgtcttttagtttgttcacactgggtgtgattgatggtgctgtggtgtgtttgccctttttctctcctttactttcatgatgggaacaagtatcaaaatttgacacgcacattttttttttctttttgccaaatgctactgctacctggcagctagcggccgatcgaactcgagcagaaagtgccagcagcaagcaagctagctttcgtgttaggcatgactcatgcctgttttgattttcaacacatatcatttatcgaaacagagaaaaaaaaattaaagaaaacgagtaccatgcatgcctaattatctctagtactagctttttaggcgcactattgtatattgtgtactatgaaagtatcgtgttgttgagatggatggtcttacacgtgtgcgccatgcttgattacttgtgtgtgattggcacctaacttgtgtgtgatcgatcgtgtcatcgtcctttgatagagaggataagacgcttctctcatcatcatctcagctggtctagctctctgcctaactagccaagagtacctaacttaattggagaatgttctctcttaattgtattggcatgtttcaaagtcacttgagaattaggttagagtgattttcaagtgaaatttagaaacatatcgaagtatatatgtatgcaacattagttaatataagaagtttcaagtgtaatttaattggatacaatttagtgctcccttcactttaaatttatgatgctcttaattttttaaccatacattttatcatttatcatttattttgatataaagcataaccatatttttatatttatatacaacttttcttttaaaataaaacgaatggcgaaatatatgtaaaaagtaacaatgttatatatttaaaagtaggggtaatatatgtacataacgttccgggtcagaataatatgaagtttttgggtgctctaggcacaaattttgacaatttgaccctttg

SEQ ID NO: 69702 - DNA, 13879 bp, Oryza sativa
aggcctctcgtttcatacaagctaaatgagattgcaattcaatatatgggtttgcagccatgcacaactcagtaactgatctttaacggataactcatttattctagtatttttagagtttgctattttactactcacattcttataattacatattagaggcaaacgatcgcgagtacactcacgtacacatttacccatggatatatatatgtcctatataaattatacacacacacacacacacaaaatcttcaccaccaaatccactcacctgatatgtaccacatcatatggatttaaattatttaattataagataaatttaaatatccatgctaagcctgtgactgtgtgactcaactacaatgaacggattttaccacaaacaactcaaaaggacgaagctattatcctcgattaactttggtgctaactgctaattaacgttagttctgatcaagcacgtacgccaaatattaattggcagaaatatatgcatgtgtttgatttaatagacacggtatatatacaactgtcacttttttcgtcctgtcattttctttcgaggaaccacatattttgacctctaccgatcttttttcccttggcatgcatgtgtcgatctcgcttcgcttttttgacagaatatgcatatatgcatagaattttaataggagagatatctcgtctcgctttgccactacacctttttctttttttcattattgtccgatccgtgtgcctcttaatttctgatcttttttttcctcgaaatgcagtacatacacagatactagtataaacgtgtgcatccttatttatatgaacacacatacatcctacctctgtacgaacgtagatatctactcgcatgaaaaataattacaagggctactatgtgtatcgcgtaaaattatatatctagtattgaagaaattaatattatacttctagagttctactatacttccttcgttcaaaaaaaaaaaaaaaaggtcaaactagaaagggacgtgaaaaaccattgagacggagggagtatgcatgtacggggaaaaaagatatacacgtacttatggagtttgtaatcggtgaccggtaattagatcaagatttctttcatttctttaattaatttccaggaacacacatgcaggctgcgtagacgtacactacttttccttgagagtatagatacgttagcttctccagtagtggaatatatttgtactaacgtataacactactatacgtaaccattagtgctagtaatacgtagtactcccttccctccgtttttagatatttaacatcattgatcttttaacacatgttttaaatacttttgtaaaatatgtaaaactacatgtatacatataagtatatttaataataaatcaaatgataaaaaaagaattaataattacttaaaatttttaaataaaataaacggttaaatatttaaaaaaattaacggcataaaatatttagaaacgagggagtattaattatacttgtatgtatacgcaggaattgtatacagtgtggacgcatgcagccgactactactacatacgtatccgagcgagtgacagacggacacctagcttcgaggtgggccaagctatatgcacgggcccaccggccaagcaggcctgcggatacgtggggcccgtttatcctcacaggtgggcccggagtgacaggcacgtgaagccgtgtgccgccccacgtgcgcgtgcggccggaaacgcgtacacgacatgacgcgtgttgcagtgcagtgcgcgccacagcggatttcttcgatttttcttcctctcttttctatttttattgaaaggccgatgggtttaaaacatggccccattcatcctataatataaaggattattctcttttagaaaagattaaggataaaaagaaaagactacaatacccctattgaatgtgattttgattgtagtgagtgggtagttgaaggttaaaataggtataaatttgaattagaattgatggatgtgacaagaagtatagcaaaatctcttatattataggactagtagtaaagataaaatcccttatattataggatgaaggaagtagttgaactttgcatgccgatgtttgacgatgtgcatgatggacagtgcacagtacttcagtggagaactcatgtaagttatttattttactttttcaactttatctttctctttttaccttcctaaactgctaaatgtgttttttaaaaagattcctatagaaaaggtttttcaaaaattatattaacccattttcttatttttattgagctaatacttcattaatcatgtattaatgcatacattgttttccgtgccagaaaagaggagttcccaaccccttctcccaaatacaaccttattgtactgaataacattctgttaaaggtattattagctcacattattagcgtgatatacagtagtgtatcgggttgtattgtaaagatattagtattattgtggacatatatttcgatggtttaaaggaggttggttacgaaagagttttgtgttttagcccttgcttttttttaatcttgtccttaaattttaatattcatttttacagaccaaatatgcaattcaaatcctatatccataaagcaattcataaacatgtttctggctggtccatcgaacaaaatatgcatttatttttttcccctattcttcactctttcttctccttttctacccataaaatctctgatcccttttcctagctaagtcgcgggctgcatacgagtatggcaacaaactatttgttacttgtaacgaccaggcacatctccctttcttacacaccaacgacatcctactctctcctgaacagccaacatgggacgacctcaacatgcacatgttgcctctccatcacgaatcattgccaccttagtcaagctcgctagatttggcaaaattgtcgctctagtcatcgaccttttacccatgtggtcttgatcgatgtcattgttctcctatctagtggttgtggcggtggtcatggaactctattggtcattgatagtagtgtctcgccaaccgttctattttttcttgtgcggacgaatagttgcatacaacctcttcttcgcctttcactatcttgactggttgatttttttttcttccaacttaattaataattggacctagaagtcacaacgacacagctgatccacactttcttccctcaggttgtctaaacctatgtgataggcaatgacacttgtggccccatcgtttgtctttttccctaataagccaaaacggcttattagggaataaaaataaatttgtaggtaaaacttttatatatatgtttttggtgacttaaaagccaatgtaaaaaaaactatgttgaaaatatttcaaaatttagcttgtaaaacttttaaaattaagtttgtaaatttaaaatttagctttttctttggttgattaggccatccgatgggagcctccacttgttttgaaaatgctttctaaggcaccgtttggcattactatggttctggtaatcttgtttgccaggtgcatcaatttttatacatttcagcatgtatcatttatatataatcactgttggaaacgtggatattattatggcctggttaacataattaataaaataaactgcggagataataaatttaaattttcacgtacaacgacttatacaaaaacagataagcacgcacatcatgtttatcaaccataatctgaatctaaatcctatccatgagctccgatcctgtgcactagctagctagccggagtaacgtatatagacttcaattccctggttatttctgatatcaataataatcatacgcgcaaccgaaggtatatgtgtgtgtgtgtgtgtatatatatatatatatatatatatatgtatatatatatatatgtatatatatatatatatgtatatatatatatatgtatatatgtatatatatgtatatatatatatgtatatatgtatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcatatatatatatatatatatatatatatatatatatgcgcaaaatttggactgtaggctttcaattttatttcaccattttgtttgatccggtggcaaagcaaattaagcatgaccacgtggatccaacgtccgcctatagctagctctttgctttttctttacgaaccaaaatttgtacgttcgaaatgaaaggttcaccccggagcccggacggccggccggccggccggatgcagcatatggattcctggagaaaatgacctttgtggctttgccattcagaatgacacaaactagcctagctagctataaaaaaaaaacgaggtgattctttacacggaacttaggtcagatctgtgcagttatcgtagggcatgtttagattctctggcaaaatttttcaccctgtcatatcgaatatttggacacatgtctcctagcaaaatttttcaccctgtcatatcgcgtatgattttcaccctgtagtattaaacatgcatggagtgtaaattgcgagaaaaatcttttaagcatgatttcttcatgatttgacaatgtgatactatagtaaacatttgctaataatggattaattaggcttaataaattcgtctcgcggtttataggcgaaatctgtaatttgatttgttattagtctatgtttaatactttaaatgtgtgttcgtatatccgatatgacacgctaaaattttacacccctaaatctaaacacagctgtagttagggcatgctttgctgatttccggaccaattttaacatttgaggatgtttggttcatggttgaagttaattgttatattttgtcacacatgtagtaagataagtttaaccatattagatatgtttttaattagttataataggtggcaagatttttattttctttttaagtgtaggtcatggctggtttgaagtgtgctatgattttgattatatcagctttgatacacttgacaaagaaagtatggttaatataatgatataatttgggcaagctttggttcatgaaccacatgtgtttttttttctagacggctaggaatagaagtgcaaaattcttaccttaccattattcttcatcgcttcggttataagtgtatcttcgagttattacatccggtcataacgaggcttctttgctttttaaaccacaacttaggttgtgtttagttcatgttaaaattgaaagtttggttaaaattgaaacgatgtgacggaaaagttggaaatttgtgtgtgtagaaaagtttcgatgtgatgaaaaagttgaaagtttaaagaaaaactttgaaactaaacacggccttatcacagtttaccacgtctaagatagcggtctatcagtcaaatgccggcggccgcgcggtcgcctctagctgtgtagctcccttcaaagatttcggctcgtcgccggccggcggccgggggcatcatcctgtcctcatgcatctaggtagcattttcgcctttgattgattctatatattttgccaacccgttcgtttctgatgaataatttagtacatgaaacctagctataatagctacgtgtaattggattctggttcaaagcttccggctgggtgtgtgtgtggcaaaccattagtttgcgtgaaaaatggtccttgtcaacgtttgcggctgcccccatcgcccaacgattcatactcgaagagtacttcgttttgacatttgacatgacgacatttgaaacataattaaccacaatctttaattggtagtacagtactactcgttccatcctaaaatataagagattttaaaaggatgagacacatttcctagtaaaacgaatctggataaaaagtatgtctagatttatagtgttagaaaactgtttcgtccatctaaaattttttatattttgagttggaaggagtattaattagttctcctacatcgttcgatcataacgtacgtgtgcctttggtttatatgtgtgtgcgttttaattgctccataagctgaaaaaacaagaaaattccccaagtagacccggcccatatatatatataatgtcgttaaatgtaacagacacttcgttcagggtttataccaaacatctagtagaataatctcttctggcattctcgatctcctctagcacgaattttgtaaccttttctagctactccctccatttcacaatgtaagttattttagcatttatcacatttatattgatattaatgaatctagacatatatatctatctagatttattaacaataatatcaatgtgggaaatactaaaataacttacattgtgaaacggaggaaataattgctaattttagcttctcggcaatggctgaaccagattgttcgacgaaccactaagcagatactttcttcaattgacaaggatatgtcatgtgtgctttattcctccttgcctgcgtctgtctttgtctcaccaagagggacgatgtatctaactatggattttatgccagaatttccacgaatttttgcgtagagtatattttaacatagtagaattatatttgctaaatatatataatcctctcgctttctgtttctatcaaaatagccattttttgatatgactatatcagttgatagggagcgtatcctatgcacacaggccctcgcgtgtacacaccgtgtataccaactaaaaattatcataaaaaaattctaggaaaattcatacatatactttcaatagtattacatctacgtgcaaagtcgcatcttcaaattcattctacatagagaataacaaaaaagataaaattctgacaaaattgcaaccttaaaactgttaaattttttatttttttgttacggctaaaatataatgaatttgacgttaagattttaaccttaggtgtaatacaattgaaagtatgtgtatgattttttctagattttttggtgacattttttagttggtgtgcacgtgtgtacacgtgagggcctgtgtgcataggatatgttgcccagttgatatacaccattattaattattggatacatcatcatgattggcaacaaatatctcggactttttcttcgattaacgttgtataagttttaggctttagaacaatcaaagaagaagttcatgtacccgtaaacttttaaagaaagtctacctagcatcttaaaactttaaaaaacggatatctaacgacccctaaactttatcatttatataatttatctctgaagtggttttacatggtgaaaaaaagtttgatttatctccatctcaattaatcctgcaacctccaagttaacctccttgcttctttcattaatttaactagtcatcaacccgtgcgttggacgggctactaatactcatactatagatgtgaaaattttaacatttcgttaaacatgttatagttatgtttgaaaattgaaattatagccgcttgtattaaaagaagaatcatccacgtcagacaataattttgaattttagaactaaattgataaaacactaaattaagagtccaagatggtaccagtcttatatttattaattatgagcttcctaactattaaaattagagtccatgctattttcaattatgtgtgatttatttaacaccgaatctcaacacgatgtagggtaccctggtaatatgatttcattaaaccaactggcggaactttctaattaacatggaagctcctaaaaagtacccaattaattaatataggtataaataatatattgctatgtagataaaacatttggcctcgtatttgggaggccctcatcatatctaaggatatattggacgtacggcaggatttcattcctttcaatcaaaactatagtgggtaagccgaatggacattggaagaaaacctttttatgaacttgttgcacctcaaatagctggggaaaaaaatacaagacgagaaatatggctactttttcactttaccaccaccatctggtgcatccaacggtagtgcaagatgagagagacagagagagaatgagatatgtaggaacatttcgaggttcctctttgtagaactaactccacatcagccttttcaaaagatcgttcctttagttagcacagggttccttttaggattattcttgttccattcagttccaatgctgtgtgtgttgcatttctaaagctgctccatttgtttttatatacttgtgttctgtttgtttctttctttctcaaaagttataattgacatggaagggaaagcttcagtttcgttgaaattgggtgagctagtagctagtgcatcgtagtttgcaaacatgaatgagtacatattgggaatgtgtcctggtaacatttgtgctttgtttacaaattttgttgcatggtgttgaggctagtgtggatcatgcaaactagttatatactcatgttccaaattataacaatttttaagttttggacatgtgcattaaaggagagtgataaaaaggctatactataccattaatatgtcctgacattggtaaagaaaatgaagcaggggtggttaacattgcaggtgtattttgggtaccaaacaataaaattaaaggtgcacttttgaagctagaagttattatacatttggataaattttgaattctagaaattgttatatattgagacgaatgaaatagttagaatagttttcttaaagacaattattcaatttgatcttagctttactgcgagccaaaaacagctgctcaccacaatgataaaattgttaataataaacaactaccatatatctactctattcaaactctcttcgtgtgttccaactaaatccacttctataattcagcctgtcaccctcatggcggtcgagcatgataagatgcgcaacagtgatatattcttagactctcttactctaatatcaaatgcaatagttattcccgtcggtttcaaaccgtcaagaaaaatccattttctgatagtgagttatgatcgcgtttgcgtagatttaaacctgagtgggtggagacatgcataggaatcactccacatccataccaaaggtgcttctcctcctcctgctacactgcactttacccatattagcaacatgacaaggattcaaaacatattctcaataagctaaaaaaacacaaagaaccaaaggaagctagctactgatcagccaattagaatatgtctctaccttcttttgcatgagctttttttaggtaggcgccgattgggtaccaaaggcagcttaacactatagcttacacatgcatgcatgagaattgagaaactatctatctagagcacttgtcgtattagttgacatcacacatgcatctactatatatatatatctatctatctatctatctatgcatgcatgcaccttaattaaaaaacacactttgcataagcatgttaatggaatcttcttttgcttatattgcctttgcgccgcattggctcgtgtgatgagtgaatctattctctaatctgcctaagtacgtgtacgtgtccctctcggtgctcttgtgtatgcatgccaccatcattgcggctgtttgttttccatgaactgattaaaaaaataggttagcgccgatcgtccaatatttatattctttccttgtcgagtaatgttaattgattttttttaatatataacgccgttgattttttaaagaaatgttgaccattcgtcctatttattcttttaaatatgaaaaaagttgtacttaatataaagaaagataaatcaagtcacaataaagtaaatgttaattatatatatatatttaataagaaaaatgaccaaccgtttcttaaaaagtctaatggcgtcttatattgaaaaacgtagggagtatatatatatgcatagacgtagcaaaagatctacctagctttcatggaataatcaaaccacataggagataggagtagatagattggtgatagcaatggctgagggtagtggtgtgtgaagtgggacacagttatatggcaattttgagttcagtcctaaaatattaattgtccatcacatctgcatattgcttgacctagtctaaagtacaattggcaacaaattgtatatgaaaatcttatctacacatggtgtcgccaataaattggtagtcacattttagctaaattttggtaaaagaatggattcatggaatatgtgcatgctcgagggatgaaataattggtacgtgacactaacaactgcggtagtgaatcgccgcaaaacaactatcccttcttttaaaaaatataaacatagctatgtgttttataaaaaaaaataaggtttggataagaaatgataatataagactttcaaataagaaaataggtgaagaagaagttaagttactatgttataaaacaaattttaaacgccagatagtggaacggatggagtatatatctcacaaaggtaatgtgtggtaacgaacttaaaaaaccactcggaccccccaatttttttttcaggagaatgaaaaaactaaaggtaaaatttatgtaaaaaaatgaaagtaattttatttttcttattgcatatagctagaagataaatatgcacaatacaccaagtcacacatacataagtttatacatgcatatttagacagtatacccatacgcatggtgataatataagaatcgttgcctaactttgcccaagttgagagccatcggataccggcccgattgacaactcgacgtacgtcctcgaccttaatatctctctctgtgtgtgttaggtataaggatatgattacattttatacaaatattgcgtttgttaccgtgggttaggaactcattccctctgcatgaaaaaagaacggtttattagcacgtgattaattaaaaaaggatcaatatgattttttaaacaagtttcgtatagaaactttttataaaaaaaaacacaccgtttagcagtttgaaaagcgtgcgcacgtaacacaagggagaggtggaacactaaccaaagaacacagcctaatctacttatgtacttccccagtagcccacttctgtagtgttcaagcaatgtgtgctaatgggcttttatttggctacgtttatctttaatgggccaccttttctgtggaccttcctgagcaacatacatgtctacttggctgcactggagtgtgtgcaaatgtggctttaatttggtgagaaggccaaggtattttgggtgaattaaagttttgtttacaagataaaacctcccacgttgctgcgaaaaaatattgattgtagccgacgttagaaatgaattcaatatggatttgttttatagttagatgtcgtgatcttatatgctttgtataatttgtacttttatcactcatccaagaaagaatataaacaatttaaagatagattgatcattcaaaggataaaactaagatgatgtagctttacgagcgaagagaaaggaagacaatagatcatagagattaatcattcaaggattacaaataaataattaaggtggtatatatgggtagaagaaagaaagcacatgcattattgcgggaattgagacataaaaagtttgaatttgtaaagttcatcagatcccttatttatctatgatgatcactaacacgtggatcctagtcccacaagtcattgatatttgagaggatgagagacaaaaatatggtcaattttcatgggcaacacaaggattgtagaaaaaaaaactctacaaggacttttaaattaaaagggattgccataaatttagagtaggcctataagagttaatatgacatcatcttcaatcacgtggaagcaactatagctcagtatgttagaaaatggtggaaaaaacttcatctggaaacaaaatatcaatttaaacgaccatgccaggatgaagccgaggcataatttgaggattggagatgtcggtcacgagaccaatgtatagtgagaactcaattcaatggtggcttgttttgttaaacagttgtgtggatgtgtggtcggtatcatgtcaggtagtcaactgcaagagcaaacaaggagaaccccccagttgtcccttgttcacaaatcacactaatatatgtataaatttgattttttttttgggtcgcccctcgcatatttattagaattataagattatttgatgttcacactaacgtatacacaaatttgactgttaatatagtttgaagtatttcaaaacattttattgtttatatatgtttacatgagcactaatacaatataatatagaaataaccatttaaaaggtgacttaataaatactagtaatatgcccgtactaacgctacagttatattttgtaatgaaaatcaagatatactcaggcaatatcaaaaagaattattatactgttgctaattagatactaacgagaaaactcaaattgcaacttttttgcatgtttgaaaacaatctaattccttatgcgcttaggaatacaaactaaacatattgcgtagaagtaatacaaaccaaacttcatattacaagcaaaagcatttttattattttataaactatattgatcacaggagacaaatttgagctggatagaaagttacaattatgcagagtttatcttctaaagactcacaagtcattgtctaactcatctgatcataaagaacaagaaccctatctggaccagccttcatgtcttcacaaagcatgttagagagtgtaagagcaattttccccactatgcatcatgaaaattgaaatttgtcctttatagtttagacttgttaatctgtttgaccatatgaattagtttacagaacatgctgtaaatttaaactgcagatgtataggctatacagatattccaacaaatcccatatatcctgaattttttcaagtgcaatcctataaaccaaatactcagagagttgttagtctatcaaaaatgtgctactctgtttatctaaaaattccgtgtcaaacatcagcaccaccagatcaccatcgcccatgaaaaacacaacgttcatcatcagtctctcagctacactcccggtctcgaggacccacaccaacacgtacggatatccaaatacgaatctagctcatacaagtaccacccagatttagtaccaagaagctcaaacagttctcttgcatccacaattgattgccaagaagctaaacgcatactgaaatacaggtcaaataagacaatgagatagtcagaccttcttcccatggtcattagttttccaccttccactttatctccaccaatgctattggcaaggggaaatcctaaaaagagcataacattattaaatttaacattccaaggggaaaagggcaagatattttacaagcatgactgtttgcgaacacctaaacagtatgtgaatagataatggttaattactg

SEQ ID NO: 69703 - DNA, 7763 bp, Oryza sativa
atagatgaactccatgaaattgatactgtgctacagattcctaagaaaccaacaaatcaatccatctcaccaaaaaaatagccagattttcaatcgatcaatcaatttatcattcatgcatattgtgacccagggtccatcgttttcgatccaacccattcagttggaccacacctacactatcctcgcttcacacaaaaaaaaaaaccagagtcaatctcgggcattgtatccttatatgctggtgctcctcaagctagctaggcgaggtgggactaaacttgcaactgctgctgctgttcggcactgctcagtcgccatgggctaggcccaaggacagctgagctgctgctgcatgcacggtagctagcttgcctagttggctcaaggaacaaagtggcccatcttctgttatgtcatctcttttttaaaaatttttctaattaatccagcgcatcacatgtaccttgccagaatgataaccaaggaatggatgaatggtttaaacaagtagtcaagataaaaactaagtattttcttcgcttcatcactcgacaatatttaattcaaagctgaaaaaataaatagaaaagagagttaattcgatctctttcaaagctgacaataaggttttaggttgcttggagctcgacctccttggcggcaactccgtcccgcctagagcgcgcctcttaattagcaaatggattcaaaagagatagcaggttttatgcacatgggattaatgttaaaaaaaacaaaatgctaacatccatattatttgatccacttggtttgggaatattgtttatgaagatgtcctggactgatggattaatgtaaaaaaactaaaatgctaacagattactatgtggccgttctcctatattttcctttgtcacatgtatcagctatttgaaatatattgatttggaaaaaaatgactttcttaaggatttggatgtattcatggtcaattcatgtaacctatattttcctgtcactattgaaaatgctaacaattttaaatgtctattcacccttaattaaacatatgctatgtaaacaaacctgagtgaaatataaaatatatttcttcaaattgaaggaggatgcgtacctttgagcttgacttttgggggatattgtctgagaagaaggcatatcacgggctgtcagtgagcaacaagagacttgaatcaggaaattcagtccacagaaatcaatgcaacaaactctaattactttgtcaactacagtacaacagtaactacctcatcctgatgaacagatgaaggcatgagcagagaagagaatatgaatttattcagatattaaacatctgattttttttcataagttcactaattaactgaaaaagtgttcctttaggcaatacatcgataagtgcttgcacattactaatgcacgatatgtacatattcaggtgtcatgaataaaaatgtaaaccacatttgacattttaaaggaaaaaataacactgcacaaatctaacattttaaggaagttatcactgcacaaatcagaagttatcactgcacaattccagcactgaggtaaattctcattctgtatataaccttcggtacacatcacagaataatcacagaataatgtatacaactaaaagtaaaagaagctctgaatattggcatcatgattcagataattaaatgtcttcttttaacttggatgtcaattcagatggtgttctcttaaaagagcacacaacatgtctatcaatttaattggtttcctgggctatgttgctgaccaagcaatgaagttaaaaaaaattagcattgtatgagttcgatcagaattcatttgttgcagcattccaacgctgctaatttaagcgctttctctgaattttcagatataaacatcccaatcatgagagaagtaaatgatttcacaatgcagatgataatcaagttaaaccatttgcattatataaaaagatgcagatgctaatgaagtttattaaaccatgatatcgtcattgatagtttagtagtgggatatgcatacacacataagaaacatgaaagttgcattattaatcacatccactgatataatgattttgcatttctacattaaaatgcaaaatcgcgatggttacctaattactttgttggccggcaggttcgatgacctgcgatggcgaggagtcctaggggtggcgcgactgagagtggacgacaagaatcgatgactacttgacttgcgacgcggtggggtggaatccggtggcaacgtgcgagggatcaacaaactgatggcggcacggtggagagggcgccggtggcagcgcgcgagggatcgaagacgacttgactggtggcgctgtggagagggcgccggttgcggcgcaaaagagatttggtggtgaggagatcagaggaggcgaggcgagggcgatgaccccggtgtaacgttggtcaccggcgatgagttgagacgacggttgcgctccgggagagagggagtgatgggagagaaggagcggagattgcgcgtggagggatggatggggcgcacggagatgatcgatcggcggcggcaacggctgcactcgggagagagggagcgcaaattgtgcgtgaggaaacggatgggaagcagcgatttcgatcgaggggtgcgatttgggggcgtggatgacgggagattgggagaggggacgaagcggtgtgaggagatggtgggagtgatttgggacgttggattcgagcgagacaatcctgaccgatcaatgaggaatgaggatgtacatcagttggtgaattatagggtagataataaatactacattcgtttcatatcataagttgttttgacttttttctagttaaactttttaaaatttgaccaagtttataaaataaaaacaaacatattatcaaaatatatttaatgttacatttagaaaacttatttggtgttgtagatattgctaaatttttgtataaacttacagaagattgactgaaaaaaaattcaaaacgacttataatatgatatggagggaatagcatcaatttaaaattgaatgcatcgagtcattcaatatatggatgacgtacatatcgtcatgtcgtttcatcattctagccggtggattgcaaccttatttaatttcttagataaaaaaaatcagataattaaccaagctaactcattacttgatacgggaagtaacccgatcttctcgacgtaggatccagatataccgtgaaacctcacgaactgggtgaacaacacgctgcccgtgcaacacacctttaaccacgaatatgcaaaatcactagtagatgcttaataaaactatctaacccttaatcccagcggaaagcaagcatgatcttaattaggatcatcatattcccctatatgtggttgtgccaaatcataggaagaacgggtggcaagaccctcacatagttgtagctaaaagctaacttttattcataatgtcgagtcctcctctataatagatgcacacctattgcttatattgcaaccctaagacctctaaacaataaacaaactcattacatgacttggacacgaagaaagaaacttctcctgcagcaattgttgattagtttggtagattgcagataaaccacgaacaatttgaaggtgggactaaaaccttgatgcgggccaataaattagctctccaacaagtactcaattttccaaaacggagtccgtatgcgaaatccacgaccgtttttatcagattgtctaggctatccaaactgaatacaaaccttgttatcttcaaatttctcatttggaaataattcaatccatatagaggagataattgccgacttatggagaatattggaatagacgaaaaccatctaataataccatagaatccacaaactctccaaacatagcaattctcgcgcgtcacttttacagaattgataacctttagtaaaattggatgttccaatcaaaagtagtgggcctccttgggaaagtggcgtgttacgtgttgcttacaatacaatgctattcttgtccttcacgattttatggaggaggtggattcctacaccaaagaacaagtgtagctgaaccctagcaacaaaaattccatgttcttagcggtcaacaacaacttttgtggcgttggtgttggtggtggcagcggaaacacacaaggaataggtgaactgagaccacttagaagttaaaatttgtgccatagctgttgtgttccaatttaaacaccaattgactgttgtattaccaatagctagcatctattttgtcacttaactcttttttatgcgaggaactgaggctcatatttagaactagctagtggatacgttataatatggcattaaactcatttattaagaagcattgatctcattgacactttgattcaatggcttacgtagtttgatgacacaactatatacatgagagttttttttatagtaattaatttaaattagtgggatgtaactatacatgcatagatatgacacctagctaaagttccatattcccctttctctcaaaataaaaatcagtggtgtattttgatccattggaatacatacttttaaggtgaaaaaataactcaaaagttggagggatgaggttgggagcgtaatggttgactttaatacatgcttaacttagctttgagcttatatgcatttatactagtactacgttgataaagtagtttacatttgactttaagtttggtttccaaaggctcattaactgctcattaactgctagacttagagtaggtaataatatactccctccgtcctaaaataaatcaacttataggtttgaattttgtcccaaaataaaccaacttctaccttcttagctaccaccggttcacaaatcaagaatttttatcctttaaatacccctcacctacatatccatcaatacaactttcttactaattagggacattttggtcatttgcctttctccttaatttcatcttgggaagctagggtttgaaattttgtgggacggagggagtagttaactactactctcttcgcccacaagagtcagacctatttcatattttactttcaaataagttgttcctatttatagtatttatgcatacaaaacttaaatagatagataaattaaatgtttgatcaaaacccgaggagtcatattaatacttattggttgcatgtgtgcaagataaattaatttgtgcttgttctcagggataaaagtaataggtgtaacttttgtgtaaggaggtagtagtttcaaaattttacacatcatctatacccaacctaatatctcactcttacaatagttagttgtagatatgtactgtatcattaatatctaacacaagtatctctctcacatagtttattgaagttcgtagtacaactggctagaaatatgtagcccgtttttcttctctcttctccacataaatacaaatatgatgtgataatttgtatggtccgcttaaatcatctcgttgaattcgctcgctcttactccctctgtttaaaaagaatcaacctaggagcttctaggacaatgtatatacaccctatgtctagatacattattctaggaggtcacgtccccttccaagtaattcttttcgagacggatataagagtaaggctgtgtttagttcagcgtaaagtttggattttttgttgaaattggagatgatgtgactgaaaagttgtgtgtgtatgacatgttgatgtgatggaaagggactgaggtttggattcaaactttggatctaaacacagccttagggccctttgaatcgcaggattgagaaaacataggaataggaaaaacgtaggattttgattggaatgtaagtataaaacagaggattgcaaaacgcaggaaaaacacaggaatgaccgtttgattgaaccacaggaaaaacataggaattggatgagagatatagactcaaaggaaagttagcaagaggttgaagctcttgctaaatttcctccaaaatccgattgtccattccataggaattttaaaggattagataggatttaatcctttgttttaaaggacttcatagaaaatttttctataggattaaaatcctctaaaatttatgtttttcctccaaagttacaatctgttccaattcctttaaccttttctcccccagttctatagtgcccgattgtcaacccaatccgtttgtacgcacggaaccacacggcaaaaccaggaaggaaagctgcccgcgcccactgagaggtgggccccacacgtcggcgtcacgtcaccccctcgacctcgcatccccaaccccctccacatctcatgctcctctcctccgcctcacgcgcactcgccggcgcaaaaccccgctcgcctgaacccttcgccgccgccgccgcggtcttactccgccgccagctcgccgcaggcatggcggccgcgccggcgtcgtccgcgtccgcggcggggaaccgcgaggcgttccgcgtggcggtgaccaacacgctggagcgccgcctcttctacgtcccgtccttcaagatctacggcggcgtcgcgggcctctacgactacggccctcccggctgcgccgtcaaggccaacgtcctcgccttctggcgccaggttatccccccccacccccccactactacccgtgcttcttcttcttctcttcggtgtagtagtagtagtagattgggggagtggccaattttcggggtggggttcgagggggcaaaaggcgcggctgctttttcaggtttcggttcggaatcgccgcagttgagctgcgcggggagcgagcttactagagtgcttagttttggccatgctggccgtggccttcgcgagaggtcgggcctttgttttgcaacttgcgagactagtgaggtgttgtggctaagatgtgccgtgttgggattgttttttttttttttgttatagcagttttactacttgtggtgtgatgatgtgatgttggtatgtggtggttttgctaaaattagcttctactacctcttggggaaagatggccactagaagctccggagcgaagcctctccttccttgattgtgaatgggagggattagtctttttttgcttataggttaggaataattggtctggtatccttcatgtgtagatgtgtcggtcgacccggtatttggtatgcttcctcaatgtgggagattacgcggctgttgtatcttcttctttctttgttatatcgttgtaaacgattttgcgaagtatgtgggtacagtgacatatcaatagaaactagtgtaactgtaaatgttattagtggagaatggttagtgcccggtgttactcggatatatgtgaaataattcccctatcatcactgtcggtaacaggaaatttttttttagtactagattctccatagatgtacatctcagcatgtgccaaaggcatcattctagtacgtattatctttgttacattctgagaatgtagtatttatgcatacatcattgacttaccgtctactttggtaccttcttagcatttcgtgttggaggaggggatgcttgaggtggactgcccatgtgtgactcctgaagttgtcttgaaggcctctggccatgtcgacaaatttacagatctgatggttaaagatgaaaagactggcacctgctatcgtgctgatcatttgctcaaggacttctgcaaggat

SEQ ID NO: 69704 - DNA, 3204 bp, Oryza sativa
tgttgctgaaatgatgtgctgttgttgatgctgctggcctactgctagttgtgatctgctgatgattgcttgccatgctgctgctgatcacgctgatccgaattgatactactgatctgctattgttgaaaatgatacgctgctgttggttcttcaggtagtggtgttgcttgattgccgacaggatcagatttgctggtgtgctactgcatggagagggccgatagagaggcggtgcccgcgatcaggagccggtgaggagaaacatccaggggtcttccggctagctctacaagttggtggactagctggcctgggttcgaaaccccatccattctgtttatttgatattatgtcattccttgtttttttatcaggagtcggtgagcgtgatctcgcaggagcgagaggcggaaacagatttcaattggtaatttttgtagttttaggtagtcaattttggccaatctcttagctagattaatatcttaatatcataaattctatttagaattttcataaacaaaattttggaatacttttggtgatgctcaagagtaccgttccatgaatcttgcttggaaataagttggaaatattattcatattcgatcgatcgggccatgttgtcccacttgcacacatgcatggcagattagggtcgatcagatcacatgtacacagaaatatgcgttgattaacatggcatatataatataatgcatgaatggtacgtacccatagcatatcccatagttatatcaacaaggatgttgatcagctgtgatgtggtgatgccttcactcgaggtgtttcatctgtgctctcccatggcaacccctgatggcatcctccgtcgacctggttttgttatgaccagttgcatagccggcaacatcatcggcaatcgcaggagctcgccgcgcgcgccggtaaaatcgagcggaggtgagtcaaatttaactagcttacaaatcttcataggtttgaggttgtagtgaattatactataggaattctgggcttctgtgacgattatagtatgacgataacaacctgcttcctgtcactgcctgctcgcagtgacgaaatggctgtcatcacagaaggtgggtcactaaccatcttctgtgaccacaagaggacatcgtcattgatacagtgacgataattctcctgtcactgataaatgacgagacaaattcgtcataacaaattgaaccgaataacgccacgtgtatgatgacatgtgatgttgcaaatgacaaggcgggtgatgtggcaaatggcgtggcaattcacattcggcccatataacatgggcttttttattttcaattacaattggcccaaatatatttttttgacccagctacaaatttgcttttatggtttttttttcattatagcccaacattacaattctagcctatgggccagcccattaaaaagcaatcacagaatataaatcacagctatttgtataattatattataatcacattcctgccataattaattttctagcccatacaaaatcaagttccaaaatacagtttccaacatgttccatacaaaagcacaaaacatgaatacaaaatgatccatccaccatccaactacacaagtacatgtgcctgtgccttcaatctttcaagctcctcctgaagtactgcagactctagcttctttgcatctagttcaacttgtatctctttcatcacattgttgtcttggcagcgggctgctatattccgacgttgcgcaaaaatgtgtttgacttccgcagcacttaggaaacagcttcaatagaagtcttagcttggtgcccatcttctactgatggtgaagtgaggacttcccgggcatgcatatcctcctagcaatcaaagaaaggtttcagttttgcattattatataaataaaggttcattgcataaggtacttaataaaagaaggaaagaagaggtaatagtttagtacttactatagctttcttcacaggttcactaaaacctttagttttgctgcaatgcaactccttaaagagatcaattgcagtgggctcactgtcaattgaaatgcccatgctcttcccccttggctccacttgtctacttccagtgagggtgcctaacataaaacatttacaagtgtcaataaaaagatcatgcacttgatttgaatgaagcatagcacatataaggacaaaagaacaagaatccaagttacttgccttgttcagtagtgctcaattccattggcttcagttctgtacttaaagtgtggttgctcaatcccattgccgccgcccaatatggccgcccagggcaaaggccccgtctgtggcgcgagaaggaagggttcaggatgatggctggctgcggcacgccctggttagggctccacccgccgatgctcaccagcgccaccggatcttgcagtcccgaggccctcattcctgtaggcacattctgcaacacagatgaagaaaggatcagaagaaaggatcacaaaattgcattagagttgcataagcttctgactagtaaccggttttgctaggcaaatctgtgagttgagtaggattttaaggaacatgtactctttgagcaagtttatagccaatttagtaaaaatctcacatcttatttacattcttaaagggatatttctgtgacagacattatattggattatagaaggagtcagagagatgctagccatgacctttcttctcaggaggtgatgctagccatgacctttcttctcaggaggtgatgcttcccttttaccagtgacattttctgctttatgaactacagactgaggtggagatgcagcagtagcttcccatcctacttcatctactgactgcactaaaggatccaagctagaaaaaatttcttccttggagatatcataatctatatacttggattaaactgagttcagattaatgatctatatacttggattaaactgagttcagattaatgctaccacacctaacattaacaaaaaaaaaggtgtttgtttttcaagaagaatgcatgtggtaagtttggtacatagtagagatcaaagcagtaaacaacagctgtgatcggttgggcaggcataaacatcttcataattataattagttaaccatgcatttttcttgaaagaacttatcaggaagcccattgcaaacagaaagcc

SEQ ID NO: 69705 - DNA, 696 bp, Oryza sativa
tgcggggcaccagactgagaagcggcgagaagtccgtgggggtcgctggggagtccatgcctctagttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggctagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaagatccagaaagagaagacgtttggcttataccccagttgagctgcctgtgggagtggagc

SEQ ID NO: 69706 - DNA, 956 bp, Oryza sativa
ctcatctagcagcaagaacaaaaaaaagcaggggaagtgtagataaaagactagctaccactaccacataaaaatcagagaagaggaaggtgggagcggaagcaatggaactacctgcggtgaagtagggagaagacggcgtcggtggtgaccggtcggcgtggaaatccgtctgcggcgcgtcggagacctgcggagtagggagacggtgggcgacggtggcgggagagatcggcgtcggcggcgacctatcgacgggagggtttccaacggcggggatcggtggcagcgctggtggtgaggggagggaaaggagcggaagggaaggagcggcagcggggctgaggggccggtggtggcgcgagtagtgggagggaagacgcggcggcagagcgaggaggcgacgcagggaggagggcgaaggacgcggcgtgggggaaggaggagtgggcgtggggaggagatcgatcgagggaagagcaatcgcgtgatggggaggagattgacgccgttggatatgccatcggatggttgagattacgcgtgtctgtcatatatgtttgttgtatcaggaatcaagaccaccactacgactttttaagtagtagagattcatactctttacatacaacacaaagtgagtttttaccgccttctgtactaatttctttctggtattcatacaatgatatgttaattgtttcacgcaatatgcacattctagagcatgatctatatcctagactctatgcagaaacccagggaaactttcaactcaatcattgaaatgattaataggtaatgtcatccatcccattgtcattatggttgattctattgctactatgtgcatcaagcttcattagttgtagtttggaactgcaggcatgattccataaaaacgtccgcggggaattcaaggaaaaactgactgtgaggacgaactttctggtagg

SEQ ID NO: 69707 - DNA, 2380 bp, Oryza sativa
gggttagggttagggttagggttttcatcaaattcaaactgatctgagccgtccatcaaaacgaacggctgagatcgatcgagggtttgggccgcaccacttgggccgcacgcggtcctgcagtccactaagtgagaggagtatgggggtattaagtagactttgggcgcttgtgggctgaagaagaaaataggctgaaaaaggcccatagagaaaaaaggatttttatttaaataaatattgaaatgatatttgtattatcaaaattagcaattaagctatgtaaattccaagaaaatttcaatgagtgtaattaatatagaaaatttaataaaaattaaatccaaccataacattttatttctcacacctactttacttataaattaatttaattatatacctacctatttaaaaaatacccaaatatttcagaaaatttgtatttcatttaattagaatttaatatgttttaattcaattttatctttttttcttttcgatgcaacgaacgaccacttttgctataattttaaaaagtgtaattaatattgcagaaaattttatatttcattaaattacaattcattttcttcgtataaatagttcaaatcaaatttcagtcaccatatcattacccggtgcaacgcacgggcattttgctggtaatataaaagaaaaagtatgaattaccccctgaactacagcgatcgattgaattacattcctgaaccacaaaatcatatattcttcatctccaactatgcgaaccagaaaaataaccccgctggctcaatccgcggtggttttggtcctacgtgatagttcagtcagcatttctttttttaaaaaaagtggcccctacttgttattttctcactctatcctctcttctctctctttccccaatcccctatcttttctccatcccctcacatccatcaccggcagcggcgagccgaggacaacagcgcacggggggcgaagccaacaggaggtgtagaggggggccgaggacgacagcgggtgggggcggagccagctggtgcagtgccgacagcggtttcggctttggcagccacacggcggtgggtcttcgtcgccggaggagaggagcagcaggcgacgcgcgagacgagggcgacgagaccgggggtgcagccttaccttccatcgactcgctggagggcggtgggtcggcgcagtagcagggggacatgggcgtcgccccctcctgctaatgtggtggccggcggccgccgttcaagcggcgccgccgcggtgtacaaggaggagattgaagatgacgacgacagaatccctagcaaaactcccaatagttggaactcccaagcctagattcttggttctccataagaggggacaggcgctgctcccaatctccctttcctgacaaaattctcgcgccacgcggaatgttcttgcaagtggtttgtcacgaggttgttcgccgctgcatcgaggtgtccggcacgatccccccccccccccgccaccgcctcgatacgacgcgaatcaacccgtctgatcccatggtttgaaatttcggaccgcaccggtaagcacaaatctccccataagtttttggatttctccaatttatctgtgaacgtggtcaaattttgttcaaattcagtcaaaaatatgttaaaatctatctattatatactaaaagtccattaaacttcctacaaacgctccgaaaccgccacgtggcgtttctacaagcgctcataggctgccatgtggtatactacaatcccaccatcgattttcatttaaattggtggacccattattttacaccgtcagattagatctatttaaaaaaagcatatgttttctgtgtccaatagaatccatttaccggaaatatttacatatgtatacgcatgaaaatagttacgtacgatggaaatacttaaatacatatacatatgaaaatacttacatacgtatatgatggagtatatatctaggtactgtattaagaaataaacaaagaacgtacgtgtgtgtacgataaaaaagcaactgttcgcttggatggaaatatacaaaaggaacatacgtatgtacggttaacgcataataaaaaaaaatactataaagccctaaagtaaaatatacgaagttataaccgtggaaaaaaaatatacggtccttttaaactaggatcttctatactataaaaataaaatttattactccacaaatatagtcatgttgtgcacgtggcactatataatctcactgttgattttcatttaaattaatggatccattttttatacgtttacattagcccgcttcctttttaatatcgtctattatatataaaagttcattaaatatccta

SEQ ID NO: 69708 - DNA, 1216 bp, Oryza sativa
aaatgaaattaaacacttgttttagactggcaccgacggtaagattgggtggtatctgggaaaggctagtaccgtccccggtcaattaaagaccgagccatgaagttaagcatgaaacgaccccatacaatcacacttctcgcatggggatagacctagcggagtaaatagctgagcgaaggcagtatccatgcatagtggtttcttgatgcgtaaggcaagggctctacagtggtgttgccattggtaggactaccatgtgttaatttaaacataattataacttaatgcatgtgtgtgagtcttcccttcccggatacgccagaactcctctcactactagaaactgtgtacgcctagagtgcatgaggatgaaaagttcatggagcgggtactgtcaatgtgaggttatcgaaaagctttgccgtgatacgtctcatgtgttgggacgaggctcatgtgttgggcagtcgcggagtgtgggtaaagtgtacatccactgcagtgtgagtaaaacgaatctattcgaatagccgtgctcgcggttattgagcaccgggacatgtattatacttggctagactctaaattcttaacttgtgtgggaagggttattgcatgatgaattttatgctgttggagccacttcctgagaagggggaaggtggacgttctcagaaaactatgacgactcaatggcgggaagctatccttgggatcacaatggatgatggacagaaccgtcgttgtttaaatataaacactggtactaaaatttgatcagtcaatgctaggtcttaggcttgtgaaaagaattacaaaacttgctttgcgcaaaagaaccatagccatcctttgaaatacccctatcatgtgcattgttgatgtggtggcttgctgagtacggttggtactcacccttgcaaatataaacttaatcagaggccggagatgaagcttcggaggatccctatgcctattaccaggagggtgatgaagacgatgacgctcaataggtcttagttacggtcattgcctatggcaatggcatgccgctgccttaattccgctgccttatctatttctgcttttgggatgtattccggaccgctcggtccgatgatttaagactacgcctgccggcttatgttgtaataatttgcactagactctcgtgtatgtgcgtttggtatctcggctataaactcgtgtgtac

SEQ ID NO: 69709 - DNA, 7062 bp, Oryza sativa
  unsure (1)..(7062): unsure at all n locations
ataatatattttaacattcttttaataaagaataaataaatttcccgcgcatctgcgcgggcttcctccttagttcataaaaagggaaaaaaagacatgcatgtctatatagatgtatagtctttctctaatgtacgatgtgtctctcgttaagactaaatagagaggcctcaccgtttatattttaccttataaaaaccaataattataaaaaaaaaaacctaaacgacacgtacttttaaaccgaaggaatgtagtatcaaaatataagatctttattaattttatacgcaacttacattatttccctttattttaacttgggacaactcttaagcctgcacacacacacacatacatatatatatatatatatacatatatatatatatatatatatatatatatatatatatatatatacatatatatatatatatatatatatagtaaatttgtttggtgctccatggtgcccgggcaccatgattgaaatttactatatacccaattcaaatgagtatgaaactttttcaaatatttaggtattaacgttaactactttactaactagttcaaagcaagtttgaactgaattcaaacttgcttttgttagattttgattctaggtatatagcatccaaacatataattagttaggtatgtaataatggattgtgaaataaagttaaatttgagttgttttgttgctaggtataggtatgaatcgaatacttataactaggtatatactcacaatttgaaaattttgaaaaatttggacgaatttgtgtatttcataccatggtgcccgggcaccatggtgccccatatgagtgtcctatatatatatatatatataagtctactgcttcaattaagcaggaagcagtactttaagttcaagttcaaactcgattggcaaccaatggcgctaatttaaattaggccgcaattagcgccattggagtacttcaagttgaagttcaaattaagcaggaagcagtacttcaagtactccgtaattaggccgcaatggacttcttgccttcgtcgtcgacatggccgccgccggtggcacgcagcacgatcgtctcaatggtgagccccggcccgagcccaaccatagctccccactcgcagtactcgtccgactcctcctcttcttccccaccatcccgccggcaccggcgtcgcagctcatcgaggacgaagatgatcgccgcgcagctcatgttgccgtactcgctcagcacccgccggctcgccgccagcttcccgggctccagccggagagccgcctcgtaggcgtccaagatcgcgcgcccgcccgggtgcatcgcccagaagaggtggttccacccgccggcgccggcgccgaggccgagcggcgtcagcgcgtcgagcaggcaccgctcgacgccgccgcgcaccagcgccgccacctcgccggagatcctgcagtcgaggccgcgctcgcccagcagcagggagactccctcctcggtccccggaatggtcgcctgcgacgccgacaccacgtggaagatcgggtgttcgacgggggtcgtcgggtccgcgcccacgacggcggcgccggcgccgtcgccgaacagtgccatggcgacgagcgcgtcgaggcgcgcctcgtagggggccgcgaacagcgggagcgtcacctccgcgcacgccacgagcacgcgcgcgccgcggttgttctcggcgatgtccttggcgaggcggagcgcggtgcagccggcgttgcagccgtgcatgtagaggacggcgcgctgcacggtggcgcggaggccgaggagcgccgcgagccgcgcgtcggcgccgggcgcgtgggcgccggcgttggtggagacgacgaggtgggtgacgtccgcggcggggcggccccactcggcgatcgccctcgccgcggcggccatggccagctccggcacggcgtccttggcgatgccgaggcgcgcgtcgagggaaggaagagcgcggttgatgaactcagggtggccggcgatcgtctcctcggagtggtagaaatggcgtttcttgatggctgatttgtcacctggaaatgaagcaaattaaatcacggtttcaacgtcagcagaaacatcctctatttttcaagtttagaataattaaaactcaattaatcacacgttattacaacctcattttacgtaaaacacttaaatcttcatgttcatcttcaggacattcaaacaccaccttaatcatctttgcaaattactcaagataaaaaaaactagagcatctcacgaatattacacacatacatataaattttcaacacaaatttagtcagattagatatgtatctttgctttctgtctcttagagtatgtattagcagatacattcacgaatgatatgagtatggtattacatgtgtagtgttatgtgtgcctatgcgtctaccgtgtaatcgaaaagaaaacaaaaagactgtgtgcactagtttggtaatccctctgttttaggttacaatacattttaacttttgtcaaattcaaactactctaaatttaactaattttgtacaaaaaaatgtactaatatttttaacccaagacaaatatattatgaaaatttattcaattatagatttaatgaaactatactatttatactattttttttatagagttagtcgaagttagagtaatttaattttgactaaaaatcaaaacgttttatagcctaaaacgtaggtagtaataaataagggtaagaaaaatagcaatataagaagagatataagagataatcttacacatcctcttcatcttggctttaaggtcggggaggtggtcgctctgggtgacccggaagtaccagtcgacgaactcctcctgcgccaccacgcacttcgccgggttcgccgtgccgatggcgagcacggcggcgtgctgctgtcgcgccgccatggcgcagccgcggtcgatcgcagagagatcgattatatgcactgtgtggactgtcgagtgatgtgcaattgcttgctcctctgcactgtaagatgcacacagatgatcaggggctatatatagcttacaccaatgcgcgtgcgtgcgtgcgtgcgagattttgctgatgcacatgccaatggtgatcatcgatcgatcatcacacggtcacatggtattacacatgttaacatgtgaaaggagtggaattagagtcatgttaagcaatatatgcgttgtactgtgtaatttttttttataaaaagcaatgtatacgtgttcagacacgaggagcgatattagtgacggagctaggatttagacgtggaaggagactaatccagttttacttagttcaattacgtaattagtttaactaggaagatagctcgcgcgaatgcgcgggcatgtgtcgtagactatgttgaacatctacaatatatgatttctccataaattattttcattagcattgcttttataatgttctaacctagctattagttatctttataacataccatatttaattaatccctacaagcaattatttataatattcttcatcatctaaaaagtaggtactcatattttgtgttagaaaacatgtatagcaaatagcaaattaagtgtaaattcaaaagtaagatttttttaattgagtataggttgtcattgtttattgacggatgaattgggtgggatatgtggctccactaaatgcatgggttaatatagcctaatattattgtttagtttgagaatccatatgtgaacgttccatgtagagtgtgtgtgagactccatgcaacctagcgtgaataatattggatgaagatatatagttgtgcaatatattattttggaagatgatgtattatgaatacacgcttgtcttttaatatgagatagatctaatggttggaaataataggttcatcggtttaaaaaggcctaggaggatttatggggtaacatgtggcgaccttatatgaaaaagaaaccatcatctaaaatcgattagatgatatataaaataaaattataagtgtagcttaaaattatggtctttttaatatttgtttatctctttagtttagtagctgaaaatagggaggagactggagagaaatgaatagcatagaactcgaatcagatatgagaaagggttcgcaatgcaatagtgttatgtgcatgtgattggagagggaggtggagggtacattgttttttttaatctttgtaaataatctaagtgagaacctatgatttgttgttttctcattctaaggatatttaagacatgacatgtggtggcttaagtttttttataaagagaaaggtattctaatagttaaaaataatgtgtcatcaaattaagtggatagatatatatactttattttttctttgaatttcaattttttcaaagttttaaaatatcatacgtggtgactgtggtgacttaagagtactatagagcatgtttaatcgatctttactatgtaaaacgattcaagaatatataagatgcgttgtcatgtttttcaatgtttcgttgttatttggtaatgagattttatttttattgaggtagatttaatgcgttcatctgtttgaattatttatgtctttaaatccaattgttaaaattataactccacttatttaaataaaaattgatcaaattatgagtccgccaatttaattgaaaattgatggttagatttgttttcttcataatttttttttataattaaaattgttatttataaaataggaaggtgagagaaagaattattggagacggagaaagtgtatgtatgtatacttacgtgcgtagggtggtgtgaagggtgggctagtggggagaggatagttgtgccggtgggagagaggcgatggatgtggattgtgatttttttaaggaaaaaaagataaatataatagttgaaaaatagatggtttaccaatttattataataccatgtggcggtttggtagtgtttataggcgtaccacgtggaagtataggagtgtttgtattttttttagtttatattttttttatttttaaatggtaattaggatgacatgccctagaaattattcttttccgtagaagtttaccacggttgaatcattaagttttttaaagacaccatggatctaaatttagatgtgtttgcaaatttgatgattatttagggtgcttgttgtttagccagtaaaaagataaatcgtctagtagagcttagcaggatgaaaacacgtgcacacccttatttgtagcagacctcatgctaattgcattgataatccctagcaagaataggttagcctatttggataaccaaattaaagcaagcagcacacacgttgaaaacctattcaatgttttgatttatctgcatcgttgtggtttattatataacttagaaacaattatgatcacttaagtttttttagatggggttgctaggtactccctcattccctaaatatttgacgccgttgacttttttaaatatattagaccgttcgtcttattcaaaaacttacttttgtgaaatgtgtaaaactatatgtatacatatataaaagtatatttaacaataaatcaaatgataggaaaagaattaataattacttaaattttttgaataagacgaacggtcaaacatttttaaaaaagtcaacggtgtcaaatattttagaatgtagggagtataaaataggagagggaggaggagtatgtatatatagaggggagatttcttttattggaaacagatccttgagatatatctaatggttagaaataatagattcaccagtttataagttataacggatggtgatttttttttctcataattttaagattttctctaatttattagagtgtcacataacggtttagaagagtatgtaggatgtcacatggtgacttgagtgtgtttataggaagtttaatggacttgtgcgtagaatacnnaactcaaaataacattatatttttataactattggctgaaatattaatttggtttttgtctcatgagagtgaaaaaaagaaaaaagaaaagaagggaaggggggacacgtgctccctccatacccacaaaacaagtcgttctgggctcttacccgttttcacaaaacaagtcgtcgttcctcagcggggtttagtttggacgcgtatgcccctgacgcgagagccgagcaacgagcggcgaggcaagaaacgaggcgacgtgattaatgccgccttaagctgaatggacgtgattaatggcgctcgatctttcctcttcgtctcccgcatgcagcacacgctcgtcgcttgccgctcgcacacgcgcgtctctcttcctcgccgcccggctgtagttagggttcagagcttggtcgcgccatggagtacgtcgagtcgctgaagtccgtcgaggtgctggactccgtcgacgccctggacatcgtcaacgcactggactccgtcgaggggctagaatcggagatggcgttggactccgtcgaggtgccggactccgtcgaggtggtgccggagtccgtcaaggtggcgccggacttcgtcaaggtggcgccggactccgtcgaggtggtgcagtgtcctcgctgcggcacattccacgctggcggcgtcttcggagaagcatgcttccaagctcgccgccgtgctcgcaggtgtgcccgttgtggccttttacatgaagactacgacctcatagcaaggtttttgcataacatggaaaagtttgattgtgagttatacattcctgatgtggagaaacttaaaatggatggtgaaaccatacttcttcctaagcatgttatcaaaaagttggacgagatctacagtatgaaggagttggaagatgcaaagatgaagcaagaacagtaagttacatgtctcattcagtcgacctaacatgcaagcaaaaactaatttgctactaatattcttgctttggctagcgtgttgcaaagactaacatgcttgtatcatctaatattctacttctaatttgctgcagggaga

SEQ ID NO: 69710 - DNA, 3679 bp, Oryza sativa
tgtaaaaggttagtgaaccaaatcctaggggaatattattattctaacagtatatgcattgcaagtataactagttcttctctattttggtaatattgacggtcaaaactgatcgctaacgacaatcaacaacaggtccgacccctaagcaaagagggggcagccgccactccaccccaggccggaccctccttggggaagtgccacgtgggtttgggggcggcctcctccctctaaacatgataccgccgggcccatatcacagacgcagtcagacttatataggtgtgttccttctaaaatgttatgtaggccaacatgtctactttatggtaaacattaaggtatgcaccaacttgccatatagatgaggagagaagtacatcaaagaaatgagcctctcctcctagctacccaatagcttatttcaacatcctaattcacgccatctctaaccatatacgataggttactactattgtgtaactcaaaagggtcttaaacccatctcactcgatgcactgcctatcacattttgcgatagtccctcaatgaactgatctgctagatttttagcaatctggacatatggctgcgttcgaatctccaacaaaagttggatgaaaactttgatattcatatcatgcttttcaaaatattaaatggtgtgtttcatgcgaaaacattctatgtggaagttgctctaaaatatcatataaatctattttctaagtttgtaataattaaaacttaattaatcgtacgttaataccacattgttatgcgtaaaacacttcatcttcatttacatgagtttcaaacacatagtctaattctatcactccgaagtattttaggattctcatagacttcaatcttctttttatatgtctgtatgactttatgttgtcctttaaactgttcaccttaataatcgtcatttgattatcacggttcataagtcactggtttttcaaccacggttaatccatcggaggcccatgaagtactcgatctcaatagtggcagtgctacgtcaaattattttgatttaatgactgaccctcaatcgttcgcaagttgttatacgttgcacacgtgtataccgtgagcgcaacttatccattttttttgtttaaccacattttaattttctctctttaattaggtatctaattgttcttgacgacatcagcatggagcagtggaatgccatagaatcgatatttgagaacaatggtagaggcagcagggtaatcgtgacgacggccatcctctcggtcgccaacagttgcacggcctacaagtccggagccaacggcggatgctgcatccgtcgccatggctgcgtctacaagatgcagactctcggagaagcgcacgccaaggagctcgccctcggcggcggcagcgatcagcgaccgccggagctggagcacggctcggcgacgcttatggcgaagtgcgacggcctcccgctcgccctcgtcagcgtcgccaaccacctgcggtgcctgggcaatctcacggggcggcactgcgccgacctgtgccacctcctcggctccctcctgctcgacgagcgcaacgtcccgaggctcgccgggacggcgccgccgccgacagcttcgcgaggctccgccgggttctgatggacagctacgcgggcctccctgactacgccgccaggacctgcctgctgtacctggccgtcttccccaacgacggccgccgcctcaagaggagcgtgctcgtccggcggtggctggccgaagggtacgcgcgcggcggcgaggacgtgcttggcaacagcaccgacgtggacgtcgccgacggccacttcaggtcgttcgtcgaccagagcatcatcgtcgcccaccctgccgacgacgacgacgacgacgaccaccgcacgaggaggtgcaggactcacggcatcgtgcacgagttcgtcctgcacaagtccatcgccgagagcttcatcttctcctcccgtgctcctccgaggcgcaagagagtccgccacctctccatccaagcggcggcgggaacaccacgacggcggcgctgagcacgacggacctgtcttgcgtccgctcgctgaccgtcttcggagatggcggcgacgccgtctccaacctccgaaagtgcaagctcctcagagtccttgacctcgagcagtgcaccactgctctgagcgacgatcacctcgctgacatctgcaagctctggaacctaagatacctaagcatagggatgagcagcaatgtcaccatgctgccagacaatatccgaaggctgaaactcttggagacgatccatctcagcaagaccaaggtgacaatgctgccactacaagtcgtcggcctgccatgcctagctcacctggtcggaaagttcaagcttctcctcccagatcaacgtgggaagaagacggtggtgatcagcaacgagctcgagaagctcgcgaagaagagcaacctccagacgctcgccggcttcgtcgccgacgagagccagcaagcgtttccgcagctgatgaggcacatgaggaagctgatcaaggtcaagatatggtgcgagttcggaggagaagaatccgacagtgtctcgacgacggcgacggatcacctcgccgacgctatcaggagctacatcgaggcacccaaggttgaagagaccgacgcacgctcgctgtcaatcgacatggagcaatgctcgaagcagctgatcaggtcatgtcatggagagagtaagctcctgcactccctgaagcctccatgccgcagctacctcacctcgctgaagcttcatggcgacctgttccggctgcacgggctcatctccatgctcaagaacctctacgagctctgcctctcgtcgacgacgacgaccctgaccagggatctcgtatcagccatcggcggattgcctcttcttcttcgcctcaagctggtggcgaatcacatcgagcatttcgccataggagccggggagttcagaagcttgcaacacctgctcctcgtggtgcatcgtcagaatcccatcctgctgccaaagatcgaggagggagcactgcctcagctcgtctctctcgagctgctctgcaagcatctgcgcggcctctccgggatccagatcagacacctccagcgtctcaaggaggtcgcactcgattctcgagtgagcgagggcacgaagcgagagtgggaggcagaggccaggaggcatccgaacaggcccagcatcttgctcctgaagaacagttacagtactgtcctgcctgacgacactgacagattggatgatcagatggacggggagcttgctcgggagaaatctgcacctgatgatgatgctggcaaccaggagcagattgcggaggtggaatcagaaagcagtgcatttcaattggcgaattccactatgaataattcagtcgctggaaaggaatcaacagctgatgatgctgatgaagaaggattgggaagcactaatgcagtgcccatggagcagataaattctactggctccatcaatgagaccgaggtctccaatagagggaaattcacaatgtcatattttgaggactgctgtccctaccatgaggtaataaactataaatttggcacatattatgtgaattcaactgcatttgagatattatttaattaaggtt

SEQ ID NO: 69711 - DNA, 17191 bp, Oryza sativa
cagtttgttaatttccttggacggaatgctcatttgtccaagctatgaacctcaagtcaatttgagttatgatcctcaagtcaatttgagttgtgcaatgcctccaattcactcatgaattatgataaaagtaattaggtccacctgtaccagtaaagcacctgttctagtgactatacgatcagaagaacaagctaagcaaacaaacccagtgtacttaaacttaatagcgcattcgaatttagcagaaaacaagggtcagatttttgtcatgggtatgcccacatgtcatagtatagttgagtcaaataaaaaacttgttcacaataatataattaatcattcctaattgcagcgcttcatttttactcattcctaattgaaccaggaagtaaagacacaggatctcaattctctacatacaaatcacaaaaatatgccttgaactgaactaagtttactcattctagttttcaacttttcaattaatctcactctctgataagagaaaaaccaaaccagagagagagatcctagaaatactcactgaatataccagccgtcagccgtggacatggacagatgagtgaacgacgcttggagctggacctttggtcggcattctggcgcaaccattgctagtgcagtgctcctggtcgccgactcgctggccgccgtgacggcgtgcagctcctgtgccgaggcgttgacgggtcgctggcccactgccttgcacccctgccccgcgcagacacgcccccgcaagtcgccggccaccgctggtcatcatcgtcgtcgtcgtcgctgctgctgttgtcgtcgtcgtcgttgcagccactatcgccatagccgctgccgccgtagacgctcgctcccgcctgcctaagcccgccgccaccgctccggagggtggaggcgagcggatccgcgtgctgccggtgctcccgctcacaccaggccgctcccgaggacggaggccgctggattcatgcgacgtcgtcgctcccgaggacgggaggcgacggatccacgcgccactgtccttccctggctatgcggcgaggcggggaagggcgaagaggtggctgggggcggagatggaggctccgcggtggatggaggaggagagggatggtggcggtgagggagtggatggtggcagcggtggcatatggatttagtttgggctagggtttggggaacatgttatatggataagaagcaattcaatgcgaatttaccaaactgtccctggtgtgtacacagtagttacgaaattgtatggacaaaatggacatttcaccttaaatttagagaactttaaatttcattttaggctgatttttgtgtttcaaatgcaaaagtcctaaacaacaaaattgcagaactcatcgagatctacaacttttatattggtcttttttaaaaataagttcatttgaacaattcaaattttgaattttcaaaatttgataacttcaaacaaaaattggggttaataaatgattttaattggaaaagtcaccaaaaccaaagttgtagaactcatcgaggtgcaaaatttttattttggtcatttctccatctgactctatttgaataatttgaaatttaaaattcaaagtttgagaacttaaaatagaattttttattagtgaatgacttccactgaaaaagtcatcaacaacaaaattgtataatccatctagatatagaatttttattttggtcatttattcatccaacaaagtgatactaacattgttcaaaaattttacgtatctcccatatggtttcataaattataagagagatgtgtaaattttatgaacaatgttagtatcactttgtcggatgaagaaatgaccaaaataaaagttatagataatgctgagttatacaactttgttgttgatgactttttcagttgaaattatttaatatttgaaaatgttagttgaagttgtcataatttgaaattcaaattcaaattattgaaacaaagtcatatagcaaaatgagcaaaaccaaagttgtagatcttgataagttatacaacttttttgttgatgactttttcagttgaaatcatttagtatttgaaaatgttgtttgaagttgtcataatttgaaattcaaattcaaattattgaaacaaagtcatatagcaaaatgatcaaaacaaaagttgtacatcttgataatttatacaacttttttgttgacaactttttcatttaaaatcatttactactcgaaaaattatttgaattgagaggaaggaggcaaaatggacttctcggcgagtgaggaacaaaagagctgggccggcggcccgaagagggaggaggggaaggggaaaccggcccatggagggagagagaggctacgggctgagggagggagagagtaatacttgggccgaaaatggtccaaggacatagagagggattttaatttgttttctatttatattaataggataaatgtattaaaattagttattgagctccgaaattcatgaaaaatttcagagaataatttagaccacgtagaatattaaaaaaatattcccggacgtgatttttaaaggaaaattttagtttcctcattaattcacttgattaaattgctttaacttttaatatatttttctcgaaatgcattatataaatctgtgacgtttgctttttgcccttcagaacaaattaatattctacacaatgtcccattgaaatactttatgacgatttttagttggtattaacgacgaatacttttttttccgtcactaagccaccccatctcatactaatcgccatatttctgattttttttcattcataaaatgagactagagatgacttcaatccaaaaatcctaatatgagagactagaattgatgtagacaagaagagttaacctaggacaaacgatttgtggtctagtagcaatgtagtataataagattttttttgttttaaaaaaaattataatagttctatattttatgacgatccactattgtcatcgtgctatcgtcacagagcccatgcagagtatactgtgacgatgattatgacagatacactgtttggtcataaacattcgtcatactgtgaacggtcgtcataaactgcctctgtttatgacagatatgtgttctatcatcaggtaatcgtcacagaagcccagatttgttgtagcgacttaagtagcatcttaaagatctgagttcaaatttttataggagcgaatttcagattggattatttcaagtgctaagttttcaatttaaaaggctgctatatccgattggacatagaggtcgggtaaaaaaaacctcttaaaaaaagtaaaattagcttacaaattgatgcacaaatgtagtcggtcagtatatttatgcacattgatgcagaaactgaagccacgaaaacatattgtttctttgaaaatggaaaaatatttctatttctacgttttgctaggtcattcgcggcaacagaacaaattcgtcttacaatttgtttctatctgcatatcatacaatattccagcagtagcacgcagagcttcatcaagtaaataaataaatttagtaactttgatttggactgtcatttccaaaaatgccagtcaccttaattttcatccttttgatggcaatcaaatggttctcatcactctcctattattcatttaaataaagaaccatcttccttagacgaaaggtactaaactacaaagttacatgaaataaaattataattcataaaatttacaaaatttcattcaagatttttatttaatttgcatgtaattttcttcttcatttataaagtatagatatggagaaaaaatataaaaggggatcgttttatcctctctaaaatctttgcaaatttgccatgcctttgccagccgaatctgctgctcgacaaccgcggggacgaagccgcatgcggccgccgtgcagccgcggcgtgcggcgatgctcgtcatcggcaccgcgaacccgcccaactccctgtcgcaggaggagtacaccgactggtacttctgcgtcaccaacagcgaccacctcaccaacctcaaagacaagatgaagaaaatatgtgaatttctaattactaagtactcggtgcgttgcaacgggttcatatagggatgggctgcataggcctagctaactgctctggcatctaatataaccgttttgttttaaccagattttgtttttaaccaaccctttgattttttttcttgattaatttaaatttgagtttttcccaaaaaaaaataatttgagtttatggaattttgctttgaattttttgttatactagtactatacccgtgtattacaccggaataattaactattcgccacttttacgagtgatgataaattatttgtcactgcattcacatgtcataatcacatgagggccacatgtcatagagagcgagtggcaaattcttaattgccacatcttaaaaatgacaaatagttaaatgtccgtattacacccatagacaatgatgtaaggatgtgcgacatatatacaaccatagacaatgatggaatttaaccggttatttttttaaccatttttttcttgttttgtttttaaccaaccctttgattttttttccacggttttctccagaatgggtggttatgcacgtaacatgagggggaggcaggaggacaactatggttttggttttataataactaggaaggaagcccgcgcaaatgcgcgggcaacttatttataaaagattggtaaaagaagtcatacttcaccatattaattataagaaacgcttatttattatttataaaaataatgctaaagaaatcctatctcaccatattaattaattataaggaccatagatcaccttataattatataaaaataaatgtctagacacaacaaaaagatcatctctacttcataccaaattgttcatgtctcacttgtgtttaaatatatgcataaatattttgaaatattactcctaccatttcatgggataaaaccattaaatttgatctaaatgcccctctaatgggtgaagccgactgtagccaccaaggctttcttctcttatgctttgaaacatgtgtccagtatcgatatagttgttctcctcgagatcagtgtggagcacaattttaatacctaattcactatcagctaaagaatcacatcggtaagtaagccatttgaactttattgcgaatagtagcctctcactggggtcacctcaacatagtcatatgcatacccccgccatacgtatagtagcatagcaaactatattatcaatgcttggtgcccttcagggaatgacacatagatgagatgaaagtgatacattttttttaaggttttgagtccatttatggaatagagttgacacttgtttatggtgttaattggtctactaaattttagtggtacagatataattttctcttctgaaaataagcagagttgatcattcgatactacttcaaataatctaatagcttcagtggtgagaaacacgtggaaaaatatttgcttgagtagtaataattcatgaacatatgaggtaatatgagttttgatatttttcttttctttgtattattgatctaattcatcttcgtggggtaatatatgatggaacaatatatgttatcaagtttatttgtgctaattgttaatgctatgtataataatgtgaaaagtgatagaatgtggttccatgtaatattttttattcaaaagatagttaacatatttataaattttctatagaaaaagtgggttgtaaatgaatataatatccactatcagttattaaaaagcatggagtaattgttgagattatttggataagaaagatataaaaattggctagaatattgtttcgtatgataactttttaatcagaatttgctatatatatgtcacaaattttactttgggtcatattttattatgaatgttttattttagactaccctttaaccaatattttcattttggattgggtaagcatatcaacgatctcggatacgtcggctcctaataataaattaactgtcacaaatataagatataagatataagatatagcctagtcaacaatgaccctaggaaataaactggagagatcgaaaggagccacagcagagggtagactgatcatgtataaactttctaatttaagggttagaaggacatggttaatatatttttttatgtacgtacatatgcatgtttttttttttgcaaataatagtctcctgtacatgcatataaacatacgtatgttttctccgggagaatagtatatatttatttttctctcttgcaaatacgtatgagattaggagagagaaattaattactttagtacgatctaatctaatgattgaaaataatagttcacctgtatatgcgtaaatcaatggttcaatgtttaacttttatttttttcagaatattttggatttgtattgatcttaagttatcagttactcccaatctaaattaaattgtgaccatttaactcaccatgtttatgttgaattgcttgctataaaatagaccaatagggtgttgagagaaaaggagatatatgtgggctgcacgtacgtatctgaagattttagatttttttttttgacacggtacgatgacagggtatgtacaaagggggagagagggttatgtgtgggaggagggatgtggatgtggaaagattttttttttaataatctgacggcttgaaataatgggtccaccaatttaagtgaaaacggatggacagatgtttcacttttttcttagaatttctaggaatttctctaatttattagaacgccatattgcgacttaggagcgtttataggagaccacgtggtggcttgagagcgtttataggaagtttaatgaacttttagtatataatagatagatagagaagagaaaaaaaattgctttcagatttcgaaatgtttgcatgaaacttgacagaactgttgcgcaagaattttgtggaagagaaattttacaatcctcgataatgcacctaaattttacacttaaatttatggtaccttaatatatccagtatctaataaagataccatggtaaattatcctttgtaaaacattatcaggtcacaggagtggcatcaagaagcggcacttccaccacaccgatgacacgttccgcgaccacccagagctcgccgtgcgcgaccagccgtcgctcgagacgcgccaggacatactagcgaccgtcgtgccagagctcgccgcggaggccgcggcgagtgcgatcaccgagtggggccgcccggcgagtgacgtcacccacctactccggcatgcgcatgcccggaggtgacctccggcttgcgtccctcctcggcctccgccgttcagtgcagcgcacgtcgatgtacttccacgggtgctccgcagccgccgccgtgctccgcgtcgcaaaggacctcgccgagaacaaccccggcgcgcgcgtgctcgtcgtcagcgccgagctcagcctcaccctgttccgcgcgccccaggaggggcatgtcgacacgatcgtcgggcaggcgctgttcggcgatggcgcgggcgccgtcatcgtcggcgctggcggggatgagcgccaggtgttctagatggtgtccgccgcgcagacggtgctgcccgaaagcgagggcggcgccgaagggcagctcaacgcgtccggcttggtgttccgcccttcgttcgagctcccggcgatggtgcgcgacaacatcgagcagtgcttggccgagggagtcggcaagcatgtcgcccatggcggctggaacgacctcttctgggcggtgcaccccggcgggaggaagatcctggacgtcgtggaggaccggctcgcgctggcgccggggaagctggatgcatcccggcatgtcctgagcgagtacgggaacatgtctggcgcgtcgattatcttcgtcctcgacgagctccgacgacggggcgacatgccgtcgggagggctaggcgtgatgctggggatcgggccggggatctccatcgagacgatgttactgcgtgtggcggcagcttgaagggagctcaaggagggaataattaactatttgccactcttacaagtggtgataaaagatttgccactggacccaataaaaaatttgtcactggattcacatgttgtagacaacgagttgcaaataattaattgacacatcttaagagtggcaaaaagttaaatgaactaaatgtattttttgaatttgagtaaattcgttttttatttttatttttgcgagagagtaaattcgtaaattggttttagagcttgaagaccaaaaaagctcatacaaaatcgtacaaacgagaggatacatttttgaaacatgaggtctaataaaatatttgagaactttgaaatacatgtatatactagatgatacaccgcacgtttgatgcggaacgttgtctataaatatacgtgagacagggaactaagcaactgtgaactgaaaaaaacttaggagggaatataaagatgttcagcaagtgcttatcaggttttatttgctgaaacatgcggatcaccgatatatttctaaaattgttaacttaagtctcgatccgtacagcagctagagataacttggtcagtgtagcaataacgtactgggctgtagcaagctggtgtctagaggatgttacattgctaaatgccctagaaacaggcacaaattaatagctgcaaactgtaaaaaatagggaacataaactttttatatatcgaacaaagagcaaatcatatatgtttgattttttttagcaaaaggaagcgactttcaacgaatgaaaccattagtccattacgaaacattgattttacctcaatatgtactgctgcacacttttttttccaggagaacagatgaaattatccctgcaaagtttctaatcaaacaatcaaacggtggaaaatattttaggtgacgtaaaacaaccacagcaaagcaaaatagtaataactacataaagtggatcaattatataggtttaacagataagtatataggattcacaacctaattaaatagggaagatgtctatgtctattttactgaatacgacttgagaaaaaggagattaatagacgtatattgtgcgaactggaaaagaagagcaaaatgacactacctatgattcttctatgaactgaaccatacatacggagaggaaattataatttgcaagattggaggttatgaaagatgaggtgctgggatctgggaggtgcagaggagcaaagtggagtttcgatgctagcaaaaagtacaccgaaggtccctcaacttgtcaccgaattaaaaaacgaccccaaccgcaacaccagatatccggagtctcttaactaatcaaaaccagtcacaataggtcctttggtggttttgaccctgattttaacctacgtgacagcttagtcagcatgagacccacataaaccctacatgtcagcgtggtcgtgaaagtctccccctctttcccctcctctctattctcctctctctctcactcttctcttctcttctttgggcaagccggccggcggctggggagcaggccaccgggcgaggcggcggcggtggccggccgcgaatggcgtcggcgacgctgcgtcgccgccatcggcgaagcgccccgcgcgggtgggcaccgcggcgttgggcgcggaggcagatgcgaggctgtctcgcgtcgtcaaagtccccgtctcgagtggcgaggaaagcgaggacgaggttgccatcgatcgccgcggggtcatcgccctccgcctcagcggcggcgagggcgcgctcggcggtggtgtgcgcctctcggagtcgctcgccgctcggaaccggcttcattgacaacccgctcagcaccggcttcagcgctgcgccgtccctcgccgccatccccactaaccagtctgtcggccgagcgtcgtagtgcaggcggcggcgagaaggcaggcagcggggagggatgggacagctatcgttgcacaatgtttttcaggtgttggatctgctggaagacgcatgcgagtcattacttgacagcatcgtggcagagaatgcaagcgtttctgcttgatctgaatgaagctatatggaggcaatgtaagcatcattttttccatgtaaccatgttcggtatctatctatgccatttgattgcgattcagataaccagaaaacactcacataagcatgtatgtacccatgttcaattgttcatacaatgtcaggctggagacatacttatatctttcatgtacaccatgatttacactgtaataaaatcaccaactcgaattacagaagctgaactgttttgttagtaacacattgcacatgtaggaagaagccacctctcgccaaggagcagctcgcgagctcggcgtcggcgacgacggcgaggtagtagtcgccggtgggctcaggggacgacgaatccgacgcgtacgtggcctcggcggtgtcctagtggacgcccacggccgtgtcggcggcggtggcgagggacctgctcccgcgcttcttgtgcagcacatggtaggcgcgcctcgacgacggcaagagcgcgtcgtcgaaggcgacggcaaggccggtggctccggcgcagcgctacgcgtccacgtgacccggatgaggagctccttcccggagtgcagcgaggcaccgtacaccgccgtggttgccgcctacagcgagcgatccagcgcgccgccgcggccagaccgccgcggcgatgccgaccgagctgttgccgaagcacgacagctcccgcatcgcctccagctttggtttttttttttccggcgagattagctgccgctttgctgttgctgctgcaataaaatggaatgcgctatgtggcacgatggtggcatcgccgcgctctcacacgccgcctctgctccgctccgccggccgccgctcagccccgctcgccgctgtccgttgctactcccccgcggcaaagagaatgaaacgaagaagagagaaaagaaaggggaaagacgtccgcgtcaccggccgccggacctcctctcccgccacgccccgtcagtctgctctagggctatcaacgagccgagctcgagcgagctcgtctgcctaggcttgagctcgataagctcgagccgagcctataaaatattcgagctttccgacaggctcggctcgtgctcgactatcgagctcgatttttaagtaaaacaatatatatttcaaatataatctttaaaaaataattaatttcaagtaaatcatattaatagaagagaaaaaaaataaaataaatatatgatgtcatataagatatacaaataacatatttgatctcctaatttattaaataacaacaaaagttatatattactgggctcgttggaagctcgagctcggctcgacaaaactcacgaacttacggagaggctcgggcttggctcgtctggagctcgagccgagcccgaatcgagcctaggacgagccaagctcgagcagctcgcgagccttgagcttttttgatagccctagtctgctccctactcgtcggttggcctgcgagagatagaaagaaaggaggaagggagggaagaggggaaagagagttgacgtggcacgctgacgtgtggggtccacgtgggttccacgctgactcagctgccacgtaggctaaaaccggagtcaaaatcactgaagaaactattgtgaccggttttgattagttaatggatcccggatatctagttttgcgtttgctgacgttttttaaactcgatgacaagttcagggaccttcgcccctttggtgtaatttttccttcgatgctacgtgcctatacatggttggcctggcccatggttcaccttaacaccaaagcaattttacggtgttatcttttcgcttacttatgcttattagacaaaatttaaatttttaactttaaatctggagttgattttaggattttttttttatgaaaatttatttttcagcctttgcttttagatcgttaagaacatgtaaataaaaatttgagtaaagtccatcactggtcccttaacttttaccgatgtgtcatcccggtctctaaactcgcaaatcgaccattcagatcctcaaacttgttcgattatatcatcccgatctctaaacttgtagatcactcgtttaggtcctccaacttgttcagttgtgtcaccccggtccctaaacaggacggtctaaaaactttatatcaaaaaataattcataactttttcatgtgaactctaatgaagataaactttatatcaaaattatagccctcgacgtgacctacaactttgtagttgaaaagtttttgaattaaaactgtttagggtcccaaaatattgttgcatgtttatagattttgtaattttaattttaaaattacattttgggacaaaattgacttaaaataaaaaaaattcaactacaaagttatagatcgcgtcgagggctacaagtttaatataaagtttgtcttcattagagttcacatgaaaaaattatgaattacttttaaatataaagtctttagaccgtcctatttgacccagatgatatttaaatccaagtttagggaccggagtgacacaactgaataagttggaggacctaaatgagtgatctgtaagtttagggaccgggatgacacagtcgaacctaaacggtcgatttgcgagtttagcgaccgggatgacacaacgatacaagtttaatgaccggtgatagattttactctaaaattttattcacagattatttttcgtttgtaaatatatcgttgatggaaaccttaatcctgccgtgtcgtggaatccgccgtagtggggatctaccatatagatatataggatttggtcgatcaaaccaaatcccttttttagtggaaaatatttggccgtgggccttctaggctctatcaggccggcgcattttacttgggccagataactgtatcgtggctgggctggatgttcacagaaaatctgggaccacattgaccgaacgatcagtaatatcgacttctttttttccccttttgcagtttttcagccgattaaggaatagcgagtctgtttgagagctatgcacagttagagacttattttagccttcagtttttttttaaacgaatcagtaagctgtcaatttcattaaatatagaagaagtaaactttaaaggtgagaaagaaaaaaatatcaaggctaaggaccttcggtacgagcaattaaaaagaaagccaactaccgagatctctcgtgccttccaagtaccatgatttggtattctgtttgattttagccagaaggctacctatgatcaatagctcttttcttgaaaggttctacggtttcttttattccagatttttcaggctaccaagagagttaatgtgcgcatggctttcttttctggagcaccttttgtatttgcgtcttttgtattttagccttcagttaagtcattcatgcagcgatatactagaggtatttccaattctccatgcatgcaagtttgataatgttgctgttcaaggatctatgttttttatgtttgtttaccgaccttcgtacacacaataaactacaaatagggcgaggtaagagtacctcaactagttagttttttatttaacctacccacaggatttaagttttggatttatcatgggtgctcatatttacaactagagtaaagcatacgggcggttagaggtgtgtcatctagttccctaaactctcaaaatgcatatccaagtctccctaaactctcaaaatgcatatccaagtcccaaaacttgtcatagtgtgtcatttaggtcccaaatcgtcacaatctcttcaggatcctacgtggtgttgatgtggcatgccacgcggacatgacatggcattaatttgactgacaaataggacccatttaattttttttcctttttctttttttccttctcttttccccctttattcttctttctctgtgacccgccacgcggacatgacatggcattaatttgactgacaaatgggacccatttaaattttttcctttttctttttttttccttctcttttcccctttattcttctttctctgtgacccgccacgcggacatgacatggcattaatttgattgacaaatgggacccatttaaattttttctttttctttttttccttctcttttcccctttattcttctttctctgtgacccgaggagaagaaaggaaaaaaagaagaatgagaagaaaacggaaaagaaaaggaaaaataaaagaagaagaaaaaataaaatgacacgtcacatccatgtggcatgtcacatcagcgccacgtaggatcctagaggggatgtgtcgatttaggacctagatgatacactttgacaagttctgggacccggatatgcattttgagagtttaaggacctatatgacacaaccctacaagactaaggaccgccaatgcactttactcttacaactaatatttgtttatgatgactttatcaacctcaagatttgatggcagagaagtttaaaaaataaatttaatatatatatagcaccgtattttgttctgaatggcattacaaattgaattacaatatcaacacaagtatcagtacatcttctggagtacttagcatcagaacaatctggtccatcaggagtatgacagattgttagctgaactcttctgaactaacatactgcctccggagtaacaaactgaattcttctagttctagagataagccatcaagaattttcatggcacatatgtactggaaacttccaagagaattggttagtgattatcaattcaagagaactgagtatagtaaacctcatgactgaatgtacttgtagttttgtctgttgtcattaagaactaaagaatgtactcctgttacatctctaccctatagttaaacaagtggttttactcattcatcatgtgacacatccaacgatcgaaaaaatctgatgagttgcatttgacggcatccgcgcctcctccacccgatcgcgcctctccctcacgcacctgccccattcccatccccacgcatcgccgcacacaccagcatccccattaggccattacgcatcgcgctgacgctgctccaccgctaccgccactagatccccgcacggcgccgacttccacatcatccgcggccgctgctgaccagcaccaccgctacgcatcgcgttgacgccgctccaccctctttcctttgcacgccttcctccccacatcgtcgtggctgcgcccccgtcctgtccgccgccgagttcgcccctcagggcagggcatagcaccctcgcccagatcggtgccgccactgacccaaaatatagatttcccgatcttcaaaaagaatgacggtgttgctcctactaacaatatctgagccatgtgaacaagattaattagaaggattaattagaaggagtattacagattaaataatgcgtttatattaaactatttttgggcttatatgttaatttcttgaatgcaaattaatatgtcgttttgctcttcgaaagaaaatagaacaacaaaaacatccggtgggatttttctatttatcactattgtactataaaatatcaccaaaacattagcacgggcaaattactagtgaatgtactcctgttacatgagaaatgattaaccaaattttgaatggtaaataagatcatgttcgtggaaatgatcagccaaattttgcgtatctaacactagaacggataccatcatctcaatcgggcggcaacccccatctcaatcgggcatggcgtccgtcataggctagaagtcattgatgtgaaaagttatctcaatcgggcaaacggccgtcacagatgaacctatatcaatcgggccataattaaagcccgtcaccgatagctttaacccagacgatcagtcaaactatagcccgtcacggatgactatctcaatcgggcctaaactacagcccgtcacagatgacccttatctgtgacggacattaactatagcctgtcacagatgagtcatctcaatcgggcctaagttaatgcccgtcacagatgagtataatcccaaaaaaaaaattatttttaggaatgccgtccaacctctcacgccagtcttttttgtccttactcgtgtgcacctgggatgagcttcccgattggtcacctatcccgaaattgctacaagccaagcacgcttaacatcaaatcaaagttctttggagatcggcatccgaaagagtagttgtaacttattgatgtgagtattctattaatcctattaagcccttggccaggatgtcacaccccaacatctctcattcatatacattcattcacatacacaatcatcaaaaatcctaaacaacaaaattgtataactcaccgagatctacaactattgtatcggtcctttctataaataagttcatttgaacaatttaaattttgaattttcaaaatttgacaacttcgaacaaaaattagggttaataaatgatttcaaatgaaaaagtcaccaaaaccaaagttgtagagctcattgagatgcaaaatttttattttggtctcttctccatctgactctatttaaacaatttgaaattcaaagtttgagaaattcaaatagaattttttgttagtgaacgactttaactgaaaaagtcatcaataacaaagttgtataactcatcaagatctataacttttatttttggtcatttttctatataacattttttgaaccgtttgaatttgaatttgaaaatatgacaacttcaaacaacattttcaaatactaaatgatttcaactgaaaaggttatcaacaacaaagttgaataactcatcaagatctaaaacttttattttggtcatttcttcatctataaaatgttagtaacattgttcacaaattttacatatatgttttatagtttataaaaccagataagagatatgtcaattttgtgaacaatgttactatcactttatcagatgaagggctgcaggaat

SEQ ID NO: 69712 - DNA, 15145 bp, Oryza sativa
tcagctaaatgccttatgtaagtttgcttatccatgcctagaaacatagctaattaaagggtttaattataaactatattatgtaattgttaattagggttatattcaatggtagctcacgatggtaaatcgtgtgatgataattaattgataattaaaacctggataaggtgggttgtgagcatatggttttgatggttgtgctcatgacaattaaggaccggttctcgcccgactgagaagtggcgagaagtccacgggggtcgctggggagtccatgccttgttttaaagggggtgattatgatccaggaaaggtgcactgtaatgggttatgttgtgcgaggggtattgtcacgactcctgtcacgcccggaaattcactagtaatttccgaacttatttgtgcataaaatcctcgtccaagaatcagccgaggtacacaaactgacaatttaatatacagattcatcaataactaaagcgaataaatacttacttaagaggcacttagtcctcatcaggaagaaaactgcagcggaaaataaaatctagcgaagctccggctccactcccacaggcagctcaactggggtataagccaaacgtcttctccttccggatcctttttcttcaactgaggttgattgattattgcaagaatgagcatatgacatactcaacaagccacacagcaaatatgcaagtgcacaaagattccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgaacagatctaactccaaaccaggagctaagcaaattattaccagttaatcatcaataattattgtgagaggtgtgagactaatcacgaaaaacattgctcaacccgcccataaccgcgggcacggctattcgaatagttttactctggccagaggtgtaccactgtacccacaagacacgattccacacatgtcgccatgccctgaaataccaccacggcattgcaaagggggaaatcgtgacaataccctttgcacaacacaactcaaaacagtgcaccgttcctggatcataatcacccccttataaacaaggcatggactccccagcgacccccatggacttttcgccacttctcagtctggcgcactataatgaatcacactatacaaaagataaagcccgtgcccatgctggcttgtggtgggcacggtaaatgtttcacaacagtagctcgcgaaccggtccttaattgccatgagcacgacctccaaaaccatgtgctcacaacccaccattaatcatattttaattaccagttaattatcataacacgattaaccatcgtgagctaccattaaatataaccataaataataatgtagtatatatgattcatcccattagtgagctaatgtttctaagcattgctaagcaattatatatatacttaacatttagctgaaccaaaccaatacataaggttcaagctaatcaattttattaccccaaggtatcaaggaatagggcattcaatgcaaattggccataacaaaggaataggttcacaccacccgatgacattcgaaaataaatgcacagttgaaacaaatagagaatttaaatataggatcaacatgctcaaaggattgtttgggatctgtgtgacttgccttgcaataatcgatcttcaattaatcttcttgatcacttccgacgcactcacgaaccttcgcaacgacggaaacgacaagctaacacgcaaaacgaagaaaaagactaataaaaaccaaataaacagtacataaaaagtaaacaaacatgtaaatcataattttagatgaattatgagacttgaacggcctcattcagacttcaaatgaatttattatgaattttacgagattaaatctatttaaagcccatttaaaaagaattaaataaatttaattcaatttatggacaattttaatatgtagatctttattttagaaaaatttagcaacttgaaccacctgaaacggatctacggttatttagatatgattttccgaagatttaaactattagaaaaaagggaaaaaggaaaaggaaaaagagacgatgacgtcagcatgacgtcacccacggtcggccgattagggttttcgagctcgccggcgataggggccttggccggggaaaaggagggcacctacgcgtagaggacgacgagacgaacccgatggtactcaccaaagtgccaaaagatgaccgacgacggccggcgacttggaagacggcggcggcggctcggcttgacggcgacaaaggggctccggtggtcggcggcgaagggggacgggcggccgaggttgctctccctcatgcgcatctaacggcggcgagacaaggcggcggcggcaacgcaaacggcggcgcgacgcggctggaaggtcgccggcgacggcagcggctagggcaacggcgcggcagcgctacgggcgacgagagagctcgggacttggggcaaacggtagaggacgactaggggatgctatttatagcattggattgaagagatcgaactccaaacgagagaaatcgatccaagaaaatcaaaactcggttttggagataaactcgaaaacgaatttgattcggataaaatacccaacgattcgctccgattcttgaggggaaagatagaggagaacgagaggatcaaaacccctcaaacaaacggaagaaaagaggccggattggaacggattcggaggggaaaggaggcggctcgggctcggcatgggcggcagctcggccggctggaggttagggatgaccccgacaggtgggtcccacctgtcggcggctaaggggaggagggggcgggcggcgtcgggttgggccggcttggactgggccgacttgggccggttcgcccgcggaaaagagaaagagttgggccaaaaacggcccaacaacctaaaggagggtttttaaaactttttcaattaaaataattcgtgaaatgttgtttcatttattaaaaatacttccctacctcaaataattcccaaaaaattctagaaaatagaagagcaagcatagtatttaataaaattttatctagctcaattttatattgagatttaacaaattaaaattagatcttctcttttaagcttttaaaaaattatttctaataattccttttaaacaacaatttataatttaaggattttaaacaagaaaagctcttaacaattataattagaccatttaatgattaatttaatatttaaataattgctgaacttctctttgtatgattaaaattaataattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattaataatttattaaataatttataaatcctaagacaaaaatcaggatgtgacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtttcacactattcatcaatgttaataatgtggtaattaatttgactcctggtttggaatggctaattcctggtttgaaggtttaatttgttcaactggggttggttgttcaaatgtggttgggcctatgcaacacgggtgtgttgtatggtgtttatttaatattgattaattatacaactgtttaactattctctcaaatatttattaaatgctgtttctgcaaatgagctatattttgccatcctttgttatcctgtgcactggcatatttgctgtgtggcttgttgagtatgttatatgctcattcttgcaatattcattcatcagaggaggagtatctcagtgaatgtgatgatctggaggattaggcttgttcttggttaagttgcctgtggagtggagtcgccatagctgttccgtagtttgttttagttttgttttccgctgcgtagaatgttatttgttttgagaggaactatctacctctgtaataattttaatttgcgaatatttgatagttaattatttgtactctattatcaaattgtcattgtgtgcctcggttgattcctggacgagggttaacacacatgtaagcgtttggaattttggatagaaattccgggcgtgacaccgtcaacttctcctggatcgtcccgtctaatcttgtatcgtagtgctttgcaaacagggcatgcttctaggttctcatactcctcaccgtgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccatgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcaggcagctggaggaggaagaagacatatatataggggtgggactttagtcccggttggtagcactaaccggggctaaagatcaccgggatctttagtcccggttggtattaccaaccgggactaaagttacgatctttagtcccggttggtgttacaaaccgggactaaagatcccgggggggcctgacagtccctgacagcattcgaaccgggactaaagatgatctttagtcccggttggtaacacaaaccgggactaaagatcaaatatgcccgctacccttttgaaccgggactaaagatcatttttagccccggtttttattgcatccgggactattgtggaaatcggccgaccgacgaaagatggtttctccaccagtgtcgtcacttcgtctcgaggccgtcgttccaccttgaggacgctgctccacctcggactcggactaaacgcggcaagatccaaccatgccagggaggatcttggtggagatcaggcggcccctaccgccgtgatcccatgcatcggtcctcctcgagctccctctcttttatgggcagcagagtcgagcggactcgctagccacctcatattgccaggcaagagaggataaaatgagagaagaaagaaaccatctccggcgcgacgagaaaggacatttatctcgtctccctgagaccctaggcacaagctgccggagaggaagctcgttggattggaggcgggcgggtgcgcacgcgctcgacggggctagccggtcgccactgtcgttgtcttcctttccgcgaatgagcgtgttggaattgctctaatctatcaaattttatcagggaggcaatctgcacagtgaacaccaaacatggatcgcacatagtaaatctttttcacggtgatgactatacttttgatttcggcgaaaatttcgattttttggcgaacgcgcaatttcgttagcaccgatagttacgaaatttcgttattttttacactttttatcaaaattatttaaaattgtaacaaattttgactgtattgaataaactttgactaaattcaacaaaatttcaagaaatcctaaaattttggtccatgtaatgacttgccggttgtccaaaatttagaaccaaaattgcaatcactggcgactgcccattttctcgcaaccgccacgaatccccgctttggactcgaattcccgcctcgtcgctctctaaatcgagcgaggggacgaaacgaacgcgatccgccacattattcccatcccctctctctttcaatttctccctcccatccatccacctccagcgctagggtttgtgcgccgccgccgccaccagagctagggtttggggatctctcgtcgtccgtccgccgccacccccgccaccatccataggggtttcgtgctccccgcgccgccatggccgccgcgcggaaccccctgcgccggtggaagcccttcctcgccgcgttcgcctccgtcgacgacgccatcgagatcgaggccgccgacctggggatctcccgcagcgagatccggcgcgcgagaggccgcatcgtggggatgctccgcggcgcggaggacgaccgggaggcggaggagctctgctcggtgctcgacgaggtgatggcggagtctctcctgacgctgcggttggtgcccgtgacgcccaggacgctggcgaccaccgatctcgccggggtggtcggcgcgctgaggaagcacgactcggagcggatccgcggcctcgccaccgacatcgtccgccggtggagggcggccgtgaagcgagaccttgtcaggatcggggtcgccatggagaagctctctcagacaccggagcgcatcgaggccgccgatcggccagtctccgatctggatgcgaaggtgaagcgcgcactaccggtggcgtcagcacggcgaaggcctcagagccatcgctgcccaagaggagtgctccggccgacatgggctcggcaacaaagccgaaggagccaacccatccgccgaagaagaagccgccggccgccgcgatggtgtcaagcccaatcacagtgacggcggcgagaagctgatgacggctgctacaaagcggaagctcgatgaggcgcagaagcggcgcaagacggccgacatggccgcagcagcaaagccagagggctctaattcgctcccgttgttgaagatggtggcgccggccgtcgttgccagccacggccgccgcgagagcatcgagctccacaacgacgaagagaagatcgccgctgcgaagcggaagctgcgtgagggctaccaagacgcagaggaggcgaagaagcggcgcaagatccatgtgatcgaggacccaaagatgctgaagcacaagcaggagaagatggatatccgatcctgagcgtgcggagccgagcaagccacgcctcctccatggccgagaagaagaagagcttcctcgtgtcgtcccttgggaggctttaggcttactagagatttacctctgaactgtaaatgaactgtgcgtccaaagatcacagtaacatcttgtattggcatgagaaactctctgaccctgtacacaacataccgtttctatgtacgtacgtatgactcgatcaatcaaatcaatcctgttagttaatgtaactggatagtatgtaagagtattaatgtattatcagtgaaatcaatggatcaatcttatgatcctcttaactttcctctgttttttttaacacatctgtagtacaaagtatataaaaaggtcagatgtgtcagttacaattctgttgagtgggtgaaatttccatacaataaattccctctgtagtgtcacaatcctgctgagtgagtgagctcattatttggttgcgtctccacgcctccagggctcaccgcccaaacttgtcgggactagctatccatcacgtgacagattttagatagttggattagactcatttgatcacttgattagaagagtctatacatgtatcaatatatattaattatatatatttcatatattttatttattagatctttgcttcgcaaaaaaaatatcaccaactcatctactaaaagttacaggtgtaactatactgtaactatagtgtaattacagtgtaactatagtgtaattacaatatacttacatgacttacaaatgtaattttagttatataggactgtaattttatattttagtttcaaactagaaaagatgcccgtgtgttgcaacgggtaaatactattttaatcttattattgttatacagtttggctatggtaaaattcactgtgggaatttgcttggatattttttctagaaaatattgagctgcaattaggagtccaaaattcataaattagcatgcaagtgtttttaaagagattttttatacgactccttttatattttcaaaatcaaacgaacttaaaatccgactcaaacatggatctgtatttccaaaagcgaatgaacttaaaaaccgacttaaacgcggatgacgtaccaaaataccggcaaaaatatttttaatttttataatagtagagaagagatagagatatatagtagagattaaaaatttaaaaaaatcaaaaaaaataaaaaaaatcttcgcaacatggtcttcggctacgacaatactggaccttgtctttgtctcccgcgttcatgggcctgcatgcttaatcaatcccgttggcaaaaagaaattgtgggtgaatcgcacacgagattgtttgcgcgggcttgctctctgtttcgctgttaaaaaaaaaacaaatcctatcattgcggcatggatcaacgatctgatgcgttagggggtaaattgatacggagtcgcgatgcaaaccaaaagggatgacgtgttggcaaaaacatctttaatttttataatagtaaagataaaaatataggtacggtataattatatgtaattacattgtaacttacacgtaattatatgctccttgtgctcagtggaggtcacgggatttcactcatttgtatctaagtagagttaacatttaggcatcgttcgtttaggggtgataggggagattggctctcgttttccgcgcgcacgcttttcaaactactaaacggtgcattttttgtaaaaaaatttctataggaaagttgctttaaaaaatcatattaatccatttttgaaatttaaaatagttaatactcaattaatcatgagctaatggctcatctcgttttgcgtatcttcccaatcttctcaatccccttctcctcaaacattccttaatcgcttttgttgtatagtaaaaacagaaaaagatgcgtgcaagacatcacttggcaacatacatgcactgcttccccgtacgtatgtatgtatcacgtacatgcatgtcacgaaccgctgccaccaacgaggatatcacgtacgaacggcgcgctgcaccgttagaaaaatcgacaaatattaagaaaaaaatttgacgacaaatttctagcaaaaccaaacttgtctcccccaaacgccaggccgagccacagcccacgtacggtgcgttcttgctgccgagaagaattagttcatttagttcccttaatttgtcgtgtagtgtaattctcatccctgaactgcaaaaattggatacaacctgtttccagcttaaaaaacagtgcaaacaagatccctcagtagtattatccctagttttggatgacgtggctcctttgactagatcttatcttacgtggcattaacgtggcggtaacatagcactttgatccaaaaaataaaacaggcaacatttaaaactaaaaaattaaaacaaaatattgggggcccataagtcagtcaaataagaagataaaaatattgggacccacctcctccacctcagcctgtctacctctgtctcctctctccgccgcgagagcatgcaaagagagacaaggcggggagggcggcgacgggtactgtggggtggtgccgctgctaacatccgaccacatggcggctccatctgaaggtagtgaccaagctggagttggggtagaggtctttgggtgccatgcctatctcttccacttagcaatccaccgccatggccaccgctgcgggctcctcttcctctattcctgcaagccagtctcaaaacccgttgccccgtgacttcctcgttcatgtcaaggcctacctctctccagccgcgacggcgtcgacaagctcctcaagatctcccgctacaccgcccactttgcccttgccgggtgctcgctgccccccgcctcctctggccgtccgcctcagcaacatgcgatgacgacttctttgtctgccatagagaacgaagaaaaaccccaatatgttagtcgccggtaactctaagtcggcaatggtagttttcgtcgggagtcaaaaaagggaacaaggtggatacaagaattcatttttgcaattcaattctcaaaatgcaaggataaagagaattctctactttcttctaccttggtctccggcagagcttcgtacctgataatgtattatacaatgcccttattcagagtagtccaacggagttgtataatcaaagataaaagtggagacacaaagtttaagggtgagactctctttcttattctaatcatcccatcaagcttgatgtacaaatgagtagccctaaatatagtgcaatcctaaatatgcaaagtttggtgatgactcaataagtatatttgggctaggcatttgtgggccaagcccaaagtttcttttaacaattaccacttcaaaatcaaactgctcccacagcgcagcacgtcagcactcaggacctagggatgaaaacagttggaaaaaccctctaccatttccattttcattttattttctcgaaaatggaattggaatagtatactcggaaacggtaacaatatcagtaatgttggtatatcgaaaacggaatcgtcggaacgggaatctaccgatgtcggtcggaagtcgaaaattcatgtcggaagtagcgaactgtggtatcaatccacatttaactatgtatgaagatgaccttataatttcacccttgcatcatcacgctgccacacaacaccattatatgatgattaataagttgacaataagattgacaaacaatataaataaagttcaactatacttcaacatcaatgtggataaagcatacaatgtggcttacatgataggattacatcataactaatattgtccgacttttttttaggatataaatttgaagtcttcgagaacaccaagctcacaagttggcatggcttcagctgatcagctccttgtcaaacatcattcatcatttcatcatcaattgacatagctacatcgtcgtcctacagactacagtggcacattgcataagaacttttatgttgacactgtatagctaccattgtaattaagttttatgctaaactagacattttggtagtttccaggtcaaggggggtcactgagtggagtcaagttggtggggcccgccagtgggtcccactgtctttctttttttcttttcttttctctctcttatccttcccttctatcggttccttctcttgctctcttgatttcttctttgttctctctcattctcttctctgccttcggctccttcacgcgcgcccgagaggagagaggtgccggagatggcggcctggcgcagggcagtggtgggggaaggagagaggagaaaggggcggcgccaatggggaagaggaggccccggtgcggcggcgctcggcatggcgtcattcggtgcttggcgtggtggcgcttggctcggcggcacggaggccggcggtggaggatgggagagggaaagagggccggctgcgatggaggttgtcggggcgaaggaggctacggccggcgtcggcgacatctactgccggcgtcggcgacatctactgctttagtctcttaatgcctaatgggctgcttctgctccggctagccaggcccagccggctttcttcttcggaattttgtcggaaatttgacggaaattaccaataaaaaacggttaccgaccaaacggtcggaaaaaaacccatatcatttccgctaccattttcgaaagagattaccatttctattttcgatactgataattaccgataccgactgaaacggtcggtgcaaaccggaaacggaagccggaattctcggagatttccgtaccgttttcacccctgtcaggacccacacagaatcgtgcgatcttcgcgtcgccatggaagccaacctgctgtcgccgcggcgcatcatcttcttcgggagcatgttggcggcggcggcccgccgccgcgacccggcctcagcggcctactccatggcgtccatgctcgtgctggtgctcttcttccgctgcatgggcgccgtcgcgcgcgctccggcggggccacggaggcagtggctcagggccgccgtcgtcgcgctctgcgtcgccctcaccggcctcgtccagctccagatctacagccccgccgtgcccctctctgtggcgctcgccatctgggccgtgtccgtcacctgcttctccgccgtcttcctggttgcctccgcacgcccgcaagtcgctcgatgaaatggcgacctcggctttgacgtttctactactggtacggtaccaccagacttgttatcactaccctccctactgctgatgagtcacttgcaggattcagacaatgtttgcatctgtaaatatcgttacaggtgttcttagacttctttataggattgaccgtgaattcgtccaaatctgacaaatgctagtttttgctgtaagtatgcatgatttccgtaaaactgggcatgtgcggtcgaaatttacttacagtaggtgccttgctgctggaattaaaatttcatgtgggcgaagaatatgtccacactgatggttggagacttggagtgtatgataatatctctcattccatgaaacattgaacaatcatgttgcttctcaagtccctacagggctacacctgttgaatacacaattgaacatatctcttctcaaagcatgaccaattctagatttttttttttcctgcacatagcatttccttatcattgttgcatgcttcgatttaccctgtccaactggctactgtatctgggcatgaatcggtaattctgttttatccagcttcgatccatgaagcatatttggttgatactatctgaatagcattgttacttgtctatttattacgttctcttagtatgatttgggaaagtactattaccttttttttcttttgctgaaactggggtacgcaatttgtcacaatctctgattaaacccagacagagttcattttagaaagaacacatggccacatggtactgtagttcaccaaagtacatgttcaggtgatcgttttggtgtaacaatatcaaaattagctcacctaacgccttctcagtcttatattggcaacatggcactgtcaatgacctcaattttctttataccatatcatcactgactccgtactatacagtacggacaaccttaataaatcatggaagaatagtcaaagacaaattaaacatgcgtatcataaattgtcaaagactgattatttttttttaaaaaaatgtctattgtgagattttggagccgcctatgccttgttcagagagtgtaagattttgagaaacggttgattgatagtcaatctctgagaatctaaaaatggctggattcccaattaattttttgaattttatagctgcatattctcaaaatctggagggagaatctgcattattttgaaaaattgaagattctgcgaaacgttataatggctagaatctgtactgtactgtttctggaacatcgtgggggtatttttcattcaaatcttgtgtgtaacaagtaacaacaagatacagaggaccatagatcacaatgtagttgccatctgaaacataactttaacaaattgagacatagatatagagaaaataaaatggtatatacgtacccgaatttttggtgatggaagtatatatcacgacctatatatatactgctactatggactatatatatagatagactctgctaatggcaggggcaaatgacatcggtgacaatgtggagggagtacatgacgacgacgaagtggacggccagcgcgacgaagccggcgatgagcgccgccatgacgtggttgcagtaggcgtgtatctgcccgcacaccggcagccacccggcgtgcgagttgccgttcttcgcgatgtccgatatggcgccggcggaggccacggcaccggcgagcaccatccccaacacctgcgtacatggacggacggagaaatattgatcgaaaactggttctacaatctttttttttaccagatgataccatgcatgcga

SEQ ID NO: 69713 - DNA, 2064 bp, Oryza sativa
ttcccctgcttttttttgttctggctgctaaatgaccggatggatcaaaacgcaccgatccatcatctcgtgatttttcttaacctttccgtgacctgcaccgttgtggcagcaggacctccactgtgcgtccgccgtggcagcagccaattcctctggacgctcttcttctggcccgccgtcccgaccagctcaggcatgtatacaacagcccagacctgctcacggagcccgccgtcgggaaaggccacgtctcggcgtaagacacaggggtgtaggtcgtgcgatggtggcatggcggccggggaccggttcccgaccctatgcggcgtcttcccggatgtcttcaggcttcagcaacaggttatgtgacacgtcactgccgcgcccttacaccgacagtttcctcaccgtcggcgcctacgagcttgtaacggggcgtgtccaatcgtcgtcggcgcggtgggctccttcctgaggctctgctccatcgtgtactgcctcctcattggcttctgcagctacgagatgtgtacagctccggctagctcaacatcgccaggcgccagcaacaacggcggcggtggcatctctacaggaactttcttttgcatgacgtctgaaggtgagcactccaatgaccaatcacatgaagtctgatgcactaaattaaaattacgacatatacatttcattaacagtctgtaacagattcccaggggcactgatctatgaacaaatttacattttcagtttcaggtgaagcacaaagaaagctgctcttcatttggtttaaagatatacatttctcttgtagtgatccaacacaaattcagcagttccctaccttggttaacctgaatgcttcactcttgagagatgtatatgttgctaaaatatgcctgataaaaagaagtcagtaaacttacccccattctcatgcatataccatcattaaaaaatattaccgtagcgttagcacgggcacattactagtgtcttataacgttgttgcgctaggaatctgtaaatgttatccactgtttcccttgcactgttccatgcagtcatctcattaattatataggggtccatatgaacccaaccatgaaatagccatgctttgggcaattttgaatcttcattgaacaacgcaaaaaaagaagacgtgagttatctgcactcggcgaatattcaatgttacatacgacgggctaaggaatgaaataaaattaggcctaaaagattccgggtagaagctaaaagcgactaggttcattatatctaagtcacgatcaacttctaacggatcttggaaaactttaaacaatggccatttacattaaagatgttaccttcgtcgtctcgcagcgtgacggctccatgtgatgaaacatcgacgacggtatatggatccattcatttactttgaagtttcctatgtccgaaaagcttcacccgtgagttgaacaacagcacctcgtcccctgccttgaactccttgtgcttgatccgcttatcatgccatcttttggttatatctttatagatcttggcattattgtggtaggccttgtccctccattccttcagctcagagagctgcatcttcctgtgctatcggctccctttaagtccatgttccaagtccggatagcccagtgcgccctgtgttccaactctaccggaaggtgagaagtcttcccgtagacaagttggttgctaacatgccagggtgtcttataagcagccctatatgcccaaagtgcatcaggtagcttgttcttccatgccttcccatctcattaacagtcttctgcagaatattcttgatctgtttgttcactactacaaaaaccttcataggtaccggccttataggtgccggttcatttaaaaccgacacctataggccctttcccacgtccgcaagatgaaaaaaataaagaaccgacacctttacgaagtataggtgccggttcattagttaaaatcggtaccaatactataggtattggttttttaaatagaaccggcacctataatatagaaccggcccatgtc

SEQ ID NO: 69714 - DNA, 4974 bp, Oryza sativa
attggtgccggctggcaaaccggcaccaattgccggttgggaaccgacaccaataggggttttttacttgtggttgcttgtttatgcctattcacttgtctggggatgatacggagtgggaatgttgtgctgagccctaagttcttgcaaaaagtttcggaaggtcttatcgatgaaatgagaccctccgtcacttatcaccatccgcggagttccaaaacaagggaagataatctcatggaacatccggcaggcgtgcttggcctctgtggccctgcatggcattccttctacccacttcgacacatagtcaacggccatcaggatatactcgcagtcataggactttgggaaaggtccaatgaagtcgatgccccatacatcaaatagcttgacttgcaggttgtatgtcagtggcatcgtatcccaagcagtgatccctccatgcttctggtaccttgtgcatcttcgaacgaattcctttgtgtcatcacacattgttggccaaaagaatccattctgccagatctttgcgtgtgtcctgaatgctccatagtgacctccatatggggtagcatgacacacttctcaatgatcttcatgccttcatctactggaacgcatctccgtagtagaccgtctgaacagactttgtaaaggtaaggtgcatcccacaagtgcctgcggctcttgtagatcaacctcttcttattctctcccggtggcacatgccccgcgaccatggagttgatgatgattgcataccacgggtcagaatctgtgactttcaacagcatgtcatctcacagatagtcatttatcggtagctcctgcatgttagtgatttgcatacgcgacaaatgatctgcaacaaaattctctaccccttttcatccttaatttgtatgtcaaattcttggagtagaagaatccacctaattagccgaggttttgcatctttttagtgagtaggtattttagtgcaacatggttagtacaaactattaccttagctcccactaaatatgacctaaatttatcaatggcaaacactatggctaggagctctttttccgttgtggcataattaagctgagctctagtaaaaattttactagcatatgtgatagcaaggtgctttttatccttagtttgcccaagaacagcgctgacagcaaaatcactagcatcacacatgatttcaatcggcagcaaccaatcagggggttggatgattggtgctgagatgagtgattttaaaggattttagacactcatcatcaaagtcaaacggggcatccttagctagcaaggtagttaggggtctagtgattttagagaaatcttttatgaaacgcctatagaaccccgcaagactcaagaagctatggactcccttgacattggcaggaggtggtaactatcgaattactacgatttttgctctgtccacctgaactccccttacggagatttgatatcctagtactattccttcacgaaccatgaagtgtcactttttccaattaagtaccaagtcgttttcctgacatctttgcaagaccctatctaagttctccagacaatgatcgaaagttttatcatagtaaaatcgtcgatcatgtcaaagaaaatagacaacatgcatctttgaaatgacgctggtgcactacacaacccaaacgacattcttcggtatgcatacattctgtatgggcacgtgaacgtgatcttactttgatcatcgggatggatggggatttggtgataaccagaatacccatcaaggaaacaaaagaaggaatggttcgctagccgctcaagcattacatcaattaaaggcagcgggaagtgatctttcttagtagccttgttgagtttcctatagtcaatacacatcctccatcacgtgacggtttgttgtgggcaactcgttgttcgagttttcaagaccatcatgcctcccttcttaggcactacttggacagggctaactgttggtatttcttacgatcacaaatagaatccgcaagcgcacggatatactgatgtagtacttcccctacggagtattccaagggtaccgaatcgaagggaacatgtgtgattaatttttcctctggttcatccaaggacaccaagcaaatgataggctaagatagagaggatttactggtgagaaatagtgtctagggaaatcttaactttaatcctagcacgatacttcaggcattggcaacccgctattcctagatgtcgctctactacgtacccggacagggacgacataagtgctcttgagggctgtcaccacctctacacctacctcaaatgtactgtgggatacacagcaattactggataaaattacctaaacaccacgtctaagcaattaatatatactttagtgtttataactcaccaaagcaatcactatattttagttgattatagtgaacaataatcccgtgtgataattaggaactaaccaagagataattctcacaaaataagtctaaattactcaggaagataattctattgatattagagtaatgaacagaagaaaagaaacaagagaagattatcgacagctccggaattcttccgacttcttctactctactctcttcgtaattctagtatacaaatagtacaatagagccttttataattcagctcaagcttgtaagcgtgtgaagaagtgaaggagtgaagctcttaaataggcaggtatgacggttgtaactactgcgaaatatctgaagtaccccacaactgctatcaggagaagatctggagtgttccagcacaacaagggattggcttttcaatgatgacaaaaatcatcactataactatatttttatcaaagttgctaccttgtgacgaacttatgattcgttgctatgtcatcactgaaattggcgtcacaaataacatagtgatgattttttttcaccacaaatactaattgtatttgtgaccaaaagtcttgtaactaatgatcataacaatagtgatagttaaatacgagatgtactagtgaccgcaacgacatcacaggtgtactcactccttccaaaactctaaaacctatttcattctttggtttttccaaaagtctaagtcctatttgtagtcattatgtgctaaattaaattgttgataggaacccaagaagccattttaatgcttattggtttggtcacatggtgaaagaattaattgctttttggtcttggtgcaaaaagaaataggactcacatttttggaaggagggagtacaagattgtgatggattatttcctcacgttttgttagtaattagtgagaatcatggtcacagttgtatgattcaataatgataaattttcatcacatattattgatatactgaaaacaatttctcacaagttaatttgttatagtgacgagattatataacgctatgaggaaattttaacttcaacaatacatctattgtgaggaaactgcattttattgtggcaatcttttcaccagataatattagcatattgcattagttttttggcaaaatttgctacaggacacttgaaaaacgtgtaattagctgagagacaccgcaaaaacgagacacggctgatgaacactacaaaaattgtgtaattggctataggacaccgaagacaatattttataatatccgggtcaaaagtggtaagaaatttttcgaaatggcaagattgcccctggctccaatcccatcttcctccacctgaaatcacaccaaaagaaaaatagcagggagaagccgccggcgaggttgtccacggcagggagcggataggagcgaccgcacgccaggagcggccgacggcgcggctgtgcgtggagcgcgagctggaggcggctgtgcgcgaggccggcgacggcagcgcggagcgtgagcaggaggtggccgtgagcgaggaggctgttgaacgttggccgatacgaggcttgctgcggccgccggtctcgccgttacacctacacatccattatcttgggtctcgcaatgccggccaaggcgaggacgccctgtctctattcgccggcaggcaatgagccggcgtgacgccgaacaaggtgaccctcctcggtgtgctgtcgcgccggactcgtcgaggaggggctccagcaactcaacgccaagccagaaccacgcatcgagcattacggctgcgtcgtcgacatgctcagccgcgccgggagactagacgaggcagaggagctcgtcgcggcaatgccaatacaccctgacgcgctcatctggggctcgctgctcgccgcatgccgcgcgcatggcaaagttgagcgcgccgagcgggtgatgcggcggcgcaccaccgacgccgatgcggacgccggcgactacgtgctgatgtcgaacacttacgcgtcgaatggccggcacggcgaggcggtgaaggtgaggaggcagatgaggaggaacgagatcgacaaggtccccggctgcagcctcatcgagatcgacggcgtcgtcaacgaattcgaagcaatcccagcaaattccatccgataaaaacacaacaagattcatcaaagaacaggttatccgagtggtcgtggttttcggtgccggagatggcgccctcgtcggcggggacgaagacgccggtctcatggtcgggcacccacgcgtcctccgggcccgccctccaccgtctcctcctccgggagcgcctccacgttcttgcggttcagtgccgcctccaccaaggttctgggattcaattgcagaaaaatttcgggccttaccgaaatgggcgaaattcggaaatttcggaattttcggacaaaatttggccgaatttgttgcaaaatttgaaccatcattagaaaatttgaggcaatttgttaacaaccaatagataaaacagaaaaaaatgaataggcaatcatacgaggatcaacacacaaggagaa

SEQ ID NO: 69715 - DNA, 2072 bp, Oryza sativa
  unsure (1)..(2072): unsure at all n locations
tatctttaagtcaaatccttaagtgcataatttctgcaacttttctggtgaaaaggagaacaacttgtgaacacgaacatggggtgtttctggctactacatcaataaattattgttcttccctatttcaagcatgcagcttttacttttctagtcatatgtttaacatcaaattccttggtggttaggcactgctgcattctgttccagttggccgaatgattgttcttgatctatatgcagaagtgaaaccaatatggatcaactctgatcagttttatggtgtcccttacatctggaaagttctccttctctctactgtttttttttctttcctttttttgtattagaggaattcatatgctacttttttttaatccaggtgcatgcttcataattttgctgcggactttgaaatgtacggtgttttggatatggttgcttctgggccgattgatgctcgactaagtgcgaactctacaatggtacaccattaacttaatcagctgtttcttctagtaagttagcatatagaattatgacatatgctagtctttttactaagttgtttttttttataaaaaaaattgaactacttgtgtttgaaggttggagttggcatgtctatggaaggtattgagcaaaatcctattgtttatgacctgatgtcggaaatggcctttcatcacagacaagtgnatctacaggtgaaattatacnaaccattttctggaagcatttaatctgcactatatgtgttctctctcttttttttaataatttgcatgtgctttatagcatcatctgatgtccttaagaaacagtatagattgctgtttggtatacattttggagttaactggtgtgtcaggttgtctggttatgctttgcagcaaatgagccatgctacttgttatgtggttttcttgtttttattgctttgaacttttctctctgagcttgataatgagtgtggctagttttggcttgatcagattttcattatttccaggtgtgggttgagacatatccaacaagaagatatgggaagtcaatggtggggctgcaagatgcttggaaaattttataccaaactctttataattgcacagatggtaaaaatgtaagctttgatattctccatgtgtcatatttaccgattgtaacgtgtatctattttcatccaacgatagacagacatatataggaatggcagtcatgtgaagtggaaaaactataaattactccctccatttcatattataaggctttctatgtctagattcattaacatctatataaatgtgggcaatgctagaaagtcttataatgtgaaacggaggaagtatcttttagtacaattaataatctaaaatttatctttattttgtagaagttacagcttattctgtgtaatccaatatattttgaatggaagcacatataaatttactcatagtcctatgattttcagaactttgattgttttcgtttctgatattttagcttttttcttttggctacaggacaaaaatagggatgtgatagtggcattcccagatgttgaaccttttgttattcaaacaccaggattgtatacaagtagtagcaaaacgtattcgacaaagttatctaagaattacattgcagtggatgcatccaatgatgaatatgaacatccacatctatggtatgacaccgatgctgttatacgtgccctagagctttttcttcgatatggagatgaagtatctgacagcaataccttcaggtgagagtgcaggttttctagttagtactaatgccagtgctttctgaatgactggattaaaaatattatatgaattttaagagaaagtcatatttttcagataatggaatgacaagccatatactcctccgaccctaaatatttgacgctgttgactttttaaaacatgtttgaccatttgtcttattcaaaaacatttgtaaaatatgtaaaactatatgtatacataaaagtatatttaacaatgaatcaaatgataggaaaagaattaataattacttaaattttttgaataatacga

SEQ ID NO: 69716 - DNA, 592 bp, Oryza sativa
acggatccgattaaaggtggagattaggggacccgtgatgcgcgcgaagaggatgagcttcgacgccaacttctcgctcaaaatccaacggggaatctaggtgcaagatctcaagggcgtcaaggtggcgagccagatcgtggtgcgagaccggcggatcgaggtgaggataaaatgcttcgagtgtgggcgtgaaggtcaccatcaggcaacgtgccctaaccctcacctctactactcctgtcacaatactggccatatctcttctcactgtccattgcttttgggaaagaagggtattaagctgtgtgggtttgggttccctgggcaaggtttttacagcttgcaagttgagatttctgatatagagttggctagagctcctgtgaaaggtatactaactgtgattcttggtgaagcttctgtgggaaaagtggttgcagagctgaagcatctatttgttgggctaaatggggagtggaaggtgaaacaactaaatgctaaagagtttttaatcaatttcccttctgatgaggtgagaagcaagatatcaacatacagagttttgattttgagacctcactgatcaagg

SEQ ID NO: 69717 - DNA, 733 bp, Oryza sativa
tcctgcagcccggtcagtaggagatcccgacgagggcaaccatggtgtaggcgacgagctcctcccgcgacctccgctcgcctggcgacaacgacgacgagcgcccgtagccagacagctgcggcagctgcaccctgcgccgcccgctcaggaacatccgcatctcgccggcgaggaactccgcggccgcggagcgcgacgcagacgcgcggcaggtggcgcgccagcggcagcacgaggttgaacggccacaccaggaacgagtactgcaagaacgcctgcaggaaccctccgcccgccgccgccgccgccggcacggcgagaagcacaacgtgaacagccatctcgatctccaaactccgagcctctccagtttagttagtaatgtacagaggaatgtatttcaacatcatcgaatccgtaaattacttccatttatcatgccttaaaggaaacatgctattacttggaaaataatatgtccttgctccaacaccaacatatcaaataaatcttagtaacaactatatttgagctccaaactttcactaatgtttgtgcgacagcttaacttataagaatacccacattgacaaaagactcgaatttgagcaggccctaaattctacaacaaattggcaacaatcacatttcaagtagctagcattgctatttggtcatatcatagcctttgatgaactaagttcacagaagaaaatacaggtttcctttt

SEQ ID NO: 69718 - DNA, 1191 bp, Oryza sativa
cgaatgaggggttcgggtctctcaagtacttcatgtttgtctgtacagcaccatgcatgacttttgtggaaggagcaatgccgagtgtgcaaagattaaatctaaggttcaatgccaacgagttcaagcagtatgactctaaggagacagggttggaacacttggtcgcccttgcagagatctctgcaagaattgggggcactgatgatgatgaatcaaacaaaactgaagtggagtctgccttgaggactgcaattcgcaagcatccgacgccgagcactcttatggttgatatacaatgggtggattggatctttggtgctgaagggagagacttggatgaagatttggcacaacaagatgatcacgggtatggatttttcattctattcccaggttacaacttacaaggattattgagcttctttctttctctgccgtggcttctatctttaccttctatgcatcttcaacctgacttgatgattgtttgaaaccaattttaatggaagttaaatgttattgttgtgaccctgaatcaggttttgtatgctaccggaatcctcttcacgtcttcagagtagaggtaattttgtttcttgtcattttacagttacagttcatctacttaaggaattaatgggaggtcctatattttctcgggtacctagaaggtgtggttcctagtcttacctccttaagaaccgtagaatgttggccctaacacttggatcaaagaacgaaaggtgtatgcactatagtatcctttatatattgcacaagtcaagacatttgttaaaacacacccagtgctagtaatttgtttactgagatatgaattatcgccaaatacccatactgagcctattagtaaaatatttacgaggtgtttgaggacagcataactttcagtaaagaatttactacgtgaggtgtgtgttttaggtattgcgcatcttgggtgcattttagcgcaaacgtgtataatatatatcccatggtactaactcatgtcttaaccataattgcacaccaacacaaaacatacactactacagagataagtatcgaagaagacatgcccaccggtgcggaagggacggtgattgtgccccacacaatggagcagttcgccctccacatgagccaagccaagcaatcccacaagctcgtagtcatccagttcactac

SEQ ID NO: 69719 - DNA, 1814 bp, Oryza sativa
atcaacaccatgagatttaggagaggacacaaagaaagaaacagtttccccattgctactggttaaagtcaccttacggttggcacagtctataactcctctgtgacgagataaccagtccatccctaagataacatctagatctttggattctagcaagataagagaggatgggaaaggaacttcttctatttctatggtagcggaaggacaatactgtgtcgagaaaacttgattgcctgggtattaactagtaaaggtctcccaagactaacaacttccatcccatgtttgcttgcaaaatttttagacaaaaaggaatgtgtagcaccggaatcaaaaagcacagttgcgggtatagagttaacaggaaacgtacccaaaaccacatctggtgcattctgagcttctgctgctgctacatgattaacacgtgccttcggtgctggaacattggagttgttcggggctggaacgttcttcacacgccgaggcttaggacacttatcagcataatgtcctggatcaccacaattaaagcatatcactggcttgcttccctgttccttcctgacaggctggttctgagctgaagttgctacaggacgagcaaccaccttgcggttgtcattgccacgattaccagtattgttgttgtagaactggcgttggggacggacaactgatgaagatcctccttgagggtacgatggaacttgaggtccagtaacgagacgcggcctctggttactgccctgttgtgccctgaattgggctgccctgcgcttcttctgctccatccggttatacttgtcttcctgacgaatcgccttgtccaccaactgctggaaatcccggaaatccgtagacatcaaagcataagacaactcatcattcagtccctctaaaaacttctcctgacgttcctcatcggtgcggacatcctctggagcatagcgagctaaacggttgaaatcatggagatactcagtgaccgaacgagatccctggttgagtgctctaaattctctcttctctagagctacaacacctgacggtatatgcgtcttcttaaaagcagccgtgaactcctgccaagtaataggttctccttcagccctgccttggcgaaaatgatcccaccattcagcagcaggtccatgcaattgatgcgaagcaaaagaaactttctcctgctcagtacactggatcaagtccaacttcttctccactgtatgcagccaatctcctgcttctacgggattggtggtgcttgaaaaggtagggggtctcacacgtaagaaatctgccagcttgttttgaggaggtgggggtggattctgattctgattgtttgcctgctgattctgtgcctgctgcactaacagattgatcagttgtgtttgttgggccagaatctgagctagcgtgggatctcctccattgttagtagctccactaccacttccacttccacttccagtgcgcgtgttcaccatctgacgataagcagagacaacaggaaagaacgacagagagacacccttagaacggagttatttaattaatttaaattctatattgctcttaactgtgtatgattatatttaagttgcattaacactatctcaccaactatcttacactctgacaagcaaaagaactagactcatgctgttacatcccaccattgatgtaagcaacaagtacaacccacacactcacaaacaaacttaaacaagcaatctaacacaacgaactacggcaacgatctaactaagcgactactcccgccttgcgtcggaacgaagcga

SEQ ID NO: 69720 - DNA, 18767 bp, Oryza sativa
catcagagtggcactctcttcaccatcaggacaggtataggttccatagtcttgaccatgaggcttgtgaggatgatactggaaagctgatgaatccaactcttcttcaaaacgttgacgcaactctccaatggccaccaaagctacttcttgacaagcatggcagtacgatcttcctccagcttcaaacttaaaagacggaaggtcttcgctatcactagccaacgtcacacgaacacgacacttctcctcgtcggggtcatgggaaatttggcgatactcaggagcaacttcatagcctacctcaaaagccatcaacctcagctccctgacgaatcctaacaccttgatcaaatttctcggtgaatggggcggcatctaaagagacatggaagagaagaattaattcatatatttctaagttagctgcaccatctagacttaactgattgttgaccaaaaaggaagaaaataaaagaaaagacacatacaaagctattttataaatattttgtagaatttaacttctctttggacagagacaaataattttttttttgacaaataactaaaataaaactaaaatacttatgatctattataagcacggtacaatgtcaccattaaaaatgatgagtagtactagtgcaaacatgattaaatcgataccataataaatgtacagtgccgactaatcaataagatttggtaaagagaaaaggaaacattttgagaagaacaactttttgcttttaaaagaaaagaatttgaattaaataaattttttgtgcataaccttgcatgtgctgccaacttaattaatttataagagaatagagaagagcagttctatttttttttcaaaatattttgaaggctacttaaggtttaccatttggcttatcctaaggtcaaggtggctctgataccaacttgtcacgcccggaatttctatccaaaattccaaacgcttacatgtgtgttaaccctcgtccaggaatcaaccgaggcacacaatgacaatattgataatagagtacaaataattaactattgaatattcgcaaattaaaattattacagaggtagatagttcctctcaaaacaaataacattctacgcagcggaaaacaaaactataacaaactacggaacagctatggcgactccactccacaggcaacttaaccaagaacaagcctaattctccagatcatcaccttcactgaagtactcctcttctgatgaatgaatattgcaagaatgagcatataacatactcaacaagccacacagcaaatatgcaagtgcacaggataacaaaggatggcaaaatatagctcatttgcagaaacaacatttaataaatatttgagagaatagtaaaacagttgtataattaatcaatattaaataaacaccatacaacacacccgtgttgcataggcccaaccacatttgaacaaccaaccccagttgaacaaattaaacctccaaaccaggaattagccattccaaaccaggagtcaaattaattaccacattattaacattgatgaatagtgtgaaactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagtcgtgacaatacccctcgcacaacataacccattacagtgcacctttcctggatcataatcaccccctttaaaacaaggcatggactctgtcacgtcctgataaattcatcccgaaataaaattcattttctaaaaggaataatagaattaattaaaatgcgaaaagaaattggcaaacactaaaatacgtacaagaaaaattcaaatgtggtccggagaatttttgtcaaattctccttggtctaaatggagctctcaaattttacttgaattttcagagcaccgaaaataattattaagccacaaaaacaattatcaaagtttattaaaaagaagacctaaaaataatcctcttcctcctttgggccaagcccagcccaaagtctccctctcctccctctctttctctccctcctcctccctctccctcccgggctgcctctccctcctctcctcctgggccggccgcccgggccaagccgcaccccccccctccaggccgagccgcgcctcccgcccgtgctgcgcacgtgcgcgcgctgacgacgcgcgcctgaccgcgtggggcccacgcgtcaggccgccgtcgccttcttcctccagccgccgcccggcttctctctcacccgtgaaccctactccttccctccctcaaatccgtgtgattcgctcatgggattccaaaattaaataggggaaattaatccccattgaatcctcttcaattccctccaatttcccccttgattcgtgccttcaatcgccgggaacgcccgcgtcttcctcggccgccttccattgccgccggccgtggttcccgccgccgttcccgctcctcccgtggccggctctctcccccatcctataaaatgggatcctcatcccccgttctctcgttttagccccctcccgagcctccccgtggtccctatccacctccccgtcgccctcctctctctcccacgctgccggccgcctccagccgcccctaccgccttgcccgtgcgccggccggccgcgccgtcgcctcctccagcgtcgccgccacctcctccaccccggcctgccctccgtttcccgcggagacccccggagctgcctccccgccgtcgcccttctctttcctccttgccggccacctccagccgcacctcccgcctcgcccgtgcaccctccggctgcgccgccacctctcccggcgtcgcagctgcctcctctttcccggcttcgcctccgtttcgcggggaaatcaccggagacgcgtcctcgccggcatccagtggcgtcgccaccacttctccgtctccggccggctgctgttcgtcgccggtacgccgaccgacgtcgccgtctcctccgttgacgtcgcagcgtcgtcctccaccccggctgctcctcggtttcgccggaacgccgtcgccgcgccggcctctccatcctcttcgtcgccggcgtcctttcggtcgccccttcctcctccccggctcgtcggcttgctgcaccactaccacctccggcatcgcagcggcaaggtcgtcctcggcatcgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgctgcggcgtgttccacgccgtcctcgtctccgtgcagccgctgccggcagccctcgtcgcctcctcgccggctccggtcgtcgtcgtcgtcgtcctctcgtcgttcccggtttcgctcgttgtggcgttcgtccctccgtcaagccgttcttgtccgtcgtccgcgtccgtcaagtgtgtcgctgcagccccgtcctcgtcttcgtcctcggctccgcgtcgtcaagccccgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgttcggtcgtcgaccccggtacccgtgtaccggtgtcggtagtcgttcacgtgtgcggatggtgaccgtgtagtgtccgtgttagtgtgcccgctcggtagccgcgtggtttccacgtgtgcaacccgtgtggtgtctagtggagtccgtttgtcggccactcgcctcggttgacacacgggatccgcttccgtcgacccgtggaccgactctgtgtactcggtctaccgcggtcctttaggttgacatgtggggtccgcatgtcaacggcgcagccttcctgtcttttccaggctagcgcttacacatgttttgtaattgcaatgcttaattataataatccgcaaatctccatataacagcattaaacctcggatgatcataccttggtcatacgaactctgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgaacatattgaatcccagtttatcaaattattttgatttaaattattgcattattgctttatttaaattcccgcgttatcactgttttatttagccatgcctatttacctttgttatgaccttattattattgctattgttattattaccttgttcaccctaggataaacaaaaccccaactagtgggtactctattcgtggttccactagtataaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatgtggaatggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtctttataaaatagctttgggcaactaagtgacttttaaatgctgtttactgcaaaacctaacccctattattatccccttgtacccccttgcattaatcatgcatctgccggtgtggcttgctgagtactgtggttgtactcattcttgctctatctttctccccccttcagtaagagaagctttggagaagatgtcttaggtggagtcctggcttataccccagttgagcgcctgtgaagatggagccgtaggcccgctagtccgctgctgtttatttttgtatgtcaggcctgaagtgtctttgtaataatgtaaatattatcgatataataaagatgtgtcttttatatcatgtttgtgtggtgtaccccggcttttcctgggacggggattaatacactagcgttcgggaaaaggcaattttcccggtcgcgacagactccccagcgacccccgtggacttctcgccacttctcagtcgggcgcactataatgaatcacgctatacaaaagataaagccgttgcccacgctggcttgtggttggcacgataaatgtttcacaacagtagctcgcgaaccggtccttaattgtcatgagcataaccatcaaaaccatatgctcacaacccaccttatccaggttttaattatcaattaattatcatcacacgatttaccatcgtgagctaccattgaatataaccctaattaacaattacataatatagtttataattaaaccctttaattagctatgtttctaggcatggataagcaaacttacataaggcatttagctgaaccaatccaatatataaggttcatgctaatcaaattataacccataggaaaataaagtcatctccggccattaattaactgggaaaggttcaccacccgatgacattcgaaaataatgcatagttgaaataataatagctttaaatgggttcaacatgctcaaagggttgtttgggatctgtgtgacttgccttgggcttccgcaaacgcttcggaaccttcctcaacggaaacgctctcctccggaacgtcggaaactaagcaaataaacaaaatcaacaaaacagtacaaaaacaagcataaacagtacatgtggatatttttaacatgtagatcttgattttagaagaatttagcaacttgaaccacctaaaacggatctacggttatttagttatgattttccgaagttttaatctattagaaaatcggaaaaaagaaaaagaaaagaagacgatgacgtcatgctgacgtcatgctgacgtcggcaagggccggccggctagggtttgcgagctcgccggagctaggatggtcggccgcggatttggagaccatctacgcatagaggacatcgagacgaacccgatggtactcaccacgacgacaaacgatgcacgacggcggccggcgacgagagggcaacggcggcggctcgggttagcggcgtcggaggggctccggtggtcggcggcgacgaaggggatgcggccgagcttcctcacctccgtgcgcacctaacggcgacgacggcaagcggcggagacggcggacgcggcggcgcgacacggccgaaagatggccggcggcggcggcggctaaatgcacgtggcggcggcgctacggtgcacgagaaagctcgggagagagggcaaacgaaagaggacgacgaggggaagctttataaagcattggattgaagagatcgaactccaaacgagaggaatcgattcgggaaagaaacaaactcggttttagggataaaatcaaaacgaactcgattcggatcaaatcctcaacgatcctctttgattcttgggggaaaagaaagaggagaacgagaggaacaaaacccctcaaaaacccggaggaatcggagtcggattgaggcggatttgagaggagaaaggcggcggctcgggctcggttggcggcggcggccggaggtaggggacgaccctgacatgtgggccccacatgtcagcggctggagaggggaggggcgggcggcgtcggctgggccggctgggccggttcgcccgcgcgggagagagagagaagttgggccgaaatcggcccaacggcctaggaggggtttctttgaactttttaaataaaaacaatttgtgaaatgatgtttcaattattaaaaatacttcccttgctcaaataattcccagaaaattctagaaaatagaggagcaagcatagtatttaataaaattttatctagttcatttttatgttgaaaattttcctagaaaattaaggtttagcttgtaggcttttaaaacaatttctaaaaatgatttaaaatatgcatttttaatttagtcgatttttagggcgtgacaaacctaccccccttaaacagaatctcgtcctcgagattcagaagaactggcgaacagatgaggatgagctgacttcaattcatcttctctttcccaagtagcttcttcttctgaatgattgctccactgaaccttgcagaaccgtataacgcgattcctggtattcctctcgcttacttccaagattctgaccggcttctcaatataagttaaatcttcttgaagctctatacgatcaggatctgcttcttccgtaggtactcgtaaacatttcttcaactgagacacatgaaacacatcatgtattcccgccattgacggaggcaactctaactgataagctacttcacctcttcgactcacgatcttaaaaggtcccacaaaccgcggtgccaatttccctttggtctggaaacgatgaactcctcgtaacggcgtaacccgaaggtatacataatctccttcttcgaaagccaaatctctgcgacgattgtcggcataactcttctgacgcgactgagcaacgcgcaacctttcttggataatcttcactttttcttctgcctctcgcaatatgtctgtcccaaaaacttgacgttcaccggtttgatcccaaaggagcggcgtacggcactttcgaccatataatgcttcattcggagacatttgcaaactagcttgataactattgttatatgagaattccgcgtacggcaaattcttatcccaacttccaccaaaatctagaactcaagctctcaacatatcttctaaaatttggtttactctttccgtctgaccatctgtttgagggtgataagcggtactgaaattcaaacgggtatccaattctgattgtaatttctgccaaaacttcgaagtaaactggctacctctatctgacactatcttcttaggaacaccatgcaaacataccactctggccatatataactctgcaagcttattccccgtataggttgttttgaccggtatgaagtgagcgacttttgtcaacctatcaaccactacccaaatagaatcatgtcctgccgacgttctgggtagaccggttataaaatccattcctatttcttcccacttccactctggaatcttcaacggttgtaatagaccggctggcttctgatgttctgccttgacccgctgacatacatcacatagagccacatattctgctatctcacgtcgcatactggcccaccagaattgttgctttaggtcttggtacatcttagtgcttccagggtgaatggaatacaaagtttcatgagcttctttcatgatagtatccttcaactccttattttctgggacgcaaattctttctcctaaccacacagtaccttgctcatcttctacaaaaccgatggctttacctcttctcatgttcttctttatttcttggatatcaggatcattcacttgagcttctctaacttgatcaaacagagtaggtttagcttctaaaacagccacaaaacctttgctgactattcccaagttcaacctttcaaattcttggcataactcccaaggtaaacgtcgaccttctgacatattacagtagcttttcctgctaagggcatcggctacaacatttgcttttcccgggtgatagtggatctccatatcataatctttaatcaactctaaccatcttcgctgacgcatgttcaaatcaggttgagtgaagatgtacttcaaacttttatgatccgtatatatctctgtacgattaccaaaaagataatgacgccaaatcttcaatgcatgcaccacagctgccaattctaggtcatgcgttgggtagttattctcatgaggacgtaattgcctagatgcataagcaaccacctttccttcttgcatcaacacacaacccaaaccgagtcgggatgcatcacaatacacttggaaacctttcctcgaatcaggcaaaattaataccggcgcagtcactagccttttcttcagttcttggaaactttgttcacaatcctctgtccacttgtacttcacttccttctgaagcagacgagtcattggtctggcgatctttgaaaagttctcaataaacctgcggtaataccctgcaagtccaaggaaactacgaatttctgaaaccgtcttgggttgcttccaacttaacactgactccacattgctcggatctactgccactcctccagacgagatgacctgaccaagaaacttcacttcggacaaccaaaattcacatttactgaacttggcataaagctgatgctcacgtagtttctctaaagctagacgaagatgctcttcatgttcttccttcgtcttggagtaaatgagaatgtcatcaataaacaccacgacaaacttatccaaatattccataaacaccttgttcatcagattcatgaaaaaggctagggcattagtgagtccaaatgacataacggtacattcgaacaaaccataccgagttgtgaaggcggtctttggtatatcttcctcacggattcgaagttgatgatatccagaacggagatctatctcggagaaaactgtagcaccttccagttgatcaaacaggtcatcaattctgggtagaggatacttattcttgatagtgacctcattcaacgctcgataatccacgcacattctctgagtatgatctttcttctccacaaagatgactggtgctccccatggcgaagtactgggtctgatgtatcctttctgaagcaaatcatccacctgtttcttcacctcagctaactcattagctgccattctgtatgatctcttatggaaagggttggttccagggaccaagtctatccgaaactctatctctctcttaggtggcatacctggcaaatcctcgggaaacacgtctgggtagtcttgtactataggtatctcttgtagagcaacttggtttaagatcacaccatgatatttaggagaggacacaaagaaagaaacagtttccccattgctactggttaaagtcaccttacggttggcacaatctataactcctctgtgacgagataaccagtccatccctaagataacatctagatctttgcattctaataagataagcgaggatgggaaaggaacttcttctatttctatagtaacagaaggacaatactgtgtcgaaaatacttgattgcctggggtattaactagtaaaggtctcccaagactaacaacttccatcccatgattgcttgcaaaacttttagacaaaaaggaatgtgtagcaccggaatcaaaaagcacagttgcgggtatagagttaacaggaaacgtacccaaaaccacatctggtgcattctgagcttctgctgctgcaacatgattgacacgggccttcggtgctggaacattggagttgttcggggttggagcgttcttcacacgccgaggcttaggacacttatcagcataatgtcctggatcaccacagttgaagcacacccctggcttgcttccctgttccttcctgacaggctggttctgaactgaagttgctgcaggacgagcaaccatgttgcggttgtcattgccacgattaccagtattgttgttgtagaactggcgttggggacggacaactgatgaagatcctccttgagggtacgatggagcttgaggtccagtaacgagacgcggcctctggttactgccctgttgtgccttgaattgggcagccctgcgcttcttctgttccatacggttatacttgtcttcctgacgaatcgctttgtccaccaactgctggaaatcccggaaatccgtagacatcaaagcataagacaactcatcattcagtccctctaaaaacttctcctgacgttcctcatcggtgcggacatcttccggagcatagcgagctaaacggttgaaatcatggaggtactcagtgaccgaacgagatccctggttgagtgctctaaattctctcttctttagagctacaacacccgttggtatatgcgtcttcttgaaagcagctgtgaactcctgccaagtaataggttctcctcccgccctgccttggcgaaaatgatcccaccattcagcagcgggtccatgcaactgatgcgaagcaaatgaaactttctcctgctcagtacactggatcaaatccaacttcttctccaccgcatgcagccaatctcctgcttctactggattggttgtgcttgaaaaggtagggggtctcacacgtaagaaatctgccaacttgttttggggaggaggggtggattctgattctgattgtttgcctgctgattctgtgcctgctgcactaacagattgatcaattgtgtttgttgggccaaaatctgagctagcgttgggttctcttcattgttataggctccacttccacttccacttccagtgccggtgcgcgtgttcaccatctgacgataagcagagacaagaggaaaagacgacagaaagacacccttagaacggagttatttaatgaatttaaattctatattgctcttaactgtgtatgattacatttaagttgcattaacactatctcaccaactatcttacactctgacaagcaaaagaactagactcatgctgttacatcccacccatgatgtaagcaacaactaaaacccacacactcacaagcaaacttaaacaagcaatctaacacagcgaactacggcaacgtcttaactaagcgactaatcccgccttgcgtcggaacgaagcgatggatcttcttcctctggagtagctggctctctttcttcagggtcttcctcctcttcctcatcacttatgatgtcgatgacaggttcagcacgatcgggcacagcttcacccatcacacgaatcttcgaagctaactggagacgaggtggcggacaggttctctttcttgcgacgaggcgtagcttgggtgttggtggcggcgtttctcctttaagttcagacaattccttctgtagacggtacaccttgctctccaacttgcaaatcttgcctcgattccagttttccctgtcatgagctgctttgtctcgctccacacttactgcatccatagcactaagcatatgcaccacatgcataagagtggcactctcttcaccatcaggacaggtataggttccatagtcttgaccatgaggcttgtgaggatgatactggaaagctgatgaatccaactcttcttcaaagcgttgacgcaactctccaatggccaccaaagctacttcttgacaagcatggcagtacgatcttcctccagcttcaaacttaaaagacggaaggtcttcacgatcactagccaacatcacacgaacacgacatttctcctcgtcggggtcatgggaaatctggcgatactcaggagcaacttcatagcctacctcaaaagccatcaacctcagctccctgatgaatcctaacacctcgatcaaatttctcggtgaatggggaggcatctaaagaaacatagaagagaagaattaatgcatatttttctaagttagctgcaccaactagacttaactgatttttgaccaaaaaggaataaaagaaaagacacatacaaagctattttataaatattttgtaggatttaacctttttttttgacagggacaaatattttttttttgacaaataactaaaacaaaactaaaatacttaagatctattttaagcacggtacagtgtcaccattaaaagagatgagtagtactagtgccaacatgattttatcgataccataatagatgtacagtgccgactaatcaataagatttgataaagagaaaaagaaatattttgagaaggacaactttttgcttttaaaagaaaagaaattgaattaaataaattttgtgcataaccttgcatgtgctgcgaacttaattaatttataagagaatagagaagagcagttctatttttttcaaaatattttgaaggctacttaaggtttaccatttggcttatcctaaggtcaaggtggctctgataccaacttgtcacgcccggaatttctatccaaaattccaaacgcttacatgtgtgttaaccctcgtccaggaatcaaccgaggcacacaatgacaatttgataatagagtacaaataattaactatcaaatattcgcaaattaaaattattacagaggtagatagttcctctcaaaacaaataacattctacgcagcggaaaacaaaactaaaacaaactacggaacagctatggcgactccactccacaggcaacttaaccaagaacaagcctaatcctccagatcatcaccttcactgaagtactcctcttctgatgaatgaatattgcaagaatgagcatataacatactcaacaagccacacagcaaatatgcaagtgcacaggataacaaaggatggcataatacagttcatttgcagcaaacagcatttaataaatatttaagagaatagtaaaacagttgtataattaatcaatattaaataaacaccatacaacacacccgtgttgcataggcccaaccacatttgtacaaccaaccccagttgaataaattaaacctccaaaccaggaattatccattccaaaccaggaattaaattaattaccacattattagcattaaagagtagtgtgagactaatcacgaaaaacattgctcaactcacccataaccgcgggtacggctattcaaatagtttaaactctgatcagaggtgtaccaccgtacccacaagacacaaccccacatcatgtcaccatgtgcctcagtaccaccacgatacctcggaaaggagtcgtgacaatacccctcgcataacacaattcaccacagtgcaccgtacctggatcataatcacccccttataaacaaggcatggactccccagcgacccccatggacttctcgccacttctcagtctggcgcaccataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaatcaggttttaattatcaattaattaacatcacacgatttaccatcgtgagctaccattgaacataaccctaattaataatgtagtataatttatatttaacccctttagttagctaatgtttctaagcatggctaagcaaacttacctatagaaccaatccaatatataaggttcatgctaatcaaattataacccataggaaaataaagtcatcttcggccattaattaactgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtaaaaaacaaacataaacagtacatgtggatatttttatcatgtagatcttgattttagaaaaatttagaaacttgaaccacctaaaacggatctacggttatttagttatgattttctgaagttttaatctattagaaaatcgggaaaaagaaaaagaaaaggagacgatgacgtcagccctaatgatgacgtcagccctggtgatgacgtcatgctgacgtcggcaatggcggccggctcgggttggagagctcgccggagctagggaggtcggccgcggaaacggagggcatctacgcgtagagggcatcgagacgaacccgatggtactcaccactacgacaaacgatgcacgacggcggccggcgacgagaaaaagcggcgcggcggctcgggtcgacggcggcgaaggggctccggtggtcggcggtgaaagaggaggggcggccgagcttcctctcaccacggcgcacctcttggcggcgacggcaagcggcggcaacggcggagacggcggcgcgacgtgaccgaagacggccgccggcgctacgaggcacgagagaggacgggagagggggcaaacggaagaggagaacaaggggaagctttatatggcattggatcgaagagatcgaactccaaacgagaggaatcgattcgggaagaaatcaaactcggttttagggataaaatcaaaacgaattcaattcggagagaatactcaacgattcgttttgattcttgggggaaaagaaagaggagaacgagaggaacaaaacccctaaatcaatcggactcgaggagaccggattggagcggatttggagggggaaaacggcggctcgggcggcttgcgcgacggcggccggaggttgaagacggccctgacatgtgggccccacatgtcagcggctggaggaggagggggcgggcggctcggcttgggccggcatgggccggttcggccgcgcggagagagagagagtattgggccgaattcggcccaatgaccaaagaaggggttttttgaacttttttaaataaaacaatttgtgaaatgttgtttcaattattaaaaatacttcccttgctcaaataattcccagaaaattctagaaaatagaggagcaagcatagtatttaataaaattttatctagctcatttttatgttgaaaattttcctagaaaattagggtttagcttgtaggcttttaaaatagtttctaaaaatgatttaaaatatgcatttttaatttagtcgatttttagggcgtgacacctgacaacaaagatttaaaggatgcaattctgaaagaagctcatgatactttatactccattcaccctggtagtaccaagatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaagtgggaagaaatcggtatggattttatcactggtctacccagaacgtcatcaggtcatgactctatttgggtgatagtcgacagacttaccaaagtggctcatttcatcccagtaaagacaacctattccggtagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtgctttagatttcggtggaagttgggataagaatctaccttatgcagaattttcatacaacaacagttatcaagctagtctacagatggctccttacgaagcactgtatggtcggaagtgtcgcactccgcttctgtgggatcaaacgggagaacgtcaggttttcgggacggatatcctaagggaagcagaagaaaaggtaaagatcatccaagaaagattacgtgtggctcagtctcgacataagagttatgccgacaatcgccgtagagatttgagttttgaagaaggagattatgtgtatcttcgtgtcacgcctcttcgaggggttcatcgtttccacaccaaaggaaaattggcaccgcgttttgtgggaccttataagattgtcagtagaagaggagaggttgcttatcagttggagttacctcaatctttggcaggagtccataatgtgttccatgtgtcgcagttgaagaagtgtttaagggtacctaccgaagaagctaatcttgaacagatagaagtccaagaggatttgacctatgttgagaaaccaatccgtatcttggaaacaaatgagagaagaaccaggaatcgagttatccgtttttgcaaagttcaatggagtaatcactcggaagaagaatcaacttgggaacgagaagatgaattgaagtcagctcatccgcatctgttcgccagttcttccgaatctcgaggacgagattctgtttaagggggtaggtttgtcacaccctaaaaattcaaaatatataaattgttgtttaaatggaatttctagaatttattttaaaagccttgaagagaaaatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcctcttttggctttgggccgaaagtcggcccaaaacctctctctctctcctcggcccagtccggcccagtccgcagccgccgcgcgcgcgcgccctcgctgtcgctgacaggtaggtcccacctgtcaagcccgtcgtcttcctcgggccgaaaccctagtttcgcgccgccgccgccgctttccaatccggccgtccctttccttctccggccgaattgatagaggggaaatgatctccgggatctcctctaccttttctcctttggaatctttggctaaatcgttttggaaagcgtgtggattcgagtttgtctcggattcgttc

SEQ ID NO: 69721 - DNA, 6162 bp, Oryza sativa
gggaggaggaggaggaggaggacgacgacgacgacgacgaataacattggtttttctgtgtaatatgcatgtaagtttggttgttatattctgcatcgatcatacatgttggggggattcgaacactcaaattggattccttttgttatgcaggggcgttatctccaatcctgtggtcacgtgtatgaggttctaaactgctaatctagctgcaattttgttgcacaatctcagttaccatgtgttttgtgctgctgcagcttgtgggcatatattctgccgtttatgcctggcgcattacatgtctcgaggacctgcaatcttattggttgcgtgatttcaatcctgcaccctggtaagggaaatgcagatgaaggtgagtattcaacctttaaagtcgtctacatttatgaattattaggacattctacgccttagcaactagctgacatgatgcattacaatttcatctagctggacagcaactagcttacatgatgcattgtataagttcatccagctgaacaagaaccaggggtaaagagtaattataccatcatgtgcatactgtacaattactctttccccctaccttgtgccttagcacgttcttctctcgcaatatttgcattgacccgttgagcaccaggggcgctcgtctcccgcacgtaccctactatttccccatttttgtactatatgctattgcttccaacttgtgtcctctattgctttaattcccatgtgatctgctgaacacgaactattttgggttaagaactttgccggctgccaagtgcaaaagtttcctttagaggcctgctatttcagtgtccacttccccttccttatttactgtgtggggtatcctctagttctcgttgtttcttgcctgaccatctccttcattctcactgttttttgtagttgacgggatcagatcggaagatgtggcttgtctcatttgccaggaacttttgtttgacccatcggtcctgaattgtggccatggtaagctcgaatttaggataaaatattgcagaactatgttattacttcttttctgttggaaaattgacattgttttatgaacagtttactgcatgccatgtttaacatctgtgggtggagaggaacttgaatgccaattttgtggagctccacatcccgctgaacctacagtatgctcaaatctgaagaactttctgaaacatcgcttcgaagaactgtataactcaaggcaagagaaaagttcaggtgttccaagcaggaaggaaggcactcgcaaagggaaaccttcagagatattgcatacccacgttggggtgggctgtgatggttgcggggtacgttcttattccaaacttagttattatggtttggctagatatgcaccagctgttaaatgcatttattgaggaggcagatgttcatgatccttgtctcaataaagcttaccatctaaattatatctaaaagcagcctgtttgaatggatagatctgtttgtttgtttgttttgcaggtcttcccaatccaagggagaagatactcatgcaaggagtgtgaggcaccaggtttagatctgtgcgagaaatgcttcatgacaggatctactgcagagggacgctttgatcagaagcatactgcagatcatgacatggaactggatgactcattccttttccccaacttagtggattacatggatgacctatatatcgatatgacttgagtgaggggtggacggtgctgaacatgaggcagtggaaatagggaatgagcggtgagagtagaggactaaccaccgttgaaggtgtaacttttgtctagaattcaatatgtagatttacaaatgctgcatctgcggtttaactctcggacaaatttattacaacgtttggtgctgtgagacccatgataatttgggcgtttgcacgagtccgtgtgcttttgttggattcgattgactgatcggagtcagacatccatgccgacctctatctacttgtaccgatgtagtgccaattatttttccatgccagaactactgcttaccgttgtcaatagggaatccaacacagtgtggcattatcaaaaatagcaatctgtgatctattggttaatggttggccactagtttaattctgcagttggctcaactatactattgggataatatgctttctcatccctggttgttagtttttacctcattctttcgtcctggtatatttaactattcgccacttctagatgtggcaattaactatttaccactggactcacatgccatagatacatgtggacccacatgtcattgagatatggatgataaatagttaaatactaaatctaaaagtggaaaatagttgtttccaagtgttcaagtcaatggaaaagaagccaagattccattcccctggctagtgttcaatgagaaagctgtaggacctgttgcgactaaaattagcactacatatcgactgttagggtgtgtttatagttcacaccaaaattaaaagtttggttgaaattggaacgatgtgacggaaaagttggaagtttatgttagaataattgggctaggcccaatttatcctattaaatctcaaaggcccataataagtgttaaggataataataccacctcaggatttaagcgaggaatatctcaacctaaatagggagttattggaggctccctgttgactagttgaggtgggggtcggaaggccccacgcgcgtgcgcgcgccgggccagggcgaggcgtggcgggcgtacgtcacgtcgctactcttttgcaaccacgaacccacgttcccacgactgcctccgcaacagcgcgtccacgatcctacgttcccacgactgcctccgcaacagcgcgtccacgatcctacgttcccatgactgccctgtgctgttctcgtctcctcgcttctaatcgcttgcgcgcacgagagatgcactgccctgtgttgttctcgcctcctcgcttctaatcgcttgcgcgcacgagagatgcacgactgcctctctcctgatagataaggaggcctgatagataaggaggtcgcgagtccgatcagaacgatccgcttgcttctttcccgggtgttagttcctcctcctccgcgcctgtgctgttctcgcctcctcgcttctgatcgcttgcgcgcacgagagatgcacgactgctcgtcctcgcccaccatgtctgcgcctggagccggcgctgctgcttctgctggaggagatggcgcgcctggagctggagccgccggaggtggtgcgccaggagctggagccggtgccgcgaacaacaacatcaacggaggcaattctgcctcacaatccagcggagggccattctgcctggagctggagccgccggaggtggtgcgccaggagctggagccggtgccgtgaacaacaacatcaacggaggcaattctgcctcacaatccagcggagggccattctcggggtatatccttctcctgttcctgttgttagcgctttactgctatgttcctgttcctgatattcatgatgcctttagcatgctactgcgttactactatgttcttgttcctgatattcatgatgcacatgatgcatttagtatgctactggttatgttacatgttgtcactagatcaccctacactgtttatgccatgattattgtcttaacattttggattaaaatatgccgatttattaccatatttccgacaatccaaaaacctgataggtcattttcggtagttggctttgctgctgcactaaaaccacatgcttttgatggttctaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgttgagcattgatcagtgtactcgctgacaacatagtggacgtgtacatgcacatgccttccgggaaggacatgtgggatgcacttgaggccaagttcggagtttctgacgccggcagtgagctgtatgtcatggagcagttctatgactacaagatagtcgatgatcgttctgtagtagaacaagctcatgagattcagatgctggctaacgaacttgagaacaacaactgtgagttgccggacaagtttgtggcgagtggcattattgccaaattgccaccttcttggtcggactttgccacttctgtaaagcacaagagacaagagttcagtgtttctgatctcattggctctatgggtgttgaggagaaggcgatggcaaaggatgtccggggcaaaaaggttgagggaggttctagtgccaatatggtacagaagaagaaccctcatgcatcccacaacaacaagaaagtcaagcctaatgtcaaacccaaggctgcaaccaactttaagaagaaaggcaagggaaaggcaaagggagactactttgtgtgtggcaagtctgggcattgggccaaggactgtcctgagcgcaaagacaggaagtctgccaacatggtcattagcgagggcggaggaacatcggggtacggtaaaatattacctacagttctctctattttccaccacctgattggtgggtggatactggtgctaatattcatgtatgtgctgacatttctctgttttcttcttatcaggtcgggagaggttcctccttgttgatgggaaacgggtcgcttgtggctgttcatggtgttggtacggtcgatctgaagtttacttcgggaaaaaccgtgcagctgaagaacgtgcagcatgtcccttcaataaagaagaatcttgttagcggctctctattgtgtagagaaggttttagacttgtgtttgagtccaataaatgtgtcatatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtcaaaggttccaagtgccatacttgtgttcaatcgaaacaacctcgcaagcctcataaggcatctgaggcgaggaatttggcacctctagaacttgttcattccgatttgtgcgaaatgaacggcgtgttgactaaagggggaaagaaatatttcatgacactgatagatgattgcactagattttgttatgtgtatctattgaaaacaaaggatgaagcattgcattactttaagacctataaagctgaggtagaaaccaacttgaaaggaaaatcaaacggttgaggtctgatagaggtggggagtatttttccaatgagtttgcatccttttgcgaagagtttggaattattcatgagaggacgcctccctattcaccccaatcaaatagggtggctgaaagaaagaaccgtactctaactgagatggtgaatgccatgttagacactgcggggctttccaaggaatggtggggtgaggcagttttgactgcgtgtcatgtcctgaataaaattccaatgaagcataaggaagtaacaccgttcgaggaatgggaaaggaagaaattaaatctctcatacctacgaacatggggctgtttggccaaggtaaatgtacctatagccaaaaagcggaaatttggaccaaatactgttgattgtgtgttccttggttatgctattcacagtgtgggttatagattcttaatagtaaactctggagtacccgacatgcatgttggtacaattattgagtccagagatgctacattctttgagaatgaatttcccatgaaacatacacctagcacctctagtcaagaaactgtcatgccccatgagcactttgcaccgatagaacacaatgatcaaatgcctgaggaaaatcctgaggaggacaacattgtagatactcgtaagagtaagagacaaagggttgcaaaatcctttggagatgactacattgtatacctcgtggatgacactccaagaaccatagaagaggcatattcatctcctgac

SEQ ID NO: 69722 - DNA, 8140 bp, Oryza sativa
agcatcagaaaccaataataatggtcactgcatcccaagactctgcatcattctttcgggaccgtagtcttggtgctgattctcccatctctgtaagttcctactaatttgtgggtatgataactgcatcttacattatagttctatgaaataactatggagttatgcacagggattgattgccttgctcactgctgttgatgctctctctcaccttcatgatataagtaatcttaagaaacaggtaagattattactactagaaattattctgtaagttgtgtgcatgttattgcattgggttcttttgcatctgtcatctgctagagcagtgttgcaggtctactctagctactttgtgtttcttttgtgaattatgatactcattttgaacttgcagcccttgacatctcaatcattgtcctttatctaagcatggcgtggtagatttaatatggctattcatatctggtttagtatggatttgtggtgattgattcctaaattgttgtgttcttattctcacatcataccacatgatatgcagcttgtttttgctgttttcaatggtgaagcctggggttatcttggtagccggaaattcttacaggaattagatcaaggggctgactctgttaatggcattagcagcttattgattgaccaggtgagtgcttgataggataacgcttgcaattgcagcactaaatcatttgcaaatgctttcaaacatatagttttccttggatgtcccttgcttcagggtattgtccttctgcagttttttaggttgtggacttaatgaatttaaacctgtgaaatttaccatatagtcctgagtcttcaggcgatacatatatctgtctctacacagttccataacctaattatatgattatttaggcaagtatctgtctacattgttccataacttaattatatgattatttaagcaagtgctttggacacgattcaggtcttggagattggttccgttggcaaggccataagtcagggatatccactattttatgcgcatgctgcaggggtaagccttttttgtggttatttcccctgcctgttcttggtgaatgtaattgcttattcaaaatgttttttttttcagttcctgttagtgtcatagtggttgataccccactctgtacaggctattttagttattggagatggataaacagaaagaatttaggcacagtagatgggggcctgtggacatccatatgtatagtttaggtttcagtgttgcatcagaatattcctttttgtcgaatatctcagtgaactattttttatcatgactttatatgaagatattttattctggagagatttatcaaaatatttgttctcaaattcttgagtaaagcacactgggtgtccaaaaaatagctgtacattggaatttaaaacaccataggcattgttccatattgttcatatttatcttctgctttgacagaattcgtcaatttcgatgaaaatggtagatgcactccaaagtgccagtgaatcacttggttctgataatgttaaagtaaaaccagcagcttcatcaaatcctggtgttccaccatcttcattaatgtcgttcctaggaaaggtaaaacctcaaatatccataaacataaccatttgcttgatagtattgcactcaatatgcaacacattaatttagtgatgttccatctttttttttcttttttcattagaaacattgatttttccaaacaaatatttctctttgaaatctgagtgccatgacctgttcactgttaacccatcaataatgcagaattcatcaactcctggacttgtcttggaggattttgattcccaattttctaatagattttaccacagcactttggatggccctggtaagttcaccatgcagagatctgatgatttcttttgtagaaacccaggattaaacctgtaatgtcttttttttacagcaaacgtcaattcttcgtcaatagcagctgctgctgctttgattgccagatcattatacattcttgctagcgcagacttgcccattgatctcatcacactgaacactattaaagtgaatgtttcactggtagaagaattgattggatgtctactgaaatgtgatcctggtctttcttgcggaattgtgaagagcttcatttctccaagcaactcatgtccaagtcactatgttggtgtttttcaggatttgcctgctggcacacagtttccttcatatgcagatgatatctctcggtttatatggaactttttggcagacagaacttctagtttggcaggtaacagtagctcttgtactggacagtgccatgatgaaggcgaaatatgtgtaggggcagaagtggaaggtggaggcagatgtgttgtatctacaactaggtatcttcttttcttgagacgcatactcccttctagaactaggtaacatttttctatgggcccttttagaacgttgaaatcaaatccctactgtgcgttacttatttgggtgacaggcattagcggtttaattatgaactaggcaattataagtgtatgcttagggatgcaagtgggcaatccctctactcatataaaaacccgcttaatagttcattttcttgcttctagtacaaaatttggaagaaaaaattaactagaattgtgataagggcacacttgcatccctatgtatgctggagcatccataatccagttagtttttgtatatagaaagaaataaaatttgctgacactaaagtaattttgactcgcactcttttttgtgttgattaactaacatgtactggtgttgattaactaacatgtactgaattttgttatcatgcttgtatttttgtggtgattggttgctgttgtactctctatttctacttggagatttactgattgctttattaactttcttgacaacttagatatgtccctgcctattcaacgcggctgaagtttgaggacaatgtatggcatgttcttccagtaaactcttcagacccttttagtgctgcagatcctgtgtggaccgaaagcttctggaatacaattggcctcagggtgtatgcagtgcaagctacatcttatgattggcttgttcttctgatcgggatcattattacggtggcatcatactttgcagtgatcgttggcagatcatacatttcaaagatcataaagcgggactaaaacatcatccattccctccattatttctgagaccttggtccatcagatcctaccaccaaagccatctctgtaaggtgctctgggaattttgagagttggaacagaactaatagtctaacacatgaattaagtcggcaaatcttagatgcaatgtggcacatggcgatagggagaggatttgtaaaactacaaaagccatgtggagccttccagctagaaggagatgtgatcctactacatgatacatgacaccgacctacaggctgttgtgatttgtactgatgtttctggatctgcttggctgattggctctgcattggtaggtataggtagatggatgatgcccctctgggaggatgtatgctgtggattagtgctggttatgcacgtatcatctttgagttttggctgtgtacgtctctccagtcctattttcctactgtgttgggaccagttgagtattgtgctggtttacggaaccttatcgatatcatgtcaagaactgtccctatacaattttaaataactgaaaagctcagattcgccatgtgcaacatgctgtttgtacactctatccaactcgatcctctatccatttggtccgtcacctagagttttttttccccagttttcgacgattagtttttcatcaaatacgacagaattccagtgtataggtattactgtattagtggctgaaaggttaaaattctccagttaataaggctgtgtttagttcacacttccatggatgaaccaacgtcaactgacgaacaaaaagaagggacggatgggggattccgccatgtgcgccaggtcgggacaacggaaccaccagtgaccgggcgtgacgtgttcgcagctaaaactaattctaaaatcatgatgctgatctcggcgtgacgtgttggcagctaaaactattccaaaatcaaggattaggactaccgaatggcactagctgccgtggagaatctctatgcattgtttctccagtgttaacatcgtttctccttggcacgctaagctttccaattcctgctaaaattttattacctttttggacgaaaggtggtgattaccccaagtacaaggaactaaaaacaaattgtcatactccaatatagcaataatagtctgaaacaacttgtagtgtctgtttccatgttgcttcttgttaatgtagggtgacagctaggataattgagagttgacacgtaaggcagcttcgttacgatgcttgcttttagatgccttataaaacaatttacgatttgctaaaaatccgatctaattatgataacatttgccattttttccttaaatcaagcgatgtttatcttcccataaatggttgaatgagcaaggtgtgggaaaaaaaaaggaagctttgatcagtttttttttatcgagctatctttaaaattatttttcataatttattatattttctccatcatttgagactatttcccttaacgagctgggaagccgaaccgaggcaggatgaaaacaacttccattcaaaattaaatagtaaattttattttgaaagaaaaaatagattaatgagagcaagtttgtaccaagctaactaaacgagcttttatttttttttctccaaatccagaatgctgcaatccaattgataatcacatttaccaccggataacctcatgttttagataactcaaatggcgaagcatgcgtgcgattaaaaaagttcgttaaaaacgctataaaaggcggcggtgcctttctccttcatccgtgatactcccaaagattcttatcgattgaagaaaaaaaaaagccggagaaaaggatagagagggaaagcaaccagccatggagtcgctgactctccgggcatcgccgtcgacggccgcgccgttgcgccgcgtccccgggcggcggcacgcggcggtgtccgtccgcgcctccgccggcgccggcgagccggacctctccgtgcgcgtgaacgggctgaagatgcccaacccgttcgtgatcgggtcggggcccccgggcaccaactacaccgtcatgaagcgcgcgttcgacgaggggtggggcggcgtcatcgccaaaaccgtaatcctctcaaccctcgcaaccgcaattctcctggatggatgacttttcctgctctaattttccgttgaaacagcgcacaaggataggatctatgtgatgtagttagcatttcagtgtttgagataagttcgcgtattaacgagagtgccttttggctgtatgatttgattccgatctgggttgggtttggagtgggagtgggagtgggagtggaggtgggggccaattcaagctcacttgaaaacaggtagctgctaacatgatgtcaggaaaggtggcggtgtgagtttgctattttggttgcggcaaaatcgaatcatggagtcgtggctacgttagatttggtggtggatcttatgataggttttgatgggtggccatacgagaattgatagattgatgggtgccggatgagaattcagttagttatatatatggctggttagagttaggatctttgcatattctaggagaatttggtctgtatgtactacttgtgttcactatgactgactactgacaaacgtcttgcttgaagatgagatggcctaatttttgtgagatgagcattgcatcctcagtattaaacatgagaaattagtttcaatttcttttgttctgcattaaccctttgcaatcatcatttccacctttttcacatacacattgttgtttccattgtgcatagtgcctttgcagtcatcactttcacctatcacttccaacggttgaatcatcaactttgtggctaattgttggtatgattatgaatggtaggtatccttggatgctgagaaagttatcaacgtaacccctcgctatgcccggctcagggcggaccccaatggatctactaagagtcctatcatcggatggcagaacattgaacttatcagtgatcggcctctagaaactatgctgaatgaattcaagcaactgaagaaagagtatcctgacaggatactcattggctcaataatggaggagtacaacaaagctgcatggcatgagcttattgaacgcgttgaagagagcggagtggtaaccttcccttatgtgcattttggtgcattcttggtcgaacttatcatgttggaatgttaatgatctgtttctatcaggatgctcttgagattaatttctcatgcccacatggcatgccagagcgaaaaatgggtgctgccgtgggacaagactgtgacttgttagaggaggtctgcggttggataaatgagaaggctacagtgcctgtttgggcaaagatgactcctaacattacagatattacaaaggttagtcaaacatatacatcttcgcagcacttaatgagatcctaaattagtttttatcccacccggttttcacattgttttggacatcgtgttcgcgaattattatttagcgttcgtgtaacatgttttggacatctcttgaagccctagcatcaccatctatggaattaccactacattagaataccaagatttaggtgctttttaagatctaccaagaattagttttttttatgggtcaatgttttcattccttacttgcattgtgcagcctgcaagaatttctcttaagtcaggatgtgaaggagtttctgctattaacacaatcatgagtgtgatgggaattaacctcaaaactttgcgaccagaaccttgtgtggaggggttagattcaattccctgagttctttttttccctatggaacatattcctttactgttaccattttttttcttataaaaaccacttgattccacagttattccacgcctggaggctattctgcgagagccgtgcaccctatagcacttgcgaaagtcatgcagatagcaaggatgatgaaagaagaatttgctgatggacagtcactctctgctattggaggcgtggagactggcaatgatgctgctgagtttattctacttggcgcagatacagtacaggtaagctctaacatggtactaatgttagtattatgcatgtttatattctacttgatgctgctgttattacacatgtttccaatctggcaacctatgtggctccctttactatggattttgaagatcataatgtgtgctgctcgtgtacagttgatgttgaattatattctagattttttcaggcatcatttttgcaattaattgattagctccatgcttatcttgaacagcataataataagacttgactaatggccattcattgtaggtatgtacgggcgtaatgatgcatggttatggccttgtaaagaagctttgtgcagagctgcaggattttatgagacaacacaacttttcctcaatagaagatttccgggggtatgttatcaccacttcccttcttctgactcttgttgatttgttgttggaaatcatctggagaaatcaccttagtttagagtactgtactatgatatgttgcctacgaatgaacttaggaagaaatggaaaatcaccaacatgagtgttcatgaaacttttcttgtaaaagaacatgctcaggggggttacacatcttttcttgcagttttattttccacatttctaagtagaagcaaggacgggacactctattgttaaaaacagacttgaggtaatgattgaaggcagacttataggttgttagcggtagtcattatgggcttgaaccttcattatgacatgtttaggcaagccttccaatggctctgccttgcacgcctgaccctactatgtgtgaatggtgtagattaaagtcttgtgtaccttatgattaattctgggtcactttggccttgttttactcattctcaaggaagcctttcagagct

SEQ ID NO: 69723 - DNA, 640 bp, Oryza sativa
atgagataggaaggggatgatgcgtttgattcagcttattgcctgagtcgcctcatttgttaatgctgcctctccgccgcctgcctcgcccgcctctccgccgccgaccgcgccatccgccgtcgtcccggcacagccgtacgtgcgcatgccgagagagagagaggaagaacgagagagagaagagagagaggaaaaggggaagaggagtatgataggtgggtcccatattttttaataaataaaatgctgactggattgccacgcgtacgccacgtatgtaaaaccgctctggattgggtcgaggggggtaatttgtccagtattgaaagtttacgggggtaatttagttgaccacgatagttcgagggggagtaattcgtactttttccttataaaaacgattttgatgtttcacttgcgacaaatttttgaacctctatctttcagtttttcggttgtaaaatcttacattaagattcatatttatgtatatccaacctacatctacactaagtaacattagattttacaacaactttttatctctcttttaaaaaaaaattaagacgggctatatctattggttaaaatttctgcaagatttaaaactataaatatgttgaaagatgaataggtg

SEQ ID NO: 69724 - DNA, 14548 bp, Oryza sativa
cttgatgggtgaaagtatcccagatgctaggcttcctcccatcctctgcagctgccccttccacctactccaggtgttgttatgttacaaagttgcagacaaattcagatcttgaacagcaaagatcatgccatacaaacaggaaacgatacagaaattaaacagaaatccaaatccgatgcaacaaattcctgccaaatttcagggatatcgtatcgacatatgcactgtctgcacaaataataacatagttcatctgacaaagtgaggtgaaactggctaattaatctaggagtacttggcacctggaaagcggaggtgcctgcgccgaagacgaagccctcggggaagtcatgccgggtgagcgcggaagcgtctctcgccgcggcggcgagcaggaggaagacgacgacgatgaagggcgagggcacgagagctcgtgccccggccgccatggctgctggctcagctgctgtgcctagtgcctaatataaagatggcgaggttttgtcttctcctcactgtttgatgctgactggagagtggaaggagagacaagtggcactgaagtcgacgcttcttttttttttcttttgggatttttgtgtccctgtggggtgggccgtgggcctacgaactcgggctattttgcccggcccaatggaagatggggacaggcccaatgatggctgtgttcggaagacagtgttactaaccggaagcacggaaaactgagcggtccattagcgcgtgattaattaaggacgtgattacacagctagtggtagctggtttgtctaaactagctaccactccatacgtaagagacactatccacctatactttaaatacaattttctcttaaactacttatccgatctacgatccgattacaccgttgtgttcgtaacaattaaatcttaataacaagatcccacatgattatattttgatgaaaaattataaattacttttataatatatctaaattacttttagatttcactaaattacttcttagacatatgaaagtaaattcaataaagcctaaaagtagtttacatatattatagaaataacttataataaaaggaaagtaactttaatgaatgtcctttttcattgggcgtgactacacagctaaaaatgaaaggaaaaaacaatcgatgattttatagatagttacttttgaacaatgcaaaagttatttccaattaacattgaagttacttttaaaaactgttaaacttacgtgtgttgatatgtgccgattaaattttatttctagataaattcatatttttatccctacaacgaatttacttctaatgtcgtgacaaagttacttccgttttgttttaaggtacttttataatatatgtaaattacttttagactatattgaatttccttttatacgtctaagaagtaatttagtcaaatctaaaagtaacttttatatatatatatatatatatgataaaagtaactttcacatgtaataaaagtaatttacaaatataaattttttttcatcgtaatataatcatgtaagatcttattgtgaagatttaattgtaacgaacacaatgttgtaatcggattgtagatcggataagtaatttgagagaaaaaattataagaaagggaaaaaacatgcatgtgtaatgaaaacaggcatgcatatgtactggcttctccactccactgttcacacggttgggtctcgcgttaagactatcgcgagaggcctcgctagatagacctttttttgcaaaagtggatcaatatgacttttttaagtaatttctgtatagaaactttttataaaaaatacactgtttagtagtttagtagtttaaaaaacgtgtgtacggaaaataaagaagttgcaaaccaggggcaacgaacacagctggcatggtttaccacctggttactaaccatgactatctctcatggatcacaacctgagtgatactgaccgcgactgagttcttttctttgctttctaaacttgcctctttcatttttcagtacatactttttaaattactaaacggataaaaaaatatatatatacaaaaaattatattaatctattttcaagttttttttctaatacttaattaattatatattaataaatgaccacattttttttccgggaagtagagttcgagaagcttctggtaacagttgtttctttaggaagctttagtttctcagacaatatagattcttacctagattttaagaatatgtagctataaaatacagaaaatgaccatctagttgtttatcaaaatcttaaaaatttctctagtagagcctcagcttctcagaatcaagtcgtaaaaaaataaataataattatgtagatttctccggagtcacaatgtgatgtcggatttcttcggccggagctttgccgccgaggaggaagccatagtaccagcacatcgagctcatgacgtacttcgttctcgctggcgcggtgaagtcggcgctacacgggccgtatcgcatgtacaccgtagccggagagcaactcgaactcgtcgagcagcgaccacacaaagtaccccgcgttcgatccgctcctgcacccgtcggtcgccggcgaaccgagaaactaattaagcatactctagctgaagtccaaatgtatggaatatatattgcaatataatggctttctaatttccaatattgttccgaactatcatcccaaaaatattatttattgtacacgttccatctctcgaacgaacattccaaagagaaggtataccgtcctatggtttcttgacctatcgccctagtaattttatgacttacttataggatcaaagttaaaatattttataatttaaaacagaaagagtagctacgaagtacgtgctcagtacatgtccgtacatagacatggacttttttagaagaaaaaaacaaataaaaagataacgacagcaacagcgaaatgtcataggtggtacaaaggagtgtagtaactcaaattgatcaccatttctgaattccggctgcttctgatcgcttctcctctcttcgtgattctgtccaatttttccatttacattcatgcatccatcctttggacttctagtcgccttcttctagaaggccaggtcatttttatttttaaccaattgcgtggagaggtgaaactttccactttcgtgtagtaaaaaggaaaaaaaaagatattaccccttttatttctagggacaatttgaaccatccacataaattttacaaaatttatgatatgccaccctgacccatatgtcattgactcatgtgggtcctacgtgtcattgagatacgggtgacatatctcaaattttgtaaatatagggtggtatgtttccaacaaacccttatttctatatgacgttggttaattcatcatattaaaaacaaaaggaagtactagtactccctccgtattttaatgtaggcaaattttgctacaagacactatgatttcgtggttttagccgtaagacattgcccaaactcacttctaggagaaaacactccataacatggtaatttgacaatggacaccgcgctatataaaataataatttccggttgaggaggagagagaaatcacgtgaaatgtcaaaaatacccttgggcccacatgtcaactctccatctctcttcctctctttcttcctctctctctctctctcttctcccggtcatggcttgctcggcgacggcggtgacgcccgtagcgcgcgcggcctactcggcaccggtggccgatggaggacctcctcctccacacctgacaccggtggccgcctcaccgtgctcgacacgctcgccaacatcagtttgctcgtcctcgccggcggggatctcgagcgccctggggcgggcgcgccagacgaacgccgcgccacaagcacgtcgaagctcgtcgcgcggccacggaggtgcggtggcgacgtcgccggggctgaaagaaaaggtgcgcatgaccatgtcgccggggaccacggccggcgccgggggcgcgacggctacgtcgttgtactctcggagctagaacgccggcttgggtggcttgcgcgcatccagcagctagctcgcgggatcggcgacggtgtccatgaactgcacgacactggaggcatcgcacatggcgtggttgaggcgtattccgaggacgaatcctccgcagaggaggcgggtcacctgtccgtccatggatcaagtcaacacatgtggacatgtgccatgcatgccaccattgtcgatgcgtgaatgagcaaaaatgaagcttacctggatcagcagcaatggcgtgccgagcaccgcgggcggagccgtccacgtcgaattgaagagcagctgatccatgcacgggaacggcgccctgagcccgtgcggcccgtgctcgtcttcatgtggcccgtcgctgctgatgcgggtgctgctgcgtgaggcgctcgcgctcgagtgccacaagcagtgcctcggccgccgagtaggccgcgcgcactccgggcgtcgccgccatcgccgagcaagccatgaccgggagaagagagaaaggagggagagagatggagagctgacatgtgggtccaagggtatttttgatatttcacgcgatttctctctcctctccaaccggaaagtattattttaatcggcacggtgtccactggcaaattaccatgtttatggagtgttttccctcaaaagtgagtttgggcagtgtcttaggcctaaaaccacacataacgagtgtcctgtagtaaaatttgcctttaatgtatgacgccgttgactttttaaacaacgattgaccattcattttattcaaaattttttttgtgtaaatatgaaaatatttatgttatgctttaagaacatttgatgatgaatctagtcataataaaataaataataattacataaattttttgaataagacgaatggtcaaacgttagataaaaagtcaacggctttatacattaaaatacggaggtagtaataacttagccagcgttggccatcttcctgtactgtacgcctccgaatttctctggagtgatcacagtgtggcgtaggatttctccggccggagctcgccgccgcggaggaagccggagtaccatcgcgccgagttcttgaggtacctcgtcctcgccgcggcggtgaagtcgacgccgcacaggccaaaccgcaagcggtagccgtagaggaactcgaacatgtcgaacatcgaccacacgaagtatccccgcgtgttcgatccgttcctgcaccagcagaccaacaaagcccttgttcaattcctaactttttctttaaactttcaacttttccatcacatcaaaattttccttcatacataacttcatacataaacttctagtttttttcttcaaacttccaattttagtcaaacttttaattttaacgtgaaactaaacacacggaaactaattaagcaggaggggatcctctactgtacagcatatgtagtaggtgacccacatgtcagtggcacctactttaggtgcagtacagcacacaatttgcatccattaagcacaatctatcttaagtccgaactgagtagtacttccgctatatataatgagctgtttcagttttgtgctaagttaaagttctctaattttgactaagtttataaagaaatgcccactcagatttttaatagatgatgacattgaattttttaacatatgttcaaccatatgtctaattttgactaagcttttatcattaatgataaaaccaagtaaaaaattaaatatatattttcaataagatgaatgtttgagttaacggtatcatctgttaaaaaccaaaagaagttattaatatctttaataccaaataaatgtaccatcacgacatattttaatgtggattttaataaaattaatttgatgttataaatattggcatatttttctgttttagttatgtttaaagaagtttgtcttagaaaaaaactaaaatgtcttacaatatgaaatggtgggagtactcccttcatactagtaaaggaagtcgtttaggataatgtttaagtcaaaccctgggaatataaatcatgaataactctcaacttgttaagtttgaatatgtaaaaattatataaatagatttatcttaaaaatactttcataaaagtatacatatatcacttttcaataaatatttttatagaaataagaagtcaaagttgtgttttagagaccatgtcgctgtccaaaacgacttcctttacgagcacaaaggaagtaagtagctaggagagtgagcgcaccgtacggacaagtacagagcttccaggtagccctgcaagaacgccgatctgaagtcatcgttgtagttgatctttccgaagatatccggtgaatctgaataacctgaggcatcgaggaaaaaacataatttacatcgtactaagccagtgacaaatgccattttaaagctaccaagaactatggaagatggattttcatccctctagatgagacctgttcgtttcttacatgtcacctaaatagttgtaatttgctttttttaagaaaaattaacaacatagattaatatatatcatttacaagcatgtaagatcaaatttgatttcaacaagttagaaaaaaaagaataaattaaactaaaaatagtcatatattcacagttatattcattatttctgttaccaacttatagaagttaaatttttaacttacacgtttgtggatggtatatttcatattaatctatcttatcattttttaaaaaaagtttataactttttaggtgacatataagaaacgaaggaatatccccctaagggattaaaaacatttcccacgcagaattcggacctaccattttcgtggatcatgaccggggggttgccatactcgagtttcaggtgattcagcaccttgccaagagaccaagaatgacactgaatgttctcctgcaaagggagcatcgaaagaagaggtgttttactcatatctatttatgttaccacattaattaactactagtagtaaaacttataaatcaatggttgagatcacttccaaagcgaggatagtaaaatagtgtcagtagagagcaccatctcgaaaggactatcaagactgaatttctaatgccttgaaacattttcaaaaacaactctgctccactgcagctcgattatctatatattaccgtgtcgtcttctcctgcaccagatgaacagcaactgatcagctgatcggtttatggaactcaaaaaactaatgcagttgagagttgattgtagaaagccatggataatgcatgcaaagtttgactgattacttagcttgggaacatctggtgttcagagattcttaccttgaacacctgcgtcgatgtagtagtcccgtagtttctgctcattcgcgtcgatggattgcacaaagataacgtagtaatggttgatgccgatgaagtcgaacgatccgcgtattttctctgaatctgacgccgttatggatggcaaccgaacgcccacgcgactcctcatcaccggagggtagtctccgtgcaccaaaggatgcaaaaacctgcattttcagacggagatcagtacattgaaaaaacaggagaccgacaatttgttttctaagataattgatagaaatctgacctcgcaggctcgcacaagtggatatacacggtcagaagatacagaaatactccctcctttccaaattgatcatcatataatggaattcaaaatttcttaaattgaatatcatataaccacatagacatagatttcatcataacataattaatacaacatggaagaatgtctgcatattaaggtgtaattggtatggtattttaatcgatacatgcattgtgggagaatatgtgcatgatatcttgattgatgtgatttaaattatctttggtcttggtacataaacatatatgatgatcaatttaggaatgagggagtacttgactaacaaattgctgaaccgaataaagtttcatatcacaaacacttgttgttttatgcttgaaaagtccgggtataaacatcgttttaagtttgtcatgagtgtacttgggatttgagatagcaatgccgagaatttaagtactacggagtactccctccgttttaaaatgtttgacaccattgactttttagtacgtatttgaccgtttgtcttattaaaaattttgtgaaatatgtaaaactatatgtacattaaagtatatttaacaatgaatcaaatgatatgaaaagaataaataattatttaaattttttgaataagacgaatggtcaaacacgtactaaaaagtcaacggtgtcaaacattttgaaacggagggagtagtagttagtggagtagttagtcagtggagtagttagtatggcatggctagttggtactgcaatttaagtagcagtactaaccatccaatatggaattcattcatcctaatggcagcagctgcatcggctgttttgtcggtgtatggctcatgccaccgaaccatgagagtgatccctatctggcctccttgaattgcctgctgtcatgtccaattcaatgttcagggaccatttcttggtatgtgaaagacacaccaaagacataccaatgaacacagtatgaattcagtattgtgacctggtatttctgtctgtagatggacactgccgaggcatgagcgagcagcaggtggtgagccacgatgtacggctccgtcgaggagtcgccgccggtgcagttggtgccgaaggggtaggagcaccgccgcggcggccggtcgccggcgtcgaagccgccgatgggctcgatgttcggctggttaaaggtggcccagtgcttcaccctgtcaccgaagttcttgaagcacacctcggcataagccgagtaatcttctctgaaatataatatgtggcaacatgtcagggaattgactagtggttgtagtgacctgagtagcaccctatggtcctgagttcaaatcttcatagaagcgaatttcagattgagttatttgagggctaagttccctgcttgataggctaagttcctaatttaaaaaggttgcatatatccggttggatgtagagaccgggtaaaaaatacccatctctaaaaaaatataaaaaaaattttagggaattgcctgaattcatcaccatttggatcagcttgtgtcatgaaaacatttagattacataggattttgtggagtttctcagggtgcctacatgaatctggggctgagtattccaccatactcatcctgaagggcctgagggagatcaaaatggtagatggtgacatgaggttgtattcctgccaatacatgacagaagatgagtctaccgatcaagattcagctaggaataaatccaaggtgcagcaagtaatgtgtaccatgcattatcaattcgtctatcagattgttgtagtactccaagcccttggggttgatctctcctcttccatctaaaaacaatttgaaactcactgtcataagtgttcagaagatattcagtagtactaccttatttatgtgattatgtctacccggaataagacgaggccaagcaatggaaaatctgtacgcatccagccccatgtcatacataagctttacatcctcctgaaatcattgaaaataaaaaaaggtagattaaactgatcttttttatagattttgtgtcatatctgaacttatcactgaccttgtaatggtgatactgatctgctgagacatctgcattggagccgtcaggcatgtaccctgtaagcatcaatcatggacatattcattctagaacaatgcaactatatgcatgcgtaaataaagaacatacaagaaaaaaaatgttctagaataaaagcatgaggagaagattatcatctactccatttttttggaccttgattgatgaaggtgtcccaaatgctgggcttcctcccatcctctgcagctgccccttccacctactccaggtgtgacacatttgcaaaaacaaattcagttcttgaacagcattgctcacacggtagtaagcacatatcttggcatatacaaacatgatgcaatacggaaacacaaatccgatgcaacaaattccgccaaatttcagcagagcatgagcattgagcgtgagcaggatgagcatctgagcatgatgagcttctgacatgcatgatcgatggattttatgtatatatacctggaaagcggaggagcctgcgccgaagacgaagccctcggggaagtcatgccgggtgagcgcagaagcctctctcgccaccgcaccaagcaagaggaacacgacgacgatgaacagcgaggacacgagagcgagctctccggtcgccatggctctagctcgcagctggagcaaggctgctgttgtgcttaagtaggcgaggcttgctccttcttctttctttttttttctttctttttctttttctttttctttttttttttgagaagggctgcttgttcttatcatatcaaatctttagttttcgtgacccactaccaacagtgttgcgattcatcttaggccagagaaatgctgctacagtactacagtccctcgccatgcatgcgccgtcagatgtccaactggtgattccatccagccgtccacacggtcatcgctcatccctccatcccctcagtccactcaatcaccacaccagccaccgcctagacatcctcgtcttctcggcgccgccgccgcgctgtcttcctcctgcgatgctcggctggcgccgtcttcctcccgcggcgcccatagtcaatgaacgatgtttttaatatcctgcagtggttcactgcgcaatattgtcaatataactatagaagaatcaacctggatgtccctagatgaaactgtgaacatgagatccaaatggtgaaatggtgggcataagagcaaagtattgacatctcatgtagctcctcagagctctacctaattatgtcaagtattagcattaccgttacagtcaaccacaaaatcgaagagtacctcagtaatagaacagttaaatcgaagagtgtacttcagtaatagaactggcttcttttgcccaaaaagtactgcaaggtatacatgctttagctatgttattattgctgaaacatctttgcttgtcacaccaccggttactaatcagtttatatgtcacaccgctttgattgctcctttgggaaaaccagtttgccaagtgctaatttacacctaaagtttagtatctactacgtatgttctaagattaatattttacacttagattggtatctatgtgttaagtgttaacggtgtcaacactatgatatgctctagtttacaactaaagattagcgcctatgtaaattaccagaaggctatatatcaagctatatgaatctgaagcaccacataacaaagacatatgccattaattttgtcaaatgttgctggaatatatggtccagtagaaatagaacaataagttagataatggagatatgtttcactggactaacagttatccgatgcattttgagctttaaagagaatataagatggatggtattagtagtttactaacaaattgtgcttctatcatcttgtttcggcgcaaaaggaacagtacatgcagttggctacaatgagggcatgatgtgacaaacagttaatttgaggttccaaatatgaagatatcgatagttcagaaataattataagtatgtgctagaagagatcatgaacatgatatatgctattcttgccaaattcctatgcttcatctttcatagagctgcagagaccaaggcagtttgctcaaaagtaaaataaataatttaagatgcacaaggtttgtagatcaaacctttagtttttaaactgtattacaccaacagtgacaattaatccctatacacagatatgtacagttgtacactccgatatagagagatggagaagcaagttggttgaactgcacatatggttgtgtgaggctggagagtggagataatttggagaattttggattcagaggtgaaattaaagcttgttaatgaaaaccgatgtaaattctatatcttaaataagaaaagtgacagtactatggccccgttcgaatccatttaaaagtgtggattaaattttggattatagtggtatgcttttcaaactgttaaacggtgcgtttcgtgcgaaaactttctatatgaaagttgttctaaaatatcagattaatctatttttcaagtttgtaataattaaaactcaattagtcacacgttattaccacttcgttttgcgtgaaacacttaatctttatcttcatcttcagaagattcaaacaccacctatctatgcctagttgcctactggtgtattaaattaaggtattatttgtgtcactgttgggtggggcccattcaggttcgtttatttgcccggctcaatggaagatgggcatgggaaaaccttttcaaccaaaatttggcgcacactaaaaattagatgctaagcaaatccatttctcgaaaaaaaaagttttgttttttgtatcaagaagttggcacatactcgctccgtaaaaaaacattacctaacccctcctagtataacgaatctccgtccaaaaaaactaacctagatttgttgtactagtagatgggtcacatgaccatttataggttagtttttttttgacagagggagtaggatattagttccttttcacgtatcaattttgaaaataagttttgtgatagtttatttttaaaatttataaaattaataagtttaaaaagttaaaaaaaatctgcgtgggagccgtacgagcatcgaggtggcagagtttagtacagacaatataaaatcaaaccctagcatttcaatgcaaaattagtggagagtgaaaacgactaaaatgtctctcattattgaaaaaaatagtaattgtgataggtagataaatgatattgaaggaataatacttctcattttacgtgttgagggtaggtagaatggtaaaagttaatttcctgtagaataaaatttaaactttagaagtcgattttttttatagagggagtacaatgtttggtcaaacgattggcccttgccgtgcagtaggagtccgatgccggttgtggtttctgaatttagaaactgtaataggttttggaaatagaaagattgagttctgatgggattagaagttgacttctagtactaaatctatgtcggagattttttatataaaaaatagacgaagagggttagatgaacaataaaagttattaatatttgcctagggtttaatatattcatagatgagagaggagtgatttgtaaacaaacacacaccccctccaacaccaacggcctgaatttcgccgtccccttggcggcgcctcctctccttgcgagttcgcccaccgcctgcctgcgccgatcgatctccataggcgccgtcttcctgcggcttccgcccgggtgagcatcctgtccagttacgcaaacccaccccacttttgtctcggatttttgcttgcgttaaccctagcttctcttgatctagacctgtggaagaagctcttattaatattaacaagtacttcctccgtttcacaatgtaagactttctagcattgctcatatttatttagatgttaatgaatctagacatatacgtgtttagattcattaacatctatatgtatgtgggatgctagaaagtcttacattgtacagtttgtccgttccccccaaaagtttaggggagttattagccatgagtttgttcttgcatttactactacacttgattgaacttcgtaccagcgactgtcatcttccgagaagtactgtaaaaagaaaggagatattagcctgcttaatattaattgaagtgtttaattgcattttctttaatttgcagttgtgtaattgtattttctttctgatttgttttgccaggttctaccttggttaactatcaggaaagatgtcaaataggtcaaagttctggagattagcagcgctagtccctgaagtgcagtgtcctgaccagcccatctctccccgtcaaaaatttaaatacacggccattgtacttttcatctttgtgactgccagccaagttctattgtatgggatccaacaccaacctcgaaccattgagcctgatccattacattggctgcatctgattctggcgtcaagccgtagtactctcttgtcgcacgggatcgtcgctattctagtacctgaggttctggtgaagatctgggtgtacctaaagatcataactctcgataccagtgcacctgaaactggtgttcttatgtaagtgctgattctgctcacctccaattaatctaacggcaatatttgcatatggagagatggaatggtgacagtcgatctgctatgctttgatcggtttcataaagaaatgaatatt

SEQ ID NO: 69725 - DNA, 6210 bp, Oryza sativa
gagttgctccgagccaaaattcgaaggcacacagcttctccttacttcctccgttgataatgacttcttttatcgtctttgtctagtatatatatggcacttatatagttaactaggaagggcaccttgtttaatgtagctttcatttttattatgaatgttaaggatgatattatattgttgaagtatttttttactccttgtaaacatgtattggttaataacgaagtagtttggacattagttatgattttcttctgattacccttgcaacatataaactccatactaaaattattaaaaaaaatgtgtcataataatggagttggtttatatctatttgtactatgtgtgatttttttaaaatatctagcatatcagtttccaaaattttactaacaatttttcttgtatgctatcaatgactttatggatttattatagtaatgaaaaatatttttcattaaaacgtagctaatagattactttatttaagtaaaggtagacttatattggttatactacctccgtcacagcacgcatcatgaacgataaatcaaatgaaattgatgaatatacatgacaatcaaagaactaggcatagaggctgtagaggctaggtccttctcctagcctcctcctgccatgcatggcagctactgcgtccctcgatttccctgccatggcagctgtggttgtcgatgatttggcggcaatctggcgcacgaaggtcaagtatgagcaaagcggcaataaatgagtctgttcgggaagcttctagctgatatagtttctctcataattaaaaggtcccctaaataatatagctttgattctaaaaaactgtagttatttaatatagaaaataaactagaaattaatcaaacgctgggaaacttagctttttcacattctcagaaattgaccaccaaccaactacttcccgtaatcttaagcaccctaaacagacgcggtgatgacatgcgtcgcttctgcttctagccgcgtagtccgcatccccagcaacgagcaaagcggagccgagccgcgcttccacgcgtggagatcgtgcatgcggctagctgtccgtctcttcacgcaattggagccgtgcagtcgcaccataagatcccttcctcaaccacttgtcgctcatctggataagggctgctcgggtgaggtttgtagccaggtatccaccaaattgccctacgcattgtagccaatgcaattagggatggcaatttgacatgtttgcctattacccatgggtaaaaaaaaaccccccccccctaatagaattaggtttattctccatttagtacccatgggttttttattaggtcaaaacctgtacccaacgggcatacggtgtcacgcctagaaattcccgaatagaatttcaagcagaatgtgcattaaattccccgtccaggaccagccggggtacacaaacgacaatgttgacattcagatccatgtcttacaaacatcataaaagtcttacataaatgcaacggaagaaaagaaagacaacaggagctaagccttgactaaactgcagcgggaacaccactccacaggcatcctcgacggcacgcacgaagcctactcctcagagaaaccttcatctgacccgaactcgaactctggggttgggaaaagtagagcaagactgagtactacccactgtactcagcaagtcataccggaataggggtatgatgcagggaattatcaaagaagagctagagcagttcatttgcataaagcgagcatttataaacagaagttgaaagattaaaccgttgtaataattaattaatatcaactatccactgcccaacgctaacccacgttgcgacaggcccaaccatccacctaaactatccaatttcaaaagattacactagggtgagactaatcacggtgaatctggttgaccgcccataaccgcgggcacggctattcgaatagttttactctgatcagaggtgtacaactgtacccacaagacacagccccacgacacgtttccatgcgccgacatgccaccacgacatatcagaaagaggccgtgacaggacccttcgcataaccccctctagccaagcacaccacacctcaggtttcacccccgtccccagcgggcaacgggcagtcccctctcgtgcctaggtgaatccggaaacgacagaggccgtcgcagggcccgccccgctccatcacgcccacccttgcctggatgcgtcgactagatgagagctacactacaagcccagccgttgcccacgctggcttgtggtaagtacgataagttctttcagggcatcccgcgaaccggtccttaactgccatgggtgcgaccagcaaaaccatgcacccacagcccaccatgtgatttattttaattaaccaacaccaaagcggtggcactaatccaacaaaaccattagaaccaacagtctaaacattaataggattttccccattgtgaactagttgaactaagcatggctaagcaattcctagtccaaactctaatcatgttgtaaccccaagctaacaaaggagcatggtatccaaaaagcatagctgtaacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatttcgaagtacaccggagcgtcggaggagtcggaatctagcgacatacaaagcaaacaatgcaaacaggctataagactactgaaacagggaacaaaaccatttttaatggattctacacattactcttgatttactgagacttgaatgggcttaaacggagctcggatgaattagttatgaattttagaagattcactgtgtttattactataacaaaaattcttaaataatttattgcgcaatattttccagggctgacatcagcacggggaagcggcgctgacatgcggggcccaccagtcagcggctcgggagagagaggaagggcgccggcacgcggggcccactggtcagcggcggggggaaagaaaaggggcggcggcacccggctcggcttggctcaaggccggccgaccggccgcggcgacggcgcgcgcgcgaatgcgttgccggcggcgcatccggcggcggggcgacggcgcaaaacgacgcggaaacggcggcaacggatggcggcagcgaccgaaggcgacggcgagcgcgggcgacggcgacgcacgggggatcgggggaaggaaaggaaaggggtgggagtcctcaccgaatgggacggcggcgaccgtcgacgatgagccacgggaggacgacgtcggcgggcggacgagctccgagatgccctaagaaaggaaaagagagagattagagggagaggggtggtccacggcgggcggaaaccatggccgaaggcggcggtagagatggtgctcaccagagtgcgagggggtgagggctccggcgacgaacctcgacggaggaggggtgaacggggtggacctcggccgcgcgaacccaacggcgccgacggcgcggtgcggcggcaagtgtagcggcggctagaggcggccggagtagcgggagaggcggcggcggatgggcgcacggcgcgggagcaatggagggcacgggagagagcggtggaaaaagaaaatatgtggaggggagtgcgggcatgctttataggggctcgggagagacggatgtggccaaggcgctcccgatttcaccggcgacgtgggaggttgaaggtgggggagagagagagagagagagcggcgggattcaaatttgaatcccggccatctcggttgagggcgcggcgagagagagagggggagtgggtgcgggaggcgcggcgcacgcacgggcgtggccgatgtggaccggaggaggcggggtgcggcggatgggctacgtgggcgagtgcccggaggttggggaagggcccgacaggtgggccccacctgtcggcgaccccggggagaggagggaggcggccggcctggctgggcctcggcctgcggccggcccagcagggaggagggggaggaaggagagaatgggccggcggcccattcgaaaaaaggaggaaaaaaaaagggaggaaaaagaaaaagaagaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcttgatttgcacctgcattttcttggggggtcgtttataaattaaattttaggcctgggaggagaacttcggggtgtgacaaacctaccccccttaaacggaatctcggccccgagattcggaggagctggtgaagaggtgcggatgggcggctttcaactcatcctccctttcccaggttgcttcctcttctgaatgatgactccactgaactcggcaaaacctgttgaccttgtttctggttcttctttcgctggtatcaagtatacgaatcggcttctccacgtatgttaggtcctcctggatatcaatgtgtttcgaatcagcctgttcttcaggtacccttaagcacttctttaattgggacacgtggaacacgtcatggataccgatcatattggatggaagttctaactgataagcaacttctccccttcgttccaagattttgtatggtcccacgaagcgtggtgccaacttgcctttcgtctgaaaacggtgtactccccggagcggagtgacacgaagatacacgtaatctcctgcctcaaaagtgagctcccttcggcggttatccgcgtagctcttctgtcgagactgggcaatcctcaacctttccctgatgattctgactttctcttctgcttccgctaatacctctgtcccgaacagttgacgctcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcgagagcgcaagctctcaacatatcttccaagatttgattgactcgctcggtctgaccatcagtttgcgggtgataggccgtgctgaaatttaaacgggtccccaattcttcctgcagcttctgccagaattttgaggtgaactgactccctcggtcagatacaatctttttgggtactccatgtaggcacatgattctcgaaaggtaaagctccgccaaccttttgcccgtatacgtggtatgtactggtatgaagtgagcaaccttagtgagtcgatccacgactacccagatcgagtcgtgacccgacgatgtccggggcagtcccgttataaagtccatcccaatctcctcccatttccattccaggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgaccctcatgttctttttcagctctgctatttcagaatcatttacttgagctgctctgacttgatccacgagcgtaggccgtgcctccagagcggctacaaacccgtgttcaacaattcccacgttgagatgctcaaactcctgccacaattcctcacacatgccctcgatgcatagggcagtgcagtaacttttccggcttaatgcgtctgccaccacattggctttacccgggtggtagtgaatactcatgtcatagtctttgattagttccaaccatcttcgttgtcggagatttaggtccggttgggtgaagatgtatttcagactcttatggtccg

SEQ ID NO: 69726 - DNA, 22122 bp, Oryza sativa
tttcaaattgtcgaaaagcataatgttgttttattgaactaaaatatggtttatttttttcctttgttaacaaattatcactaatccaagctcttcacatcatctcagggcctctctcccgtatttcaccacacacaccgatttggtacatcggcaaagggaggcgatcaaccagaggaaggctattaggaagggcctggaatcagacaaggactggaccggtgatggattcgtcaaggagacagaaagcatggtgtccaactgattcgactctgaactcacacccccttccaccatacttccaacttgtgattaaacagggaccatgttcagcccaaaacagcagaaacttttgcatcatctcgttcaaataaaaagcataccaaattacttccatcatgttgtcctgtgcttgtccattgcaatcctaatctgtgcatttttgagtcataaacttcgggtcctgaatctggaccaggtcagtagttcagaagtcgttttctacacttgatgatttgtagcaaacatgccgtgctcataaactgttccatgtgaacataaagtcagggtcactgagctttgggatatctggacttgaccttgtaaagcctcaagacttcaagtctctgctggaccgtgtgcctgagtaaagtgtgagcaaacgatggcatcagcatctggtcagattgagccgtacatgtctctaatccttcacacctgccgttttgtacctgagattcatgctacaattatctgtggcgcacactgtcagaaatttcagcatcgatcaatcagaaatccgctgatgaagaaggactttttcttattacttcttctatcctaaaatagaaatttcagcatcgatcaatcagaaatccgctgatggaggactttttcttattacttcttctgtcctaaaatataaagtttctaaataaatatatcaaaatataagcatttttaactactactatgaatctaaacataaacatgtttatataagtatgtctaggtaaataaaccagaagttatattttaaaacaaagtgagtattacaagaaaaacattttagtatgtctgacgggggaagttggaagtttagaccatggtattcatgggagaacatgaactcaatttttctccgtttacataaaactgcattgaagtggtaagtagtagcataattcggatacgttaaattgtaatcgcatggtttcaatttcacaaattttaatggtatttttcaaaacggacaaatttatagtgacatggatccaattaatatatatatatatatatatatatatatatatatatatatatatatatatatatatatatatatatatatatatatatatatataggacactcatatggggcaccatggtgcccgggcaacatggtatctaatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatggtaatgcctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatatatatatatatatatatatatatatataaggcttgtcttctgcctagtactgttaaggtatgaattagtcgatctaggttcgagtttcgcccctttctcaataaattttgatacgagagccccctaacgtacacaccgaagataaaaggatcttgtaccttataaattcctattaaaatcgcacacctataatcttgactacgacaagatggtctatcattttcgcacatgacacatgtatactaatgagttcacattaagtcgagataattttggggtgccaaaaacaatggatgaaactattcaaattacctccgagggatccaaaataaggtaacttttttcccctggaagagcccagagtaaaaaaatacaagaaaaactacgagtcaaccactgaaacgttggttgccaccaccattccactaagtccgttcccatgcccatttctccctgcatattatacatacaatcaactacccgctgatctgatgaagtcgccattcaaacatcaagaagcagccttgttatctcaactaaaaaaatacagattcattcttgcttgatttcatgattgatagctacatatcttagtttcacaccaggaaaccaaaaaaaaaaaaagatccttgacatccttattatatatagcctctgcctaaaaccatcatgctccttcagtttcctggacatgaagctgcaatggcagcatgtctggtcgtagtcaactagccagccaccaaagagagagctatcatccatggccgccgtggcggcggccgagaaggcggtgaggtgcctcggccgcggcttcgacatggccggcgacctgaggctcaagtactgcaagggcggcggcgccggctgcctggtcgagaggcgcggcgagacgacgccgctcaccgtgccgggagtcggggtgatcgccgacgtgccggccgacgtgaggtgcgacaagggcgaccgcgtccggttcaagtccgacgtgctcgagttcaacaaggttagcaccttaccttgtattgagatcatctactttcaaagttatcatacctttgtcactgtcatgggttcatggtttatcaagcccacatatcattgaaaaagtcacgtgatttcaagggtagaggattttcatccagtgccgctatgccaccattaattcaccctacatgatgataatatatatgggtatggctatgaatatatatatcatacgttggttttattctatatttgcttagttttttaaagatagttcaaagttttagatatttttgagtttttaaatatgagatagaaaatgggcaaagctgaagataacttgctcgaagctgctctatttaggtttttgaacaaaaggttgcattaattgaggaagatattcgggttattcataatttcagttgtcagtattcaccaaactgcagaagcaccgtattaacagaaaattactgttccaagaaaaaagaaaattactgtggttggttattggatgctaacagagttttcgcttattaatatttttagatattgacacgacatttgcggttctacgtgtttctcacgaactgtacttatcatcaaccatatcggcactgccaacatttttgcgacagaaaataaacacttgtcctaattttggtgtcccatcagtgtcaaatattcagtatctcaataaaagccgataaaatcaactttacaggaaaaaaatcctctttttttttctgaaagaagactttacagaaaatctgaaaaaagtgattatgtttgcttggttcgttggtattaagttgcatgcacctaaaagcctaagctgatagggaaaggcggacaattcactttatacactccaacactccccctcaagtctcaagcgtggaatattggagtgggctgtaattattttatttaattgcgcgccagccaggattcgaactcaagacctcttactctaataccatattaagctgcatgcaccagccagttacatctaaaaacctaagctaatagggaaaggcagataattcactttatacactccaacagttaggagtagtggtcctgctctaagttcaagtcaaatttgcctcattatctagttttttttaaaaacaagagagtcaaatttgcctgtaaaatagctacacttgtacttgtaaaaaacaggacagtggcacaccttgaactgcgacagggcctttgtttgactttcaccaaaagagatccgtcaaatgtacatcactgaacagaatcttgccaaaatttcagccttcctgaatgtgatcagttcaacaataatcaaaatcaaatagcattgtttctttttaaaaaagtttaaccaaatttgacgcattcacgcatgcacgcagatgtcggagctgttcaaccagaggagttcggtggaagggaagatcccgtcggggcagttcaacgcgtcattcgacctggacagcgggtcgtgggcccacgacgcgccgcacaccaggtgcctcgctatggacgggtacttcatctccctctttgacctccgtctcgaccaccgccacctcgccctcgatgcaggtgtcctcgccgacgtgccacccgcctgggacccctctgccatcgcaaggttagtggctagcttgtgagtactcctttctttaaaaaaaagtctaattctagctattagtttgaacacgcatgatttatagttagaattaagctttttatgtgacgaatggtgtagctagcttgttgcacgtacacaaataattgcattgcaactttacaagcgcatgcatgcatctgaaagctacctgcaaattgctcccttttctgaattctgagtggtcttgactgtcccttttctgaattctgagtggccttgactgacccaagagtggtcgattggccctgctgcgatttgagtgctgcaaatgcgcgctcgtgttaggatcatgatcttgataggcaacaacaacgcaacactcgctagaaatgtcaggtcccaaccagagacaagtagacaaaaacaatgggcagctgaaaaatcaaagcgtcgcatgcatgcaccagctttattcagttcaacccaaaagtttaagctgatcagtaaggatggacaattcacaagggtggctgttcgaagccacacatctgaccatttcatatcgaaaggtacaaatatagagtatgccatttggcatggctgcgacatgtggatggagattgaaaattctggattcctgtgggagttgggacaacaacgacggggactttctgtcgcacgatccagaaggatttaaattaacctgcaaattgcagccatgaagatgtacggaaaatcacttgcagatttgagagttgcagttgctggacttggactaattccaggtctggggatctcaagtcggtggctgaagaaagcagctcgattagatgtccaagtttgctgcaaaaaaaactgggtactgactgaatctatgacaagacaatgcgttacccagagaaacgaataattcagtcatgtccaaatcagggtgcttcatttcagatgattaaatatgatccaataatgcattgacatatacttctacacacatacatattctatctttttttcgtattatatatttgtccgtcttcgttgaaccgattacagatggtatgaactctgcacatgccgtcatttgactagcgtacacatgatttgtattactaggcagagccgtagctttcagagagagttctgaactgacgatgctgccgacaccatgtcacaatgtagtcgatcatgtagcaatcaatcgttagaacgctaatgacttgttcacgcaacacatccaagattaacctgatcctgattgattgatgcataattgcgtatgcagattcatcgagaagtatgggacgcatgtgatcgtggggctgagcatgggcggccaggacgtcgtctacgtgaagcaggataagtcgtcttctctgtcgccgtcggagatcaaggagcatcttgacaggctcggcgatcagctcttcaccgggacatgcgccatgccacctctgcactgcaggtccaaggacaagttcaaggttaaacatgtcaagtattgttaatgtacagtaattactctagaaattcagttgtcattctcatcagaagttgaaggtttttgtgctgaaattcagtgtctgtgtggtgaattgtgatagataccggaggccttcaacgtgttcgatgcacaagtagctcagcagaggcttcacgggatcaccactcttgtatcaagcaaggaggtaattaactgaatcactgtactctattttctagaacaaaaatggctaagggttctggcattctcaactcttgaatctttcgatcaattatgagataaactttgcattgcttgtgacataaatttctactatatctgtttctttttcttcgttggtttggacaacgagtcaatggcacagtcttcaatacatatatctcatctttacttttttttttccaacaccgtggctgtgtttagtgtatagttccctttaaatttctaaaaattccgtcacatcaaatgtttagacacatgcatggagtattaaatatgaacgaaaaaaatcaattacacagtttgcatgtaaattacgagacgaatcttttaagcctaattacgccatgatttgataatgtggtgctacagtaaacatttgctaatgaagaattaattaggcttaataaatttgttttgcagtttacatgcgaatctgtaatttattttggtattagtctacgtttaatacttcaaatgtgtgtccgtatactttaaaaaaaattggacagggaactaaacacggcctgtatttatgaaacttataaaaaaattgaccatatgaaatgtttttcatgaaaatatcttttaatatcaattttcacatattaaatcctactccctctagtttttttaccgataataccgttgacttttaaacatacgtttgaccaatagtcttattgaaaaataagtaattatatttattttactgtgacttaaatctattattaaagttactctaagtatgactttcattttggcatatttgtacaatattttcaagacaaatgattaaatatatattcaaaagtcagtatcgttatttattaaaacccaacgggaataatacttttttatttttaatgatcgaagatgtcacgacttgactgcgtgtatttgaggataatattttctttttgataacggaggtttgaccatatcttatattatggaatagagggaggactagctaattatatgagtttgctcatcgtgtgcagggtgtgacggtgatatactccaagaggggagggaacacgacggtgagcagccactcggagtggctcctgaccgtgccggcgatgcccgacgtgatcaacgtcaagctcgtccccatcacctccctcatcaggggcgtgcctggcactggcttcctctctcacgccatcaacctctacctcagatgtaacaacagaacagagcttaatgatttttcttttttagacgagtttatttactgttgattagtttaaaataacaaattaagcatgtgattggattgttacagataagcctcctgtcgctgacctgaggtacttcctggatttccagcatcactgcgtgtgggccccggtgctcggcgagctgcctctgggcccttgctcacaccggcaaggctccagcccggcgctgcatttcagcctgctgggctccaagctctatgtcagctcaactgaggtcagactctgaaacagcctctcactctgtcactgaaccagataaattccattctgtggttcactttccatggcgtgtgtgatccttcaaaataaaaaaattgcaggtggttgttccgaagctgccggttactggcatgaggctgcatctagagggcaagaaaaacaaccggtaagatttcacaggtttatttaaatataattaaatacacatgaaaacttgaaaataggtttttcttttttatagatgcacacccacgcactgagacacacatactactacacatgcacacctcacaaaatgtggctccccacgcgctcaatgaaattagtttgggggagcttatgtcagctctgcagctgcaagaaactcctcgaaacaaactagatgatcttcattcagataccaagaagttttagttgtagaatccagaaaataaactaaaagctagaagctagatttcccagattctttagattctcactagctaacttttcaccagctgcttctcagaattttaagtttccaaaatagaacataaaaccagcgacaactcagttatcagtccatcatgacataggcacctctgcattatctacaaacattttattattgtccaaggcatcaaacatcttccaggaaaaaacattttattatttgtcacccttatctcaatgacacgtgggtccatatgtgtcataacatttgggcccactaataaatggttaattgccacatttaatagtggcgaatagttaaatttctaaaaaaaaacaaagactacgatgaaaaagaaaaccttaaaactaacttttaagtaagttttaaactttgattggggccgatcagaaagagcatagaatgaaattgcatgttaacaagtttaggtatgcacagtacatatgttttgcgtcggatggtgtgtgactaaagtggatttcattgtgtcgtgcgtcaggctgggcatccacctgcagcacctgtcgacgacgccgacgttcgtcgccgccgccagggccgacaagccgccggtgtggcgtggcacggaggcggtcaccgacgaccggtactacgagccggtgcagtggcggatgctggcgcgcgtctgcaccgcgccggtgaagtacgacccgcggtggtgcgccggcgaccgccgccgccgccccgccgcctgcgtcgtcgccggcgcgcagctccacgtcgtggcgcacgacgccgccaacaacgtgctccacctcaggctgctctactcccagctccccggctacgccgtcgtgcagtccaagtgggcgcgcggcgcggcgcggccgccgtcggggaggtcgtcgagtttcctgtccatacccttctcggggtcgccgtcgacatccagtggcgccgccgagaagggaggccggccggagcagggcgcctcgccggtgggcgtcgccaacgtcaactccggcgtgttcgccggcgggccgccggtgcccgtcggcgcgcagaagctgctcaagttcgtggacacgtcgcaggtgaccatgggaccgcaggatagccccggttactggctcgtcaccggcgcaaggctggacgtcgacaaggggaagatcatgctgcatgtcaagttctcactgctagcccaagtttcttgacgacgagtcgacgagggtgtcaagatgttcatgaccatcccgtgatccagagtttgtacagttttcagctgccaaatgcagatatgctaacaactgaaaaaacagaatattccaaaaaaatttgatttttgattttttttttttggtttggaccctgaagatgttgcaacgatctgtaaatgaaaaaagatagtaggaaccagaggtatcattctaacactgcaagaaaaaaaggattcgttgatctcagatcacacattcatatatgggactcgcatacgattcacagcaacttgtcttacattactactactgcagttcgtcttacgcaaaaggcgggaacaataccaaatttcattacaataaaccgaaggcaccaagtgaacgactgaatccaaaggtttgtggaaacacatatatacatcacaagctagatagcagttcgcccgcattcagtaagcattcaagcaccagaatagacatgttcaatgcaaaagttcagatatatgtataagagcaaacatgctggccacactcaaattctcaagttgtggagagagaacaactcgggctgcatcttcctgacgaacttcctcctttgcttaatgcgcaaaagcttctcatagatacaccatggaaagctgataaagtgtggtcgctcatatccttcattgtagcaaccccagaattcagggtggtaagtgacatggtaccaggcggatgccttggcttcggaggcatcatggccatgcccattatcatctaagctcatctcactgaaccttgaccttgcttccttacgcaaagatctcaccgccaatctgatagcatcagcatcgcttttctttgtgaaattctttgccatcttaagaatgcatccacttattatctcggcctcactttttattccatagtgatccataagattacccaatttgaagtcgtactcgtccttcaatgccatagcttcagtgatgtaatcttcatagccatcaacaatcatatcggtgtcataagaccgccttgccacctcccttgtgaagtgctttatgtgaggggtgtgcttctttatttccctgtagagcttcccgattactccttttgattcataggtgactttgtcaagcttctccatgaaatcaggatactccttcacatgtagttcaggaggaatcagggctggcactccagttttgggaaagtcaacagcaatggagaagagcttggccagctcaatgcatggtgaactctctgccttgaggtcttccttatccgcaaatactacatgtgcattggcaatcattcctaaactctcattgactatgtaatttgtgaagtactcttctacttcctgcatggtgcaataatgaagttacagggcagtgtataagatttgctaaaactcagttctaacaaagataaatttatgacatttattttcttaattatgtgatttccgtgctgttttattgcaagaaaaacaagtgactgctatgtagacaaattcagaaacatgaagctggtaataattttattccaacaggcaacataatagtattatcaatttgaacagcaactgtccaaccaaatgcagactacccctagacttgaatcagactgcatggtttccaaatacatttttttttcaaaaaaaaaaagaacacagaatttgctactcttataagtgagcacagtacgtgtttacacaagataaccagggaaacaaaaaaaacaactagcttaagacaaattctctcagttgacagtagtatcctcattatgaggcaccaattacaaacgtatctctagaagttaaatattctaacaagaaagaggcagcatatcttccttctaatattcaagatttattacagaaaatagggaaatagatgtgtaatattattaaatgaaggattttgaataaaaaccatatatgctgtgcactaggattagtttgtttcctcctgcaaataaatatacccaaatcttgcagtgccagaaaataggagtaaatgataatcttaaaaaatacaagagctggactcgtgagtccaaagaacagcataacactagccagccaacaattgaataaaattgctagcatgagtggcaagaaagagtggacaattctggttgaaaactgagcttacctcaattgtaacatcatggtctaatgtttctgttggtgctggagtatagtccataggtgtcaccatacgaggcggaatgagagatgggtcccaagaaacaaaatatatgtccccgtcaagatcactccctgaacactcattaggatgcggcctgcacaaacaatcatgttcaaaataattactgcctcatgttttaaatatggcaccattgactttttatttcatttgactatttgtcttctctataaatatttgtacaacagacaaatatgacaaatctagtggtactctttgcactttacttaacaaagtcaatggtggcatatatttaaaaccaaatgtagataacaaaatcgaacagacaagaacatgcatgcatgggaatttaacaagaaaaaaaaaggatcaaatatcgcatatccatgaaatcgcaggtggctaagcttcacaaacaacgaagttcttcaacctaaaatatatgaaattggagaataagcttttctccaatgaatatgtggtttcattaaaatgtgaaacccagacagaatttgtttccagaaaagtggggttttgcagtaaaaagcatactactagaaaacataggagtatgtaatacttgccttggtccttgctgtggaaagacgacacagttaaacatgtggtgcaaaacaggaacatcaacagcatggagaatccgtatatcacctgggtggaggcaagggtttttggcaatcacaacttttcctgtcacggtgaacctgtcattgtcatttacacccgaagtagctcgaatgaacacttgcccatacttcagcgtacgtgtttcatccaagcatcccatcattgctcgtccttttgggattaatatccttgacttggttttcagctctagtaatttggatgccctaaaagtttgtagcagcatagaaagatatggttcatcatcaggctggtagccacacaacaacagctctttaactgcatttgttatttctcccatgggcataagttcaattgcttcgatagcagcttgaggatcagtaaccattttgttcaactgattcactgcttcttcttgcttctgttcaaagacactatctctaactccaagtgtcgaaagaagagtaattagctgccgattaaggaagcctggctggtacttgctgtatgcaaggacatctactgtgatattgtctgactgaaactttagcatgctttttcttaaggaaagcttccagcgtgatgtagggtcaacagcaacaacacctttataaccaccataccttatttgaaaagcagaaggagcaaagcgtttcaggttgcacttcatggccacttcattagcaaaagcagatgatatctttccaatcccatcagagaacacatgctgtgtaccattttttatatctgagatttcttccacctcatacttctgaacctttaatgtttcggttgaggaactaaaagactgaccaagtcttgcagcatattttgctacatttctgatgttacggaaatcccccatccatgtcctaatgtcgctagcagctaatccctggcgagaagcaaacatccatgcagagttatctcggagctggcttgaagaaaaagcaagaaactcaaagttcttgccaccaatagtgatgccatctgaaaggactgacagaactctcttatacagagcagttctgtttgcatcatgtcctgaagcagaacggggggataaatcagttgcacggagcttctcgcagtcctcgtcaacaaatgaaatgcgaaggaaattctctatgtcagaagaaaaattccgcaccacacgattggagacattaatctcaggtccataaaaatacactgtagacataaaccaatccatcatccagagatatgttaggtgatggttggacgtagcgtgatctccggaattttgagtattgttcagatagccaacttgttggattcaagcaggtctttttcaaatatgacatcatttcaagtgcacgctttatatggtcaataggtacaaaagctgggctgaccagacgaaagaagctgtcatcaactgtcggtccgctaagtgtcccattctgaaccaaatggttgatcttgaagagtatctcataggggacataaccacgagatttcacaatcggaacaaagcgagtatcacttgaatatggataccccccactccggcactcgaagtcatgattgtactcatgatagtaaaagaagtagtcacgaatgtttgggagatcacatcgacgtggtacctcaagacataaaatatatgattgcccaatgctagaagatgaagtaaaatccgttgtcctggtccattgatcatctgtatgatccctaaaatagttgaataatggatcttcgtacataacaccagaacggcgtggtgtctgttcataaatcttaggtgcagcttgaacctgaaacatgaaacgatttataaatttaaggttatctaaactttaaatcaagagataacaactagaattggtgactggggtggatcaacattttgaagtggaaatataaaggaaaatactggataaaagaattcagtgcttcagcatgatcatatttttttttacataagaacacgatcatattttcactccagataagtaatactcaagtagcatatctttatacaacttcattgccgcatattttgaaatgaaagggacaggcgagttagagagcactcataaattcattagcatgaagaattaaagaaacacaaagattagaaatgcaatttcattatccagtaatttatgattgaacagtataatgtcgttcaaccatgctaaagtgcaggttgtgagccacagcaaagcaggtaggggaacaagaatactaacagaagaaattcaaatgattcttttaaaccatcacagtaagctcctaaacacattaacattgtccatttgtatatcaaataaggaccatatgatacatacattctaacagaactcccatgtaactttcaccttccgaaaacagcaaaatcaccattgaccaaaattccaaaagtcatcaccatgaactgttgtgactaaaccgttcttcgtcaagccttaatagcagaacaaaacacagtacaggcgaaccactttaatatttactaaagaaactatctcaacagcaagattagtcaatgtgaacatgtggtcatacaataattgtacaatttactgaaaagaaatcagcaagtgctgtagagctcaagatacctggatcaaaagaaacttcgtttgtgacttgggtgggcgttgaagctggatctcccatatgctctcatgggaaagttcaagtttatattcgattgagctgttgggtagctgcaggtaaaagtaaatctttttcagattgaaaccaaactcaacagaaactccttttcgactccacagagcagataaaattgtttccttaagcaggcaaccaaaatgcagtgttacatcctctagcttgaacattgaaactcttggtcttggaacaatgtcacgatctgaaggatggactttcagataataatgcccacggcggagtatctttctttgagccgcattttttacaagtgaagcatgttcctcggtctgaaactgaactatagcatatgctcttgaggtagcagtgacgttctttggatgcctgagctttactgcatacacattcccacagccaacaattcgctccaacaaatccttgacgtaatcagcactgtcatctagagcaaaccctgatacctgtaaagtcttgacacccatggcgcatatcacaactgcaggaactcatcaatataaacaattattgttaagaattacgcacagctctttagatttacggcagaatggtaagtatcgtctacagaaagaacttaaaagctaaattttatcctgtttctatcataatcttaaagtagtgaagtaaacaaggtactgtaatgtatcaaagaatacaagcaaaacaatgatcatgcgaaccatctccatgcttcctttgtaaactattccctgatactaactattgcacatgccagattcctttttgtaaatcaggtatccccaagggcggagctgcagtaatatcgtcagggtcaggtgaccccgatggtattcaatcgatcaagtgaatcgtgcaggattttgcagctaatgaccccagcagcaaaagcttcatgaccccgatcaggtcgctaaactactggagctcatgaaagctgaaatagtacagcttcttctttggaagcacaatttgttagctaggttatgctactgtcaacccactactaatgcggcaattagacctatttcatccattaaccaactctttgttttagctatgtgttgtgtatatcaatgcattaggcctgtagttttgctaatcaactactagatgttagctgtgttttttaagctactaactccgtctcaaaatatgttacatttaatgttcaaaattatcttaaaatacaactaattttctatgtaccgttccatctcaaccaatcacaattttcccaattcaattttttcacctactttcttttttcaaccaatcataactatttcacaccctaacattaatcttttaaaaaagagagtaggtagttgtattttgagatagaggaagtaataaacaactttcagaacaaacttttatgtctgaaaaaacgcatggttgttatgcctggttttatagtcttaacttttaaatttttggaccttaaaaaacctcctgcattcttataaaataattataaaatatagagtttaaacatttatttttaacaaaatgaaacgatcccaacttcctcattgctctagctccaaaataattttgatctaaagatatctagcttcgagaacaattagagttttaaacacgacattagtacaagtaaaagccatgacccagtggctcaaaatcctggctccgccctgggtatccctatcatctatccatttctatactctggactatacatatttaccacatgttcttgattccccaaaattagagcattcctttttcccccctttcaaaagccaaattatcatgcaatgcagtgacagaagcatggagaaaaaaactaaaaggatcgatcaaattagacgagcacaatttccacaaaaacacatcatgaacgtacattaccagacttcctcatctttctccaccacctgcccttctccacgcttgccaattccactcccccaaccaccaaaaagtgtaaaagagcatgacaacaaccgaatcgatctcaaattcacatcctccactaaaacctccctcaaaacccttcatattccccccaccaacgaacaccaccgaaaaacccaagagtataaaaaaaaacccgacacatcaacactaaatcgcccgcacataatacgcatccgatcgaacacacaggttcgccgagcaccgacgccaaactggggaaagcacagcactctagagcgctagtacagctagtaaagcgaacgatcgcacgcaccgagcagtggcggagatggggctcggcggcgactgcgtgggcggcgagtcgacggcggctggatcgcggcttcccttcccttcccttcgctccgccgctgctgcgccgacgggtgctcggtggttttcgtcgccgactcccgcaatataagcgagcgcgacggtagtgagcagagggattcgaggacgaggagtcgcccggtcaatgtgcacgtagcatttaaaggaattaaagcgaagacggataaatgaaggggcgcaggaggccagggccggaggtgtcacgtaccgttgatgttgcttcgagattcgtgcaaagcatggaaaagaatggaacgtgaaggcctatatatatgtgtggcttttattatcatagcagcagtattgcacaagatctattgccacggataaggttacatttttatttcttctttaaaagatatactactatataagtggcttttactaggatccggttgccaaaaaaaaaatgaaatgcccctcttggtaaatgtttatcccaaaacaagcccaacacattactactagtacacatgatgatacggtagaattgatattgtgttgaccaattttagaaggggttgttttgtcattctgatcattttcaaaattccttttgaaagaaatcattttaaatttcaagtgtacatgtgtgcgtatataagttgtcccaatattgtgagtatagcatgtaagggtgtgcgtgctcgattatatgctcatccgagaatgaagatactttaactatagttagaaggaaatattgtcacataatttccaacggagcctcacatagtcacattggtctcatttgaaaatggcaaaaacaaaaacaacgtgaactgtaccggttcaactcgaatataggaaatgcacatggtttgaacttatgtttcataatatagaaagacttctagcatcatcggttacccatatttcttagtaaaccaaaacagtttattagaaaataaaatttaatttgtaggtaaaacttttatatatttatccttaacgacttaaaaaccaatataaaaaagaaactacgttgaaaatattttaaaacgaactttaaaattaaatttaaaaaatcaaattttagctttggttaattagggcacatcggccattctttgctcttggctttcttgcaaagctgaatcaatgcaatttgatcccattattttttataaaaaaaaagctacagttagaatggagccttaccgatgaagctaaatcgtgtacgactctgaagatgcatactccctccgtcaaaaaaaaaaaaaagacaaacattgatttccgtgcctaacgtttgaccgtccgtcttatttgaaaaaattatgaaaaaaattaaaaagacaagtcacgcataaaatattaatcatgttttatcatctaataacaataaaaatatgaattataaaaaaaattcataaaagacgaacagttaaaattggacacggaaattcatggtttgccttttttgggacggagggagtagtctggtctgtaaatatactgatgcaataggcaatggcaatgccccatactagtactccctccgtcccaaaatatagctatttctagcacagtgtcttgtcccaaaataaagttatttcttcacctacctcctcctctcaaccaatcacaaccattcttcttcacctactttctcttttcaaccaatcacacacttcctccaatcattctcacctactttcttaatacccatgccaacctcagaaatggcttcattttggaacggaggaagtagcaagataccacaggctgggaagaaaccgcaccatcttttgcatctcctttttttttcttgcggccccagttctacggttactgaacctccttttctagttttttcccccaaataatcagttgatgatcagcccaagaaccgaatgaacagtcgttgcccatgtttactcagtacattcagcgaatagaagatcgacagcgaaaaaaggaagtggataaaggcaaaagagaatatatatttttagaggaaaactaaatgagaactatagaccatatagataacaccctaggcccatgtaagcaaagtgacgcaaccgagtacatagccccatggccatagcatcgctttgcagattccttcctccactcgcggccacggagagaggaaaggaaagtctcactggctgggtcattgacttgactcacactcacagagtcacagggccacagcctcacggcgaagcaaccgcggcctattggcttcgtatactgttgcgaagtagtacgtccacaactccatcgggagaaaaggatgtgaaaccgtcgtggaaagcggatcctgcgagagaaagttgtcgggagaaaaggatgtgaaagttggccggcgagacagagaaatgcaacgcagaaagatgcttcctgctcccctgcctcagtcccacgcaggataaaaatatatacactaccacgaatgctgcatgtttacgaattttacataaacgagtagcgtcatattgcagtttgcaaagtagcaaaaggtaccagtgaggccaaaaagaaaagcatagacattttccaagacgtaaagaacacaacagcacaacacattcacccggagggaagtgaaaccgaatggggaagtagtagttccagacttgcagttccgtggcatatcatacagcccattccaaacaagatccaaaacatggaccgtcggcccagacaaccatactaccttgctcgttggcaagtggctagtagcctagtactagttagttcattgcaagcaagaaaccaccattctgattcagctcgaggttgaaacaaaatatcaagagttaattgtgctacatcagttaaacacgagaaatcaattacagcccaaccaagctcaaatagagcgggagagggtgaccctaatatattgcgataataatatattcacaaccctgacaagcaaaagcaaacacactatctaaattacagaagggaagaagacaaggtcctccagcctatacaaccacaacgtgcactgccttgacaaaatgggagcgtgccgcaaggttaaaccttaccgaaggattaccttcactacattacagcaaagccgatgtcagatgcaagcctactctttccccaatctaggtgtcgcagggtcatctgtgctatctcaatcacaaaattaatacgaacagaggaacaaatacaaagggaaatccgaaactatcgaagaaattcatgctgactggtgttagaggtatgttattgaaggttccgagtcaacccaccccgtggtgcatttctgctgcaaaagaagacagttcaagatgatttagccaggcattaattaataaatagaggctcaatatcaaacagatagtacaaattcaagaactactgatgccaaaaagagaataaaatcttaattatatggatgtgtcatgtatcatctaacgcctaaagtaactactattgctactcaggaatctgtaaactcaatccaagggaaaagtcaaaaggttgctgtaatgctgtgtctaagaaaagcaactcgcagccaatctaatgagatcaggcagagggaaatgaagtagggaaagtcagcagtcttataagtagttaagcacaactgtgataaaatatctcaagggcaaatgaagtatgaatctcgagaattgaaatggatgacaacatggcatatttaagtttacaaaactttccggtatcagaggtatatgcatttgaatatccctatagctgaaatatcagcttctcaaaatatagaaggcattcatagatataccttccatgaggcgcctgagaagtggttccaggtcctttgaaatttccaggccgcttagccttgttttcttgatccttgtcaagacgcatagcagcaacttccttctccatagcagctacctctcgcctcatctttttagcctccacttccatagccttggttaatgtatctaccttttttgccaacatctgtaaacaagaggcagttagcaaaggcatgacccacagcattggtcccattaaatccataataaacaggaattctagtgccatacctcaattgcatcatccttgtcttttagactttgatctttctcatggcatgcctttctcaatgaaatgacctccttttgcagcatgtcatagagtacaccagatactgtgtcagttgaactactatttgtggcctcgctacctttttcttctgtgttagccgccttccaatcatcagttgtctcacaatctctaacagcatccgtagatctattgagcaaatgaggtccattcccaaggacttttccacggtctaatgacctggtaccaccatcaaatgaccttgaagttccctttgcatgcttgagaccaagctgctgctagtagaaagagaggatcttgaattaaatgatggagatctccttgccaacatgccattcggggagatttttgacatattatctgcccacctagagacaaccgacgggatggtccattaccgatactctttccttctgtaggacgactagaaccactaggtggccccctcaatccatcttctagaacttttaggcgcagctggtacttttcctgagtagaaggattttgaaacagtgcacaattaagtaacttgcttccataaaagtttagcttaagatgaatgccagctttctcacctttagttgagcttcagatcgagctgttcgttctgcaatagcaagtttatcacgaagttgctgcatctcaccctgaagaaacatttgtcatgccataaaaattgaatatatgatgtgaagtgtgactttgcatggacaaccgtagatgagcttcaaaaaacaaacagaagtatatcatctttacctgcagaaacctgcgctcttcaagccactgtttgacaggcattactttgtcattagcatctttccactcatttgcaactacaacagcaactctgtttgctgtaacttttgcccgcgcaagctcacggtcaagaatttttctttcctcctaagtgtgccatggttagagattagcatgggtcaacttttttgcgtacagaacagtgaagattatccgaaagcaacagtaaaggatgttacattcatttcttgaactttccgctggtaatctctgacagcattagcagctgcaccaccagcaagaacagcctcttccagctctcttacagtttgact

SEQ ID NO: 69727 - DNA, 1100 bp, Oryza sativa
gaattatgggtgatgcctttgatggttcatgccataggctatggtgtttgtagatgcaagcagctgtgactgctggtgctaggatcatagcactaataactcattcttaaaatatgtataggagtagcaatcttatattgaataggatatatcttactattgcgaatctgtaaagtacgtgttatatttcctccgtctcatattaagttttttttagttcattttatttgtcctaaaataattttatttttagagtaattattgcattggagtttataaaaagcagtgaataattgtattggagtagataaaaaaatgaatagttgtattaggatttaatagagtatggatattctattttttttcttttgtattggcatgtgtgggatgtgtgaaaaatgctgaatttattttgggatgtaggtagtatatttggagacagaaggagcatgtaaggatcataatttctcgtgtagagcaaaaggacgttcggattgttgtgatccaagccagattattaagcaaatcggtaaccagaaacaaataattttaatttggatttaaaaattgaattcatattcttccggaccaattttgtttattgttagtagttcctagtaaggagtagtaatacgacgttatatagggacctgtccggtttgtcaagccgtttgcttcatgcattgatactgaggtactccgactagataggttgttggcttgttggtcgcagagcagtagatgtcagaatgtcaagtaccgcggcagcgtagtgactaggagttcttgactgagagatcgagagggcatcccggtaacaagaaatgagagaaagatggaaagaggtcctagctatgcacgtactactacgtactctagtctagcaaagatgctgggactactgtggtaaatagtgccactcgtagtgttcaagttttgttcaaagttttaggtataacatttactacttttacaggtggaaataaacacctgatatatcaaatgctcttgtctaaaaacatatatccaacgttgaaaatgatgccaatctaggctgtgggaaaccaatttcttatatgggagaaattataatagtgatg

SEQ ID NO: 69728 - DNA, 4239 bp, Oryza sativa
aagaaaaacagaagctcaaaaactaaactttattaccaaagaatttaaaccggcattggtccgaacctgattaaaacccttaaaaaaaaccagccaaaatccttattaagacagccatatcataggcacatgatatcgaccgtcgactgaccccaagcaagcaacctaaacacacaaactaacaagcagaagctagacagtcgattaactaatggaaaacgagcctaatgctcggaacggctcctgcggtcggtggagtcgaaggcgtcctcctgctcgtcaccaggtccctctgagcgactcctggagcctggcagataagtctcgccgctgcccgactctgagccactggagctgctgctgctgagatcgcggctgccactgggagtagcagacaaccaacctccgttgccactggctggacccctggcggctgatgctggagcgaaggagagagcggacgcgggagctggagctggagctgcaggaactgcgggcggaactggaggtgctgcgggagctgctgatggaggtgggttcctgggcgcaagctggatgcgcacgggtgccgtcgtcgtcttgcggggtgtggtgcggatccggactcctcctggcgcgggaagaccctttaactgagcattctccctcttcaggcgcgctatctcgtccatcagagcgacgatcctcatgagcttcccatcgttcaaggccttggtcgccttgtgcaggtccgagtgcatcctatccaatccactcatcacagcacacatgtgaccaaaggtggtgtcgttctggccggttgtcggacggaaggtgctgacatcatcaccactggctcgacgagggtgaaaacggtatgccatgtcatggaagatgtagttgtggcgctcccgtagtctggccatcatcaggtatgctgcctcctgacaggcgtgatctgctgtgcctccggacgcctcaaccaccatgttagctaggcaggtacccacgtagccatggacctccaagcgaacacggtgaggaagctcgccactgagcggtggaaccgtcgtctactctggcgcgttggggtagcccaccaccagcgtcatgcgtgccaactctgccacaaaatcaatcatgccttctccgcggtggttgggtgggtgtccggccatctagagaagacaaaggagtaggatcaatgcatgctcaaatccaaatttaaataaagcaataaaagactcaaataagagaatcgaataagagcgaaattttatgcatagatcattttgcatgagtgcgaataaataagacagactcacataacgataaaataatggggaaattagatacatactaataataacaataagagctgaaataccttgcaacccatgttcctgagctaggacctaatgcatttcacccatcaaatcccaactgactaacgaataaatctcaagagttttactaaaactctagattgactcgttttgacaaatctcacttaaacgagcgaccaagatttttcccttgaaccacaagaacggatcccaattttcccggaacaaatccaattgccaagaacatatgcaatgaaaaggattcagagggcttttaggtttttccatttggcttgtcctacggtcaaggtcggctctaataccaacttgtcacgcccagaaattcccgaatagaatttcaagcagaatgtgcattaaattccccgtccaggaccagccggggtacatgtcacgcccggaaattcacaagtgatttccaaacttatttgtgcataaaatcctcgtccaggaatcagccgaggtacacaaactgacaatttaatatacagattcatcaaattaactaaaacgataagtacttacttaagaggcactaagtcctcaccaagaagaaaactgcagcggaaaataaaatctagcgaagctccggctccactcccacaggcagctcaactggggtatgagccaaacgtcttctccttcgcaacttgtcttcaactgaggttgattgattattgcaagaatgagcatatgacatactcaacaagccacacagcaaatatgcaagtgcacaaggataccaaaggatggcataatataggctcatttgcaaaagcagcatttaacaaaacatttaagagaagtaaaacagtggagtaattaatcaaaaattttaatcaacactgaacaacatgcctatgctgctcaggcccaaccattctgaaacaaccatacccggctgtacagatctaatctccaaaccaggaattatccattccaaaccggagctaagcaaattattaccagttataacatccataattattgtgagaggtgtgagactaatcacgaaaaacattgctcaactcgtccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaattatatctaatatctagttgaaccaatatatataaagctcaactagtccaattataatcacccaaggtatcaaggaataaagtaatcaatgaaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacaacggaaacgacaagctatcacgcaaaacgaggaaaaagactaataaaaaccaattaaacaatacataaaaaataaacaaacatgtagatcataattttagatgaattatgagacttgaacggcctcattctgacttcaaatgaatttattacgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaaggatttattgcatcagcggctagggtttgcggtggaccgggtgcacggcgacggttcacgggaacggacggccgagatcaaccctatccaaaacggaaggccgagatcaaacgggtccacgaccggctcacgggagacggcaacgatgacgtcagcaccggcggcggctcgggagcgcaagctcgccggcgaacgacggcgcgacaactgagaacggagggcaccaggacgtagagcgcggcgcggcgaacttaccggtgaccaaagaagcggcggaggaacaacggacggcgacggcgacgaggaagaagcggcggcggagatcgggtcgacggcggcgacggtgctccggcgatcttcggcgacggcgaagcggcggacggggacggcgacgacttggcgatcccgacggtggccttcccgagtgacgacgacgaccgtagcgacggcggcgcacggctggacgaacggcggcgacggcggcgcaaaagctcacgaggtagggcgctacacacgacggcgggcgaaggcgagagaggcggcgggtagcggagacaccgggggtccttttaaaggggcaaggaggcggcagtgaaggcccacggctgccggcgacgagaaggaa

SEQ ID NO: 69729 - DNA, 680 bp, Oryza sativa
aggcagctgcaactctctccccttcgttgcactcctctttatcaaattcctccattaactcgcgttgtcgttgtgtcacatccctgtacatcgtgaagacgaaagatgtcagtttataggaatgggcaggaaattctttgatcagtgtaattatatagctctagtagtctagtttgagaatgtatcatacgttggaactcggacgttgaagtgaatatactgattcccataggctggggaattccgtgcttttattcctgcagttttttagtgaaaaataaaatatgtttatcacaacagtgtacatagtgagtactttcttccagcagatataatagggcaaaaaccaaatatatcatctaacaaatccaagtatctgtgcataggatttctagcatggctcgaacaaccaacctttgcccctgaggacaaccttttctcctggttgggtaccttggcgaacctgatcaggaaataccacaaacacggtcattggtaagccattgaaataactggattacatggttagtgtcacgcagcaaaaatgaaatcaataccttgactgaaacgttgcccgtaagggttggtactgtgacagttccacctagtacagcctgaaaatcaagcagttttagaactattaatcataaaaggaatatctgcatagacagcagaattgg

SEQ ID NO: 69730 - DNA, 19536 bp, Oryza sativa
ctgggaaatgtaaaagataattgtattaggggagagcaagtgagcgaaacattcaacaaatgaaaaccatcaacagacctacggctatcgcattcctcatcaggagactccaaagcaagagtagaatcccaaaacctctgcattactgtacttgccacatcatttacagtgtcatttcctccttcaacctacaaattgagaatgcattcagaagcttagcatgggaatctaccgcagagtggaagaactatcagaaattaaggagtttgggataagggaccaccaattgaatggctgcgtgggtaagttgcaggacatccaagcaagcagcaatttgtccttctgttgaggaaaatgtaagacaagcatcaaataataaagtcccagaagatgctttgttattgtccttttgggacgcagagacatgaataaggctctacctcgatcaagaacaggaatatgcaagaactttccatcatgcattatatgtagagcatcaagaattgtcgtgtctaatgtagcaaaatctgggtttacagtcatcaccttcaaaaataattgaaagtaacacagtgagttcatatgcaattaaacaaagctcagatggcatcggaagaggcaagaaaatgtaaatctggtggagaaaccttttctactagggtcaattcaggagaaagattctgtgcaacaacacgcataagcaaatcctttgagctgcatttggatgcatcagtaaagtagaagaaaaataaggaagttgtaaataatagtagaagtactaaaatagattgctcacgtgaagatcccctgtagtgtgtttcctgtagcaacaaccaccgaattaactcgaaattcacgcattttctgtgttgctacatacactgggtctgaaggagaaacaattgctaccctgaaaattaacagaaaatagtcagagaaaactctcactattcattcttttttgctaaaagttaacagaaaatagtaagagaaagcagttactgtactttgtgccctccgtgacaatggttgacaaagaaggtttgaacatcctctctcttagagtttctatgaaagcataaggagctgtatccacaaacagagaataccttaaattgatcattaccaaatataattatgataaacaaacacatataatagtctagtagaatatgatatacctgataagttgttcgacatattttatttaaaagatgtatatagcaacatgaaaagtgataatccataaaatgtaccataaatagtacatgttatgcacggtgtactttcagtttcaagagtgagaaagagtgaagtaattgataataatatccagtgcagtacctgaaaagtgcctcctaattgacgctctacccttctacagcagctgctattgcactcccttgttctgctgccttttccagtcttgatattgcatcgtaaaggcatttagcaatgtccagcatagcaataacctcaccattttccacaactgggaggtgtctaaatttacctaaaatatgtatgaacattttaaagaaactacagtcagtatgtttgtgaaaaagggactagtttctagccaaccaaggtctatgtgtaacaaagtgaaacaaccagcctacatatatgccactgaagttcagggcataccaaagaaatcttagacgtctgacgatacaaatcaaggaatcttcaatttcttttgctggagatattgagattccaagacagctaagatgcctaacattaccaaaaaatgtgcttttgcctttcattgcacacacagaaaaaggggcagattgagctgatctgatggtgacatacaaaaacagtatgcgtaacaaaatacaacaagaaaacatcatatttttcatctaagatagtacttgaaagttgaaagcatgatcatgcaaagagaatactaagttggcctccaacatcagggcttttttagttttcctctctctgtcagcctttcgagggcttacccatcatgtaatttctggatattgcttttttgttctctccctgctataaattaatgggacaaaactcctgcaccctttttcgaaaaacaaaaaaaaaaggagaacaagcaatacacagcaaacaagtactccattcttttaatgctctactaggtgcagtataccttcatttagtactgtgaattatccccgtttcacaaagctctaacaaaattgacatgtgccgattctcaattaggtgctcccaatttgtttaaccgagtactttatgttaagtactacaatttagtgaatcattggcgaaagaattatgcatcatgatagcgaaaatgacttgaagtggcactagtcactacagctaaaataataatagaaatgactggctaatctgctacaatctcaatcatatgaaagaacattttataagatgacaggggaattgaatttagccagctcaatttcactgttacattgtccctatagatgttttagccaagaaagtgtaaaaaaaatggagtgcgtctgacataccttgaaccatcttctgcaatgcttcaatggcaagcgtatcagacatggcatatgtggggttccttgtcatgatcttggacatgatggtttgctccacccgcagcccctcagcaaccacccttgtagctacatcctgcgattggaatcccgaaaaagaatgaaaacaagaaccatcttcatctcgaatcgtagtactaaaattagaccaagtgcaaagcatgttggctttttggttcacagcagagtaaaaagcataaattgaactccatggcttagtggaaatcgacttcactttaccttaactaattctaccttttttgccaaaaccgaatgaaaaagaaaaggcagaggaaaagtatgcatcaataagtataaatgtataattgcagagactagtgaacacatggtcaacaaaaatgactcctaattttttggatgaaaacatccaaaatctaaaggagaacaaaatatcttaaactttgacacccacaaaaagccacttgctatgctccaaactgagaatccaatccaggcatcgatgtttttcaaaagagcaacgagaaggtgtcgcatccgcatagcatcaaattgaaagaatcaaaccatcttctatcttccaaaatcagcatctataaaagcacactagaaattccaaatttccaacagattgggagggggcaagcaaagaaaatcctgtaccttatcagtgacgatgccggagaggaggccctgcgcgtcggtgagcagcacggcgtcgaccctcctcgccgccatcctcctgcacgcctccgacaccgtcgtcccctccggtatcgtcagcgccttggacagcctcagcttcctcaccgtcctctccccgcttcaaccaacagaagaaacccccaaaatcattcagcggctacgaaccaaaggagagaaggaacggaaggaagggttcgcaggctcggtgtgcttacgtcagctggccgggggaggtgggcttggaggaggccttcccgttcccgttggcggcggcggcggaggggtcgtcggacttgcgggaggacgccgacggcgggcggctccgcgtccggcggctcggcggcgccgtcgccgaggccgtgctcatggtggcgctcgtcgcggggaggaggttagcgcggcggcggcggcggcggcggcggcggccggagagttgggagagcaggtggaatggaaatgggagcttcggcttcgtttctcctgcgacagcgcgtgggttttttgcgcttcgaccctccaagtatcaaattattaatgccctatataggagtagtccttaataatgcctggtttaaattttatttctaatagttctgttttttcattggttttagcctaaatttttaacgcacgtgaaacgataaagatggttaacacatgattaattaagtattaattattataaactttaaaaataaagttatttgaatttgttaaacaacttttaaattaaaaactttttacaacaaatacgtttgaaaaatgtgctaacagaaaaaatataaagttgaagaaaagaactaggacttaaaaattttaagtgaaatagatggctcctattttaagtataatttttattgtattttttgttgaaattatttcaatttccacgatattcctttgctctaagaaaggtcttattgtttttgaccaagagcaaactaaggttgaccgcttaatttctaaccaagcaatattaaagggagcagctttaagcctttaactatataataaatatattagtgaaatactcttgattatgaatatagtgatacgacttttatgctacaaatattagtttgtttgaattatattatttatcaaagcttacaatttcaaaatcaaaataatgaatatggtgtgtgttcttctccaccaaaaaatttcaaatttatgacacctgaccacattcagggaagagaaaaaaaagaaatagtgggactgatttaaaacgtttccaccaaaatttagcacgaggagcaggagcagaatattgtacacccacccattaaactcaacgcgtgaagccctgaaccgtatcccactgtccccggggtcccacactcacgtgggccccacaccaacgtgttcgtgtccacacccgttcaccgtgaaccgggtccacgcagatctccccacaaatcaaaatcatctgggcgttgtgcgccgccgcttcctgcggcggatttgaatactcccaaattttttgaatccactccccgcgggatgagcgaaaagccccctcaggtttcttcaaatttcaaataggtccctccaagtagcggggcccagccgtggtggcccacctggcagtgagtgcgagcgtgtcaattggagtggaaggctgtggtgctgccacgtcacggagggaacgaacagatggacggttgggagcagcgagggccagccacagccacagacggttgtggtggttttggtgccacgctgtcatctcagctgatcgctgacaaaaatcttgggcgctaagcgacagggctgacacgatcacaagacaaaatccaaaaacatctcttttttagagggagaaaaaaaataatttgttggagttttctttgagtggaaagaagtttatccactagttaagatttttttttcttcttctcacatgcttatttgtcatcttcattcatttgagtaaattgtttacacctttaattttgagtgaattttagctaatcattttttagaaaaaaatagctaattatagttcagaagaaaaacatcaatgcaccatgaaattgtactaattccgtcctaaatgagtggataattgtagacatatgcatgcaatattaatgctttgcatttttttgcccacccaatagatccaaataaagagaatgagttcgagtttttttatttcttacacgccttatctaaatacccttttgtagggaaaaaagaagtaaattttacaaaactacagatactttaatcatgctattacaaaactacagatttaaatgtgtatcacaaaacaatagatttagtaccgaatttatcacaaaactatagatttagtgatgaaattatcaaaaaatagagtttatatccataacatattaaggttacaaaagttatagttttatgataaaactattgttaaatatatggttttgtgatacacgttcttagatatagactaatcaaaatacaagcagttttgtgaaactagaatgagttactcttacttgatgatacaatatagagactatactgagttctttttttttccaattaaactcttgttaactaattggaaaaagtacgaattagcaatccagtcagcatcttatttattaaaaaatatgggacccacctgtcatactcctcttctcctcttcctctctgtcgctcttcctctctctctctcggcatgcgcacggcggtgcggggatggtggcagacagcgcggtcggcgtgcacggcagtgcggccgacagtgggtcggtgcggtcggcgcggacggcggcagagagggacgcggaggcggaggctacgcgggacacaaaggcagcggcggtggagccgccagagtggctgcagaccctgcccgtggcgccggagtaccacccgacgctggtggagttcgccgaccccatcgcctacatcctcaggatcaagcccgaggcgtcccgcaacggcatttgcaagatcgtgcccttgctcctccagccccccgaggatgacaccatccgccgcctcctccaatgccgccaacccctccccgaccttccccacgtgcctccagcaggtcggcctctccaccaagaaccgccgtgccgccagccgccgagtgtgggagagcggggagcgctacaccctggaggcgttctgcgccaaggtgcccgagttcgagccctcgaggcacgccgcactgcccaagaaccccacccacctccagctcaaggccctcttctaggccgcctgcacctccaggcccttcagcgtcgagtacggcaatgacatacctggctccggcttcgcctccccccaccgcctctgggtcccgcaccgccgccgcctccgtgtccctctcccctaccgttcgcagctccgcgccgaccgcccccacccaccgtcgcccacaccgccgtgcgcgtcgaccacgccgtccgccgccatcattgcaccgccgtgagcatgccaagagagagagaagaagagcgagagagagaatcagagaagagagagaggaagagggaacaggagtatggcaggtgggtcccacatttttttaataaataaaatgctgacttgattgccacgcatacgccacgtaggacaaaacagctctcgatagggtcgaggggggtaatttgtccgatattgaaagttgagggtgaatgatgtctggttttcgagtttagggggtaattcggtcgaccacgatagttgggggtggggtaattcatacttgttcctaactaatattacaataagtactataattacacaaagcaaaattacaagaagtactatacatattgatgatataactattaactactacctctgtttcaggttataagactttttagcattacccacattcatatagatgttaatgaatctaggtacacatatatgtctagattcattaacatatatatgaatatgagcaatgctagaaagtcttataatatgaaacggaggaagtaacatactatttgttggaggcataccacgaagggccttcggcctaacctgccgaaaccaagaacttaggcgagaagatcggaccagaggcaatcggcgaaggattgagaaaggaaccagacgggtgaatgccgcccatcggggttcgctggacaaggacctcgtcggagggccgcaggggcgatgacgacaaggcgaaggccatggcacgaaggcgtaggcttcgccaaataccaaaccccatcataaagaggccccgcgggccattatgctttctggaggtttcgtcaagtaaatgggccgatccatttggtccaataggggcccatacatgcaaaggacactatttacacccaataatgtctctatcataagggtaaccatgtaaattcccctgtaaagcctaaacccctaagggggaacctgtaacagagctataaatagccccttagagtcatgtaatagggggatccaaaaatttttactaagcaatacaattgtttttttacttccaaccactgttgagagaaccacgcctttcggcatgacgcagttgtccattcgacaacactatttaatatgacataaatcaggtagagatgaacagtctacctaggatcttgtgcacacaaggagataaatggactgtaaggtgtaatactccagatactctgtttttaagagcaggtacaaagaacactataagttagctgtaaacatattttaaagagataaaatacgagaaagaagagcagcggactacagatttgcagccagctgcagcacagactcgaagatgcaatgtgtgtatgacaggtgagatcaagtattaatattgtagtaagtaactattgtatgaattggctattaagttgactataaatgatttggagctagtagttggctatactattaaacttgctctaaatactccgactccgactgacaatataattatttatcttcaaacttcaaccactcgtctttgtcaaaaatatgcacatagatacttaaaagattccatgctatcaaagtatattgtgacttaaacattttataaaatttttacctgatttggtttagttccttcataatccctccaaatttcttccaatccgaagaatccatcactgtaccctaaccatttagggcccctttgaattagaggaaaaacataggaattttggaggatttcaatactataggaaaatttcctatgaagccctttgaaacaaaggattgaatcatatccaatcctttgaaattcctatggaatggacaatcctatagagattttggagaaaatttagcaagaacttcaacctcttggtaactttcctttgagtctatctctctcatccaattcctacgtttttcctgcggttcaatcaaacggtcattctagtgtttttcttgcgttttgcaatcctctgttttacacttacatttctatcaaaatcctgcgtttttcctattcctacgttttctcaatcctgctattcaaagaggcccttaatagttttagcggttaaagcgaaataatgatgctggcggttatttgaaaacagatgaagtaactgtaaatcgacgtatagttaaatttaggagtttaaatcttgccaaacagcccaacttagtaccaaattagtaacacttagcttctcttgtatttgttgtcgttgagacagtagtttggttcgtaacagttctctgatagaaatgaaacaaacgcataaacagaaatacagacagcacatccactttctcttatcttctcctaagccacaacaatgatgtaccatttcgttttccgtcatttatgaacatcacttgttgccgatgtgttgtcaaatgcgttcatacgtactaagtagaatcccgttttcagattgatacgcaacgaattggttgctacgaaaatgtcagagtttcccatatcatgactcatcagctcatgacagatgatcgtctgcaagacagtgacatgactggactaacttggatcatattgctgctagctaatgttcatgctgcagctagccaagaaattaacacatcgaaatccagatgcagcagcagctaccagtcactgaaacttcagtggcagctgcgagtgttcagagtcacacaacactgcatgcatcgcaacaaacgactcccagctgcagccgtttccatcactgaaagcctgaaacgaaatcagcgacagcattcgacgccataggagcagatagagaagcatattgtcccttttcagctaggagtgacgatccattttgaggccagaaacgttcagagaattccagtggatataatataatcaggcacagctaaaagataaaattcattcgtgaattaagctgtatttttacaaggtgcacacaaaattgaaattggaattctgatcagccaccaaaacagttgaggaaataagaggagtgtgacaaagcatcagttgcatggagacaaagaagatgacagcaacaggattggaagtgatcagagacaggcaatgaaatcctgagaacaacctgaacctcacaactcgtactatccctttgcacagccagcaggttaaccaggttcagtcacttcactccagtgcagtgaagtgcaggcaggactaaatacaggcctaagcttagtttcaggtttatcttcagttcagagttcagaacttcagacacaggttgagaaagaaaagaagcagcaatgtcatctgcaactctgctcaaatcctctgtccttcccaagaaggccgccgagtggggcggcacgcgtcagctccccgccccccgccccccgccccccgcccgccgttcgtctccatggtcgtccgcgccggcgcctacgacgacgagctcatcaaaaccgccgtaaaaacccaataatcttcaatccagtcttgaattgttctggtgcttgggagaaacgcccaatggttttccggctagctccatgaagcggtgggctagacaatcttggttcgaagcttcaccacttctaattactacatttgatattaggttctttcctaatattcgtgttttttttgttcttgtgcttgggattacattaaaaaccgagtcattgtggattaatttaaaacggtggcgtcgccggggagggggatcttggcgatggacgagtcgaacgcgacgtgcgggaagaggctggcgtcgatcggaacaggcaggcgtacaggacgctgctggtgacggcgccggggctggggcagtacatctcgggggccatcctgttcgaggagacgctgtaccagtccaccgtcgacggccggaggatcgtcgacgtcctcgccgagcaagggatcgtgcccgggatcaacgtcgacaagggcctcgtcccgctggcagggtccgatcccgagtctttggtgccaggggctcgacggcctcgcgacacgcgaggccgcctactaccagcagggtgcccgcttcgtcgagtggcgcaccgtcgtctccatccccaatgccggcccctccgccctcgccgtcaaggaggctgcctagggcctcgcccgctacgccaccatctcccaggtcggtcatttcatgtaccgaccagttcaatccaaaaaacttaaatatcaatcgaccaaccaagtagtatagtgtcatcgaccattcagcacaaaagtttaaactgatcaaccgccactaacatggtgtcacagtatcagccagttcgatctaaaagcttaaagctcaagctgatcgattgttgctcgcattgcatcagaataccaaccagtttaaaccaaaagcttaaactggacaacaatccacccacacagtgttacaacatcggacagttaaacacaaaagcttaaattgatcgaccagtcgaccaccgatatggtatcatataacccgtcagttcatcccgaagcattgattaatagtatcattaaccaattaattcaacctaaaattataagttgatcgatcgatactgacattggctttagaacaccaaccagtttaactcaaaagcttaaaccgatcgactgatgctaacattgcatcaaatgcatggatggatggatgcaggaggacgggttggtgccgatcgtggagccggagatcctgctcgacggcgagcacagggtcgagaggacgttcgaggtggcgcagaaggtgtgggcggacaccttcttccacatgtcggagaacaacgtgatgctcgaggggatcctcctcaagccgagcatggtgaccccgggcgccgagagcaaggacggcgcggcgacgccggagcaggtcgccgccgcgtcccgccggcggtgcccggcgtcatgttcctctccggcggccagtcggaggtggaggcgacgcggaaacctcaacgccatgaaccaggcggctccgtcggccaacccgtggcggtggcgcgtctccttctcctacgccagggcgctgcagaacacctgcctcaagacgtggggcagccggcgggagaacgtcgcggcggcgcagggcgaactcgctggcgcagctcggcaagtacaccagcgacggcgaggccgccgaggccagcgagggcatgttcgtcaagaactacacctactgaaaataattttcgactgaaaaactctgaacatacatatatattagtaagtacattgcgagaattaggatcacaagaagcttctctgaaaactctgaacatgtatatattagcacatcgagagaatgcatcatggttactgtattttacaaggttttctagatcacaagaagcttatctgaaaactccgaagatagatgctgccaatctgcttagacatatggacatcgagaggatgcatcatggttgctgtattttacaaggtttttctagatctttgtttttttggtttcattagatgcttggctcctcccatctgtacaaggatgctttggtagatttgtcgtaaggttttgtaatgatctacggatttgcatggttgctgcaaaattttgcatgtatatatacacgacgcttgaacgtcgatatgtaataataatggctaatttttaatgatatatcgactatggagtactttgtttgggtcttatatgcaccatagttcttcaattaatccacacgtaggctccgatcggatggcctaatcagccaaagaaaaagctaaactttaaattttcaaacttaattttaagatatttttaacattgtttctttttcagcattagcttttaaatcactaaaaacacatatataaaaattttacctacaaattctttttttcctaataaaccgttttgacttattatggaaaaagccaaacgatggggcctctaatttggatgagtttacttaggagatagaaatttaatttaatgccccaaaataattttgataatatggagtatagtggcatttatcactctactaatcagccaagtttaaacatgatatacacattgggaaaaaaagacaaatcattgcatgaatagtgtaggtattaattgttagtacgatggatttagactcggttgagagtttattgaacggagtacatatactcaatacacatgctatcaaatgttttaatagtttttcataatcattaacttggcattttaatgaataaaggggcgttcctcgagaaataaaaagagttccccacaaggcttgcccatgtagaagccaaagataagcttacctgcaataaacttgtgctacttattactcatcaaattattgatatggattgtctacttgactaaggataaattaaatattttaggaaaataaactcaataaataataagtggcgttaatttgatgaactagatgaaaatgacttggggaatttggctctaaagaaatgctagaattttcaatgcagcttacggctcagtacaaggagtggtggactcgatcatcagaatgtacaaggcgtgggaagaagcccaagaaaatcggatccagatcctctgcattgaagaagctaatgcagagggtggcattagctccaatccaatccttccatcatcatccaacggctgcatcttctttttcccttcgatactggtaccagaaacaaacaagtccccctcgccggtgaccacagcagcgcaacaacgactcctcctccgctttggcgatctaaaccgctgtgccttctgttattcccttgacctatattatcaccaccgtgagctgagagtagcacagagctcatgattatcgaaagaaaatgaagcaacagtgcatgcaacgttcggttctctccgtgcttaataagtactccctccatttctaaatactccatccgtcccaaaataagtacagttttagcagtattcatgttcaacgtttgaccgttcgtcttatttaaaaaaaagattatgattagtatttttattgttattagatgataaaacatgaataatactttatgtgtgactaatttttgtaatattttttataaattttttaaataagacggatggtcaaagcgctaaacacggatatttatggctgcacttatttttgggacggtgatagtatttaacaccgttgacttttttaagcacatatttgaccgttcgtcttattcaaaatcttttgtgaaatatataaaactatatgtatacatataagtatatttaacaatgaatcaaatgataggaaaacaattaataattacttaaattttttgaataagacgaacgatcaaacatatttaaaaaagtcaatggtgtcaaatatttataaacggagggagtattatctccgttccaaaatacttatcgtaccatattatttagcatgtactaaggtttgaagacgaatactataataccccttaatttataatgcatactccctccgtactcgtaagaagtcgttttggacagcgatatggtctccaaaacataattttgaatttttgtttctataaaaatatttattgaaaagtgatatatgtatacttttatgaaagtatttttcaagacaaatctattcatataatttttatattttcaaactcaacaacttgatagtatatatgatttatatttctaagatttgacttaaacattgttctaaacgactttctttacgagcacggagagagtagttggacgcgggatggtggttgggggtataatgaggagaaatttgaaatgtaagtggttgatatgacaagtagtatttcaaagtaacagctattttgaaataatttttgaatgctagaaagacaagtattgtgaaacgaaggaagtagtgcggtttcgtgccgcgggccaaccctttaaaatccagtgcgacgccatgattttcgttcatccatagcttccgcagcgccggcgatgcaacatacttcacgagttaagcgattcggggaaatcgatacaatggaatcaacaagaaaaggcaatcaaagccattccctctcagatggatggccaggattcagcctaatgccaaaaagtggttgtctgccgtagcagttgatacggcagaggatccgcgtccaagaaaatccaacttagatgattttacgccgtttgctgatgctagtcgctttccatttcctaaaactctatgtaattcttcccctatggactgatggtctcttttgaggtggtctacagtttttatctcataatattaatgaaatggcagagatcctatgcgtcccctcgaagaagaagggccctaaaactaaggataatttaagtttacatactcaatcttattatcatttgtcgacatggagagcaaacaagtttagaacaaggcaacaacttaattaaaagtatcaaatctttgcacgtcaatataagaatcttacacaaaatttatgttacactagcaaataattgtgtcatctcaacttcatgcgacattaaacttatgggtaaacttcaataaactatgtttttttaaagcaattactatattgtaattgtatctgcacatatcatataaactctaaaaacacacaatttcctttgctctttactctatatatgtgtttattaattaggcgtttcaggtgttgtgtgtgcatcactagtgaacctaagactattttgatgaaggtacgtaccttttgttggtcctgaactgttaagttggctatggctgcaacaagctctataactacaatttcaatagtagagctctattactgttattcagtgctttaattgtagccagctgagccaaaaagacatgttgtttttcgaaccattcatataaggggtatttgcaaatttgccaccgttttttttccaattttgcaaggatgccactcgaatgacaattctagtggtatttttataattttttagtgtcagtcttgtaataacaattcaaagtagtgataaatttgtaattgccccttcatataatcatttaaaactacatttttactttattctaaattactttttttagcattgttcttacttaaacgttcatccaaagtgtttagagtaaattatagtttggatcaccatttaaccaattttcaccttggacaaagtaatttttatttttattacacattggaccaccccaactcctcttattaagtactctcttcgtttcgtttcaggttataaaacattttgattttggtcaaagtcaaactactctaagtttgactaattctgtataaaaaagtagtaatatttacaacaccaacatagtcttattaaatctataagtgaataaatttttataatatatttatcttgagttaaaaatattactattcttatctataaaattagttaaacttagagtagtttgactttgatcaaagtcaaaacgccttataaaccaaaacggagggagtacatcaatgacctcgattactaaattatagtctcttgcacaccgatgaactatcgattcttgaagctatatattgcctatacgtaaaccatactctcttttttttactgaatgaaccggatgcagatggttaaataagtttaggtggtctaaaatgatacaaaagtaaaaatacctatttcaaagtgaaaggtaaaggtagtccaaattaaaaatttagtaataaaaagctaatcaaaatgtaattaactcatttatatattacggaaaaaaatcgtgaatttataaatacaaaaatcttatgacgttaaactatataaattgagaaattaatggtcagaattacgaatgttttgacttttaaaacgaccgagagagcacaaaatttacttgaaatcaaagagagaataaatttatttattggagcaaaaccatttccttctctcctgcctccttgggctcatctctctctctctcactcttctccctcttctcaccaccagacgccatcaaacccctacctcccgcggcggcggcggcggcggcggccggcggcgagctccggacagacagaggagggcgcgagcggagagggcgaggagggaaggagggagggaggcgacaggcatggggaccctcgggcgcgcgatctacacggtggggaagtggatccgcggcacggggcaggccatggaccgcctcggatccaccatccagggcggcctccgcgtcgaggagcagcgtaagcaccagcatcttcccccccgctctcccttcccccctcgttaactaccgcgcaccacctgctcgtcttcgttttcctcctcctccggagaggagaggaggaggatcgggcctgcgaggtcgaaatcgtttcgatttcgttgtcaaagtctttggcccaatattgggagagttcgtcgctctagttgttgattaattggtactagcagccgtacacattcttcacaacccctttgtggtttggttgttattgggaaggggaaacgggttccttccttcgtgtgtattcaagtatcgtcgtcggtgattcgtcaagtgctgcatttgaagttttcgattagtgattctcgtctgtgtatcgaaacagcagcaagtaaatcaaagatttcacttgcacataattgttattattgtggttatactgaccaattggaatgtcgcattggcatgccgatttcgagtgtttattttctgttccctagcatcatgaagaatgccattttcccctctagctctagttggggtgtgttgctgtagttggttctgattaatcatcaccattctgcaacaggcaaatggccagaaattagcgtagatatgaatataggcacattatgacgagggggggcatcttttgttattttttcgggtgttgtgcatttagcttgatagatcagtttacaacttcgctaagtgtatgacttcttcacttagatacatgaattttatgcctgatcctgagtaacatgttagcgttttttgtatgccattgtcagtttcaaggcatcgcacgatcatgaacatatttgagaaagagcccagagtccacaaggatgtttttgttgctcccagtgcagctgtgattggcgatgttgagatcggacatggatcctcaatctggtacggctccattttaagaggtaagctctttgtcaataaacactagtattgatacatgtgctactaataagcatgggctttgtcttgataattatatatctcacctttcttcttggcaacaagtatgtttactgtgcattttgttttcagagtaaacttgcttctaactgcacttcatctattgctatggtatatagaaaactgacataactgccagttgtcaggagatgcacagttttatcaaagcacaccatgttttcattgttagactctcaatcgacacttcgcatgaaacttcagttttttacctttattcgacgaagtgtcaatcagggtttatcctaccgctagtagactatttactgacctccggcagtagcacgattaccgcaacaaattcgtattccaaattttgaactccctgcagtaatacacggttacgtgcggtaaccactgtgtgtcgaagctggaagaaaaagaatgcaggaaaaattgtaaaacgtagtaagaagtaatagacttgtatcgtagtgttaagtatttgtgctgtcatacttacttggttaacccaagcatattgatatttttaagtttcagtaattataatgttgaagttgtactgtagatatttccagtgttcagtgataaccattttagctccttttcgttgtttgtcctcaggtgatgtcaacagcattcatattggatctggatcaaatatacaagacaattcccttgtacatgttgcaaaagctaacatcagcgggaaggttctcccaaccataattggaaacaatgttacaataggtcagtagagcacttcctatcttatttcgtaataattttggtacacagtttacactgtgatatgctattgatattgcgatttggtttttctggaagacattaatcacgtggcatcgtttatacatgatagaatcggatataaattgttttcattgcagcgttgtgattgattcattaactaaaattctgaacttcatttttccttggactactcactgtgttatgctcccaactaaactaataagcctccaccaggtcatagtgctgttctgcacgcatgcaccgtcgaggatgaagcttttgttggtatgggtgccactctgcttgatggagtggtcgttgaaaagcacagcatggttggtgcaggatcgcttgttaagcagaacacaaggattccttctggagaggttaccttcttattctcttgctaagcaagttttcttttttttttctttttcacttgctatatgggaaatatgcactcaactgccagcattttgtaatgagggaattctcagacactgatatacgatgcttacaatcgttctttgttccacaacatatctaatcgtttggataatggaattgagtgattccaaggtagaggtttagtctacatatttatttttccaaagaacaattactttaaagttacaatgcattgatgacatatttacatgaatctgtgtagtttttctttccttatttcaaaacctgtaattggggactggaggataaccaaagtaccaaacaacgctgcatgtttatactgatgtccatattttacgttccatgctattgctatgaacagctgcgagacttgaatatcttttggtatttatattgtatataacttaatatattacatgactttattgaaccatatggtttcttgacactgctaggtctgggtcggtaatcctgccaagttcctaagaaagcttactgaagaggagatagcgttcattgctcagtcagcaacgaactacatcaatctggcccaagtccatgctgccgagaattc

SEQ ID NO: 69731 - DNA, 900 bp, Oryza sativa
gtgtaactatactaggttgcttgcttaatcaacttgaacaatataatggtctacgcacaccagatcagtggtaacctggttaaggtcttgtctttagtgtaacctctctccttctatcttctctaatatgcaatagatggtgaacactcgcgccagtggaagtggaaacaataacaatgaagggaacccaactcttgctcaagtcctggctcaacagactcagttaatgaacatgatgatacagcagatgcagaaccagctcaaccaagggaacaacaatgctccaccgccgcagaacaagttaactgattttcttcgtgtaaggccacctaccttttctagcactaccaacccagtagaagcaggtgattggctacacgctgttgagaagaagttggaactgctccagtgtacggatcaggagaaagttgttttcgcttcacatcagttgcaaggacctgcatcagaatggtgggatcatttccggatgaacagagcagaaggacaaccaatcacttgggaagagtttactgaaggattcaagaagacacacatacctgtaggagttgttgctttgaagaagcgtgagtttagggccttgaagcaaaaggatcataccgtggcagagtatcttcatgaattcaatggcacgttatgctccagaagatgtgcgtactgacgaggaaaggcaggagaagttcttggaaggcttaaaggatgaactgtcagttacgttaatctcccatgactatgttgattttcagcagctggttgacaaagcaattcgacttgaagacaagaagaacaggatggataaccgtaaaaggaaaatgattgtattccaggaggcacaaggtagtagccagaggcagcgtatcaagccactccaaattggtgaat

SEQ ID NO: 69732 - DNA, 1500 bp, Oryza sativa
atttttcatatttgtaaaaaatttgaataaaataaatggccaaacatatatacaaaatcaacattgtcagacattaaaacaagaggcagcagttaaattgcaccatttttatcactgtttcgttttagttatattttaaattttgtttatgtacaaatacgattgagtttagtctaattcttttttgaccgaacaagggaggcccttacgactattttttattaagtaaaaaaaagttcttgtaacaactgagaaaatgaaaagaaaataaattacaacttactgctataagttaacatgccattgtggtagtttagtctaaaaaattataacaagggtatgaagcatgtactttcatttacatttagtaattaaaaatacaaacaactttgtagttgttctactagtagtagaaataatgtactagtagtttagtcgcctaaaaaaaataacaagggtatgaaacatatactttcatttacatttaataattaaaaatacaaacaactttgtagttcttctactagtagtagaaataatgtaaacactttacctttattttttcatgcaatagaccatatctatttatattaacaactcaattgctgttagtagaatgaggtgggtataataattgtttagattaccagtataattcatggctcgatcgaatcgtatctactaatagagggcactataaaagtaatttaaaatattattggcattgtcgagtaaattaaattcatatgtatagttactaacttaattactatatgaaggataaaaaaggggaaatttgagaaaatagtttgtaaattcatgaaaaaaatactagagatagatgtagacatgaattaccttttatcttgcaaatgcgtccggatagtttcaaggagtcgatcaacctcccaaacatccgaagactgatgctgatgttgtggccgcagctgtgacagcatgtcggtgaggatcttcgtcatgtcaggcttccggggcgtccgcacgaaagcccggcagtcgaacggcgcatccaaccgccggccatgcagacgatagaattctgtggccagcgtcgtcttgccaacacctccggatccaacaatggaagccaccttgagcttcggctcgccgtcggccagccaccggacgagcttttgcatcgaaatatccctaccaacgagctggccgtgcacagcagcgtcgtccatcccgaacgtcagcgacagaaaccggcggcgttcgttgccggcggagtcctcgcgatcgtcgtcgtcgacttcttctctcggcctcgagctcgaggtgcgcctgccaagatggtagctctcctggcggcgaatggcctccttcacgcgggcgctgaacagggtgacctcgtcggcgatccaccgccgccggttaagctcccctcgaagccgggcgatcatgctgctgatcatcttcttggcaccagcagtgctactgccatcgccgccgccgcggtggtggaggagctgggtc

SEQ ID NO: 69733 - DNA, 1747 bp, Oryza sativa
gcgagaacgagaacgatcgaacgaagacaagcgagaacgagggaacgaacatgaatgagaacaagcgaacgaacgtgaatgagaacgagcgaacgaacgaggacgaacgttaacgtgaaatgcaatatatatatatatatatatatatatatatgttacttcgcatttattctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacatatattattgactacggaattggtgtgactcctagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattaaacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtaacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagt

SEQ ID NO: 69734 - DNA, 11955 bp, Oryza sativa
caagggcaagctatgatggaaagaaacaaagaaaatgccggcaagaagaagtcccatcaccacttggggtcaggaggctatagtgtcgcgatgccgaagagggagcagatggaggctagcttgattgagaggggtatcgaaccggcaacagccaaatggccggaacgatcaaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagttacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccatttcgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattttatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccaactccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtatgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcagagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtatgaacttgctaagtgtttcatatgtaatgcatcccacgcacattgcagattccactgggtgcttttactcttcgacctggatgcctgcaccgtcaacgtatatgactcaatggataaaaaagagtctacgtttgacaaggttttcgaacttatagacaggtaccgtcataagttcctttgttaattaagaaaatcttgttatgttaattgctactacaaatcatagctttaaactccatgtagggcttggtatcggttccgtcatttggtccgcggcaaatggagagaaagacttaggcggaagttcaaatttcctgtgagtacacatgctctgcatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcgaagtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgttgctagctaggacatataatggattgtaattaatacatgactacatatgtttctatatacatgtgtacacattttctataatgtaaatatattttggtcatatatatatctatatacatatgcatttgcataacatatatatgtataaatacatatatattatgcatgtatatacatataatataatataatatatatatatatatatatatatatatatatatatatatatatatatatatatatatatatatatatatatatatatatatatatatatatatatatatatataaaccatgcagcaacaaggccatgcaaaaaaaaaaggtcagctcgatctttagtcccggttgataacaccaaccgggactaaagatcgatctttactcccggttatttcacccgggactaaagataacgatctttagtcccggattggtactcccggtttggaaaccgagactaaagggaggttacgaaccgagactacagagggtttctccaccagtggatgacgcggcctcgaggcggagcgatggcatggctcgacctcgacacggagcgatggcggtgcggccctcgaggtgaagttacaattcgaatctcccacctgtgcctatcgctggcacacaaatgcctccaatgagatcgctcatatgcctagtgcgcttctactactcctcgtgtgagacggatttcatccgaatataatttaacacagtataaaagaatgtgtgcgtgctacggtgtaactggcaaggggtttgcatgtattgtcggagaatgtgtgcatggtatcttgattaatgtgatttaaattgttcttttagtgtataaacttataaactccctccttccctaaatgtttgacaccgttgacttttttaaatatgtttgaccgttcgtcttattcaaaaaaaatttgtgaaatgtgtaaaactatatgtatatataaaagtatatttaatgattatcaaatgatagaaaaagaattaataattacttaaattttttgaataagatgaacggtcaaacatgttttaaaaagtcaacggcgttaaatattttgagatggagggagtatttggaaaggagggagtactatttaaggagtcaaagttgaatttttttctttttttcttttctttttctacttcggcggaggcacagagacgccaaggttgaggtattgggggctgaggctttgggctcgttctttttccccacgacgaacgggctccagccagcaggtctccaggtcccaggatgtgggcgacacgcagtgtatctgatggctaccaatcgccgtcaacgtggcctagcgagagggcaaagaatgaacagtcagcaccgggaaaacaatagtacggagtaggagtatatgatatgatgggagaatttaccaaattacaatgcatgtacatatagagtaccttttaccttgtaacctatactatgattttcttttattttcagttttgttcaatattagttaatcaagttacttaattagtttgctaattttgcttgcgtatatacacgaaagttaataaattacagtgcctgtgtgaacttttcacagtgtactccctccgtcaaaaaaaaaaaaaggcaaaccgcgggtttgcgtgccaacgtttgactgttcgtcttatatgaaatttttttataattagtattttcattgttgttagatgataaaacatgatgaatactttatgcgtgacttatctttttaattttttttcataattttttcaaataagacggacggtttggacacggaaaccagggtttgtctttttttgggacggggggagtatcctataacgtaaattttgcaatatatgacagtaattatttaaaattattttttctctcaattaaattcaaattcacactatatatttttaatatatgattatttgtaccctcaaaagaatatatgattatttgttattagtcatctgtgctttggaaatttgatcgcgttttaaccaaaaatatggcacatgatgaaatactgttagttccctttatcttgtgcgttggttttctcatccgagggcaaaaataattcgagcgatctaggttgaaaaaatgggccggctcccacccctgaatgcttcttggattttttttttcttttttgaactctctacgcgtcattttttcgatccgtcgaacagtgaattgcactctgatctatcttttatcatcaaagtttttctttgaatcatcttttaacatatcattttcactataagctaaataagattatatttgttatacattttagaccaccctaattttcttttctagttgtatctatcttctcatctagcaaaggacgattcaagtgtaagtcgaaaaaatcgccggtgtgcaagatgtgatgtgcttaaggtattaatgtgttcgagaaaatattttggataatttaaagtgtaacaaaggcgaaacaatctagaataaattgaaaagtttggttcaaattaaaattttagtaacaaaatgttatgtaaaatgcaattcactctgaaaacaatgcggttagcattaacaaccgttcagctcttaaaaaaacaagaaaacagaatccaagaagcgttcagtggtgggagccggcagctgtttctgcgatccgcctgtttaggtcctcgctgtccaccaaaaccggcgtgtcgtcgactcatggcttttgactgattttggcagcttgcaaagcccaaacagaacttgtactcttctagctgctctatctgaacttctcatcaaacacactgcaaacattacggtatctcttgcgttgatgtcttggtgatcgacaggatgcaaggtttggttcttggtcgaatcatttcagaatttaaattcggattttgattcttgttttgatgtttgcaattggacggtgaaccagtcgttttgatggtttctttctgctttcaggggaacaccatgaccatgtccctgtctacgagtcaggcaccgaggtgagaatctgaacaccaactcagattcgtctaaattttttttaatctttttccagtaagaaaagtaatgttcttgtagagataattagagcagagcacatcaacctcatgctgtgatgattctatgagtcctgaatattttctttcaggtgttccaaaagcttcaggagaaatggaattccaccaagcacaagcgataccgcgcgatgtactccagcgtcgtcggcggaatcatcctcgatccatcgatgatggtcatccccatcgacgatcacatggtccacagaggccatggcgtcttcgacaccgccatgctttccgacgggttaagcttcgtcctctgaacttttatctgaacatttgcttctgatgatgatttgaactttcataatacacgagctggttcttgatttgatcatcagacacatgcaaattcgctcatttggtactgaattttcagtggttcttgatttgatcaggtacctgtatgagctggattcgcacttggatcggctgctgctatctgcatccaaagcaaagatcagctccccattctcccgcgaaacacttcgcgccattttggtgcagatgacggctgcgtccaagtgcaggaatggctcgatcaagtactggctcagcgccggccccggcgacttcctcctctcgccaaagggctgcactgcgccggcgttctacgccgtcgtcatcgcgtccgccgccgccgccgccgccggcgggcacccgcggctcagggagggcgtgagggcgatcacgtcgacggtgccgatgaaggacccgttcttcgcggcgatgaagagcgtcaactacctggcgaacgcgctggccatggcggaggcagaggagcgcggcgcgtacgcgtcggtgtgggtggacggcgacgggggcgtggcggagggcccgatgatgaacgtggcgttcgtcacgggcggcggcgacctggtggtgccggcgttcgacagggtcctcagcgggtgcacggcgaggcggctgctcgcgctggcgcccaggctggtggacgccggcgtgctcaggagcgtcggcgcggcgaggatctccgccgccgacgcgaggaggtgcgccgagatgatgttcgtcggcagcggcctcccgttgctgcccatcgtcgaatgggacggccagccggttggcgatggtaagtgatattcttcagaatcaaaatttagtataatttcgcttgaaaaattcatcaagcagattgaagcatctgaatatatgcaaattattctaattttacaacttgcaaggatgcagtactgactactttgatcatttgttttgctactatttcatagttttttagataatcagtgggaaataggagtacttgatagactaatctctgaattttttttgtttgttgaattgcaatcgaaagaattcaggatatcgagcctctggtggtgttaccctatatatctgcagctcatattcacagcatgttctataagctagcaattcatatttctcaaacaggctaacaattccaaattataaaggacaaaattcaataatctgttcaattttcattatgcaggtcaagtggggaaaattgcccttgccctatctgacatgctttgcgaagacatcaaggccggtctcgacagagtacttgttccttatgatcaagcgagctagacgacgactcatagagctttggaagatcaactttgtataataataataataatgtaatacttccatttatgtgaacgaaatttttccgtattatgagtggaggatccgtcacattgacagaattgaatatagacttattttataaaatcaagttctacgcttcattccaaaagctaaaattttcaccattaattcctaccaaactgggagaaaattatagaacggtcacccgattcaaagaaaagaaaaaagaaaaaatcggatgataaaatgtcgcaattgactaacaagtgaaacattgacttatatatggtgaaaaagaatcaacaactgcaacatttacaaaattaaagcatttaaaattttgtaaaacattgtgaaaacacaccttaaaaagggtcactatcatatatgaaacaatgagttttaacaatttgaacatatttttttattaaaatataaaggataatttcgttgttgcccatactttaatgtacaatattaattttgcccctattttttattttcgtttttacccctactgttttaaatgaatcaaccataaaacaaatcaaccatttacccatgttccgttaattcttgctaatagtgttaaatgtgggggtaaaaagacaagtatagtcttagatattttcctttacttttgacataatcaaaatacaaatctattgatgccatactatagcaatgatttaatttatcaaaaatttgtgaaagtttgccaaaatttgggttaaaattgaaagtggtgtacaaaagtaccaagaaaatatctaaggtatacttgtcatttttaccctacatttaacaccgttagcaataattaacagaataggggcaaacggctgtttcgttttaaaaaagtaggggcaaaaacgaaaacttaaaaacaggggcaaaaacaatattggacatcaaagtagggggcaagaacaaaattgcccaaaaatataatcatgtgatatttttgttgtaaagatttagttgcaaagaatataatggtgtgattgaatcatagatcggatatgtagtttagaagaaaaaaaatattttgaagatcactacacgtatgcatgcatgaatggaatggaggaaaaggaaaagggaaaatttggaaaaatatgacgtagtatggtaggagagagagtaagaacatgtagttgtgtaagttttgtaaaacacaataaaaacatacactgaaatatatcaccatagcatatgaaaactaagttttaactgtttaaaacatatatttttctttcactaaaatataatcatgcgatggtgtaatcgaatcgtagattggattattagtgtaggagaaaaacattttaaagattgatatttgtatatattgttggagcaaaggagtagtagtacagtagtacatgttttatttttattggagatgagctctcgaaaaagtttcttaggatcggtagaccgattagcattattgtgaacagtatgagtgaaaattctgcaaaattatgtgaaattcatgtattctggcggcttgtttggcaacttaagtgaaaatgattgtgagtttagatgagagaattgatggtgagattaatatgagaatttgatatttagtctcaatatcttgtttgatagatttggtgagaattgacatggagtttagttggaaactagatcttaaatgaaaacagatcgcgaatgcttgtaatcgcccgtctgaccaagatggaaaaatcggacaccacaccgatgcctcccacactatacttgctcagtctagaaaactttcgaatcagtccaccgatatgataaatttatcgggtgcttctacctgcaatcaactactctctcattccaaaagtctaagtcctatttctttttcatcaagaccaagaagcaattaattcattcactatgtgataaaaccaatgaacatacaaccaataagcattaaaatggcttattgggttcctatcaagaatttaatttagcacatgaagactacaaatatgacttagatttttggaaaaactaaaaaataaaataggtcttagacttttggaagaagagagtaactgctaactcaattgtattaactattcatttcgaccatacatatgcatgtgtcaatcttcataatattttttctcctaaactacttatccgatctaaaattcgattacaccgttgtatttattgaattaaatctttataacaagatatcacatgattatattccgattaaaaccattagtacttcgtctttcatacgttatagcgacatgtttcagcgtctgtttttattgtgtttcacaaaattcacggaaatacttgccactgccctcccatctctctccacacatcaatgattgcatgcatgcattttagcgatttttaaaatgatttttcttctaaactacttatccaatctatgattcgattacaccgttatattcgttgtaattaaatctttacaagatgatatcgcacaattatattttgatgaaagaaaaatatatgtttcaatccgtaaaatctcattgtttcataagtgatagcgatatgtttcaacgtgtatcttcaccgtgttaaatctcattgtttcataagtgttagcgatatgtttcaacgtgtatctttaccgtgtttcataaaagttttaaatgtttcagctgctgtttttttaccgtaaataagttaatgtttcactcgttggtcaacttcaacatttgtttcactcgttggtcaactacaacatttgaccgtccgattttttttttttagagatcaggcgtttgatgggtagttttctccgaaaacagatgactgagatttgtttaggtaggataaaggtgaaattccctttcaattaccagcacattgaaaaaccaaatagaatcctatatccctctaacctttcaatcccttaaaaaagactcctatcaaccaaacacacccgggagagttgaaggcagcagaagtttttagcgggctaatcggcctgatttatgggcccaaatgaagcccactacgaccagccacacctcctcttcttctccgaactctcaagtctcaactcgtcccccggcaaaatcccccgtgctagggtttccgcaaccgcctccgctgctacccacccaacctgcattgcgacagcgacgcggcgcggccatggcgacggcggcgaagggcggagagaagccggcgctgaggaagccggtgttcgtcaaggtggaccagctcaagccgggcacctgcggccacaccctcaccgtcaaggtcgtcagcgctaaccccgttcctgcccgtggccgtgccggagggggcggcccggccgtcggatctcgccccgcgcgcatcgccgagtgcctcgtcggcgacgagaccggggtcatcgtcttcaccgcccgcaacgagcaaggtgatgttgcctttttgactttgcgtttctacgagtttatttgatttttgcaatgtttgttatttgttaaattttgcaatgtttgttattttgcggatctaacaagagccgtcaaatatgttttcagtttaataattagtgaattaccatcgctttttagagtcaactggataacatgttgactcatgactactacggagtacttgatatgaccaatcgcctgtagtcgaccaatccagactatgacattacgcaaattgacatttggaatatcacaagtattggtgagtcaccaaatattgatttgtagttgaccaaccttgcagcttcaggactcataggtggctgccattgcgcattttaagagaactctattcataccatagctagggttcgattcgagaaatgcaacaactcctcttcttttatctagtacggaacacgacaagagagagtgctctttccttcgaaaaataccaaactgttcagtcttttgaagaaatgagcaggtggagggtgggaaattttttgtatttcatggatttgggtcgaaaggtgttgtattgatggaaattttcttacgttttattcttaagagtcaacctggcagtaatcaatttagggaaacgggtgtatgaatagatgttagagaaaagtgagaagaaaatgggcatcacactacccttctgaccatgatagcgtaataaatcactcatgtggctatccttattgcagattgtcatttgctgcatcatcatacatgaaccttccgttagtggcataatttggctaatagtaaattcatgcgggcctaccaaa

SEQ ID NO: 69735 - DNA, 6554 bp, Oryza sativa
ttatattatgggacggagggagtactgttcagattgtaagtattggcaacttatattccctctcttgtctcaaacggagatggagggaggcactcatccttagcgtaaggacttccagtgtctggctcctttgggactgcctccacccaccagcagtgggaccctccttgccatgttcctactaacctttcctccagtgttttttctagatttgattttattttcttcaaaatcaaagccactagagagggagatgggcatgcacagtgagcaccagtacctagtactgttgtatagtgagcctgtccctcctctcatctccctcctgttcagctatgaacttttaaaggctgattatcagcttatcacctttctctgtcccagttacttgacttacttcatgtcttcaccagatgacggtggtggtagcaactgcttatttattgtctctttccccaactatttttttagatattatctcttattattgcctccctcatcgagggctttgatggatgcttgagcatactgtctaccaactggccatgttctggctagatatgagtgtcatccacaatgtcaactgatcaaactgaattcacgaagggaaaacactgccagggaaaatagccatgcaatgtcggctgctagagaaagcagtatagcacaaagaattagactgggaggaagagcattggaaagggaaaattgataaattctttcttcattgctctgcaatatcaactctatggcatgctttatagactagttgctagcactcagtaacaactcatatgaatagcaaagataattagccaactgacagataactgaactaactaacaactcaattatactcttctctataaccctaatctcccaattctgtggttgcatacatgggtcttggaggcattgatgttggtaatcgatcagatggttgggtatgccgaggtgttccatgccttggttagatgaatgctggagatttcaatcaaaacattcagcacaaaccagcaagcccagttgcttggtgttggtggtggtgattaccaaggactgacagcatgctttcaacgttggctcaagattcatcttttgtcttgtacttttagagactgctgtccctgttgtaatgtgctctctggtctgtgtgatgtgtgtacttgtgctgctattgttatcctagttccttttagggatctctctccccttgtttagttttaaaaacacttccattgtttctatggtctgattttgaggtttctctctaatttctacttggtcaagtatattgttgaacaacgtgtagtgggcctttggctgttaggcaaactagatctttttggcagtgtgggctgccgatttagtgttttcacattgcctattcctaggacacggtctaaattctctgtgtaggcctgtagggaaccttggtcatataattcttgtggctgcagtgcgcacagcctagattaatcataacttaatataactataaatggttagtatttactttggcagtatcgggtattaattgagtatttgagttagctacctaaaggataccttggctttatagctcattttaattaaaaggtggggatgaaaattcaagttgttctgaaattgatttatttgatataccatttggaactcgttccattcgtatggtgctcaacttttaatctctttcctttagtgttgggggtatgtataatgacctgaccctttcaggctgtatatttggacaaattccttttggcattccactcatgagaagttttccattcttattgttttctgaatttttagtgtctaatttgagacacatggttttttattcatttctcagcataccatagtaggcctttttaaccgttttaagggcaaatgaaaaaaaagttaacctctctttccaagaaagcctatcttttaaggcaaaatggaaaaaaaaagggtaccatctattttccaactccctctctacggtgtggtgtaagaacaaaaatagggttctgaaaaaaaagatattaaaagaaaaggttgactttcaaaatcaattttgtgtgtagcggaaaggagttgctgtttcttctttttcctatggaacatctactgataagaatatgaaattgttaatagcaagtaattattgccttgcatggtctaagtctatggatataccaaaaaaaacgcttatacaatttcatctacttggctgaaatgtggatcaaaattggtgtttttctcacttgcataagcacaagttaaaactaaatgctgaccttaacagatgctggacacttatcccttttttttccaaagtaattggatggcatgtattttggtgctacagaagtacttaaaagaacactaagatgaactacaattgcactgtataggggaagcagatttggagatttttcgtgcttttaaattttagtcactaatctctctttcgagatatgaagttttgaagtgcttgagctcatttttttgtgcttttggttctacttttgcagtggacatgctgatgccaggaaatacagcaatcttgcggaatgcgagaatcgatatgttcaagggctcaatgaggcttgctgtcgacaagtggggacgtgtggaggttacagagcctgccagtttcgccgtgaaagaagacaataacctatcgcttgttgagtatgaattggttaacgtgccagagtgattgttccatcaaagtttctactgctagcataaaaagggaatgccaaacttgtagtgatttttgtttaaaagatcgtaggaggggctatggcgttttgttaagagttctcaatcagtgaaattcatataaaatccttgtgtgtgcacccatcaagttgcttattctcgtgacctgataatcgtattgctgctagttgtgggtgtgattaccgaagctgcaggacaggcaagatgcaaatgcaaccgtctcagcaacaattttctccggcttttactctggtttatgaccaatactgtcgtgttacattacctaccgtctgcaagcaagcaggggtatgttactacagtagaatgacatgttagattgctactagtacttgctagtagttggctacagcatcttgctcatcctgcttagctgaaaggcagaagcaaccaagatcttaggccaaaaggcagtgaccagccagccggtagtgtacagcagctatgctcgtgaaacgcaattgtcacatccccttggcaaccaggcagaatagccaaagtttcttctcactcacggaagcatccatccaagtgcgcacgcgcacggtaaagaaggtacacgccatggacggaccatgtttccatgtaacattgtccgtgaagatgccattgccagccatcgtcttatactcttatgatgcgatcgatatatccgttgcaaatggagttatctgagggagcctttgtagcagagattggtaccacgatctactattttcatcctacggaggcggtaactagtcataccacaaattgtttggaagaaatttcaagcagaggtactccctccgtcgctaaatatttgacgccattgacttttttaaacatgtttgatcattcgtcttattcaaaaacttttgtgaaatatgtaaaattatatgtatacgtaaaaatatatttaacaatgaatcaaatgataggaaaataaataataattacttaattttttttaataagacaaacggtcaaaaatgtttaaaaaagttaacggcgtctaatatttagggacggagggagtaaaaattagaggagaaagccagccgaaaatatcatcaggatcagcttaattccatagcacgataacctgataagcatggatcgaagttggaatcggataaccccgatgaacagagcttagcttcgcccttgctaaaacaaccattttatggggaggttacttacactgatcatatcaattagctgaattctcctgaaatgtttacatacgcataaagttaaaatatatcgttgtagaatgtggttagcactgctattagagtttatgaattgagtacttctatgaacaaatgagatgtagtatgtttttttagataacgaaaaatattacatttccggtctctgcactattgcaaccggacataaatcacatcaataggactgtagggaagggacacatgtggcatgttcgtgatccactaaggtgaaggttcatagccccaaatccgcagccgctacagtctcatgatatcagattgacaaatatgtaagttcattgactagattgtgggtacttaccataccatgtccttatgacatatcactaaaacctgcaatttcacactaaattggaacttttctaatgagtaaagattactagggagactatgggtatcaggtgtgtatatgacccgtatatccgattactataggaggagaccataactatggtatttggaattgtatatgtcttagttgctagagttttcctatcggttatgccctgcccatgacggcgttggaagtggagcaggggatgagagagtagagaagatagatgggagtagatcggatcaattgcttgtgttattcataaatcagtagcccttaaataggcttacaatgaactgaattaccgctaatgaggaaacaactaattaacttaatcctatccatgcaagcgtgatcactgttccttgttcggcaattgcggagctaactcatgagccgtcgttctaagcgccgtcctctgccatcttcttgtgattattgcgttcgtagaccataccgaccataacaagtagaatattacttcttatcgagagagtttgaacctgtctaaacctttattcgtacaattcattcactttaagacctcatatgttacatcttttattattgtcgatatagaacatcgataattactctgctcggttcctaacttctttttttttacgatcgcttccatacgttaagttacacatagcttcgcccattgacgatgcacatccagaatggatgtagtggccggcttttaatcaattttatttttttaaagaaatacgtcttcttacgtcgagccaagattctactccatcctccaggaatgtcgctgatgacgataaacaaatcccttcatacactatggttgttagtggatcgaaatatattatgtgatccaaattccaagccgatacatcgtcggtttgtttgctgctcaccatctttatcttgcttgtggtttacgtggcgaccaggctacaacaaaaatggagatcgatcgagacccatgactcatcaatcaacttaacagtggatgcctgattttctcagtagttgatggaaaacccaaaacccagtcgccctctctgacaaggacaacctcccatgctggtcaccgacgcacttaagtgccctaatcattaggttcacactacgagaggaacccctttagcaatacatatatgtattgaaaaagtgaaaataaacattgctaggctctgtatcaacgcatttaatatgcgttgcctatgctactgttgctagcaccaataacaacacatacacaatcgttggtaacatgtaagcataaacgttgctagttagcaacaaagtaaatagttttcagccatacttgtatgcgttggcagtttcggtgatgaacaattctatataatccttgcaatggctataatcaagttgcaccaacactaataagtattgcaatataggcaactattcattccagcatgcctttgcacaattatcttgttgggttagaggcccgtaaactcaaatgatgtacacatgagaaaaaccaagtcattcataaaactaattgtaattaaagagaattttttgtattacatggaaaatcatcctcataagtcatgacattaaattttgttcagaacatcatgcacaaatgtaatctaaactatagaaaaaaaacatgcatatgaagttgccactatcattgccaccatcttccacattacagtcatcatcatattcacaagggatctttagatgacagttgtccaccttgcagtaaccatattgtcccagatcatgatccatttatcttgtcaacttgtaacagaaaaaaaaacaaccattgatacaacattggaagaaagaagaccacatctaaagaaattgagaaatagcaccgtacaaaaattgctggccacgcaatatcaagtcctacgacattgccaataattttgtagcctttgtatggcctgatcatctagctctgttccttatggatgattggatagaacacaaacaattgatatataaattaaatattgtgtattataaactaacaaaaaaagagttcagaaaaagttatctaaataatgctgatgtatattatttttagagaaattatggtaccgtagtacggataatccagactgaaaagaacacgctcttacacccatataagcaagcaagcaagcaagcagagagcaaaacagagcagagcaggttgtgagccagcactgcatcagcatgatgagcagtcgtcttttcaaacgcgcctgcctcctcct

SEQ ID NO: 69736 - DNA, 5010 bp, Oryza sativa
gccgccgccgccgctggctcgccggagtacggcgtgtgagtgacttttggtctcaccggagtaaaaaaatcacatcacatgcatgcgattgcacgagcagctgtggcggatcaacgagacgacgttcaactttcgggcgtcgagcggccggttcgtcggcgccgggagcgacggcggcgcggcggtggtggcggtggccgccgcgccggggccgtcggagacgttccaggtggtgcgcgacgacggcgacaagagccgggtgcggattagggcgccaaatgggcacttcttgcaggtaatttatttaattaattaattaatcagataagaaaccgtgcgcactgacattcataatggcacgcgtgtttatgtggaagaagcactgcctaagaggagctacaccattgtacttcttttttttcgcgattacacgaaagacacacataccagggttggaaatttcggaccgaaatttctcatttcagtcccctccaatacgatattacttcggctgaaattttttatttttttcataaattttggtaatatttattcaaattcaactaaattttgtttaaaatattagaaattttggaccgaaattttcgaaatttcggcatttcggcgaggcccgatcaaatcggcctaaccgataggattaaccctggcacatacacatatctggtatgaacgcatacgtaatttttaacatgctttagaaaaaggaatgtgccaaaccactgatctcactaaatatttatacaaacgcatttaggcgtgtagtgttgtggacatcaatgttcaaacttttacgtggaaaatcatatactcacgacttcatcatcacaccaattctacctttttttaatatgcttttttaaataatgcatatatcacggtgtgaagaggcagagagtttttttctattatctgaaatcttggtttcgtatattatctgaaatcttggcttcttacttaatagtggtcgtatttaaaaacttaacatccatgtactcaatttgattaacacactataaagttacatggtgaatactaggcatcaccctacttcatattaagtgaacatgtacaatgtggtgagtacatgctgttgtacaatgcccctcctattacaattacaattactccttgttaaacaacacgtgacatttcggttaatttggcagatagcattgggatctaactcagtgacagcagattactacggtgaaagcacaagttggggagacgatgacccatcagtatttgtagtaacaaaagttttggagctgcagggagagtaccagatttgcaatggctatggtacagccaaggctacaccaatactcagggtaagatatctcacaacccaagggccccacttgtcatgaaaataggcttatcttcttgttgatacatagctaatgaatcatgatatagcatatacttacttgtttccttaattatatgatttggaatggtccatacttcagggatatgtctgttttgttttttgttgtatctgatgtcaatgtctataggggagaggaaagaaacaagaaaacagtagtagcaagcaatcaatgcaaccgatatatagcccggtgtttactttgagtttggaagaaattgtacaaatcctgacatgcatgtgagagatcagtgatcacatatgagttgcaaattgcatctatgctatgattacctcttgtacaattccggtgggccaattacaggtggaatagtgtttatcttatctgaaaggacctgaaatttactaggcatgcaaacatgactccattctaaacttttttctttttgataatgaaatttaatccaatatccgtgtacatcatcataaactacagagaattgaagcactcctgtgcatcccaaatgtgtgaaggggtctgttcattactacttggcacttgcagaattcagagtaaaattttcacatacatatgctgagttcagcttgcttgaacgaaactatcttgtttttgtcttgcgttctgtcccgtcaaagattgccaatccaaacactatgatttggtcccaattttgttgtcataagtgaaagccgaggccttagcttgtgtgtctgaatgattgagggaaccaattcattaaatgattattggcactggtcctatatatgccaaacagtagcatgatttctttttctgaaatttagtaatagacccagcaaaatcaatgaaaatatgtttgcacgattatggttgctttgtactgatgaattgggatcattttcacttcagttttgtgaatcaattatatattattttctggcagaatcattggagcacatacatagtcgaagacgacttcaagttcatctcagcaagcgggttaacagcagtgcgaattccagttggatggtggattgcgagtgatcccaatcctccggctccatatgtcggaggatccctgcaaaccttggacaatgccttcaagtgggcagagtaagtcttcacaaaattaaatcacaattttgtagctttaaatcgactcaagtaaagtaaagatcaacaaatgttcagatcatgagctaatctgaacatttcagattgtgaattcgttgtaaggattgttatgaatattcagattgtgagctaatctcttgtatctgaatataggaagtacaagctgggcgttattattgatctccatgcggctcccgggtcgcagaacccatgggagcatagctcatccagagatggcacgcaggagtggggaacatctgatgctaacatcgcagagacagtgcaagtgatcgacttcctcgcatccaggtcagggttctcatctttcacaagggaaatttttctcaccagtgccaaaatcataatttaaattgttcaaacttttgtagtcactaaatatttatagatcatttctatgccagaagcaacacactttgagaattttcaaagcaaattggcagatttcattcagtaaaaagaaaaaaaaatccattctgaagtgatgagcatgttgatttacaatggacagaaatattcagagttctggaaatttcagatatttcagtccgaatcacaaaccttttcaaggtctgctactgaacagtgaacagtgaggcagatgttgtaagataatgaacagtaagccagatatcgctgccatgaatttccttagatatttcaggacagcagatctttcattagcatgtagtctagcagtgaatcaaaacatacagaactgcggaactttaagatgtttcagttcaattcgaatcacaattcgttgcatgatctgatactgaacagtaagccccattttgtcatgatgaatttcctcgtactgttttaattcaccttgacgtcaataggtacgcaaagagcccaagcctcctggcagtggagctgatgaatgaaccgtttgcaccccgtgccaccttggagagtctgatgaagtactaccatgatggatacaacgccgtcaggaaatactcatcgacggcttacgtcatcatgtcgaaccgtctgggaccgcatgatccaactgagtttcttcaatttgccaacggcttcccccgtgccgtcatcgatgtgcactactacacggtgttcaatgacctgttcaataacctgactgtgcagcagaacattgattttatcaaatcaaacttctcaagtgagctaaaaaatgtcacaacacaaaatggccctctcacctttgtgggtaagtaataattctttttgggtgaaaagagagctttattaattactcaagaaactggtataattattttgcattaggattcctaaaaatttctaaaataatggtagtaagcaatctaacataatatgagatatgttcttttcctgcaggagaatgggtggctgagtggagagtacccaatgcaacaaaggaagagtaccagagatatgcaaaggtgcagatggatgtttatgggcaggccacctttggatggtcctattggactctcaagaatgttaacaaccactggaatctagagtggatgatcaacaatggctacatctccttgaaaacctaacaactgacatgcctctagctgccattgttacgaggtactggctccgtcccaaaatataacaatctaatagacatagattagactttttctattaataaaaatctggatagaaagtatgcccagatttattataatataatatatctgggttgttatattctcgaatggagtagccaaattttttgagacgaataaattgggccacatagatcagtgagattttaccgtaatgggaagatgcaatgttttgttagaccacttgccacctcactttttagtatcagaatatactataactatttctgcttgacataagcgcataccatttgcacaagaagtttgataacacaactaagaattcatgggatgaaattatgaagaattcacaaggtatctactctagaaaaacggttcataaataacaaaactctgattaaagtacactgaggccatccaaatgtgaattatcataattacacatctgcatgtcttgtttccgggaacttaataaattaatctacggccgtagcttgaaatccatgctgaatatattcttggctttcttcaacttctcccaaggaaagccgtgaagaaaaaaaaagggtaaaaagaatgttttaacttcactctgtattatataattgatttattttggttaaattgctaatgcgcatcaatcagagactaccttatcttgacctgctgcaactttgttgcttttgctcgtaatgacttcataataccatctatcgctggtttcctggttgaacaggaaaattcagacaaattcattattccaattataaatccatatcatatccgtaactcaaataaattaacagaacttataaaaattgccccaaaaaaatgtctgatcaacatactctattttttggttcttcccttgtttttgctgatttgaggtgccacctaatgcttcctgtgtt

SEQ ID NO: 69737 - DNA, 43766 bp, Oryza sativa
  unsure (1)..(43766): unsure at all n locations
cacactgtacatagtaaaacattttcagttacagcacaagtgtcaagtgtgtgctgcagatagaagcctactactaccttgaggtagtagcagccaacgaggagacctccttgttggtggaggctggctcatcgtctccggcgccggcaactcgcgtcgcggcctcctcgtccgtcgcgccggcgacctgcgccgtctcctccgccaccttggagcccctgcttgcaagagttttctcagtgatgagtagcgatatcgtcacagctgattgctactccctccatcccaaaataaatcgatgtcttatgtgtaggtttgtggccagaaaataatttattttaggatgaatgaagtacgtatcttgaggaattttacttcctttggaaaagtatcttgagatacctaaattttatactacattttttatacttttagatatttagtacttattagagataccaaattttaactaaaaaatatcgtatctctaggtaccttcttaaggatggtaaaaaatttttgacgtaagttaaggatggtaaaattacacatgtatcttatgtgcatgttcagaaggaatggcagatgaagaatgaaggcttacttgtatgagtagatgacaaggccagctgccgtgccagcaaaagcaacgaaatacatccaatcaacctgcaaatgctcaaaatttgattaaacaagatcaatttgaattttaagatttagtattggcatgactgtatggggggaggaattgttgttcagagaccttctcatggtaagcgaagatacggattagaacagcccacatgtccgaggtcaaaagggagagattgagcatagttgcaccacatatctgaaattattggagtaaatttagtaacatgcaatattcagaaatgctgtgaattttcccacaatcatggcctgtaccttcaatataatcggtactgttgagtagaacaagaacattgctaccgcaaatccaatgaaaggtagaatctgaagaaaaaaaaagggtccatgaatacgaagcatggcttaacttgacttactgcctacgctcacgaccaacaaccnanttantntncntntncnantnctncntntnanntntcangnnactngctnggngcctttcaacaccccaaccccaaccccaaccacgcgcaacacctctaagacgacaacttagaacctcccataagagaaaacccgtgggacaaaaccaaacccattaaacaaacttttttttttaaacttttcccacaatctgagaaaagaattgactctgtgcgccaccccattactcaaatgtgnncctcgagtaccatgtatgaaagggaggagatcgacttaccgcaccagcattccattcggttgaccgaagttcttgtcgttcaagtatgcttctgtagcagtgttaaggaaatgggatatagaagcatattttcttgctatgccaaatataaatcaggtaatacaaagtacaaaatagttacagatgggttggtagaaacatgtcccagtttcactggttcattgttttggtctcgttgctattcaagtaatttcccttgttttaacttctagtaacatggagaggcattcttataatattcttagtttaatcaaactacagtggaaacaagtcatcacttaactaatccaaaggatacatttgtataccacttataactgctccaaaaacgcccagcattgccatcacctcaattctgctgcttttcttgacaaagtactcctgaaatgttgtaggcaaaacatgcaaggttcttcatgtgcattacctaatttagttttatgcttaatccgatgggctgtcaaggctaatatttgaagtggtaattatcatatctcaaagaacatgttttttgccgggtcggccgaaagatttggtcgaccaatttcattaaaatctcaaagaacatgtgaaaaatctagaactgggagttctcccctgtgttctgaaaagaaatggaaaataaatagtaataaacgaactatagatttgctattacctcggtaacattactgacagcataaagcatggccccagcaatgacaaacaaatcacctttcaaggggttgggtccttctgcaagacactccattgtgtaaggtcaacatgatttacttgttattcttttactgacaagtgcaaaatactgtattttctttataatctatttgccacatttcagaagagctttgtgcctttgtgctgagaatcaagtacacattgcaaagactacatgaaacagagcaatgcagcaccaaaataaaacgcagaaactgaacagataacggcatgccaagcagatgtatataagtgtataattgtgtgagttgagtaaactttcattggaatcatgttcttacttgctctatcagaggcatggacatcagaaaatactaccaatataatgccagccacacaaatcacaacaccgatgaacttcctcaatccatactttgtcttcaagaagacccaagtgaggagaatgacacacgggatcgcccagcaatcgatgagcatcacactcgttaaggatgtatactgataagccttcacaactgtgtgaacaaatacaagtcaagtttagaatcttcacatgaagttactaactaaaaagaagctccaatctcagtaagaaattcagattacatcattttcactaatggtagacatttaccaatatagttagcttctacatcaacgatgccaaggatcaagaagtagtaccatttaatctgcagaaacaaaatgcagaaaacatttcaagctccatgctgataaaaatattcagattgctgcattgcaatataataccgtggtgacaacgaaacagcctcagaaacttttttttttagagaagggtattttttacccggcctctacaaccaatcggatatatgcagcctttttaaattaggaacttagcctatcaaacagcctcagcaacttgcgaagaacataatcagaataagcataaatatgtttggtaacaaagtgacttgtcattggtcctggcttggggataagatacgctaaatacgcaacgtacatgcatcaatcatacgaaaaaaagaggaacagcacaactcaaaataatggtcctagggaataataatctgaaggtcaggccagggcacaggacatgtgttgttaaacaccataatagcttattgacctttggtttcaccatttccagtctccagatatcaaaatcataaccgaattttgatctaaaaaatagccaaaattgcatccaaacatttcttttcagggcaaaacgcagcaggcagacataccgtcaggtgttgccttctgtagatcagtatcccaccataaacaagcgcaagaaggacgtaattcagcagagactgcgaagttggcgcgttgacgcctgaaaacaatgcgcaggattcaatctcataatcagaacttcgtaacccaccattcacaactctctatatctgaacatggcatggtttgtaacaacataataattttcaaagattatgaaattcgaaacatggtcattcatctaccaagaaaatgaaaaaaaaaagaaccaaaatgaccacgtataatacaagccaattgcacgaatacattctgaaccaaaagctcatcaaaactgaaactgcaactcatcaagaacccaactattttcagagttcagattgcatgaatacattctgaaccaaaagctcatcaaaactaaaactgcaactcatcaagaacccaactattttcagatttcagattgcatgaatacattctgaaccaaaagctcatcaaaactgaaactgcaactcatcaagaacccagctattttcagagttcagatttcagatagatcgataccatcataccaacatccagttgttagtttcaaacaaaagccctatcgagcgaatacgcgaacatcatgcggcggcggcggcaagccgtacctcggcgggcgagctcggaggaggagaagccggtggaggtgatgagcagcgagacgaactgccccagcgcgagccccacgaacacctcccgccgcagccacctcgccgccgccggcgccattgctccctctccctctcctcccctcggagacttctcctcgccgtggacagtggacaccaacgtcgccgtcgtcctctccactggactcacgccaagccaacaagctaatgactttccaaaacaaaaatgcttaactacttggcctatatatacggcgcttcgttgccgtcgttgcagtgtgggccccgccgccgctaagccggccggtgtaggctaattgctcattttaattactgttccttctatgacggcattaacttttttaattaccattcgtcttattaaaaaattatgtaataatatcatttattttattttaacttgatttatcatcaaatattctttaagcaatggtataaatatttttatatttaaaaaaaatttaaataacacaaatgatcaaacgttatagtaaaaaaaaaataacatcgtcgtacattttttttaaatggagggagtatctttttcgctgcccccttgcattgtgcagctgtgtaaactgtaaagcaagatatttttccatgcatttgatttgagccaaagacatactatatttattttttaatgtataacgttgttgattttttaatcaacatttgactatttatcttattcaaaatccttgtgcaaatataaaaatatttaaatcatgcttaaaaaatatttgataataaattaagtcacaataaaaataaataatagttactttcttttgaataaggcgaatgatcgaacgtatctcaaaaggtcaatgacgtcatacattaaaaaataaatgaagtatcaaatatgaaccgaatttgaagtgaattcaaactttttttcgcatttcagaaacaggctgatcatgtcatgccagcgctcaggtttaagctttgaacggggtggattgggttttggcagaagactctctagctctcaccatcaacctggattgggtttttttcttaattaaattgatatcaaattctcctttttatatcttacagtattttaaaactttcttatagcattgtcacaactcacaagatatagatttatatgctataatgggaagctattgctatctaaagtgagatcatggcatcatctacatgtttaattaggcccttaattaaggtgatattgttatgcacgtatgctcttgtgtaccgtgtgattatccaaggaggaaataatcttcagccacagaagatttttgagaaagaaaaattgtaagttagtatatctatttcaaggaaccaaatagttgactttgtgctagttgtgcattatttattacaacatttctatggacatttgcttgttcttgcaagtcaacaaattaaaaaggagcaaaaaagaaatggacattgcaatcagttcgttgtatcttggaataggactagtgcatgacggccactctcatgtgacatcacactcatgtatatatgtgttcagtcaacttgtgataatatcatttccgaaaagataagatgtgattataatttataacctctcttaagtctctagaacatagctgtaaacaagaacatccttttttctagtttgcactagttaaagtaattataaagtttgtccattcagagtttttaaatctctaggtcgtttattagaattttaaaacatttccccctatttttagggagaagagagaagtagtagatcccaattgcttagctcatttgaaaagaaaaaaaaacatgtagagaacaaatgacatctcaactagagtagttatttttacagtgaaattagtccatccaggttcgagtctccaactctacagttaattattttgtaatggtagtccttacccgtaaacaaaacgttgaagtgatttcgtcaatttcatgtattacctcggtaacaaaaaaaatataatagattacatgtatttatactttattttcttaaaaaaatccctgtaaaattacctaccgatttttatctattttatttacatgggcctaaattggacatggtccaacgcgtataacgtaaaggaataagttcatctgatgtctcttaacttgtcaatgaatccgattttcgtccatcaaccgaaaaccaaatgcaacgggtccctcatctatcaaaaccagtgcagatgaggtccctcagcggtttagatggcggttttagctgacgtggcgcttacgtggctaatttgactcggtcttcatctgacgtagcattgatgtgacgcttacgtggcaattcgatccgaaaaataataaatcttatgggacccacatgtcagtttgaatgaattaaaaaatgatgggtaacattctcacccctcctctctccccatctctcccctctcctctctctagcgccacggggtcacggggaggtctggcggcggcggccgacgacgcgggggaagggtggggcgtcagtggcgggagtgttgggggacgcgccgtagcctaccacggtgacgctgtggttgacgtcggcggacggcggtgcacggccccgtgtagacaccgctgccgtagagctagaacatgaagttgccggcgtcgacggtgacggacaccggctgcgccgccacagccctcgccaagtcgggctcgctgctggtgtcacgttctggtagcccgcgatgctgaccgcgctctggttcagtttcgccgcctggcacgcgccgttcgcggcgtggtacggctagctcgcctccgtggtgactagtgaggccgtggttgccgacgatgaactcgaacagctcatgtacccaccgccgcaccccacagcctcgtcgttgcagtctacgagctcctgctctgacagcgacaccagctcgccgttcttgttgatcccctctatcaccgccacggcggagaacgcccagcaagaacctgcatccacacaacacccagatttccatcgattaatctccaacatttttacaggtttgaatctttctttaccatgctattgctcacacaccacaatcttcttggtactccacttccaccactgctcctttcttcctccaatctacgctcttcggcagaatatcatcactgctctctccaggcattgctttgaggaattgcgacatgaggtctgaaccccagcatcttggctctgaactcctcgttcgtcaggtcggcgaacgtacttcttgtcagccagcttgtagccattgcacatggagttgaacttctcaaataactcaacgttgctcctgtacacctcgaacctcctctgcttctcttcggcagtcgtgcagctcccggcaccacgctcgcacgagctccagctcgtcggagacgggcggcgccgcggccccgatctcctccacgagcccacgcgcggggtccgcgccgacgccgtgagcgaagacctagcgctcccgccgccgacgccctgcccactacccttctcccgcgtcgccggctgccgccgccggacctccccgtggccccgtggcgcctggagggaggagaggggagagatggtgagagaggaggaagaagaggaggggtgacaatgatatgtggggccatgtgggccccaccattttttaattcattctttcggtgaaactgacatgtgggtcccatgagttttattatttttcggatcgaattgtcacgtaagcgccacgtcaatgctacgtcagatgaagaccgagtcaaattagccacgtaagcgccacgtcaaccaaaaccgccatccaaaccgccgagggacctcatctgcactagttttgatagttgagggacccgttgtatctggtttttcggttgaaggacgaaaatagaattcgttgacaagttaagggaccttaaatgaacttattcctaacgtaaagtcctcttctttaatgcttatattaggcctggcccatattagcccattgagagcccagatgactcatgggctcgtggcccgtgcagcgcggtcgccgccgcaaggtttatctcctccgcgaggccgcgacctgacgccgccgccgccggcggccgccgcctcgtcgtcgatgagctcgccatggcgccctgccgaaccctatctacgccgccgcggtagcagggttcaggtttggcggcaggctacccccttctcactgtcgcacgacgacagacgactcctccctcctccccacctcgccgtcgtcgtcgtcgacgactttgctcttcctccgtctaaccaaatcccagattctgcagggccgcaggcgcggactaggcgaagaagggccgtcccccgttcatggcactgccgcgcgagcgtcccattccccactttctcgccggtcgcgatgagcagtaggccagagtctgaaatgtgttcgtctcagccggctcaatcgttcggcgggcgctgacggtatgctcttaccatgatcccctctcatttgttctagggatgcaagtgggtgatctcactacccgcataaaaattcactcgctagttcatttcttacatgatagtataaatttcggaaggaaaaatgaactagaagtgagataagcgggcaaaataatctcgcttgcccgccccacttgcatcactaatttgtttattgtggcctccgcgagactctgtggtgactgattgattggtgttgttattagtaatctagctgcattgtggctattatctgaaattaggggatctaacactgagcattacttttctcattgatatccccattgcattgcgtttatccatgtgtggatgcatccaattattgctatctgtaggaaactagaaatggttcttcatctctggggtttattcctttgattcaatgtatttggatatattagcctttcttccattcattatactttaaatcaggccctggcacctgtatctagaaatgttatggtatatatggttttgtatgccatataaatgagtttcaacttggttttttgtgaccctttagaaaaaaagaatgagaaaaaaatgtccacaattagatgctgcgagtaaaaagaattcagatttgcatatatgtatgtgctaatttgtgttcattttaaagtagagaacaccaactgttgcactattcctcataattactgatatgaacatcagcattaataggtgactatgaagatattggacttctaatttatttcatacaatacaagtcaattactagactacttgattgtcaactgctatatatatgctgttaactgcgttttgtgcattatgttttgtaatcttgaatgatgttgcatccagccttcaacttggtccctgaaacctattaacaaagaatagaaaaaaagaattagtaaatgatggcttttctcctaaaaacagcatgcctagtttgttattgttttggtgtctaggtcttggcttcttgcatatatgaataggggggataaacatgccatctttgtaatctaatgtattgtttgtttcttttgaaacaccggaagtgtatatagtgagtagaataattgttcagcattaaaaaggatgcgagaaggcttatttctgttgacaaaattgccatggtaattaaaactacatatgtgcacttatgtcatggaaagcttgctcattatcatgaacagggtaaagtaagcgcacccgtgtcctaaaaaggtactaagctaggaacttaagttgatattctactctgaattcactattctgggaagaaacgtgtattactaataaacctattttgtatcttccagatatatgcaatgagctttagcgatcctcagaatcttttctctagagcatctttggaaatcttatgcttgtgttagagtagatgccacgtctaagtctatgaattttcaatcaaaaatgtcatggttatgttttgagagggggtgtatgagtctatctggctcctgtgatttcatgactaccaatatatgaatatttattgttttagtctctctttaagtaaaatattaaatttgttcctaccttctgccaccaacaccactctccttctggcagttgaagtataatgcagcaacaggtggtccaagattgtaaaatgcagagaaatctctgacgttgaaattttgccgccatcctggagcataaactgtttgtcgtgcttcctgtttgaatagcacaaaaacaagccgatgaattccagccggtggccgtggagcttcgtacggaactatttcattgcctgaaacagtgtgtattctttattagatttgttttgttgtggttcatattatcaaggtgaatgttagctttcaccacatcactctacagactacatgttccttgatagtgtggtatagattgtcctatagttcagtcattcagtgacattactgcccacccttcagtcctgtgccacttgctgccaattaaagcaaataaacaataccctgtggtacatgttgtttcacgaaatatcattatggttagaagtattgcaaccaattgcacatcctgaatatctgtcatggcttccacatgaaaataaatattaaagttgaaatcccactagtgaaaatgcatatataaaaaaaagaggtgaaccatttttattatgtgaccattaagtgtgagtgtgtgactaataaaaaatagtaaatgcctgagttctagtatattatgtgacttacatttatttttttcaatattcataaaactagatttgatgtttaaataatcacttgcaatcttgataatttagcagaaaagagtgtgcctctctgatatccttgggatgagccagatgagaggatcaggcgtgcttcatgtatgcactaccgaaggtatgcttataagttataactccagcattgcagcttggctccaaagaagtctgtaatttgtaatgctactagtgttttttgtgggaaaacagtagtgctgtttttgaactattattattttcagttgctcacatgattattcctagttggcagcttctttagggagggacagagggcatgtgataactttacaccttggttttccttaaaactccagaaacgatagtattatgttttcacttggaaatgaaagatctcatgtttgaaaaatctgaagtatgtcacacagattaggtgtgtgtttctgtggggccccacacaacagaaccattggtcaaccataggcaggtaataccataatagccacatatactaatttcatcagtgggccccacagatgatctgaggtactcaacttgaggcgctgttgggcagataacaaccgtccaactgcttaacctgcatcaaaaataggtgcagtcatacattagagcggggcccatccccctctccctaagttgctttacatttgattcacaggtatgcatatttaagatgactgtatatagtttagtagtcaatagatcaatcgcagacttactttaaaattagggacctaatgtttttttcttaatttttgcaatgtcaccttaaatccaaaagaacaacaagtgtagggatatagaactagattttccaattaaagaaaaggaatctcggtatgtgatagtctgatagatgacctactaaatgcacctttaatgaaaatgccattgattttcagtgtatatgacatctaaaataattattgacttgatccttgtcttgttagcttagtacaggagataaattgattgtctcaagctccctatactttctttgcaaaatttgactgtgtaatcatggtcgatagtaacataaactatgaagaccaatgcattcttttgaatcattccttagcatttttatcatgtcttttacttttgcatatgtaacaccctcgtagatttctaccttgacaccccaaacaccagcctactatacaaataaaattcatcaagtttcatacagtaaacttgtttacttaaaatcttggaaatatatgcactaacataattttagcaaaacaattatttcatggaagtattaaggtatttggtattttggttggatcaaaccaacgatatttccaaacagttatattagttatagtagtatttccatagttactcctgtctctatcatcatttatttttccaacttgacatagattttactaaccacgtggttattccattgccaagggtacttgtgaaatgtttacaaccatatacaacaataaatatcatgatttctgtttgaaacaaatggcaaatattggaagtgattttgctgtttgtataataaaaatgtttgctgatctgtacatgcaattactcaacattggaggttatgtaggagtaagatgttacccaccaaaacgtgcatctattgcctctgggatgtctgtcaccaacctgtagaaaaataacaagaagaaagaaacaagaccctagctttagctctttgattaggctcagaagtaagaactgcttgtaaaggacacaaataataagatactatgataagttatatgttaattaaagaaacttcatgtatggtcaaattggaaatctttactcttatgaaaaacgcaaatctatgtaaggagatatgagttgcagaaacatggattagattagataatcaatatataatattttagatatattatggtaccacattgttagtagtacacagcaagcaagaatttgcccgatcaactgaaaaaaaaaattcagtgttgcaaatgaccatcatgttacatcagatcatcctttgaaagtttaattaagattagttactcataagtttgtttggtggtaaagggcacagttcttctatattaatatgccatagcaaggctcttaatacatcttctagattagttagcttctaattatattcaaaatcataaacttcccagttacaaattttgatattagctccagcacttgtttataaacataataagaatgatattacaattcttatttataatgatattagtattcaaaatccatgatactagtattcccagttacaaattatacaaaatccattagtcttgtttataaacataataagaaaaacataaatttcaatttaacacgcattaatgttatttacttattttagccatatgtgacattacctgtaagcattagctccagcacatgtttcttttttaaggtatctttaaattctagccattttttccctgtaaccgtataattgcatgcatgcatgctatctacatgaagtccttcatgctgatatcataaataatgccgtcaattaatgttttttcatagtttatcatcttatgttgatatgttaattgattgtagcacccaataatgatgtccttagagttactcaggatcatgactggtttctccttactttatctatgaagaaattaataggcaaacttccagagtaccttctccatgagaagttggtaaggtgccttcttaaatactagaaagtataaactattaagataatatgaaatagtttgaagtattggcaattttattttgaagctacataatagtgccaatttaagaactaatgattgatgataagaaatgacaatctgaacaaagagacttaggttgagggaattatggtgatgaaaagaattaagttatcacagaaattgtactttcttacccaatagcatatagaacaagagttcttcagctgttgatggttggataagaaacacccccctccttttcgagagggctgcattccaatcctgcaggttatctaggtaaggtgttcttgaactataaacataacaatagtgtggcaagtagcactcattggtttcttgcaaaatgtggctttgttgagtttttaggaaggcattatgcaactctttgcttgtataataaattcaataagctcaccaatgcaaatattccctgtattctggtttgcttggacttggcgcatcaggatccaccataaccttataaaaggaaaaccttttattttagcatttagacatagatatcaaggactagttgcatgccttatagaggacctagggcatagctcaataaagcaaacagaaaaaaagagagacaaaaaggtattctggagaccataaaaaataaaaaccatataagttttcaccctctccatgctaattatgtgaggttttgtgataaaattaaagttgtagagtgcctattagtggttagagcagcactgtgcagggaagtgggatcagcttagtatcttacagtcttacttttctacagtgagttcaggctggatattttagtgcgtgatatttcatggataatttgaaatgtgtggcagtgtctattgttgtggaaaggatgctgatatgagaaagtatgccaaattaccaactttaatacagcagagattcaatttctcactttaagtaaatcagacatgacagggccttatcctatccaatattcctgtaccacagtgtacaaacaagacaggggtgcacaagtatattctaaagtagattgtaccatatgtgtacttgatcattaccaaaaggttacaatatgattacttttttagcaaataccagctggcattatgatttagttttcctgccactacaatattctgtgaaacctaataagctatatccctcatatttctattatcgacagtacctatggatctgttgaataatctatacttgtgcaagttagatggccttttctggtgaagcactaattagatctgtgcattatttctttaaaacgtagggtgcctggagtaacaaacatgtttcattaattagtgtgcatatgcatgagtcactccataagaaattatctaatattctagaaaataaatattacctcttctgacacgagagaaatctttttaacttgaagctttgtttggatcaaaagtcattttcaccttacctaacagaatggttcaaaagacctgtacactactctgatcatgatcctacaaattatgacacttacaagtgtgtagagcttcgtttggtcacgaccttcaatctcaacatgtggtgcagtgaaaacagcagatgatcgtactccagttccatttgtaatctccttctcaccataattaatcctcattgcagctgactttatgaaaggatccaacacatcgccaattacctggctcaatgccaaaggatccctacctcgtgacataattttattgatccttggtgagaagggaattgggaaatattcaataaggtggaagggctagctaacaaattttctgtgggaaagaacagagcggttcgatgtaaatttatattaggagtgaagcatccactttatgttcacaacattccattgagcactatgagcaaatggaatcttgctttttatataatatttatttcccttatagttgcttctgtattgcatatggtctttgtgattgatatctatggtcagtttttcatgcatatattccccaaagatctggaggtatgtttaaagctccaagagttagcctcccctgcatggcgccttgcctgggctaggccaaaggtttacgatgagtcatttcgtgttcaatgatacttctctgagtggtgagcactcagctggagagagaatcttttgatcgacatcacaatgcaagagtatgaaacctggggaggtagaggcaggtcattagcaatcttctttcttcttttatttgcttttccttgactgtaacgggagtatctagtacttcatccttcatcctttggtgaaaaactgctatctggacctgttctacatgacccttgcatacttaactaaatataatgataaaggccctacaaaattttcaataaaattttagcaattgctcgtcaagtttctcatataaatgagataaatacgattcttacaagagtctctttcgacaaaattgtaacatttttcagtgcagaggaaaaagattaatgcatgtctgggaacaagttattcactgtggacacttctgttacaggtaagaattacacattagtttgccataattccatattttacccagtgctgataaattttctaccatagcaatgttattctgtggtatgtcttcctgtttctgttttatacattcataatgtattcatatgcaggcatgcaggtacaactttccttgtccactaaatacagctgtacaggatcattcggaccaaacaggaacaggaaaagcatctgccttgttcgagttgcagcatcattgtcttgatatcatgagaatgaggccacattccattttccttgcagcacttaaaatccagttgcacacagaagtttcacctttgatgctacaaacgggcattggacttttcgaaggacggaggatggataccatcacactatggggttgtgttcaagaacaccacatgtagctgcctttgctctccattcaaaaacatcacatgcgactgcctcggctctccacataaacatcaatgtcgagaatgccatgaagaatccatgcagattttaatatttttcagctgggaatacaggtaaggaccactggctcttcattttgcaccttttacttttgcataggcttcagaataagtactccgtactgtgccatacctttttttggcaccctttttttctggtcaacatgtaatggcctatttggaataaatgaatccacagaaaaatttacagagaacaatataaaactccgttattcttacccatttacatctcttcatccaaatgggccttaaggatcattcatgataacaaagcatcatcagttttagaataaaagtaacttcatgtaggacagattgtgttttgacatttggataactgtttggcacgtgtacttaaaggctgactgacgacatgctataatattgcaatacacagtgaggcaaggaatatactcgacatccaaaaatcttgttggaataaaggtacagtcttcagatcagatgagcatctccaccagggcactgcatggctgcaaccagaaaagctgaaagattaactttgaattgttgaaagctcttgcatgtcagtcacaaaaggggggaaaaggcaccaaggaatttccccgcactgcaaacaacctacacccagcttctgtggatgaactcgtgccatgccagtatgccaccgtccctgctgcctcaggcccctctagattgttcgtggaccagctggaaactgtgctaaagctgatctgatctccaggtgagagctgaatctattctgatggggagcaatcttatcattttgacagcatgcatctgaaggtgctagtggataagtggaagcttactgaatactcttttctgtaagttctttttttcttttttagcagcaaatgctatggcgtgctttcgatgagcttacagattttaacttttctattgattcacttgtttcactggtttctcaggcaaaattgaccagtgatgaatctcttataacaggtgatacatgacaagcttcgttgctgcagaagaatgcagggtcaggtgacctggaaagattgatgagaagaatttgagaatcttgtacagcaaattggatggagataaggtgaatggctgcggtccacttcaaaggtgaactgggaccagccgtgcatacagaaacaacgtctctcatttgtcccggtgcctgcataaacaatgtgagcgtgaacgtcaaagtgaagctcaacacagttcttctgatactctctcttgttggtccatattataaggtgttctgtttttcataagtcaaacttctccaacattgatcaagtttatgaaaaaaacacatcaatctacaacattagattagtttattaaatccaccttaaaaaggttttgatagtgtattggacgtatgtattatactacctatgttttagattataagacgttttaactttggtcaaagttaaattgttttaagtttgactaagtttgtagaaaaaaataataacatttttaacccaagataaatttattatgaaaatatattcacttattaatttaataaaactaatttggtattataaatattactatatttgtctataaacttagtcaaacttaaaatagtttgactttaaccaaagtctgaaacggagggagtagatattaatgtatttttttttgtataaacaccttacagtacaggatggatagaatacatttgttcttattgatggattgattattcgttccatggatgtgtgaattgggtccagttagtttgcagttctaattagatggcaaagatagaagcataaagtggcccaaacccaattttcagacagcaccatgggcggctcgactggcccaacgagtagagtaatctgggttaaaaaaaaaacaacttttaaaaccagtttataaattccaattgcatattgagagccttttttttttacacaatatactcttgagagcatgattggaaccttggataatccatttggtcttcgttccctaatctgtacgctaatcatgcaattaagagagagactcaaagcgaatgtgctatcattcggagacatggccactaactaaaggccgtttgccgttactaaactactactaatgcaagtacatatccagatatccttctggtacaccagcacacgcatcatctgaacataataatttgataatgaccatcttatatatattttaaaataaggcaatggtgataggtacacccaaaccgtaccagctccctcgcaaaatccacctgcctgcactgcaccaatatgcctaagctggaaagccacatgaacaaacggaacaaacaatgacccattcctgctgtgccgccgcggcgaagcaagctagaaaagccggcgaaacggccaagcaaaactagtgccgcgtctggtgcactcacgccgtgtttagtctaaaataattcttcaaacttccaacttttccaacacatcaaaactttcttatacacacaaacttttaactttttcgtcacatcgttccaatttcaaccaaatttttaattttggtgtgaactaaacatagcctcagttatcaaaacaactacgttcctgtaggtccctgtcactcggatggacattaatttagagtattaaatatagaccacttacaaaactaattacataaatgagagctaattcgtgtgacatttttttaaacctaattaatccataattagcacatgtttactgtagcatcacgtagactaatcatggattaattatgctcaatagattatcccgcgaattagtccagggctatggaatgggttttgtcaatagtctacgtttaatacttctaattagtgtccaaatatctaatgtgacagggactaaaaatttttaagtcccatccaaacagcccctaagtgcacagtctattttacatggtaaaaatttatgacggtccattacaattttgtagtagcttgaatagtaaatgtgttagtttggtttgatgccaaatttggtaatacctatattcaaaatggtacaattctaaaactttgttcaccataatataaattttagctctcaaacttatccactttcaaaactactctaccataacattggattttaccactatcaatattttagtacgatactaaaccaaacaagttatttgcctcatgttcaagccattgtctatgttgcccgaggtctgagttcctcaggatgtgtaaaagaaaaacataaactaaaaagaagggagaggtagggagtgtttgagatatgagaaagggaaagattaagtagatacgtaaaacgagataagttatcagcgtataattattaagtactccctccgttccaaaatatagtaacctaggatcggatgagatgtattccagtaatacgaatctagatagggggcatgtccagatatgtagtactaggacacatcacatccggtactaggttgctatattctgagacggagagagtattaattattctaaatttaaattgtggttaagatgatttttttaaaacatactccctccgtccaaaaaaagacaaaccctgggtttccgtgtccaacgtttgactgtccgtcttatatgaaatttttttataatcaatatttttattgttgttagatgataaaacataattaatactttatgcgtgacttgtttttttaatttttttttatattttttttaaataagacggttaaacatttaacatgaaatcggtcgtagcagttaagagcaaccaacaaaacacaagaggagaccaaatcaagcgcgacagctaggcgtgtacagccccccgtacaggcgtgcagccagcgcgacgcccccctgtggtgcgctggtagttcagccttcgcgcgcgggcggcaaaacacggcacgccacgccaatacgtgcgcgcgtcccgcgccgtcacgccgtgccgtgacgccgcccgctgtcgctcgcgccgcgtccgcgtggtgtgtctttcccctctcgcgaagcgaagcgaaatacaaagacacccaaacccccaccaccacgacgtctcgttccctcgtactagctcgtctcgtctcttctctaccccaatcccgttctctccctttccccccaccccacccccaaccccgtgccgcggcctcgccgatcgatcgatcgtgcgctccacctcctcgagctccctccctcgccgccgccgccgccgcgcgccgccggttcgacgccttcttcgcgctctcaggtgaaatcatcttctctctcaggttcaggaatgaatgcgtgggggatgggggttgatcggtttcggctagggggtgctggattggtgggtggggggtggcgcaatgctgctgcggcggggtggcgtttttgccgggtcgaggcgggcggaattgtggggaattttttttttttgcgtgcgcaattttggcgtggctcgggatgatggctgggtggcgtacggcggcgtgagctagggggaactcgcagcggcgccgggggtgggtttcggtggtggtttgtgtgagtcatttgtctcatcgagctccaagtttggaggtggtgttatgctgttttagcactggaggttttgtagtacggacttgcttggatgtggaggatatggtcatgtttttgttgattcccggaggccacctcttgtttctgatttccttttggtttgtgtcattggttcatcaggtagcggtagacactgaacatgatgattcaattggtgtgacggatgagtctggttggccatgcatagaattagacaggcggatgcgtaggttagtaaaatatccatgtgaatgaagctgagcgacaactgaaacaaaaataaatgcaggaccaaacttgatgttgattgggacataggcatgtgaaatttgcccatgttcacaggatgaacggcagaaacccagaaaagaacataaaaatggaacatgaaaatgatagttcacttgcttgggtggttggcaatcggcagaagaggatgcaatccctctcccttaatcgcactgcctatccatgattaatgtccatgtgcttcagtactagattttttttttaatttggaccacttcagttctgattatgagttttgtcattgaagtattaatgttcttagctgtatcggtgctaatgtgctgtcttttcctccttttctgaacttaaggcatagaaaagaggaagaaacaaaggatacatcattatgttgcgacgctggttctgctgcactcagtttcacgcaccatatcgtgaacacgaaaatgaatttcctgacatcccagaggagaaagaaggtatctttcttattgagcgcccctccttattctttttccttttttgagcagctatcttcaagtttatggtattgtatggtctcaactcccaagtagtcaagttgaggaaaaaattgctgaggtgttcacatcatcattgttcattctatatgaactaaactttagtctgtccaaggttgctatactagatgtcagtgcattttcagcatagttgtcagaaccattctttttcccccatggccttatcagttgaactgcacaattccttgcatggtagtagtatttttatcttgattttctttaatgctaaaaacaaggtcttgtattatatatccgcgaatgcttcatatcctgttgtatttttgcctttgagacctaaacctatttgtcaacatttggctagcaggaaatggttttgctcccaaaagtgatgatcccacaaaagcacctcctcccattgaagtaccagaattatcatttgatgaactgaaagagaaaactgataattttggttcaaaggctttagttggtgaaggatcatatggaagagtgtattatgctactctagacaacggaaagcaagttgctgttaaaaagcttgatgcttcaacagaacctgaggttgataatgattttttgacacaggtatggttaatgattatataatcatatgcagctcttgccaattatatgcattctgctattcgatgtttggaataaggttttactctaaaccttacttttcatttctattggcataggtgtccattgtgtcaagattaagacatgaaaattttgtggaaatgcttggttactgtgtggaaggaaatcagcgcctagtggcctacgaatttgctacgatgggttctctgcatgatattttgcatggtatgagaaatatgcctttacggtaaaaaaatgccatcgtatctcactaaacacatacaagccttttaatataattgtgtatataatatagatacttcaaggtttaagttggttgcctgtttcttttgtaataactcaaaataattcatatatagcagtgctctgatattgtttttgtttttcacatccttgtcatacataaggaagaaagggtgtccctggtgcacaacctggcccagcacttgactggatgcagcgagtgagaattgctattgatgctgctaaagggctagaatatcttcatgagaaggtccaaccttctatagtccatcgggacatacgctctagcaatgttcttctatttgaggactacaaagcaaaaattgcagatttcaatccttcaaatcagtctcctgatatggctgctcgtttgcactcaactcgtgtccttggaaccttcggctatcatgctcccgagtaattgctctactcaagtacttgaatagtttatgcatttcttttttttcccaagcaaaatatttaatcaccttttttgctataatagattactctgtaatatatattgctagaagatgatagtgttctgccttcaatattttgtactgttgattgcgtggctgtagcatccaggcaattcttaaatatagctaaacaagaccaatagttctatgaataactgaagttcccattatttgttaccatgcttgttaatcattcactcagtcatgtatcctttgttctcactccatgcaggtatgccatgactggccagttgactcagaaaagtgatgtatatagttttggagttgttcttctagagcttctaacaggaaggaaaccagtagatcacacaatgcctaggggtcagcagagtctggttacatgggtaagcattttatttgtaaatttactacaatatttaacatgagagctgtttgcctcagctattggtaaaaggagaattactttgttgataagatcactctagaataaaacgaagaaaaatgtggtcttaataacaaattactaggcatccagctcagatggactgaagttaaggttttgaatggtacttcaaagaatctctcagactagactttgcacgttaatgattcttcattcaacaaggctttcaaaccaaacagaattttattgtcctttgagaaactatactatttttactgtcactgtgcatagatgctattctatcgtgttatgtaacacaccattctaagttgtgtacaagctgctctgcatatttctgattagctcttgttactacttattttgtacgcaggcaacacctcgtttgacagaggacactgtgaaacaatgcgttgacccgagactgaagggcgagtatcccccaaaaggggttgccaaggtctgcctccctcctcccttccctttaaatgcacaagcactctcttgtatggtcactgtgtggagccaagcaacatcgtaaccaaaatttgagcccaatggtttccatctgtttattgcagctcgcagcggtggcggcactctgtgtgcaatacgagtctgagtttagaccaagcatgagcattgtggtcaaggcactctcccctcttctccagcataaaccgccaccgccaccagccgttgctcctgagacctgagctccagattcaactgcttcttatgcttttacttccgagtttcaacatggatgtaaagagggatggaatttcttcatcggtccctgtcgttactgtttcatgcttgccaattggttaccatgccgtttaagtactggtcctgtgagctttacaatagatttttggtgtttacactcggagctttccttgtcattcctttcatgtgtgcttatgctgagtgctgtgctgccttcgttggtcggcaaagttgtgtttttagctgcccagcggtggtgatcaccgaataatcttgttctgagttgaactgtgacatgggaaggttctaaatctaactgttcatggcttgacatgctttcggtgtgtgcctacgtgagaggatgatggttcttcactttgttaacatgtgagttatgaatggatgcttttggcttgctacaaatgtgagttgaggctaaatgctcgtcacaaattgaggttgaccagctaaaacatgcaagttttgataattgataacctgtacgccatgcggatacagcgacttgaagttgcccatcaacgaaaccggaatcaatgatttgccactataaagatttgtcatttttattgcatgtcatagtgataattgttgggctgaactaaatccacaatgtgcaaatgtaaatttatcagccggtaaatataggacacaactacatatcgacctgttgttgatttggttaaagcaacgaccacttcatcccatgcataataaatccttctttagcttaaaaaaaatgcaatggtaggtgctatctttttaaaaaacttcttcgatgacttctatcttaggatctatttttagcattatactccaatcaaaatatgtgacaaaacaagatcaatgttgaatgtatttaaacattttatttaataatttgaatatattcaatattagtcttatattttgtcacatattttaaatagagtatgatggttcaaatggatcttacaaataatatacgatctaaaaaatattcctatatcataaaagactaaaaaaaactaatataacggtatgttagcctcagtagcatgcacgtgaatcgacatgacaactaacaactagccgatagtgtgtggttctctttttctagcaagtggtctcgtttatctatttgtccgtacaacatctacgtgtttgtatctcagccatcattaactgattgaatggtttataaaagggtctctagatacaaccaaatagagaacgcatctcacaagggtgaggtaatcttcactactccctctgttttacaatggaagtcattttaacgttttccgcatttatatttagattgattaacatcaatataaatgtgggaaatggtagaattacttatattgtgaaacggaggaagtatattgattaatagacaaatcaacgattcatatagactaaactcttacgagtaaatcgcaatgagtcaagtacaaagctccacgtgaagagaatttaagtagaccaacaacaataatgacacacatgagtacgcagtactctatggcaaacacttcggtccgatccggtccggtccgcgccgcaaacacgtcgatggttcgaccgcaaccgggtgacccctgctccgaccaggccacccccgttctcctccccgccgccgccaccggcgcctcccgctcgtccccggccggcgagtcgcgtaggagggaagcgccaccggcggcggccgcggcgagatgagcggcggcagcggcggcggcgccgcgagcgcggtgttctacgcggagaagtaccacccgatccaggcgggcagcatcgacggcaccgacgtcgccccccacgacaacgccgtcctccgcgccctcctctgctccaccgccggcctctgtgcgtgctctcctccccctcctcctccttttgctccacgcggagaagagcgcgaacgccgccgcagctccctcactgactcggttggggttcggtttccgattttcgttttcagatgatccgttcggggaccccaaggccaccggcgacccctactgcacggtgttcgtcgggagactctcccgctacaccgacgacgagacactccggaaggtgcgcggattccctttggtgtgtgttgtactattagctttgctcgttttctcatggctggagttgttgtttctcgttgtgtatgtgagagagcaggagatgagcagatatgggagggtgaagagcatgcggctggtgcgggatattggtgagtttaaccaatgtgattcatgaaaacgttgcttttactttttgaagcatggttcatttgtaattgtaatggttattgaacatagcatccatacaatttatattatgccaatgcaaattgacgttgtattctgcgcggtattgataacacattggagcattgatatataagaaaatgggaagtgctgtcctgaattttggaactgtacctttagcggctattgagttgtcggtaggcagcaaatagcagtgcttcactggagcaacatgccagcatctcatcctttttcgcttttgcaaattcagtttttactaaccgaattacttgattttcagttactggtgcttctcgtggctacgcatttgttgagtatgaaactgacagggagatgcgccgtgcctatgaggttatatgatgttcttatttctactgcctgtttgtttccttcttaattcttagtacacttgaaatataaaagaatacatgttacttttgggtctataggatgcacaccattccattattgatggcagtgaagtgcttgtagattactacaggcaacaacttatgcctggatggataccgaggagatcaggtgtggttctctgccgaagttttatgcagagctaaaaatacttgagatggttttcatactacttttatttatcattttataggaggagggcttggagggaagaaagaatctggccagcttcgatttggaggtcgagagaggccatttcgtgctcccttgtatgaacccaaactcttgttgcagtccaatatttctcatgtaaagaatcatagaagaagttgctttggagtttctagacataaagtaacagcatgttgtacttctgtaaaacacaggaggccaattccgtatgatgaactgaaaaggcttgggatcccaccaccacctgaagggcgatacatgacacgttatcaggtagttcatcacttctagagggacaggctatttgactttttttttatttacatgaagtattattgcaaccgtcatttatggtttcaaaatttcatcatttaacaaaaacttgttgcattcacctctgtcatggtaagaaacaaagaaatgtgttattcacgagtgagcataaggaaatgatatgaggttgaaacttggagcgattggctagtgagaatagcagactgttgccctgaagataagggcataggaagtaccatgttcttatgtgaatcacagtcacatcacttttgcacaaactgtttagctcaacccacatgggggtgatgggagcattagtagcttatttgatgcagtagtatctgttcacagcctcgcaggcacaactgaactttctagtcactttgctatccaatgaagttggaagtgtttcattatgcttgcttactgccatgaagtgacactgtactcccactatcacaggttcccccaccaccaagacgaaaaagcagtgatatctacagggaagagtcacctcccaagagaagatccaaagacagggttgatagcagtcactacagaagatattgtagcccaacccaagacgacgacagcacggtcagcacccataggcggaaaggtagccatgaccggcgagaagaaaccgagaggaggacaagagcatatatcagcagagaggccggcagctacagtaagcggagcccaaccgaagacgatggtgatcgtcgtaagaggagaagaagccgagagcctggagaattatctccatacaaggaggatgatgataacagcaaaagaggaagaagttcagtggagccaggcttcagcccttatcagtctcatcaccacaggcatcacagggagcgtcatgacagcagcagccattctcgccacggtgaacgtcggcatcaagacgaccgtggaaaccactccaggaacaggagatcagagagccgggactacagccactagaggtgtcgagtccatggtgggttcctagtgttttaacctgaatccctggctgcctgttcgctgcttcaactcatgtatatgatctagttttctcaggcgtccttgccttgggttgcctgtgtagtgagggctactaaacctgaagtttcgactttggaatacatgaattaatagaattcatgatttagttcaaacctacctataaaattctttcattaaagccttattcagttaatcccttgtccaaggaggttgagagggactggaattaatactcccttatccactccaatcacttggtcattgggactaaacaaacaagcctagagtaagcctaagcgattgtggaaaatccaaataactccatataagttgctggtcttttcattctctccctacaacttaatttcatacaagatattcttcataagttctttttcttttcaatttcccccatttgtcttgtttctagtgattctcgtcatgctcatcgatttctcacatcctatgcacctcccgcatggtgagtgaattcctcctttgttctttattgttgggaattagatttaatacaccttatatgtaatacgtgatcgctgtcgtgttttatcgccgtacctaagaaaaaattgaagtatgcaaaagcaaaaggagaggtatctttggtgacagaggcaacttatttacctcaccataatgctcataaggcacaagaaattgccgaaaactgaatagtggtgggaagttggaagagaaaatgaacttacgagaatacaaggagagtgtgtttggataatggaaaatagagggtgggattgggattgggaaatgaatgaagggttaggattaaatgaaatagggagaatgaatgtttaggatttaaagatgtcttttggtgggtgggaaatcacttccatttcccattagccaaacattgccggagtgttttgcacgaaattaccttataggggagatttaggatgtgttcggttggagggattttctaagtttgtttgggtcgagtccattttcatagatgtttggttgtgagattaggtatgataggataattccaaaagagaatatattccactaaaaaatgggttgagttaatctagaaaaatgtgacggaccactcatatctgtgtatagcaatccgtatgagcatgaaactctacacaagagctcttcgcatcattttcttttttgactttgttcgtaaaaacaatgctcctgttttttatatccttttaagcataaaacgtgtaccactggaataaaaaatgtttgaaaataagtgtacatttttccaagaaaaaaaatctttcacgcgccacgatacaaataactcgaaaatcacagccaagaaaaaaaaaagcagctcacacgcacgcgtgaatcacatcgccccgtttccattttccaacactagtccacttaaccaccgcttccttcgccttccaaaacaaaaggaaccccaccaccgctcttccgcgcttcgcttctctcgccgtctcgcggctgcgcggcgcggcgctctcatccatcccctcctcccgcttcccccacccgccgcccgatctcgacggcggatcgccccgggatgggctccgacgaagacgagctgctcgacgacgaggagtactactactactgcagcgacggggagtgtagcggcggcgggagcgggagcgacgaggatgaggagttcgggggccgcgggagcgacgagggctgtgaggccgacgaggtcgtctccacgcgcgagcaggtgctgtctgtgaattgcgatcaatgcccttgcgtgtttcgttccgtcgttcaaatgagagaggcccccccttttcggatttctggatagcgagtggcgctgctgttgtggtgatggtgatttgtggctttgatgctgattcggttttgggtgcgagaatcctgcgtgttctgtggtaattcgacgttctgagcgacaggtgcaatgcgatgtacgagtggtttatgcttgtatggtgatggtgattagtgtctttgatgatgatcggttttgggatcagaaaccctcgcgtattctgtggtcatttgatagaatttctgggaaacaggtgcaatgcgatggtggtgtgcttagagtcgcagcgaaatttgttcatggcttctctgctttacagatagcaaaacgtttcatccttcggggaaaaaaatagcaaaacatttaccaagatctcaatagattatagatatgatgttttctcttcataaattgtttcgatagcttggatggttgtttactctacagattgagagtttgagactgctattttccttctctgcattgtatgtcattaacgtaattgtgttttggtccttttgttcatgctgccctgcctttctgtttctctattcttaattcttgtatacttggtgtcagaactaactcaaaatctcaaatgggcctcttctgtgttcattttcttatgaacagagatatgttgtgttgaccgaagatgatatacgcgagcgacaagaggaaatgataagccgtgtgtctgcaatattttcagttccaagggaatcagcatgcgtcctccttcgtcactacaaatggtcagtgccgccgctccagcagctcgtcctttctgaacacactctactgttttatttccgttgtagtgaatttgagaagcccatctcatgtatctcttgtttacaagatgtactgcaaatgctttgtgtagttatatgtatatgtaatagcattttcttactgctggcctgccacaaaggtaggatgcttttgagctaaactagaagatccttttctatgttaacaatgtatcttcattttgttgttcaggagtattagcaagctaagtgatgactggttcgcagatgaagaaaatgtccgccgttctgttggcttgccatcaaatgttgttcatgttcctgactgtcctgaggtagaattacattcctaaaagatatggagcttcattgggtttttttttatcatattgtatcatatctggtttgaattggtgactaatgtagttaactgcatgttgtaatttctatttgtttctttggttgcagctaacttgtggaatatgttttgaaggatgtgctgcaaatgcaatgagctgtgctggttgttcccatttctattgtcatgaatgttgggaaggtctatctgtctctctctctctctctccatcactcatttttacattataagttctttgtgacttcaagattttgttattttacttgtaacattacgaattgattgctattgtaactataacaaattgatagatgactttgttgttctcactttcagtagtttgtagcattcttgttcttaaaagaattctgaaatttatggtgctaaaatgaggtaaattttcagggtatattagtgctgcagtaaatgatggtccagggtgtttggtgttgcagtgccctgaaccatcttgtgatgcaatcgttcttgaagatatgattaatagtctgacgaaagatgaggataaagtaaagtatgcacgatttgtattatggtcatatattggagttaacaacaaggtaattctttaaagtactcagcgctcataatggttcacattatcgttctcccaattatgtttattaaaccttactgtattgcccatcagatagtagtactatttactatttactatatagttggtatatacttgcttatatttatgccaagtgtcaccccaaatggttttcaaaaaaacatatttctgaagtaataaaaattaattcctgcagataaaatggtgtccagctcctgattgtacctgtgcagttgagtttcttggtgatggtaactatgatgtctcatgcaaatgcaaattcagtttttgctggaatgtcggtatttctttatttatttatttacttgtatacctttcagattgattgtttgatattaccagttaaatctttggtaaatgcagtgtgcagaggaagctcatcggccagttagctgtgacacagtctcaaagtggatactaaagaacagcgcagaatctgaaaacatgaattggtttgtcgcacacataatttccttttcattcttgtatttgatagtatgtcttgtactttattctttccatcttgaatatttcttgtgtaaaatactttttttctttttaatttcctaagttcataaggaaaaactggaagctgtttctcaagtgttgttttctcccccaggatattagcttattctaagccctgtccgaaatgcaaacgacctatagagaagaatcagggatgcatgcatatgacatgcactcctccttgtaaatttgagttttgctggtaagcttccctctcggcatatttgttttgatggtgattgtgtacattttgcattgaaattgtttatctttggtctgattttccatggttgcaggttatgcctaggtgcatggtcagatcatggagatgggactggtggcttttatgcttgcaatcgttatcaatcagcaaagatgggaggcatggtatatttcatcttggatactgtattgtgcaagaagaatcgtgatttttaccttgctagaataagcttttctattgctacctattcatgtgtttgctctagtcttttatactactttgctgtgtatttaatttatttgttttccttcatgccaataatctcttgtaatgttttcctcatgtttcagtatgatgaggctgaagcaaggagagagagagctaaaaattcgcttgagagatacatgcattattatgagcgctgggcgtccaatcaaacagtatgtctaggatccagtcactttacatagtctttatctgattttttatggtattcatgcttctacatgcccttttgattttcatatggaccatgtaatgtgtatagtaagctcattaggttggagacttttagttttgctgactggaaggatctaatttcatgttgctgctgcaaagtacagcgtctggcactaatgtccttggcaaatcagttgtctacttacttttcattttatatttaccatccaatattatgagtggtaaacacatacacagtgctttattttatatttatctttctcatactttcataacaattttccacaatgctgtatatttccattcaattttcgcatacataatgtgaagggtctgccataaatttacattttagctgtacttttatgtatgatacattttctgttttcttttccctgttggcagtcaaggcagaaagcacaagcagatctgcaaaaagttgaaaatgaagatgtaagttttacattggaccatgtgtacagcatttgtgggtcatagcagaagtttgattttattaatacttgtagcaaaactcactgttttggcagtccttttatcagttgtaaatacttttagtttggacttctgtgatgtttcagttttgcgtttgactattttctcatgtgtatagcttacaaagttaagtgatgttgttggtataccagagacccaactaaagttcatacctgaagcttggtcacaggttagatattataaatcattttctattgcccattgactgtttatgtaatttacatgttcattattcgttgtgacagatcatagaatgcaggcgagtgctgaaatggacatatgcttatgggtactatctacacaacaaagcgaagagtgatttttttgtgtacctccaaggtagtagataatttctgccttgccaagtaggcgcttatgcatacttgacggctgtacatgttttaaaatttataggtgaagctgagtctggtttggagcgtcttcataaatgtgccgagaaggatatgcgtgaatttttacctacagcggattccactcaaccttctctttcattgcaagacttcggtgaatttcgtgtgaagctttctggtctaacaaggtattgcagagatatcttcactcatcatcacttcagtgaatttttgtgaatgtatttgccgttaattttgtaatttacttggatctgaagggcacacgcttgctccaaccatcactgttatccttgcagtgtcgcttgcttcatgcatgatgcaaatgtatattttccaaatatccatgaactgctcaatatgtcactatgcagtgccaaatttgcttgatcattttattcactataagacttgcatgtttatgagtatgtacagcaactaagcctttttgagaacatgatctaagctaaatatttcattgcagcgtaacccgcaactacttcgagaaccttgttcaaacactggaagcgggtctgcaggatgtccgcgctacagaccaatcagcttcagtcagtacctccagctccaagaagcctcccaccaacaccaaggggaagtcagggcggagtaaggtggcgagaacatcgcaggagcgctcaggcgacagatggccatgcgaccgctgcactttcatcaacccgtcctctacgaactcatgcaacatgtgcggcaggaacaagccccgccgcagataggaagattggtcaaaatgcagttgtgcaaaggaacaccttctcactgggattctggtcgaacaaagtggtgctcatttggcccaacactctggtgctatgaacatgaagcagactctcccagggatctgatgatgctcagaggagatgtaagaaacgaacaatctcaggaatgcagcgcaagaggcttggacaaaattaggtagtagtaaaacatatatgcgtgtgtgttgttagctgtaaatattacttcatggagaaaattaggaaagtaccagcctggaaaatctgcgagttataaaataggattgcatgtgagaatgacatgtggggtcctcacatgtgattgtatttttcaacttcgtgaattcagctatggttcaaattaaaattggcctgtatggatgagtggttccattaaattggcctttgctgtattctgctctcagattggaaaagcttaactgtttaagtttggtgatttcaattctgacctgtaaattgtcctctatttttttttacagccgtggaaacaaattcttatgagaaagcccattttgccctttgtgcttcagaacatcgagcctacaggacgatgactccacacggatctgacgaccggagctcagatgatgggaggagctggtcaagggcacacttcagcctgcaagtggggtgggtcgacccgttaggtccgtggcccgaacctaaatttgtggcactaataggttttcgggccggcccatattttcttaggtgacaatgggtccaggagtcagttgaccctaggggtttttgggtcggccttgttcgagcgctccgcttgctcgcgttcacatggcggcggcggctttagggctcccggcctgagacggtgcggctccaccgcggatcgagccggcggcggtggctcccggcggaggcggcagcggtggcggcacggctccatcacggatcgaggtggcggcggcggctcccggcggaggcggcggcggtgacagcttcgacttcgcggtgtgctccaccgcgttttgaggcggcggcagctgggcgtgctccttcagtcctcctcccgtctccaactccccccaagactggtactgtggttcacatcatagcaactagcaacggattcttttgttcttgattttctttttcttttctttggttcttgattctttggttcctcttctatgcagttccttctttcggcggcggatggaggcaccggcggacggcggctacctgcttggtggccaaccggcgaggtgctccggaggacactccaccggcagcaacggcgagggtttcggaggacacccggccacatcgccatcttcatctagctgggtttctctccctcgtgagcacaggtatgatttccagatgatgggaggagctggtcaagggcacaccgcacactcgacctgcaggacgatggcaccatgtgctttttgtttttctgaacgaatcggcaaactgccaatttcattgaataaagaatgaagaaaactttacaagtatgaaaggaaacacagcttcagaccttcggttcagtcgagctaagaaattaaaaatctagccagctaccaagatacctcgccccggccaatgaccacgtcttggcctcctctttgattttagccagtaggcttcccgatgatagctcctatgctggaagattatacagtttctttcattccagatttcccaattgaccaggagagttagcgtgcagattgctttctttgtagcttccttcaagctggcagtggcctcccaccatgtgttttactagtactttataagcatgatttacatctcatgcatttacataaagtttttgaacaagacaaataatcaaacatgtttttaaaagttaacaacgccatctattaaaaaagaggaaatagcaaacaaaattctatgcataattaactacttatgcaaacacattggctttataagttatgcaaagtgcaggagaaaaatatttcagtgacggtacaatttttttctctcgtcgaaacttgtcacggtgtctgcacgacaaaacatcacttgcaaccacaccgtgtgctaaggcaaaacaatccattttgtttttcaataatagaattcgtgtgtgcgtgcgttgtgagtgtctgcgttgtactgtgtaattttaaaaaaaagttacagctaattattataaggttacatgtcgaagactacgacatataagatcacaacttgattaaaaataagaaaactagttaaaacaccaatctaaaagatagagaaaacaactttcatctataattagcaaggatctgcatagccatttgtttcactgacgcttgcaagatatgtagtccttttttctcaaatcaagaaataccatctctaaaatatgtgttaaacccaaatttaactcctagagtaagaaataggaaactatagcctaatttataaagaacctagaccgcagccatcgggcgggtctaggcaacgaggcgggtcaggagtaggttaggctgaaacacgcccgccttcgctccgcgacttctccccccggccctgcagaggttgtcgggtaggaaacatcacccgtcccttgcctcgtaggggacccgacggatgagcggggcccgcaccacccggttgggcgactgaggtgacgagcgatgagtagctacgagagacaacgaggatggtcgagctccggcgacgcgccgaccaggtgagtacgacagcagacggcagcgaggtggccagcaagatgaggaggcacagtgttaacaccaaatttcggcaaagatattcggagttgaagatgaaaccgaagaggatttaaaggagatagttcgtttccaaagcaggcgacaagatacaggtgacaacacataatacctgaaactgtataacaaagcacaaaaaaaaacatacgataagattctgagttgtctatcacatgcattatgggtacaagagtcttgaaagcgaaagccccaggattattcagaagatagaacagatcatggtgctaccagacacgcaacatcttgacttgtgcttttccattcgaagtttaaccttcccattaccatcgccattgtgcccaactggcatcacctccacaccagtgaagactacaacactgtcaattacttcattatcattatccatggacctaatatggaagaaccttgaaatgcagaacctggcggagccgaggttgacaagctgcggttcttgatattccagccatccctcaggtggggcaaattcattccagtcgcctataagttgtggctgggagtcagaggagatcagatcagcagcagccagcaggcggcggctgggctcagcagagaggccaaaccagagcttgagctcgggcacgtactcaagcttgccagagaagaatggcagcggcatctccttggcaagctacagccatgtgttcatctccgtgtccaagcagtaggagccattgcctcagcccccacttctagcgtgaagactataagagaccccacgaagaccctactaaattttttttatcatatgtagatgggaggggactcctccactactagtgtgaagactaccccacgaagaccccactaactttttttaccatatgtgtagatgggaggggggactgtaactctatctagttttctcagaccccactaaattttttttaccatacgtagatgggaggaggaatgtaactctatctagtttcctattttttttaccatatgtagatgggagggggactgtaactctatatagtttcctcagaccccactaaatttgaccccactaaatttttttaccatatgtagataggagggggactgtaactctatctagtttccttataccccactgcatatgtagatgggagggggactataactctatctagtttcctcataccccactgctgaggaggtggcagtggcaagaggacttgccccaaacaaaggcctcaaattgattaatgtatctgacacggaaaacagagcaataaattagtacgtggttaattacttattagcttataaaaacttaaaaatggattaatatgattttttaaaataacttttctttagatttttttttcaaaacatgcaccgtttagcagtttaggaagcgcacacgcggtaaccgagagagtgaggttggtaacttgaactcaagaacacaacctcagctgcgtgccgtcctccgggtcgggatatctctccatgacatagaggctgccaccgccgctgctggggacgaagagagagatgggatctgacttgggcttgtggatgtttggcatagccatcacgctgcgggcatcaacgtcacagaggcgtgtgatcccagtgtggtccaccattaccaccttgcgatctgcaagggggaagcagtcgatattacgctgatcatagggcatatatgtgcatttcaacctcaacatcggtctgggaaaccgaatcctctctatttgtatccttaagccccgtttattcttcggattataggagtcagcagccggtgctgctgctgctgtgttgccgaacagatggcgcgtcaggtcgatggagcgcagccattgggcgcccgcgtaggaagagtccacgatgagattctgaaaccgccgcgataggcccatggcggattattcgatcccaatttcgagccgacctttgcttactgaccgactgtaaaagggaaggatgggaaaaaaaaagaagaagaagaaaggaaattatattgggtgcatggagaaaagaggaaaaacccctcagatcgatctaacagttatgagcagggttcacaatttcaacgaaaatcggccgaattccgcgaaatttcgagtttcgacacggctcggaattaagtttcgattggaatttcgaaggttaaactgtagatttggtccaaattcgaaaaccgattaaaatttatcgaaaaccgtgacaccgatggggctcgaaatttagtgatcaaccggtaatgtaatccctgattatgaggaaggaagaaatagtaccttaccttcaattcgcaaaacagcagcaaacagatgtagccttcaaatcggagatggcgtcacaaaatcctcctatcaaataccgcagacaaagaaaggatttggttttcgaccaagcaggatgaaggatcaatctacaagcgatgtccctcaaaaaaaaaaaatccgtcggaactcagaaagaaaccatcaatcatgggctcgtggcgtccatggatcgaagtgaaactactcgacccaataggcctatcaaaattcggcccactagaactgactatgtgggaccaggataagccacgtcagcgtctgtataaaagaagaccgttgactcgcctccctcctccgtcacctacctcctctcgactcttcgagctcatcactcatcacctcgtctcgccgccgctcaccacaccaccttccgatggatgccaccgccttcgcctccgctccgaaccctagccacgcgccctcctcctcctcctctctctccgcctcgtactcgcgggttctccgcttctccgtccgcgacccgtggcggcggcggcgggggcagcgcctcccgctccacgcgctccgatcgcagcgccccgagccggcgcccgcgtccgcgtcccaccacgacgtggtggttgttggcgccgggatcatcgggctctccatcgcgcgccacctcctcctccacaccccgctctccgtcgccgtcgcggacgccgccgtcccgtgcaccggcgccaccggcgcaggtaccctcagtgcgcgtgcatgtgcgtggggggagttgggtaatatggcctctagggttttgatgtcccgttggtgtgtgcgctcgcgcagggcagggatacctatggatgtcacaccggacgcccgggagtgacacgtgggagctggcggtgcggagcaagcagctgtgggaggagctccccgcccaggtggatggcttcgggggcggcggtgcgcgggagaggctggggtggatgaggacaggtaaaatccatgtgatggtgaattgctgttttttcaaaatttgtttgggggatttgggaccgatggagtcgcgtcgtctaaattgcttgccagagtgattataactttgtaagtagtggtgatttcagttagagagtacaatggacattaatggcatcccctagactcttacggtccaacagatttaacgaccaaggtaattgaggtacttttgtactccaatactccaggactgtaatgttgatgcggtagttggaaactatgctcgttcaatgatgaaatggcttatcatatacattgcattatgtgtactgtgtttgatcaaattttagttctctatggcagtcagagtctgaatgaaatgtgaaattctgttatcatttttgttaaggaagcttactagttgggagaacttccgaagagatggctacattggaggaaaggaccaaagctctatctcaggcaggaatacgtgcggaatgcttgtctgctgcttcattgcatgcattggagccggaactctatgttggacatgatgggggtgctatgttcttgcctgaagactgccagattgatgccttccaggctgtctcattgattgaaaaggtttcttctgcagaatttcgatttcatatttgtgcaattagcagtggtctccaaccgttaacattttcattcaatagaccaatggttcatattcctcagaaggaagatatatggagatctataatgatcctgccatgtcattagtaaggtatcaaggcctcttcttttcagataacttatgttggttggtagatgattacttgtctatcaggctactgagatgggctttcagctatgccaaaccatctacctctatctgcattactgataattgtgttaatttaatgcagatcagagactactggaacagttcaaggtgtccaaacatctaagcacatcctatatggcagaaaagctattgtaattgcttctggtgcctggactcgaaccttattgcgtagttttcttgaaccgaatcctacattggacattcctgtgatgccacgtaaggtacatgatacatctgaaatttcttgaatttacctgtgatctgaaaaatatttggattgaaatgatcctaatgacatgctagctaaaactaaatcattacaaattgttcaccacatatcttcagttcttccctaatatagtactaacatgatggtcatttctctgtaatatttaggaattacattttttttcttcttgtacccaactcaatacctaacaacattagggtaaaagaaacttcctctgttgtttcttaaactttcaccgagtccttatactcaactttgacaattactctttcctaattgcatgtttgtagaaattattaacttaagaaatgatacttttttgggggtaaatccactcagatcattttcatgcaagtatggtccacatctgtttgaggatgggggttgtaatgctgtagtcttccatttcagggtcatttgcttgtgttggataaatttgacaagcttaaactaaatcatggactaatggagctaggatacgttggccatcaagttgctaaatcaagcggcacacccctatcttcagaatccagtgaagatgagcatggtgctttatccatatcaatgaccgcaacaatgaatacaaagggaaatttaatcctaggtaatttatgaactagcaaacttcatcctttgtaacacgttttgttcgtgtggatgaaccaaactccttttcatttaaccaacttaagatacaacacaaaatgacagatgcaaccatgcaagatcaccacatttctatgttacaggaagcagtcgagagtttaaaggattttcaagagaagttgacatgtccatccttaaatgtatatgggaccgtgcagcagagttctttcctacgctgaagaatgttcatcttgatattgatgaaaacactgaaatcaggatcgggcaccgtccctttagtaagcccttctcattttagaacaactcaggaagagaatgccacatagtctttcaaagatatttcattgcaatgttattagtagttttttgctcttttatgtagtaccattggaaataaatatctcatttgtttcagtgcctgatgggaagccagttattggatctgttcctgatctgccaaatgttttgattgcgacaggacatgaaggaagtggacttgctttggtaagggcaatgtataaatctgctccagttagtagctttgtctcttattatttatgtagttgagcaatcaagcataggacttcctcagtccttggttctcctgatgacagggctacaggagttgggacgaataggcccaatagaggcatgtgtcctgtgtcgtatacagaaatagtcgtgttgtgttcgcttgattttttttttaatttgtagagattggttctactgttatctcttttaagaaggtacagaagttgatgttcatgtggtaaattttacttcaggcattaggcactgctgaaatggtcaccgacatgattcttgggaatcctggaaaagtggacttctcgccattctccataaaagacaggttttcaggtaattctggtaaacattttgtgataaatttatctttatgaaaatccatttgttatgttttcataatcacaatttctcttatctgcaacattgtctcactgatttttttttcttgccttgtactccctccgtttcataatgtaagactttctagcattgccca

SEQ ID NO: 69738 - DNA, 1721 bp, Oryza sativa
attcgctccaaaggagatcaaacatagggcctcttatttaacgtagaagttccactagacttttgcaggaaccaattcaattttgcgaggaatcaagagcataacatctcattctgcgataggcaactggccaagttgaactatctattggccaagtagtgactgaaactgtagcgggatttacgctgggctagaagaattctgcaaatggaaagcccaaaccgacagaagcatagacccaagtgacgaagacctccgatgagaccccgatccaggcaacgttgactttgacttggaatggacagttcaaattttgatcaagaattcggttctgattttatccaaaccccctatcttgttccctgtgaatccaatccatcacccttttttttttttgtcatgtcgatccgttatgtatagttttctagcttagttgcacatcaatatcatcatgcactttaacttatctactcagcatagcatggtcttccccatcatcagaacaaatgctgctaaaatgctgtcctgccaaattccgtttccttcagccaatcagcaaaaagaaactcccaattccacagtgagttccatgaaggttataatgaattcacaaaattcaaccagacaattcatagtgccaagtaacaatgcaggcctactacaagtccaccactgatatgtcatccaaagaatcgatcaagtgtgttaccatcaatcaaaatcagcaaaatcagagctttacctcaagaccgagcaaaaaatcaagcgacgttttgaacagcgacaccgactaatggcaggaccggccatatctatggctctctctgctatgcattaccactacggcgacctgttagaacagtctttggttttcagaaaagtatgagatgtgaccaggtctctggtctctgctcgatcgatcgatcgatcggtagttccagtaaaatgtcactgtccgattacctcagtatcgttttgggtggtgttgaacgccatagaattatgctagtagctgctcgcggttggagtaagtgaagtgtccggcccttttttctaacctcacctgcttgtcctctgtgtgtgcagtgtgttgttctaattgcttctgagtttgcaatagaattttataagtcatgtcgctaggatggcgacggtagatcgatcgatgccgtgccgtgacgattcagccgtcaagatatatcggttttatgcattgtccttgttctttactactattgtgtagtaattgatcaaagaacgagaccagtcagtgctgaatggtgcgcaaatgtcacttgtatgactaggattctgcttagtctagtctagattggtacagttatcctagaataaaatgcgtgcgtgtgtcctcttaggttgaactggtaagctgcagaatgtgaaaaaaagaactgaaaattagcttgtgaaaacattgttggtcagtcgtaattagcttgtgaaaattagtaactttgacggtgaaaattaggcggttcaggtgaaagtgacgcgagcctggaatgtacttactagctagtgtggcaccacctatcagctcatgaatcacgaagacatgatgcaagtgaacaagaatgaccttcttttcggcgtctcctgatcgagtcctgaactttttgtttcttcagtgcatctcttgcagaacattgattattagattggcatgatgagttcgtgtttcttgcctaataaaagggtta

SEQ ID NO: 69739 - DNA, 1996 bp, Oryza sativa
tcactcagaagaatgctcaagggaactgggggcaggctccttgatagcgcatagacaattggaacctagaaaatgtcaacctgaatagaattttgcgcatatgaatataattatctaattatggaggatgtttctttctggagaatcaatcaatgcctacatgtatttttgtaatggttgatctgcctttatcatgactaaggaccaattagatcttagggatgggcatggattactccttgagtacacaccaagtgacccgcgttcatccttactagaattgtaaatatgcttgaggaactttcatggccattccagattggtgttgtctaagcattgtgtttgcactagtttgatagtttgaggacagtattttgatatcttgatgctgttaaattacatatatataatgcgttgacgatgctttgatcttcagatagcatgtgagaaaatattttcatttggctgttcccttccccagaatctattggaagaggacaaggacctagcaaagcagcaacaggagttacttgatggaatttacaagaagtactgcatactagacagtgacgtgatgaatgatatcaagaacctctctcgccgttatggagtcaacctggccggtgactgatcagttttgaccatccaagagacggactgcttcaaaaggtccagatcagtcccccaggcgagcaacatgcattggtgtgacccaataactgcatcttctatgtaaatattttttttgagaactttctatgcaaagattctgtagtgttactgttgttcccgcatcctgacccacccagcaacagtatgctcgttttgtgatgtgtataggagtaacttcttgcgctgcgcggagatgattcgctgctgtcggatgctgtctattatgcatgtctgaaattaacttgctgttgattaatcggaggttacattcataatgcctagtcttgccttgtttacattcattgtttcggttcagttgagagttcagagatgtcctgatggggttgcggatattgttgtatcaatctctcactgagcaagtttaataataggatataaccaaccacaaacttttgtgaaagaaagggagaaacaatgttagttctcgtactagcagtaaatgcactacttatataataagtaagagtaagacaaagagatagggaaaaaaaatagagacaaccttatagtaactaatactccctctatctacttttgatagtcgtattttatcttggcacacagaccaaggataagtaattctacttatcatccatttaaacatgttaccagtcattcctcgtaaacaagcgattcattaatatttacatttctcgatgcccatatagccaatcttgtgtggaagaatgaagagtcatgcattacaaccaagaaagtcattaagatgatagattgttgaattgaaatatgcctatcaaaaatatttttttcagatttagaaatatgactatcaaaagtagatggagggagtatgctatacatgttagctttagttttttgccgggatggccaacctaattttattaaggctgaaaggaattgttacaaattttacaaaattgacattaaactgtaggggggtggggggttgggggtagagaaaataaaacgaaaaacaaatagggccggctgacagggaggttctcagccaacttctctaaaaataccggcctccctccacaccaaatctcatctctaatttctctataaatctctgagcgtgacttttgctcaaagatcctagcattcctctctttccacacaaactaacataccatcatattagttttagtttgagcttgctaagggcaaccgcaatggttatctataggctatctacaagagatccatatcagcatatttttctacatggaagagattaaatgaagagagagagagagagtaaagctatctactaacctggagatagtctatagagaaaaacgaggcaatggattagaga

SEQ ID NO: 69740 - DNA, 1763 bp, Oryza sativa
aaataacactgtttactacccatgttcccagctcgaaatagctgagcattcctccagagtccatacaaatatggaatatggccttggcgagcacggacaagtaaaatatacaagcagctggtgtaataaacaagctgtgacacactgtggaagcagcctgtggacaaccaaggtacagccgtcgactgcactgttcctaggaaacgagaaggcaacggctttgcgctggagagagtcaccgtagtccgcggccaggggaacagggggcacgcatcctgtcgggcacccagccaaccagcgctccttctgcacgctcgcgtggtcgtattccagcgccaccaccgcgtggcagcttggcagcttccttccgcctaaaataagcgccacggggactcccgggcttggacctccagaaggtcgcgagatctcgaatccgcacggtcgcggccctcgctccgcgcgaaagcgcgtcgaagcagaccgcgactgcaagcgatcgaactcgataccgtacatggccacgtccggggatccaggaacttcgggttcgcaaacgcaaagcgtggaaactggaaacccaaaggatttgccatacggaacggaatccgatccagccgagcgcacgggcgcgctcgttcgccgtgccgagccgtgcgccgcgcggctagtagccgtggcttctcgttctccgcgcgcgtccgtggcaagcaagtcccacggaatcgggggcgagttgcaaggcttgcagctgtcgagccgtggagcgtacgtgcgttcatcaaagttggacaaggcccttttgcttgccaagtttcgagtcatcaccagttaagcatgccccaggtggccaggtatggaatggatcaaatgaggtagaaatagcaggagctgggatacgaacacatgcgtgtgatctggccatgacaactactcccttcaatagcatctcccaaatactcctttgatcacaaatttttgtaaattttatagaatgtattaaaatgcaatatgacgaaagttgtcaatgaaacaagtctgagtggtaggaccagcaccgcccatttcgaccataattgacggcacctctaagctgaagtcatgattctaaggatagaggggatgacatagtagtagggtagtagttgtagtacatacgcatgctacatgcaatgctggggtttttttcttaggttgtgttgagttcacactgaagtttgaaagtttggttgaaattgatacgatgtgatagaaaagttgtgtgtattaaaggttcgatgtgatgaaaagttgaaagtttagaaaaaaaaactttgtaactaaactgggccttagtcaggcttctcaccgtctaacgctgatcaattcaacgatatatgatttttcggatcctttttcgttgcaaccaacaaaccaaggacatgtttactttgatgccaaaaaaaccttactaaattttagcatttggcaggatttcttatatagttaccaaaatttggcaagaaactaaatgtagccacttttttttgtaactttaccaaaatttgataaggttgaaaatgatatcaaagtgaacaggcgtcaataattgtggatgtcagatcaagcagctctatacgtcccgattgcatttcgaagccaaggagataaaaccagtagtcctctacctgcctgacactggcacacaggttaggtggtcgtgtgatcgattagagaagcaaacgaagatatgccgatcctaagtcaaaagattcgggctgcaggaa

SEQ ID NO: 69741 - DNA, 1889 bp, Oryza sativa
agtgccctctctcctccgtcaaatctaggagggagggagggagggaggggaggggccacgccgcctcctccgctactgtctgtggccgtcacccgggaggagccacgccggcacctgctgggaggaaggagtgaagggggagagggggatggagggggaggtctaaggaggagtgaggccttttttgcagccggatgtctttacattccacctgcaaaaattaattttcacatgcgtggtcttaagacgcccgcatataaaaataacccttattttgtaggcataccttttaaaaccatgtatgtgaaaatcgattttcgcagacaggactagttctattcaacctttagctatttttgtaaatggtgatttttgtagtccgtctggaaaaataaaatcatgatgttgggaaaaatagtttttctagtggtgtgattttggtttcacctgtgtggtaaatgcatgattaacatcttctagtcccacaagtcaaaaacccatgcagtgcacgagctagctactcctgaaccattgatctcatttgatcaagtgtttagatctatttatactaccacgctagttagcagtagcagaaacatggaggaacattactttttaaaaaaaggtgcggaggtgtcatgcccagaaattcgctaactcgaatttcaagtagaatgtgtattaaaatccctgtccaggaccagccagagtacacaaatgacaatttaataaacagatccacgtcttacaaaaacaataaaataaatcttacaaacgcaacggaaaaaacaaataaattagacttaatcttcacgaccaaaagcatagcttcctccataaaccacaagcaatcctcgacgttcggaacaagctcaatcctcgaagaactcaccatctaaaccaatctctgcctcggggggggggataaagcaagactatgtaccaatcaccgtactcaacaagtcataccagcaggaaggtatgatgcaagatattctcaaaggaatggctcattggatatttgcaataaaagcagcatttataaatcatattttaaataagtaaaacaatatatataattaagtagtattaaatcatcactgtcgaacgctaaagccacattgtgacaggcccaaccaaatcacctgaactacaccagttttacaagtcatattattatagtgagactaatcacggtgagctagttgaccgcctaataaccgcgggcacggctattcgaatagttttccacaagactcattccacacatgttaccatgcctcgaagtactgccacgatactgcaaagggggaaatcatgacaaaacccttcatataaccctccctaatcgaacatacccacctcaggtttcaccccctccttgtgccaagtcgtgcagtcccctctcatgcctaggtaaatccggaaacaacaaagattaatatccaggcccgaactacaccattgcctctacccttgccatggtatgtcagctaggttaagttatactctagatttagcctaaagcccatgctggttatcatcatataattaaggactaaattataatgaatcccattgtgaactagttgatctaagcatggctaagcattcctaaacatatcatctagtcaattataacccaagttatcaatagcataagatattcaacaggccgagtatgataggcatccatcccacacgacattctaaaacaatgcaatttaatagaaagcaggggattttataaaataggctcaacatgatcaatcctgtatgtatgacttgccttgctcttgtgctgatgaaacctcggcaaccacttcgaaataaactggatcaccgaaactgacagaatctaaacgacaaacaaagcatacaagaaatac

SEQ ID NO: 69742 - DNA, 1616 bp, Oryza sativa
atatcgaacgataacgtcgcagtccgcagcaaacacaagcatggtagttaatcattatatcagcttatcctagtgatgcaaaatccatgcctgacataatctggaatttacctgcattgatacctgacaaactcttgtataatactgcactcatatctgtgaagtaaaatttattagcgttggattccgccgttctggtatatttagaagcttcgaatccagaactgaccaccagttaaattattgccttccctatgttcttaggcacagcgccacagaatgtacactggagtgcttgcaagcatatgaaattatcagaaccagttcagatcatgaattttgtatgcttcactcacaaaaactccaaaacgaggattattgtatttgcgagagggtatggcaattgagggagatcttatttttaagaactcgagatgttgttaaaaaaaaactctagagcacttcgtcttgttggcaccttccttggttactctaggagatcgagtataactatagtaaaactggctacttggtagttgccccatgagacataaaaatcagacaatgttatacaattctttttgtacaactatcatcatacatttggccaaaattgacatacagtattatgttggagcatactaggtttttgtttagaccttataatttgctaggcaaaaaaggtgtacaatatcctaaagaaacaggagttggaattctcatcctacactagctgattctatcacttgatggacattctgtactgggtattccttgtctgactcacaatcatatggtctgtgtagacatggaactagtgtgtactcatcgcttcacccttatacatcattccttaagcatactgtactactatatgctatctcttcccttttcctttttctgaatctgaaaaactaaagccttcatctacctcttcctattaccctatacctagtcacctaggcctcaacatatcacttgtctttctcgaactagcttctgtgctatatagaaaggaaaagcgacaaaattcacgaacagtgatgttgtagtcctttttgtgcaatcttcatatttacagaacttaaccgctcgtcttctttgagcccggagaacatgcatttcacaaaataagctctaagggtgtttgggatgcaaaaatgcagagaattttactattctgaattataactaaccaactactaccttttgtactttgcgaattgtcttcttccacattctttacagatcgcaagtgccaactcactttgtcttcagtggactagtgaatttagaatcatggtataattgatcattgggcatatggtgttattacgttttcatttatgaattatcagggataactctaatggtttagccggtgtactgagaaaactaacccactttctaaaaaacatgaatattagagaatgatctaatatcaaataaatataaggagtgatactttgaacctaagccggctagcccaccatctcatggaactagctggaagactacaggtatttctcactaacccactttctcttttgtactataaacttggagatccgtactggaattaatctagtacaatattttacatattcttcacaatt

SEQ ID NO: 69743 - DNA, 31628 bp, Oryza sativa
acatctgcaggctttgtcgtgaacgaagctgacaaatgtgtgtactatcgctatggtgggggagaaggagtgatcttgtgcttatatgtcgatgacatattgatctttgggaccagcctcaatgtgattgaggaggtcaaggactatctgtccaagagttttgaaatgaaggatttgggagaggctgatgttattcttaacatcaaactacaaagagaagatgagggtgggattacacttgtgcaatcccactatgtggacaaggttttgagtcgctttggatatagtgactgcaagctagctcctactccttatgatcccagcgtgctattaaggaaaaaccgaagaatagcaagggatcaactgagatactctcaaatcattggttcattgatgtacttggctagtgcaacgaggcctgacatctcatttgctgtaagcaagctgagccggtttgtctcaaatccgggagatgatcattggcaggctctggaaagagtaatgcgctatctaaagggcactatgagctatggaattcactataccggatatccaaaagtactagaagggtatagtgactcaaactggatatctgatgctgatgagataaaagccacaagtggatatgtgttcacacttggaggtggcgctgttttctggaagtcttgcaagcagaccatcttaacgaggtcaacaatggaagcagaacttacagcactagatactgcgacagttgaggccgagtggcttcgtgaactcctgatggatttgccggtagttgaaaaaccagtgccagctatcttaatgaactgtgataatcaaacagtgattattaaagtgaacagttcaaaggacaacatgaagtcatctaggcatatcaagagaagactgaaatctgtcagaaagcaaaaaaactccagagtgatagcattggactatgtccaaacggctagaaatctggcaaatcagtttaccaaggggctaccacgtaatgtgatagacagtgcatcgagggaaatgggcttgatacccaccaaaggttgcacaatagtggaaacctgtccattgtgattggagatcccgtgaatttggatggcgaaacaaactattgtgtgactgagagaagagacccttgaaaagggcttattttcatgatgtacttctcttctttcctgcatggtaggatggctcatgccttaatgtgatccgagtggcttttccaagcagagatgttgacctacagaacatctcggaaggaacacacctatatgagttcgactgctagtcacagtctatgaggtttgggcgatctctagatactcatgaaaggcctggagtttgacttatatgctccaaacaaaggggatgcgaacggcagcccagtaccagtcaagggtctgagtgaaacctgatcacacaaaacagacaattcaaggcatagtccattgttcagttttggtctgatgtagctcatttcctaggtggaagttcaacttaacagtcttcaccaaaaccctggtatatcgaacaggcacaaccttgagaacatttcttatgagccttgaaatttagtggggattgttagaataattgggctaggcccaatttatcctattaaatctcaaaggcccataataagtgttaaggataataataccacatcaggatttaagcgaggaatatctcaacctaaatagggagttattggaggctccctgttgactggttgaggtagggggtcggaaggccccacgcgcgcgcgcgcgcgccaggccgggccgaggccgtgggcgtgggcgaggcgaggcgtagcgggcgggcgtgcatgcgtcacgtcgctactcttttgcaaccacgaacccacgttcccaggactgcctccgcaacagcgtgtccacgatcccacacgggcgtgcatgcgtcacgtcgctactcttttgcaaccacgaacccacgttcccaggactgcctccgcaacagcgtgtccacgatcccacgttcccacgactgcctctctcctgatagataaggaggctgcgagtccgatcagaacgatccgcttgcttctttcccgggtgttagttcctcctcctccgcgcctgtgctgttctcgcctcctcgcttctgatcgcttgcatgcacgagagattggaaggagcagggcctccggaaccacaccttcgcctgagatctgcaccgagtaggcgggtgatcaggtttttagggagtgcttcccacacgactgctcgtcctcgcccaccatgtctgcgcctagagccggcgctgctgctgctgctggaggagatggcgcgcctggagctggagccgccggaggtggtgcgccaggagctggagtcagtgccgcgaacaacaacatcaacggaggcaattctgcctcacaatctagcggagggccattctcggggtatatctttctcctgtttctgttgttagcgctttactgctatgttcctgttcctgttattcatgatgcctttagcatgctactgcgttactgctatgttcttgttcctgatattcatgatgcctttagcatgctactgcgttactactatgttcttgttcctgatattcatgatgtctttagtatgctactgcgttactgctatgttcttgttcctgatattcatgatgcgcatgatgcatttagtatgctactggttatgttacatgttgtcactagatcaccctacactgtttatgccatgattattgtcttaacattttggattaaaatatgccgatttatgaccatattttcaacagtttatgtgtgtaggaaagttttgatgtgatggaaaagttggaaggttgaagaaaaaatttgcaactaaacacggcctaaagggaggagttaatactggatattcagtgaacatgagagagataatagttagtgacagatatcagttgtaattgctaaagcgataattcatgaaaccagggtttataaaggaaaaatatcggtaattttgtgtgtagatcaaaacttgtgtgcttccgatcataaatattgagccaccagttgcagatgacatcaattggagagagatgctaaaggacaagatcaaacaaattgtttcttgaatgaagtttgataccgcaaattaaaaatttgtgcttcctcgaacttctaatgctgtgttcgggaaccctcacttcctagcacgtaaaacgaagcagcgtcaaagataagatgagcagatattcaaagacgggagggaaagaaaacaaaacaagttgatcaaaacggcagacaaagcgagagagctcaaaggatgacgacttgacgagccggccgggtacagaaaagttaccggctccgggttgcttgctcgccgtcgacgccagcgtccgcgaggaccgcgaactggcggacgcggcgcgcaaggcgcttggcgtggcgctcgcgctcgggggcgccgccgcgcacgtcatgctcggcgtttacggcgcgctcaatagtgtgctcatcgtcgcccagtcggggccagcgtcgccgtcatcttcctgtgttggatagtatagagagagaggatactgcaaatattagacacattgtattgagcctcaggagactggtatatataggagtacatggagaggagataaagaaggattacagttatggaaagagtctacacaaatcaatcctatcttaatatgactctaactaccatatactctaacatcctggacgacctcctcgacaagggctacggcctgcacggggcgtccgccatctccctgctcgccgccaccaacacctgcgagaaggtggtgtggcaggtgttcagccccctgaccgtcgacaccgggcgggcgggcccggagttcgaggggatcgccgccatccaccacgccgtcctccgaccggccatgttcgccgccacctcccgaacgtgatgggcctgctggccacctgcgtcgtcctcctcgccaccgtcttcctcgagggcttccgcgtgatgctgccgctgcggtccagggacgcgcggggacggcagctcgccctcccgatcaagctgctctacacctccaccatgccagttgtgctgcactccgccgccgtctccagcctctacacggtgtcgcagcttctccactacagccggttcgccggcagcctgctcggcacctggaagaagaccggttacgccgccatccccgtcccggtcggcggcgtcgcctactacgtcacgccgccggcggggctatcccacgccgccgcctacgccgcgtcgctcctcgcgtcctgcacgctcttctccggggcttgggtggaggtgtccaggtcgtcggctcaggacgtcgcgaggcagctctcggtgcagcgcctcgccttgcacggggcgcgcgagcgcgacgctgctctccgctcgcacctcagccgctacatctcgacagccgccgcgctcggcggcctctgcgtcggagctctcaccatcctcgccgacatgaccggcgccattggctccggcactggaatcctcctcgccgccaccgtcgtctacaatctcatcgacgcctttcagaaagaggagtagccgagtagggttcgttttagtcattactccatgtttcataatgtaagttattttagcatttcccatattcatatttatattaatgaatctagacatatatatctatttagattcattaacatcaatatacatatgtgaaatgttagaatgacttacattgtgaaacggaggaagtactggagtatactatactgcattacaactttacaagtcagtcttttgcaggagtataatcattacttcttcctcttcttggggaggttttcgattatgatcaatgatccatgctccattttatttagcaattaattcttcgaaacaaaaagttatagtacatattagcaataggttgtcttgatattcacaaattactcctctacgtgctgataaaattaagctagtacagaaattataaggtttgggtttgaattatcgatatgaaaaaatattgggggcaccgataaacatgattatcggaaatctcggaattttattgaagataaaaaaattttggacaaactttgttagattttgcctcaatttgtgcatgaaatcaagtagattgtatctagagcatttggtataaaaaaaagtaacatatataatccgcaaatgaccaggataggtgcaaagaatcatatagacagtcaaagatcatagtgtcacgcatgcaaattcaaaaaaggctgaaatattcgaccgatactgtttttttttcggtacccaccgataaactcgatttttgaaaaattcggtccatgtttcgtcaataatgtgaacccttcccacctttactgtatcctattataagtcgttttgactttttttttaagttaaacttctttagctttggcaagtttttaaaaagttagcaattatctataacatcaaattagtttcgtaatattaaataaattttggtaatatgtttttttgaaaatattattgtgtttttctataaatatcgtaatttttttaaaaaaaaaagaatcaaagcgattaattataatataaatcagaggaagcagtaaggagcaatttctgcaaagcttaaccagccagagctaaaaacaagtttgggcgctgaattcttccacgccaaatcaggaattggagaaatcaatcctatggttttttttctgatcccacatgtcaagtattgttttcctcaaagaaaaaaatggaaaagaaaaacaacaccaaaccatccacccattttttttaagcaaagggcaaaggccctccattttcactaatagaattgagatagtagcatgtaagcatcaatggacatgttcattctagaatagcgcaaccattctaggctgtgtttagtttgtgtgccaaaatttttttaagtatacggacacacatttgaagttattaaacgtagactaataacaaaacaaattgcaggttccgtctgtaaactacgagatgaatttattaaacctaattaatccgtcattagcaaatatttactgtagcatcatattacattgtcaaatcatggcgtaattgggcttaaaagattcgtctcgcaatttacatgcaaactgtgtaattggtttttttcctccacatttaatgctccatgcatttatccaaacatttgatgtaacagaaaagttgaaagtttgacgaaaaaattttgaacctaaacacggcctaggactactactgcctcgagatctgtgcccgccacttgaccgaagaccaagttgcgcttacgtttggtgtttgtgttttacgagatgcatttgacagtatagtggcaagggatgtgtggtttcaaccctaaaatctcgtgttcagctcctaacacgtacataatttcttttaaaagaaatatctggagggacgttttcttgtttgtgttttgctgacggttgggccctataaaacgggcccacttagggcccgcccagttacagcctgctgcctaacgcaaagcaaagccatttagggcccgcccagtcgggtctgggcctgctattgctctcgcaacgcaaagcaattcatctaaatccgtccattgccgaacggacggtacagatctctttggctgacgcgcccggatcacacgaggaagcgtgtcgatgtgatgtgatgtcactcgtccaatgggagacgcccaaacaccgaatcagcgggccccacgccgtggcacttatgcaaaaacacccttatactctgtgaacccttacataatgttcacgccgtggtactaatagaggtcctaaatccaaatatctcattatgtaagggtttaattgtaattagggatcactccagaaggccagaaacctatatatgcagatgccaccctggagtctcgaaaatttgaatttcgaagaccttctccctctccacctcgctcctctctcctctcgtggccatggcgatggcagcaagggcgcgctgctcgaggcaacccaactcccatcgcctcctcgccgtggttgtcctcgccgctattctgctccttccggtggcctccgcggcggcggcggtggtggcggcggtggcggagggggacggggtggagaaccggtcggcggcgaggcagtgggcgacggggaaggacgagggggagctggtctccggggaggagtcgaggggaggtgggtcggtggtggaggacgagttcgcgggtgggttcggctccctcgacagcatgctgcagtgggcgatcggtacgtgcagcccgaatcccaaattctgcgattaaatctttagattcgctttgggattttgagattttgaagtgcgaaagcagcggatttcagtggcgctggcgaattttcagcccagtaatatgattgcaactagctgtgtacaaattggtttgattcgggttaattggaagtagagtgaatgagtggtagttactggagtagtattctgcacattgataatttattatagttttgtttgtgtgatgctcactttgaccacctgtagtcttaatcttaagctgttggaactagtaggctgttattgttactgaagtatgaagtttggttaattttggagacatgactgcattttgctgagttctaccttgttggtgcaggaaattctgatccggataagttgaaagaacaggcagagggtgtgcagaaattgtctgcagatgagctgctcaagcggcgaatggagatcaaggtgaaaaatactgcttcaggatccatcctctgattttgtgttgccgttggtttgtcaatgcattatcttatgacgctttctgctctttgtaacttattataatactggccatacccctagcttatagcagcagattggaacatgcttctgttcttgctgtggtttggattaccaacacatattgttctgatgccaactgagcaaactttatttcttgagcatttttcccatccttgaggaggtactatgaggtaccatgaggtacgaggtatcatgaagtaccaatctaatctaaccgttgatttagcaggggtatgatcggactaaaaaaacatgtgtactctcttcatcgtccgtgcccatccagcccaccgtcgtcgtcgtcatcgtcgccgtcgtgcatccagccggccgccgccgttgcccatccagcccgccgtcgtcgtcgccaattgaggccgccgccgccgtcgtgcatccagccggccacttgccgccgccgtcgcccatccagcccgccgtcgtcgccgccgtcccccatccagccggccgtcgtcgtcgccaatcgaggcttccgccgccgtcgcccatccagcccgccgtcgtcgtcgccgtcgtcgtcgtcccccatccagcccgccgtcgtcgtcgtcgccaatcgaggctgccgccgcagtcgtgcatccagccggccgctggcgtcgcgcatccagccaccgctgtcccgcatccagccgctcgccgccgccgtgcatccagccgcccccgccgccgcgcgtccgtccgcccgccgccgtccccctcgagcccgccgcgtccagccccctccagccgccgcgcgtcccgccgccgccgcgcgtccgtccgctcgctgtcgcccccctcgagctcgccgcgtccagccccctccagccgccatgcgtcccgccgctgccgtgcgtccgtccgctcgccgtcgtccccctcgagcccgccgcgtccagccccctccagccgccacgcgtcccgccgccaccgccgccgtccagcccgccgccgccgtcacgcgtccaggcgcccgccgccgtccccctcgagccagccgccacgccgctgctgtgctctcccgacgttttttctctctcatgaaacagtaaaggacataaataccctcccacccataataccacttcaatgaggaggtgcagtaccatgaggtacggatgatttctaaccgttggatgatgccagatcaatggtcaggatttggtactgcacaacctcaaggacagtaaaaaacctcttatttcttacattattatgccatcaatgctgtcataagagtgatattcatggaggtatcccaaatcaataacatgctctcagttagattttgtaaatttttattttatccgtgccttacgttgcactgttattgatcaaataaaaatagaacaatttatcacactcatgtaaccggatgatatgggctcctaattgctggtgatccttctctgcatagatgaaagacaaagcgtaagaatgttttcatgacatggccgtgttgaacccattgaatttttcttgcaggagttgatggagaaattaaagatgccgtcagatgctgacttaatgaagattgcaattgctgacttaaataattcttccatttcactggaggatcggcagcgtgcactgcaggaactattaattctcgttgagcccattgacaatgctaatggtaaacatgctctagtccatctgaatactatccactcagactcagtgctctgcacatcaagaaaaatatattcttataactttataagtacctcagattgaaaaatctaacttttggccttgtagatgtaggtgtcagtaatattatagtttttcttgtcatagcgattgttttagactaaggccgagtttagtttcaaactttttttttcaaacttccaacttttccatcatatcaaaactttcctacacacacaaacttccaacttttccatcacatcgttccaatttcaaccaaacttccaattttcgcgttaactaaacacaccctaatagtgatttaccgaggtactccaagcccaagcgtcacatatgtgtgactgaatgactgtgtatagttactagttttcaccaaaaaaaaaatccatgcttttttaatacaatgctcaaatccaatcttgaagttgcttgcttgtatttctgataagccagcagcattttcttttttttttaacaatgcaacttcaacttgcgaatatatttttcaaagtaataaatggcatgccaacatatggttcttaaatttgatgataaaaggcactggtagcctgttaatgaatgaacatgattcaacttatgaaaaaaattcaaaataaaaggaagtgcatgccaacatgcaaaactctgttccatttgatgaagcaagggcttatatttgtgcatgcagttcttagaatagtgatgttctaaaatatatgtttcttgtgtttattatcagatcttgacaaactaggaggcctcgttgctgtgattcaagatcttaataatgcaaatgaagaaataaggaccacttctgcatgggtcctgggtaaagccagtcagaataatgcccttgtccaaaatcaggtatcttcttgtttgttcgtcgaatctgcatcattgttgtttataaactttatgcagtgtccttagtggatataccttttaatagtcacttctcttgtgtggttaagctcagggagtagtgattcctctttgttgaaacttgaacacacttttgatcattgttatcaaactcgatgtttcatccttggccagatcctaggttatggagctttggcaagattagtgaagatgggctatgcaacttctgcagaagaagctacaaaggcgctgtatgctatatccgctttggttagagacaatataaatggtcaggaggcatttcattcagaaaatggaagtgcaatgttgcaggtagttaaaacctggtcttgataatattagcatttttgttttagttgtgacatttccctttttgcagcacatattggcgagtaatagtgttgacgttcggcttcagaagaaggcagtgtttctagtgacagatctagcagattttcagctaaattctggaaattcaggacttcctttcttaagtgaccgtatttttcttaagtcattggttgatatgctgtcaagatttgacctcgaccttcaagaaaaggtattatctgtggttctgtactgcttccagttctgtacttccttgtggttagcactgcttagcagcaaaattcttcactcgtcatcagagttgttgctgcttatgtgcaataatttgctgatttcttggtttatttgatatgcccgtactggaatgtgtgctgttcctcatataaggacttctgtcatatgtcaagagatgcatatgagcaacacaactttctgtctggaatctgttctttcagtttccatgagttacttatttgcttggattttaccagccatttccttcatagcttttactattatatactcaatctgatgttctgcacaaaaaggtctagaaatgtttgcttgtgtccaaggatgggagtaatgtttactccaattgacaaaaaattacaatgggctgtaaagtttgcctgttacaacataacgattgatcttgctctgtttttgcgtgtcatgtaggttttgttggctatcaagagcctactgaagctttcatccactgaagccacagatttcgagtcctgtgacctcagcagtgtactgtacagattgggcgtgcagttggaggagttgccatcagaagagcaaaaagagtatgctggggaggtggatgacctccggagagaagtccaaattctgttccaagacaagctcaaagaggtaaacaaatcacctcgcgcagttgctactgtaattgaggtggtgcgattacctgagctaacgtagcttctcttctgttataacctgcagggcacaaagactgcattgtgatgatattaggacgaattaacgacggatgtagtatgcaatggaggcattaaatttttcaggagtatagttgatgtttggggccattcttgcagtgatcagaatcctcagaggatcaaatggagtcatggaatatttatctgtggatcttcggccaggtggtgacatagtgtctgtaggatttgatgtaatcgtaggttaggattattaactgtatggcttcttttcctgaagctacctatggttaattcatcattccctgcactatattttaaccactgcaatgaagcaaattttccccttaagtcacctgtgtggctgtgtcttcctcttgagaatgtatccacgtgtactggaagttgatgtcgatcatctgttttctggcttgagaatccttcctcgttttgcactctgctcgagttaactgttcactctttccagatcatagagctgacagacagattaaatttaaacctgctatactcttgcttactccacttgttttgattgctcatggaacattttttggcataagcacacgcatagggacaaatataacgcatgcttgtcgcatttatttgttttaacagcgacgaaatttcagaccatttttcatagggtaatttggaaccatgctattataattttacaaattttgagatataccatcgatatctcaataatacgtagaatccacatgagtcaataacatgtgggtcatgattgcatatcttaaattttacaaaattataatggtatggtttcaatttttcctttttcatattgggaacctgagcacgtgaacgtctacttttcgcccttgaaatgaagccacgaagttggaagagcgaacgttgaacgcctacgtatttgcacgtgaaatggtcacagttttcgtcatgattatccattgcattcgcactagccaagaagcaaacttggcgtcctggaattttgcagcttggccgttatgatcggagagcggcgctcaccgtcaccgtgccaccgccgaggacggattgagatcctatacattcgaagttatcgtgtcttcagtcttcaccactaatgaaactaatccatccaccaactatctcttacaaagtaaacgtatatcaatgatactctctctcacaaagtaaacgaatatcaactggtttattttttttcgtgaaactagtttactcgagtttaaattctaaacttaacacggtgttcaaatttatggttaattatacttttagtgataggcaacatatcacttgtcccatcgacagcaagacgtccgtgattacttggtcaatctcaaaatatttaagtgtttataaggataatgacttcgctaatctcaagatataccaagtgctcataagggtggtggtttcatcaatctcaacatataaaactcagtctttcgaaagtgctcacagaggatagtgtacacattcataggggtgagtttacatgcgttgtgagtatctaggttttgtcatgtgtttctaacaaagaaaaccggataactttaatttcaaaaaatagttttaaaattttaaatcattaatataaaaatgttaagccctggttaccaaggtaaccgtcccgctatcctccgttccgttccacccatgtgccgcatgtgcactgcagcctctcgctttcgtcggctccatctcacagggttcatatcctctatcatgatgacaacaccattacatgtgggttccacctttatattattccatacatcaattactataatgatacaataagcacattgtaatattgtaatgtagggacattagagcaagtttaatagtatagccaactatcatctccaaatcatttatagccaatttaatagacaattcatataatagctgcttaatatactattaatacatggtctcacctgttaggccattcccaacccaacacactagacatagttttcataaactccacatcatcaagaaactagtactagacactactcttccaatgcaaacaccactattctacttaaatttaatgctacttatctcacatgatgttttggatgttgtgtagaaaccatgtctcatgcaatacatggtttccttctctttcctcatttatttacttgtcacatcactttttatcctagatggcaacttatttaatgctatggacatcatcctacttattgggttaggaatgaccttatacatatattacgttttatagtccgtgttacagctaactatggatagactgctgattatctctttcatcttttttatcttttttaaatatatgtttatagctggctattatagctgggatgctcgaggggtagatggttggctacctcgtcccctcccccgcacgctgcacgcatcccctctcctctccccctcgccatcctcaaatcccgctcctctcctcctcctcctcctcttcctccacccgctccccacccaccaccaccacctctcacctcgtcaccgatcaccgagcgcatttcgcatggaggcgctccggctgtcgggcccggcggcgccgcccttcgtccccgcggcgagggtggcggccgcgtggggcgcgcgtaggcggggggcgtcgaggtcgtcgtcgtccgtggtggcgaagatggaggggggcggaggcgggaagggggtgccgaccaccaactacgtggtgccgctcgacaaggccaccgggatgacgcgcccgctcgtcgagatcctccgggacctcaacaagcgcgtccccgacaagatcatcgaccccgacaccaacaccgtcccctggtcagtgctgctccccatccccccttcgatctcttctcctgcccgttccgctcttgcgctgcagaatgatccggctgatgttgcaataggatttaggcacagcgaagttatcgaattgatagggtgaatgaatgcgcgacatgaatcattttggggattttgctggagcaattgtcgcaattcaggaatttgggagtaaaggtggtgccattttttcacgtatcgcattggatggaagatttagctttgctttcaatagctaatgaattttccaccggcgcgaacaattcgatcggttttgccttgtgttaattacaaaatgttctacctctaccatccaagggccaaacagggggcacgtttcatcaactattgatgagtatgggtccactggatattaggatgattgtgagattcacctgttctgcagtttgcacctaccagaatggctgactttgtctgttacaaataaaaatgggctttaaggtagtaggctatgcgattaattggctaggctttatgattctttctgaaacaactaggctttatcatttttttcgaaacaactaggctttaatattcagatagttggtgttctacagccagcagtttatgctcttgctggctcgtttataggtttggaacatccatttgatgggagagttgcttgagtaacgtggtgttatcctgtttcgatctttgtttagaatatattatgaaaagtcaatggtcaaatgtttggtgtgtggatttgtttagttactcatttaatacaaggtcaaatggagacggttcttctagtctacaaagaggaaatggtctgttactttggaatatgggaattattagaacttcttagtatcatgccgtctttttttaaacgatgcacttatgtcggttcaatgaagctaaggcatttgtttcgttggtataaaaatgccatatctttgtgggatagaactttatgctttatgcataaatagttagtatttcctccgtttcacaatgtaagtcattttaacatttcctacattcatattgatgttaatgaatctagatagatatatatgtctagattcattaacatcaatatgaatatgaaaaatgctagaatgacttacattgtgaaacggagggagtagttaccttcgagctatttttttttttttaaaaaaaagcggaaactagagtgtcactaaaggatgaattacttgtgagacctaccctggtgttgggagagagtggtgcccctaggctctagctgtctgcagatctccttaaaactatgtgtaaaggaattatggaataactaatacttcttctgttcttttgataagaaatgttgttgctacatatgctggattaaactagcaatggaacagtataaattcaaagatattttcgtcactaacacacaagaataatcgatgatgctaaattgtactgacataactaagacttctgcaatgactactttcctatttttcaggtttgacatgaaagcgtttgcgtgtttcattgcttccttttgtgtaatgtaatcattgttaatatttgactctgcaggtaccatgccaatagaatgctgagcttttatgcaccaggtgaagtctctttaagattacaaactactttgtgctttctttcctttgattagaacattcttttctgctggttgctggttggttgtactatagtttggcgctcccagatatttctgtatgacactttagttccaaagtggatgtgtttttgttagttcacagccttcacaaatctcacactaagcaatgtcatgtaaatcgaccagttcctgcagacctgctacaaacgaaccttgaaagatggctggttacagtttgatggtatggtacttggtaacagctgtatgttttatctgataaaacattataaggtgtattttgttggatagagctattatgattgtagccctgcataaagattcgttagatagctaaacagaagctaggaactaccacattaggtatttaggtggtacataaattggaacatccactgcagaatgcactggagatgcaaagaaatgtgacgaaactattcttttttcaggttggtgtggagaagttcgcaatgttatttattctgacaatggaactgtaaccgtggtttatcgagtgattctgagaggaacagacggagaggtatttcatctttttacactgcagtattctacatactatgacatagttgatcataacacaacatacatgaaaagaacaacctactcgtactatcttgtttttgtagctgcccttatgtcaggtcagcataacccctgtatgtgtgtgagtgtaggcatacagagaggctactggcacggcaccagtgcacgagggccgtaacgacgatgctgttgcggctgcggaggaagcagcgttctgcaaagcctgcgcacggtttggtttcggcctctacctataccaccaggacgagatcccatagagatgaggatggctttgaggctcatttctgcagaggatctggtggtcacaaagtttgtaggaaaaccgcgatgaattttcgcaccttgctggtagcacaaggcgagcttttgctgatgcatatttacacaagaaaagctttaatttgttgctgcctcagttgttaaatgtattgagtccatgtcgtccagcatagtttgtcagataggaaaagaaacattaaaatcgtgccgttgcatagttgctgtgtttatacccgttttttgtatttgagtccacggatggatatttttgttgtcatgataatgaagttgcttcgacaattgactacgactcgctgtttcttgtatctcttcgcacaaacttgatcctcgaattttggtgacacaaaagctttattaattgtttttccgtatggctgattaaacgattatcaagctctgtgactaaatcatttgctatttgggttagaatcttatcaaaatttggtagagatttgagagtggaaagctccagaagttgtgttggtaatggtgttttaccctatcaaactttaattgtgctactaaaatttagtaaaattaaaaattgaccataaacacgcccagaatagcagtaaagaggctttgttcgaatcaatacatggctcaattgattattaactatatttaacacgaaaataaactaatttaaattatataattttatttcaaaacacgtcatcaagtagtttgagaaaatgctcgcgagggaatagactagcctgataagagcaaggtcaataatatagccagcagctagcttcacttacctttatattttatagctaatactaaagccaactagtacaatagattagctcttatatatagactgcacctcagtgatcaaataattaattatgtgtgccaagataaatgtgtatgatcaaaactaaactatatctgtgtagccatctgtatgatgtgaacttgtgatatcaacaagaattcgtaaaaaaatgattagtctttagataattactgctagtgaagtgttgatggaaagatccaaatcttatcacaattgcatcgctcctaaaaaaatcatctactttgtgtaaataaacaacaggtatatatcgagagaagatgtaaaaagaaacagaaaaaaagatccccaaatccactgacacaacagaactcagaaccacttcttctagctgcttgtttgctcaatcaacagaacagccacaaggcggcatgagatatggcatggcaacaacggcttcttcttcttcataaggacaacatcgatctagcgcgcagcaaccatcgatctgatggttcagcatgagaggaacatgatatatgaggtgcgtgggctttgatttggcaacagtggcggagcttcgcggcgtacgtggtttccaacggcggtggaaattgactccgaatctctgatgaacggcggtggggctcatgtggagtaggagtaggcgatttgtgcggacggaaaaagtgatctagagcaggagaggtgagagctgatgtagggaaaaaagtcacacgggatcgatggggttcggtgtggcccaattttttatcgcggaatcgtgtgtatcggcgggcgatagaagtcgcccgtttcagtgagctataggcttactataaagttaggtggaggagagaggtagtgaaaaattaggaattttggctctcatgcaagagttatttatcacaaattccaagacaaatacattaaatgtataagtgagagatagagtgaggagaaaaaaattgtagcaaaccttatagctaatctattactatatatatgttttggctttaagatgggctaatagtaggaagtgtgctatattattatccttgctctcattctctctctttgattctctctcatgaatttaatgatataaattttttttaagcctgctaagtagaactattgtacctgctcaagaactcacccttctagcttctgttcggcccatctggaacacactggacaacccgaaccgaaccatcaaccaaccgtccacgcaaaccaactcgccacgtagacttctataaaacccacgagcccgaatgcgcccgcgctcgaacccacccaaaaccggccatacataggcacgtagccgcatcgaaccggatccgatccgatccgacccaaccgcgaataccttctcgtcgaagaagcatcgaatcgatcgagagagaccgcgtgaccatccgcggagttcgtcgtcgtcttcgccttcgtcttctccatccaccaccgcgctcggcgaggcgatccaccggcggcgaggagaggcgcgcgggagcggccggagatggcggagaacccgcagctgttcgggaacgggatgctggtgcccttctacggcgagatgttcgtcctcgcccgcgacggcgtcgagttccacgtcgacaagatcccctcgtacgtcccctccctcctcctcctcctccgcgtgtcctttccggtttctgccgcggcgaggcgaattgaattgagatgctggggcttcgatggcgatcgggcgagggatcgtggtgtcttagatggggggaattaggggattaggttaggcacagcgggtgtgatattggcgcgccgaaattgagcattgggctgtatgatttttgtccgggtggaactcaacgctgaaattgagcttcgcatcgagtctaattggcggttactttgttgatctgtacgggttgataggttacaaaccgggacgcttaatcttgctttggttggaaaattacaaaatgttatctccttactgaagtacagcaactatggaaacagttagggatttagtgtcacaataatgagcattattcaccatctcattaccacgaggaatgcattttttttcattacattcaagtgttacgtttatgttccgtcttgaaaagttcatcttcgttgtaaattaatcactgctttggggcttgggctaattagtcttctcttgtggctgctatgcttgtcctcagagctcctggtggtcatgcgaaaacaaagggcacaatttacctgtcaaacataaggatggtctttgtcgccagcaagcctgttgggaacttctttgcttttgatatgcccctggtgagtaatggcagcctgaaactgataggagcaattggtcaaattttgtcggtatgatttgtttgatggtttcattttgcatgatagtaaattctaaatggtgttgcatggcaaactctttgcagttgtatgtgcatggtgagaaattcaatcagccaatatttcactgcaacaacatatcgggtttcgttgagccggtaagtacttgagcatcacgggaacacatggatatataatttgacatatttggtgcggcactgaccttggaggttataatgcaggttgtaccagagaaccagaacagggccctgtactcgacccacactttcaagatcttgttcaaggagggtggctgtggtacctttgttcctctcttcctaaacctggttgcatctgtgcgacgctacaatcagtttgaggcccagtctgccgcaagtatggcgccacgtgtggacccgctacaagctgttcagactcctgttgatgatatgatgcgtcatgcgtgagtgctcaacctatctagtttcctggtgtgccatctgtttagcttttgccctgctagaaaactcacatgatctactatctacaggtatgttgatccgaacgatcctacaaagattttccttcagcagcctgcgccagagtcacagctgaggaggagaaactaccacggacgggctgacaatgcgtactagtgttcttacctgattgcaaagaacccatatgttcgagcctatgaacatatggatttcggcctctagtcgcgtatcatgctattacgtgggtgtgaaatgaaagcttcatgttgcccagaaacctattgtatatcttttatgccatattcagttgcatatctcaataatggtgtacatattccgtagtcctctggacttggtgcaaaaaatggtttatttgatcccatggtgtatggaattatcattgctcgtgccagcttgtaaatcacagaaacaatacgattattgcttgtgttagggattcttttttctttggtcacaggggagactgaaaacagatgagtaatgttggtaagttaggttgggtgtttctgaattacttgcttttttttccttcctgactttcatgttccttgcaagactctgaagagcaatggcttctgtcaaggtgcaataaataaccaagctaaccttgttctgttagcttttgctttgggggatgtggcagcatggcatgtgaaaaattcttagggaagatctcactgtctgtataaaatgtgttttttaagcagagttacaggcattcaggaatccaaatcagcaggtcttcaggatctgaatatgtaataatctgggttcttatagttatatcgatttcgtcaacaggactgttgtgtactcctctaaattttgctttcaataaaagcaaggaaaatgtcgtctgtaaatatatacagacaaggttccatgacaactttgattgataaacaccacaaataatgtatacgtgattaattcaattcacattggtccacttgtggcattatgtgctaccaaaagtggattgccaccagctgccagagactcaacatggaaaatgtcaggcttgcagcttaaagctgcaaacgtggggctgacactggaatttctgaaaacaacaagagcaaatgataaacaccaggcctttgatggtaatctatcttcttgacaagttcctgaacacatggcgatactgaagtttcttttggcattctgattccttccatccatttgcttgcttgcacattgtcaggctgcacggatagcagcaatatgactggtacaaaggaaaacagacagccgcaagcagcagcatccagaccatcaagtccttgtcgagacgaatttagatgcctatttcttcttttcttttcaagggaaaaaaacactgaccgtttctaaggaatgttgtgaacttgacaagtgatctcggtgttagtgtgtcattgtctcattgactatcttactttcacattcagttcgctgaagcgggtagcatttgcatcattcagcttcagaagctcagaaccatcatataattacaagaagtttctttgtaccataaccaggtttttcacatgtgtagtggtagatgaatgaatgcatctactacttacaatggaaccatcttaccttcagttctgcctgctccatgacttcatgtaatgaggttcttatagatgatcatgaatgaatgaagctggtagttgagaggctgtatgaaggagacagctcttctgctcgcaacagcaccaatcatccatggagcaaatactgagtagcaggagaaaaacacagcaccacttcagttcagttgacaacctctcgagacaaaacaacagtatcagacaattttgtctgcaagaaaaaagaggcatcttcttttttcctttttctttttctttatcagacaattttgtctgcaagaaaagccgacttgagagtatctctatgtatgacggatacagctcatgattggctgaaagcttttctttttttttttggcagaatgaggaaaagaacagctctctatgaaaaggacattcagagtgcaagacgaaacctcagctgttttagtttttttaaaaaaaaacaacccgcatgaggtagtgcgaggtttcatattaacatagcggaaaaaattacaagattaccgtccgaaagctataacctgggaaaagaaagacacactaccacgtgatagcgactccttacatatcccaggagaagcactagcaccaagtcggccgccgctatacgagatcgatcgcgctagtcctacacaggatatttttagcaattttgatattgtcaataagtcagttccatctctgtgtttgctgtcacaactagtttcagttttggttttgctagcttgagcggtttgctgccatatgaacagaggaaagtttttttcagatgcatcacgagtgatcgatcgatgatgcagcaaaggatggacccggttttctataacgcgtcgcaatgcaacttgctcttgtgggcagttcagcagctggttgtttggagtcccactcaacaagatagattgatagatgcatatagatcaagaaggagaattgtataggcacccctactttccaatctactccctccgtttcaaaatgtttgacaccgttgactttttagcacatatttgaccgttcgtcttattcaaacaaaaatgtgaaatatgtaaaactatatgtgtacatgaaagtatatttaacaatgaatcaaatgatatgaaaagaataaataattacttaaattttttttgaataagacgaatggtcaaacacgtactaaaaagtcaacggtgtcaaacatttcgaaacggagggagtattaatttctttttcgattaaacgtggcgaatgcatcccttaactatcgaccacccatgcattgcactccatatgtaacttggaatcggcaaatgcatccctcaacagtttgaaacagactcaaatagacgaaggtatgaataattctgtaaacttcgcaagaatctataaaatttggttaaaaaaacactatcctaatcaccaactaattcttatcaattttcaaggaataaaaaaacaaaagggcactagaatctaaagtttttaagtttcaccctttctccgtggagatttcaaacaaaaaccacacaagattctacgacttcatttaaaaaaccatgccaatcaccaactgattcttatctattttatcaagtcaaggcacaaaaagaataaaaaggacactagaatccttaagttttcaaatgccatattttccctgtaaagaattcgcatataaaccacacaagatcctactataattttgttagaaaaaaatatgcgccaatcaccaactaagtattactctattcgttatactatagtattatactataggccgttttaacttttcttctaatcaatttttaaaatttgatcaagtttatataaaatatagtaatattttcaacacaaaacaagcatactattaaaatatattcaatgttacttctaataaaacttatttagtgttgtagatgttactaaggtttctataaatccaaagaaatttaactcgagaaaaagtcaaagcgacttataatatgaaacggaattagtatctattttctcaagaataaaagaaactaaataaaaagcactcttagaatccttaacgtttcaaatttcatccttccccgtaaagaattcgtattcagaatcagggacttaatttgcaattagtaatttaaaacagggttggatcgtataataaaaaagtactccacccccacccccgtatttgatcctagtcagccacccctgcttccttcttcttcccaagttctcatcgagggttttcctctctctctctcgcatcgcatccatcccctcgtgtcgccgccggcggaggctgcggcgagccttcaccccccacccgcccaccgccggcgagccacggcgtgggcgacctcctctcctctcccgatcccctctcgcccttaggtaggggcttctccccagtccccaccacacgcgcgtgcgtggccgacgagcaccccaggttcggatcggatggaaggtatgatgatgatttgttctcgtctcggtgatctccctcctcgtcgtccttctccggcgcgtcgctttcgtgagtagatcggagatccgttcgggggttgggggtttgatttggggtttagtgaacaccctccccaatcccacgtagccgcatcgttaggtccgcctcccagtgattatctagattgagatttcgatcttgcagtttatggtgtacagtatttagagtgacaggtcgaggtgaaaggaaattgaatctcccttgctgctgtcgtgagatttaacttgcgtgtggacaggtctaggtgaagggaattcaacttcacctgctgatattataagatctagctttgggtattgctgctttataagaattattagctttttattttttttcatatcaatcaattcgaagtccttcactggtaaagattcttaactcttgagtagtgcttgtgatctggcttatgcgagtagtttgcatcaagcaatgaataaattattctatagcctctgataagctcctctttgtctgcccaattacctttttcagaccagaagaaaaatgcaaaaccagaggggtcttctggctcgcaaaggggagctcccccggcacctgatgcaggccttcccaatccttttgatttttctcagtttagcaacttgctcaatgtaagttcttttttttttcgcgcagctaaaagcatgatatgtgctctctttttgtgcatcacttatgtttaactgtactattcttacgtacacaactgtaatgtgatgtgcaggatccatctataaaggagatggcagagcagattgcaagcgaccctgtgttcacccagatggcagagcagctgcagaagagtgctcatgtgaccggggaacagggtggccctgcattggatcctcagcagtacatggaaacaatgacacaagtcatgcaaaaccctcaattcatgtcaatggcagaacgtcttgggaatactcttatgcaggtatcatgttatgtttccagagtcatcaccagaaaaaattttcagaatgtttcttcgcttcaagttttctgctacgcatgacaggatcctggaatgtccagtatgctcgagagtttgactagtccttctcataaggagctgcttgaagagcggatgtcccgtattaaagaagatccctctttgaaggggattcttgatgagatagagagtggtggtccatctgctatggtgaagtaggtgttgtatgctagtatttagatataactgtggcttttaaatttgctgagatggtttgcctcacttatttcaggtactggaatgaccctgaagttcttcaaaagattggtcaggctatgtcaattaattttccaggagatgctgctacttccactacattgtctggacctgaagaaactgaagaggatggtggagatgatgatgagtccattgtccatcatactgccagtgttggcgatgcggaggtaatgaagttcgataataactataggacgtgacttctgtttttactttgctctgagttgatctgaaacttgtgctggtatctatccgtattagtcttcacgactatgtgtagctatgctgcccatcaatgtagcaggttgtttacccgacctatcactatacaacaaagcttgcttctccaactaagcatatgactaaaccatgcttttcctagatagttctataacataacctggcttcttgttcttaaagctttgtggaccacctgcttattgtgtttattatccatacaccgtttgcctttatttggtgccaattctacacaaatgctacgtagaaaaatgacttctgtttgttgaatctgatatacgcggggtttaaatcagggcaggtttctcatttggctgccctttttcgttcttaatgttcctgatctttgcactagatatggtcgctcttgatgtcaatctcttatttatgtttgagcctgaggaaatatattaaatcattgtactactcatttgctgcaagtacttctttatacaacataatgactcaacagggtctgaagaaagctttagaggatggagcagacatggatgaagaagacgctgagggaagaagggccttacattttgcgtgtggttacggtgaggtatgtggaactgctgaatggtttagaatagaaatgaatcacgtaacacagattaaatacggatgtttgtagcaataaccaattgggtgaacttgtctgttttcagttgaaatgcgcagagatccttctggaggcaggtgctgctgtaaacgcactggataagaacaagaacaccccactgcattacgctgctggatatggtcggaaagaatgtgtggatcttctgctgaagcatggcgctgctgtgtaagtttaaaccagctatttcatctaaaaccgagtcgatttgatgccctgctagtttgtgcctaacttgatgaaaattgatgaccccagcacgccccagaatctggacgggaagacccccatcgaggtggccaagctgaacaaccaggatgaggtcctcaaggtgctcgagatggacgctttcctataaagaaaccaatgccaaatctcacgctcatcatcaccggctcgtcgctttacagttcagatttttactgcatacccaaatcatcatcgactcttttagctttggttttggtgtggtggtggtacattcgttgaatcgttgctatgtttggtgctccgatttgtaatctgtttcacttccccgttacactgcatcactccgtttcatcctttgtattcctatgttgctgagtctggtgttgcagacgttgctcctgtttttctcagcgttttcgtgtcagattggtagtttatatagataagagatgcactgccccggtgtacatgtgtctcaccgtcgctggtgccgtgtttgaacggtgagaggccgatcaatgcacgcgatcaagtgggcaatgcgacctcgggtaggtgacaaaacatggtgatctggagagtgcgggaagcgagcgcttcggtggtgtttgtttttaccctagacgaagctacacgaaaaatggaaaaaaaactaatattgcatgattaattgaatattactaactgttacaaatttagaaaatagatttatctgatattttaaagtaattctatataggaagaatttacacgaaatgtgtaatttagagtttgaaaacatgctaattaaaaactgagataaaatggagtatatcttaattacaaacgatcatgggccttcgtcgtcggattggagttcttctatccacttctattttcttccatgttgccattttgggcggatgcaactgttgctcaaaacgagcttatccatatgttgaattgttgactgagattggccggggagagccgtacaagttttagggagcaggagaacgacaagtaaaagaaacactttcatgcgtacgtggacgccgcagctgccgagctaggccttgaatgcttcgaacgcttcatctcactcactggcaggtgggtcccacctcagggattaaaccacacgtcagcatcttcccctcttaaagacgaatataccccacggattccctaccatacctactagttcgcgcacggtctcagtgtcactgacactgggcccccatccctgtggcccacatgtcatcgacacaaagaatgttttactagccacgtgccgaagccgtcgatggccgcggggggcaaaacggcgaggcgacagccgccgtccgatgagaatccgacggccagggtgccgccgtcagctgcctccacccgccgcgagcgatttgaccgtgcggtgacggtggtgaggccgccagccacgtcggcggcggcggcgaccggcggctcacttcgagaagcgtctcgcctcctcctcctcctcctcaccattaatacccccccacccacgccgcgcgcgcgcctcgccctcgtgctccatgcgcgccacgctgcgagggcgaggccaccgtcgccatggccgtgctgggagtgggcgccgccgtcaggctgcggctccgcgtgctcggccgccacctccgcctccgcgggcgcaggcgcacgcggcggcggcggggaggtggtggggtggaggatgaggaggaaggagggagggaggcggtggtgctggtgtccgggatgggcgggtcggtgctgcacgcgcggcggcggtcgaaccccaggttcgacctccgcgtctgggtgcgcatcctccgcgccgacgccgacttcaggaagtacctctggtcgctctacaaccccgacaccggtgggtcgcgcgcgcgcgctcgtagtgttcgacgaaacgtttgtgtgtgagttggggtgcgcggtttgtttgaacgagagtgattcggtttgctgttgtgcgcagggtacgtggagccgttggacgacgatgtggagatcgtggtgccggaggacgaccacggcctgttcgccatcgacattctcgatccttcctgggtgagctagcttctgggtgttagttcagtgaagaacactagaaagagggtttgtcttttcttgctttgtaagaatggtatatttgcgagggtattagttcttccgcctttacttgagcgacggtcattcgttttttttttaaattgttaaccacgccacatttggtgtgtaatactgataattggtgtcactggtgccgtatcaaaagtacatataggttaagtgaagccgtagtaagtactaacagctagaccgtgcgaaaatatttagtaagtggtagcatgcccccgtatcatgcctatgggtatattcatgagcactagcaattggtgatttgatgctgctgcttcgtgatttctttttgtactcatttcttatgttgacattgaagtggaggagcgtgtgcttttaagaaaaagccattgatatttgcttctcagatttcatgggatagatagaatctaaaaagcagatatttgtctgtgtagtgcaacaatactgatgtgttaaatcaccttccttcttcaactagtcacactcaaagaccataatgtttctgatttgatttttcctctatcttctgtaaactcagtttgtggagattctccatctgtctatggtgtatcactttcatgatatgattgatatgcttgttgactgtggatacaagaaaggaaccacactttttggatatggttatgattttcgccaaagtaacaggtacgatctatgtgggcttatttgcatagtctcgagtcttgactcaatagcatcaaaaaataaattagtttgaacattttactgctgagcaaacacaaggtgctgtaattatgggtttatctggcaggatagacaaagtgatggttggtttgcgagcaaaacttgagacagcttataaggcttctggtgggaaaaaggttaatataatatcgcattctatgggtggactgctagtgagctgcttcatgtctatgaaccgtgatgtgagttttcatgattagaacagtctgttgcttactaacaatcgtattctgtattcaatatgttttctcttttctccatttttctagatatttgcgaaatatgtgaacaaatggatttgtattgcatgtccatttcaaggtaatatatattttgacattctgcacttatagttgctctattcttgcgttgatgacctttgataaaatctgtgttctatgttttttggttttacatcttggcaggtgccccaggatgcatcaatgattctctgctaactgggctacaatttgtttatgggtttgaaagcttcttttttgtttctagatgggtgatgcatcaactggtaaattcttgactatttcatattctgctagctgagtttgtgtatgcttactactgtaaatcttgttattacattctatataaaaacaaccaccgtgtgcttttcatctcctacctacagtaggggggtccctattggaaatatattttaacaaaaaaaatgcatgtatattcacatatattcaaaggatgaggaatggagctctagaataactaaactgctaatgaagggctacacaatgatggtcctctgcaagcctgcaaggattttttttattgtgttggttaagttatttgtttggtagcataatgctattactcctgctcttggttgctaatgtttagtcattattttacactgaccaaaatcaaaatcaactatcattttgaagttttcattcactcaagcatgtccatatagcttcttacagttctcgaaatgaattatgtttacccttctaagttggtctgtcacgtgtgcagcttgttgaatgcccatccatctacgaaatgctgccaaatccacatttcaagtggaagaaagcaccagttgttcaggtttggagaaagaaacctgaaaaggatggaatagcggagttagttctgtatgaagctaccgattgtttatctctgtttcaagaagctttaaggaacaatgaggtagtcactctctgcttctaatttgtaaatacttttaaagcataagaaattagcaccgcactaagcgttactatcaaaagttgaaaaatcttttacatacagatgagaactactttgcgcactaactggaactaaatcatcacaccatcctttagttgagagggaaatacccagatagtatgcagaaggcaaaagcacgttggcagttggtattactcatgaaaaacatagtaatgctgtctactccattgatttgacaatgttaaaatggtttatagattggtggctcacttcgaacaattggagataatgtttactgcatgtgaacctttttttatgcggaactgcctatgtattaacattctgtgtgtacccacatctgggagaacttttgtcctgcccataaaaccattagtcgata

SEQ ID NO: 69744 - DNA, 1185 bp, Oryza sativa
  unsure (1)..(1185): unsure at all n locations
gctcagattatttagttatgaatttcacaatataagctgggttattacaaataaccgaaaacccttaatcatttattacgtattattgcccaaagataaatagatcaatggaaatatatctccggtaagcaagcctcacgaattagcgactccacaagccaatactttgtgacccgggaccatccaaacggtcaaccgaaccggcgaatggaaccagcggctcaaaacgactataaactaaagaacgactgaacgaactaatactttgacaacactacacgcgaacgaacggttagcggcttaacgaacggctgtggcaaaggcggcaactaagcactattagcggcaacgactcggtacagcaaacgataggccggtaggtatgggcagcgagaaaaccacaacgacgacgcgggaccgcggcaacggcacggctaggtggtggcggctcggctcggctcaggggcggcagcgacggtgcacaacggctcggcgcgtggcagggggggggggccccaaaaaaggncgacggcggcgcggttgggcggctgcggctcagcagtgactagggcaacggcgcgcatggcagtggctacacacgacacggcgacacacgaaaaagcttaaccctaaaacgagaagaaaacctcaccggagaacggaacccggagagggatgatgacggcggcggcggcggttccggcggcaacacacgtgatcgacggcgacgctagatgagaaacaactgaatagattaaatagatgaattgatgtttgcggcggaaaacacatcaataaagagggagaatggagtaccggcgacgcaacgacgacgtttaaggaaaggaaaggaaacggtaccggaaacgaaattggacttggctcgtcatgcaaaacgaaaccacggacgaagagaggagtgaatcaggcatgattcacgaccaaaggcaaggagaaaatttattattaattcaaatcttgataatttaaattaacaacatcaattctgttgctctgaatattccgctttaagtcctgttaatgattttggagcaaagagaattcgaaaaaaatctccctaacatttccgattattaaatacattgttaattagggttttctcctagttatccaaagtaatttctatagtcaatttattggtgaattagaatctacggaaaaggg

SEQ ID NO: 69745 - DNA, 4907 bp, Oryza sativa
agcccctcaacggagactagaatcccctcaaggatttgaactccgggaaatacatcggcgcataaacctcggtgatatcctcactctctttaccttcttgttccattgctctgtactatgctaatattgttgttggtcgagctcacctctttgcttgtggattgaatctagatctcttaggttgttctcttgtttgtattgttgttgtgcaggtcagatagtctgatctcagttcagactatctgatcacataggactatccgacctgatatcatacaatccgaccatgttttgttttagcttccgcatttatttttaaaaccgcctattcaccccccctctaggcgacatcaaggtcctttcactagacaattctaagatcctcgctatatctcttatccaagaaccacattgtggctatctatttctcgccccatttcaccactgtgcttaagctcgacatcaacaaccccaaaccgaagctacctgttgatgcaaaaaacacacactggcctgggagatctgtttagctccactgcaggaccaaaggttgatgagatgcgggcgtgccagtcagtttgaccctgcaactgacaagatatacaaatagcaaatcaatgagccgatcggctgacaagccgatagattacttccaaccgatgttgataccagccgatagcgatagggttttgagctatcggctataattctgatgtagattctgatgcttgatgtaaataacaatataaaggcaaccggctgatgataatgcaagaaagcaacaatataattcaatagaaaccaatcggctaacaatgatatgatagaacaagtattgatccgaaggttaaaacatacatcggctggaggtccgatatcataaaatccacagattaaattaaacggtgaaatatttgttatcattggctaaatccaacttatatgcaatccttgtaagtcgatgcaacatccaaatacctcatcggctgaaaccccgatgaaacccttattggcagtcaaaaagcaggctagggattatggttctaaacacggcttagtagatcaaacttaactgatgcagcactaagtatgaaaagaaacacaatatcgagacaattaagccgttgactgatgtttagggtggtagatgccttagctaatctaatctagtaaaacaatttagccgataccggcagaaaccctaaagcgagaagacaacagattgagctaaattgagatactaagactagattaattaagacatgttaaatagccaggcaaatatatcaaccaaaccagagcaatccaagaggtcgaatgtactgatgcagccttgaacgacaccgacatagacgatacaattgcctgggccggcggaacattggacttaccccttcgccggagatcgaaaaccaatgcagccccgcgtcaggtgccaagtctcgccagacgataaaataaagtagaaaaggtaaaaggcagcgatgcgtcgaattgtattgatcatggagagatgttacaatgaccccgggtgtacatatttatacccatgggtagatactagtccttgtaggacaagaaagaaactttcctaaaagataaaaggaaaacataaagtccttatgggacactaacaaatattgcctaattaatagataaactaccatgtcgcattctcctggaactcggtcacttctagataatcttcctttaatatattaattttttaaccgaatatagcaggaatccgactattggcgacgtgataattctctttgaggcttaccaaattttactgttaacactaccgtactcgatatcccacttcagtgtacaacccttaatatacccccgcctaccactgactccatcatggtgaaagcttcgatctttaactctagcgagaaaacacgtgtactgacttaggtatgaaaccaaatcaaatcaatcctaacggaataagctaatttcacctcccaaatcagctcaaaacaaagcaaattggacgacattgcaacggattacaattgctcaccttgcttccactagatccatcggccccatgacctccatcggtggaatcagatgccctacccctccatcaccaccgagtgcctccttcctgtccctgcacttgcagtacgccttcgtcgtcacaccccttgctgctaccgacgtcgtcgtcgttgtcaccaccgcttcttttagggtttgagggctcgagggagaggtgatcgggttgcagctgcacaagccgattcggttggtatactaattcaaccaggggcaacttaatccaaacaaccaagccatagtcaaatacggtcagattaataatggcatggatctaattaacccaagaatctattggtggtttgagaggtggtcttttggggacaaaacccatccaagccatagcgaaagtggaaaacataataaaactagcagggtgggtgcgtgcctagatttagagtttactaaaaaaaactcagctagtcgatctgttaatgcgctcgcgattttatggccagtgcatgcatatggtgtttaatgagtttttaagttcggggtcaatggtacggtttttttttttagaattacacagtacaacgcagacactcacaatgcatgcacactcacccctatgaacacacgcacgtaaaccctacccctataaggactggtgtctgattgtttagttttaagaggaaaatgcccgccaaaaaaaaaaagtttcaagaggaaaatccaaatacataccaacaagtcaatgttcttttcaatttctcccaaagaacttaatttcgtgcatgtgctcctcacaagttaatttctcttttaatctcctacctctatcagttttcaacaatttttcacaccctatgagccccactcaaggtttactaagctgtttggggtggggttaccaccaccccatggtttgacggttaccgagataaccatgcggttaccacgaggtataccgtggtttcaaaaactaaaaatgttaccatacatgataaccattataaccgcacggtttttataaatcatggccccactattgcaataagcaaagtggggtgtatacctcggcttccttccaccttccacttttacacactttaattccactagcgctatggtgttgaaatatgacatcaatcacatattatagaaaaagtgtattaaatttcatgcccagcaagagaagatactatcgagatccacataatgcaagaaatcactaaaaatcaaaatctaggcaaagatgggagtggggaatgttttaatggcacggaattaagttgtattggtagattagaaagattcatgacttataagaggttgtttgaattttttatcttagttttttttattagtgagtaggcgaagataataatagagttggaaaggaaatgataaatattgatagttagacataaatttagtatttgtcagtgcagtaagtaaaaggaaaatatgtggggcaaaccacctataatgcaaagttgataactaccccaggttaaaaaaaataaacgttaaggatttatccacgtccccccgagtaaattttttacttcaagtaaacttttaccccgagagtaaaaattttactcggggtggcgtgaacatatcttttatgttcatttttcaatcctaaggtaatttctagatttgtactgtaaatgtggtttgcacggtatgggatattcttccgtaaatgaagaactccaatagctgcttgacacttgtactcagcggcctcgatctgtagaagagtaagcttccttggatcgattcagaagttttcgatggtttgatcgatgtgaagttgcatgtgacggcaatgtcgttacgaacaaagcttaaggccctgtttagttcaaagacaaaaactttttatcctgccacgttaaatatttgtacacatacgtagagtattaaatatagataaaaagaactaattacacagattgcgtgtaaattgtgagatgaatcttttaagcctaactgcgccattatttgataatgtggtgctacagtaaaaatttatgaataacggattaattagggttaataaattcgtctcgcagtttatatgtagaatctgtagtttattttgttattagactacgtttaatacttcaaatatgtgtcaatatatccgatgtgatacgcaaaaactttttaccttgaactaagggcccctttgatttggaggaaaaatataggaattttagaggatttcaatcctataagaaaatttcctatgaagccctttgaaacaaaggattgaatcatatccagtcctttgaaattcctatggaatggacaatcctatagagattttggaggaaatttagcaagagcttcaacctcttgctaactttcctttgagtatatctctctcatccaatttttgtgtttttcctatggttcaatcaaacggtcattcctgtgtttttcctgtgttttgcaatcctctgttttacacttacatttctatcaaaatcctatgtttttcctattattatgttttcttaatcctacgattcaaaggggccctaaatagggcctaatatgggccgcacgtgagcaggaaccttttaactccacgtgacgcgcaaatgctgtttcataacgaactgctatgataaagttacagtagcatattgtttatggcatgccacacagtcctgggctcgtttgttacacagtcctgggctcgtttgttacacatgaattttataagaattctgtatgtactaattaaacttctgtaaaaatcaataaaaaaatatttctttcgatgaagtcctacaactatagccttgtttagttgcaaactttttcttcaaacttataactttttcatcacatcaaaactttcctacacacat

SEQ ID NO: 69746 - DNA, 17957 bp, Oryza sativa
agggtgcccaagtggtaaaagactggatgtagtggagacgagcggacaacaagacgctagcgacgcactagagctactaggatggaggagggaccacctgacgtcgggtcattagttagaaggtggggacaacgggcgcatgataatggtgcaagtggctggagatggggaagaataacgggagggggcaccttgccaccactcagcttcgagaggagaaatgataggggtagtaggctgatacggtgagccttgctagcactgttggcaacttccacactggcgaggcaggaatgcagcgttggggtagtggttaggagatggagagttggagacacattggtatctcgacgatgcaagccgctagagacgggaaaggttgccacgcctcagcttcgggcgaaagaagggatagggggaaggaggtcggtatggtggcccttgttggcattgttggtgccttccacgctggtgaggcagagaggtacattgatggcggtgacaagggcagtggggtgaggaataagagaagtgacatgtagggcttagagggtgttgcaagattcttaaagccatcctagtattttaaaactcgagtgatattttttcgcattttcagctaactgacaaatcgcaagcctcacctaatgcatttttctttttcatgatcctccaagatgcaaatcaatcccacttgttcttatttttactcaaatatgctaataaatttgtaatgctacgaaaccacactcggaagatttgcctcttgccctttttttttttgccgggtcggccaacgaccaatttcattaagattggaaagaaaaacaaggagaatgttacaacgacattacaatgtcgcgctagtccgggagagatcccagacccagcgtgaacaagcaaaggggaaagagggaaggtagggcagaaccctgacaatacacaacacgattactctccaaaatgggagaagatcccagctaccctccacaccgcaatttcttcttttatatcctcggctagttgcttcggaatctttgacacatgctgaaaaattctagcattttgttccttccaaataagctagcaaattaacataaaggcgttgtcgaagtccaccctgtagctcgtcctaaaacggcgccgcgttgcaagccaccagtcagcaagcatgctgtcactgtccgccgggattgcaaagtttgcattgcaccatcttatgaactttcgccatacttcctcttgccctcttcccccgctgctgcatgtcaccaatagagatgaaaatagagcggatacatgcggatagcattcatatcacatcggttttcgtacttttagccggatatgaaaacaaatacgaatagctgggatatagacataaatatgaatgatctcgaatacaaataaggattgaataagaccagacacaatacataaacaaatatgtctcggaacacgaaatccacctaaacttctaaaatgtgtatccgtcggaaagtctaataccatatttgtattcaactattcatgtgggaaaaacatttgtatttgtatgattgtatccgtatctgtaccatcctaatgtattcaattttctcgataggctccgttttcatccctggccaccagcggtcatccaggatcatgcacgcgtttaccccccgcaacgcagccaaactcaacggcgacgcaacaagccacaacgctcaacgcatgccttgcgagaccggcaaagccatttccatgtcgaaccagtggaattcacggcggcaggcgcgcgcgagcatcgcatgcccaagctaaatctgagggaaggaaaattagcatgttgcttatatttggccgcagcaatggcgcgccatcgcgcgcatgccccgttttttgcgtgcgtgtggtttccaactttggctcgcccctccgggcgcaaacaccacaacacctcgcgcccatgcgaggacgcagccatccatccatccacccagcccccacactccttcggcgcgcgcgtccgtcctcgatcgcgcgcgcgtcgacgagctaagccggcccgggaaacccaaggcccctctcccttcctcaagcgcgccggcgggcctcgccggcgcgcgacattgagctcaacccccccgtcgtagtcgcacgtcgagcgccaccaccaccgccagcgcgtcgcatcgtacgtcctccacgcgcggcgccgtgctaggcaacctcctctgctgatcgcccgcctcctcatgagcgtgtgacctgctgtcgaatggtgcggcggcacctgctgcgcggacacagcctggacaggttcctgccgatcaggagcctcatcatgtcgtccagctcttccttctcgtcgtcgtctccgtcgccgccgccgccgtcgtcgtcgtcgtcacggggaagcagcagcggcaggtggtgcggcgtcagcgtggccgaggaggacgaggacgatgccgccgtctccgcgacgacgaccccgccactgccgccgctgcagaagcgggtgctgtcgaggagccacgggtccaaggccaagccgctgggcggctccgtcgaccacctgccgccggtggtgccgccatcgtcgaagaacgtccgtgacagtggaccgccttcaggtgatcaaccatatgcaaaatcacaattgctcaaatcttcttggatcaaccgcttagtttcgccattgatttgatcgatcgttcgatctctgttgcagagattgatctggtgaaggagaagttcgccaagctgctgctcggcgaggacatgtccggcaccggcaaaggtgtctcctccgctcttgctctctccaacgccatcacaaatctcgcaggtcagtatcacaccactcatcacatgctatctactacaaatctcttgtgttcttgcctgtcatgatgtttttttttcccgttcttcaccgtggcaaaatctgcagcttcggtattcggggagcagcgccggctcgagcccatgtctgccgaccggagagctcgatggaacaaggagatcgactggctgctgtcggtcaccgaccacatcgtcgagttcgtcccttcgcaacaggcgtccacggatggaaccagcatggaggtaggccatccacaagatcgttgcaacctcattactatttcatcgtgcaattcgcttcattttcgtccttgttgtcaaccaggtgatgggtacccagcagcgcagagatcttctcatcaatatcccggcattgcgaaaactcgacgccatgctccttgtaagcataatagcatatacaaatgtccaaattgatcttttccccattagttttctgaaccagcattactttgcggtggtccttttgccggtggagcaggagtatcttgacaatttcaaagatgaacaagaattctggtacgtaaaaaaagacgcagatgagggtgaaaagggcgatgcgccaagacagggcgacaagtggtggatccctacagttcgagtccctcccgagggtctgccagatgcgtcgaaaaaatggattctgcaccagaaagaccttgtagggcaggtgctgaaggcagccatggctatcaatgctgatgttcttacagagatggagatcccgggagagtacattgaaactctgcctaaggtgacttataataccattaatatttgtaaaaactcctttccatactttacgcatatcttttctcgaagtgagttcattttctgcttgatgctgagttgaacaaacttttcctggattttggaatgtagtacggtgttttcctgaaaaacattatgaggctaatctaaccgagactacttctcttgcagaatggaaggtctagtcttggagactcgatatacaaaattataactgatgatcatttcgatcccaatgagctcttaagttctgtagacttgtcgacagagcacaagatcgtcgatctcaaagaccgaattgaggcctccgttgtaatttggcagaggaaaatttccaataagctttcctggggccccggtgttagcttggagaagcgagagcagtttgaagagcgggcgcaaactgtcctactcatcctcaagcaccagttccctggggttcctcagtcatcacttgacatcagcaagatacaatacaacaaggtcaaaaaaaaaaaaccatagctgcatgtttagttacttttttcggatttgctacagtacttatactcatgccacctgcatttgctacttcttttcttcaggatgttgggtatgccatcttggagagctactccaggactcttgagagcttagcctttgcagttttatctcggatcgaggatgttcttcacgctgatgccattgctagagacccaaagcgcacgaaatcaaggagaaggcccagtctagttgacatccccgagatcattgacaatgcactggaggaagaggagactgtgaacagcatagatgccaattcacaagtgaccaacaactctattcactggcaagagcaagaacacgaggacaaaggcgcgaggctgaggaaagtccaccgcatggtcacaaagaaacttttgcacattgagaaagttgataatttggggggtgggttgaaaagcttttctcataggtagctgtagcctgaaaaaatggtcagacagctgcatgcttggttgtgctaccggggggagcacctgtaaatagctcaaacttcagagaggctggatgggttgtattggcgatttggcggtgtaatctgctcatctcagttgagatgaaatcagtatgcatatttcacggcctcattttggttggaaaatttttgcatgaatagatcagaaattcaaaatgtgaaaccgctagtatctgaataacagaatgcacactagcatattttccttcggaatacaaaagcagacgtgcgcgcaccaacagtaacacaaagatatgcaagctacagttgctgtaaactatgcggagtataagtaattggcaagatggcccaggcattaagcctagatttatcaccatatttaccttgtaaatgaaataaccgcacagcctccttattgccatcttcgcacgctgatactaccttcttttttaatagatgacgccgttgactttttctcacatgtttaaccattcatcttattcaaaaaatttacgtaattatactttattttgttatgagttgttttatcactcatagtactttaagtgtgatttatatcttatatatttgcataaaatttttgaataagacgaatggtcaaatgtgtgagaaaaagtcaacagcgtcatctattaaaagagtattaagctgtgcagaggcagtatatgcctgttcagagaacgggcattgctgttgcgatccgatcagtttctaccataaaattctctcttcttgaccaataatccagtttactctagaagtcactgtctaagtgtcaacggaaagatcaaacctttttctggagatataaactgaagattataacttaacatgagcactgaacattactacttgattcaacagtggatacagattcaaacattatcataaagtcctcacaactaggcagctcatcgacaattttattcgcacaagtattttgcagacaaatttaaacaagattgacacgataggtccaagtgatcgctgccgttcctaagagctgaagctcttacagtgccttgaggatctcctcagcaccagagattgtgaattggccaccttcctcaatgtttgcaacagtaaccttgaggttgtcagcaaggagagcaaaccgtctcgaacgaataccaagccctttctccgaaaggtcaagctcaagaccaagtgccttggtgtatgttcccaaaccatcggcaaggaatttcacatgcttattctcagggtatgactttgcccacgccttcatgacaaaggggtcgttaactgcaaaattatatcatagatccacagataagtcatattctgccacagctgccttgattcggtactatatacagtcagaaagtggatagtgtttctactttgtacaccagtcagtatatctaccctacacaactttaccgagaacacgggaaaatcacaatatctgaaatagaataaaattttcctttgtccttaccatgtttagttcaaataattgactgaagatttctgacaaaagctaaatttgggaatatgaacatggagaaacaaatgacagaaacataccactgacaagcaagatgtcgtctacacccttggctttgagctgctcagcctgatttatgaatcctggcacatgctgattgctatagccatcgaaaaataataataaaagacattatgtcagttcatcaggttttcagaagtgaaaagaagacaataacagggcgagtaacaaagtaatatgacaacttaaacctctgtgatggcaaaatagaacagcgggttcttataaaagggacagcaaaatgagataattggcagctagatatattaaaactgcggtgccaagtgccaacagaggatgatggcaaagggaaggataaaacatttcaagctcacaaatttatcgaaaccaaatagtacaagtaaaaaccaacagcatcagtctaatctaaagaatgaagacaaaagttagccagttaggagcacttggatatgagcactttgctctcgataaaatgtgtactctgtatttgtcagtcatgtgactcgtgtctccattttttctattcgaaatgtttgttttagttcagttagctgcatccaggtttacagattttctgtgggagattaatcaacaagaaaaggctatcagcttacgaaattctgagcgaatctccacggagtaactatagccaaaatctcccttttatatcctgccacccatcttggcttaactgcttctagcatagatgcccaaaaattataacattttctctcgcgtgctcagaagctggggaacaacacatggagtaaaccagaacagtggatcgaagtctactttttagtcatgcaactagcaatatataaacccacatcaagatttttaaccctaactctgacacccaaggaagtgggagtgacttcagagctcgtcaaatcaatcccataaattgtgagtatctgtataataaagcagtaatcttggatttggtccggacatcagctagtacacatttcagttttgcagtaaaatttctcgatctgataaaaagaagtcccattttttaaggaatttttttttcagggaaatataacgtctccaagaaagaggggggagaggaaatcgaaaaaaggaggaagagacctgcaggtcggggtgaaggcaccggggacgccgaagaggacgaccttcttgccggcggcgaggccgtggacggagacctgctgcagcttgtcctccccgtcgaaccaccccagctggccgtcggggagggtgtcgcccacggcaaccggggccatgtcgctctcccggatgattcttgtgttgcctgcctggatgtgtggaggagaggaggaacagaggaaggagagaaggtaatcgacagggaagggagatgagtgatgatgaggagaggaatgcgaataaataaggggcccttccctccccactgattgtgatatgctttggggtttggttggttgttgggagcttcgagtgtgccgccgagtgtgaacccaaaaatttgggcggatatacgagtggtactgtactactgtgtagactttcaagtccctatcaaggtttggacactaattataaatattaaatatagattattaataaagctcattctataatcctaaactaattcgctagacgaatctataaaacctaattaatcgatgattagcctatatgatgctacagtaaacatacgctaattatagattaagtgggcttaaaaaatttgttacgtgaattagcttttatttatgtaattagttttataaggctgagtttgagaaaggggagatagagaagactgggaagatacgcaaaacgaggtgagccattagcgcatgattaattgagtattaactattttaaattttaaaaatggactaatatgatttttttaaagcaactttcctatagaatttttttaaaaaacgcaccatttaatagtttgggaagcgtgcgcgcggaaaacggaacaaactatctcccaatctcacggtggcgaacgcagcctaagtagtctatgtttaatacttcaaattcatccgatataagagtcacttgatccaaacaccaccttacactgatctcggtagattgaacggatcgtgaagttcagcgggtatactggagtttcttattattagtagaaaataaattgtgagagtacgcgattcccggatttgtcaggatatgcgcaccagaactgaatatgagaagaagaagaatcatttaccaaaacctggtacgttcgctcttgttgacactgcccgtgaggccgtttcaagttttcaacggatcgcggacttggtggatcatacgtgttcgtgcaaggaatgatcgtgccgcagtggggctcgaggaaattaaacttgtactgatgctgttttacctgacaagaaaatgaaaacaccgcagtggggctagaggaaattaaactttgtactggtgctgttttacctgacaagaaatgaaaacaccgcagtggggctagaggaaattaggctcccatcggatggcctaataagccaaagaaaaaaccaaattttaaatttttaaatttaattttttaacctactttttttttcagcattggcttttaagtcacaaagaacacatatataaatataaaaagttttatatacaaatttatttttatttctaataagccgtctggtgctgttttacttgaaagaaaaaagtacgtcgacagcaggattcgaacctgcgcaggcaaagcccaacagatttcgagtctgtctccttaaccactcggacatatcgactacttgatagtggatggaggtgacaatttatttatactctactacttagtatcaaacaattttccaacgcctactagctaacattacgtgccttggccacatcatctgcgttgctgtcctgtttgtatgcttctattggccgtaaaaatatgaagtacaaatgagaatgcaatacggctgtattttgtgaagcatataaccctagcttttcggggacggtgcgtgacattcaaaatctaaccctctattcatggaaaatgtcgttttaatcagtttcaagcccaattttcaaaaggaaaaaaaaagacccctttgaaaaaaagattaataagaaaacccaggaatgggaaggtaggtatataatgtcatgtccatcgagtttctacacgaattaaaaatataagaattttttttaaaaaaattgtagttggtatacacatatgagaaacacaaaaaagaattagagtcatgcatgggaggaagaacagatcgtagtagcattataaattattagtaaaaaatgtattgtttagagaacgcgtagtacgtaaaacgtcacgtgtgtacgtaacggaagacaatggtaattttgtatggttattaaaaaacggtgaagtttttccgaatgtgtgaatattagttgagcttatagaagttgcacatcttctatgtaattgagaaaaacccgattatgttgcaaaaagactaaaaaatacatgtaatcttggacaaaaccaaaagaaagagatcacttgctgctagcaacaattcaattaataaatgtggtaatattaaacaatccttgctctgtagtaaatctacaaacggctgaagaagtactatactattctacgagacatgctaaggtgcttgggaatgatgacatccgttgatcggatgcaatccaacgatatggatctatatatatgtctagaaaagcacaacaaataaaatgcgcagggtaattatcaaaaaaaaaaagagagtatattttctagataatggaatagaacattccgacctttgcttaaaagagcttcaattattacaactaggaaagaagcccgcgcatctatggatctatatatgtctagaaaagcacaaaaataaaatgcgcagggtaattgtcaaaaaaaaagagagagtatattttctagataatggaatagaacattccgacctttgcttaaaagagcttcaattattacaactaggaaagaagcccgcgcagatcattttgtttattgtttatgtcaaaagcgtttcctagattcaaacaaaaatcactgtgtcccagttatatataaatttgcctaatatcgccactacttattattattattttattttattatggagacttattatcgttcttttgaaaccaaagtgattatgaccctgtttagatggaactaaaacttttaagtccctatcacatcggatgtttgaacactaattataaatattaaacttagactattaataaaactcatccataatcttggactaatttgcgagacgaatctattgagcctaattaatccatgattagcctatgtgatgctacagtaaacattttttaattatggattaaattaggcttaaaaaaattgtctcgtaaattaactttcatttatgtaattagttttgtaattagtctatatttaatactctaaattagtgtctaaatacagagactaaagttaagtccctggatccaaacaccacctatttaatagatgaaactgtatttgtaacatcaaaataagaacaatacatcgttaatcgactaaaaaaattatctccactactaacctaactgttcatgtcgatctgacttatttctaaatctatgtataaatattccaataatattttatcaaaaaaatatattataacaatatcgcttctatgagttaataggataataatgttaaaatttgatatgaatgcccatctaacggatgaagccgaacataactaccaaggctttctttctcgataccttgaaacatgggtcacatatcgacataatcgtgcccatcaagaccatcgtggataacagttttaacggctaattcactattagtaccctcataaaggattgcatcgttaattaagtacccatggtggcttaactcatccaaatgtatgcctttgctatatcatggtagtatagcaagctttattatctatgcttggcacccttttgagaatggaaaaagagaagacggaggtgattacaataatcctttttaaagattgagttgttttgtggtatatagtagacacaatttgtttatagtgtaaatcaatattactcaaatttcaataatacatatacaatattcttatttgaaagtgagtgaggttatcatgttagtagagtatatgacatacatccatcaactatgcccgacacatcggaattcctcaagtataaaaaatatatattatgggtgttacttgattgtttatttgttgccaaaactatatgacaaacaaaaaacctacatatatgaccatagttctcatgatggattaaggggttgtagtatagccatatcactcgctagaagtatttttaataaagtttatcatgtctatgtatcatgtgtgcttctcacttttcaaataccaatcaaatagttctgaaaaattcaaaaaaaatatttgagaatcgtaatatctcacatattaaaattagataagatctacttgaaaaaaatataactaaattctgttgttttcatttttcatttttacatatgtagattcaaattatttgtcaggtgatattgtacaccataattatttgaaaaattattatgatattaattattatgtgccattatgtatttatcagttagcactaactactataggtcaataatagttcatttaattaaaggaatacatcagaattattaaaattgatatatatatttaatagatgaacacttacagaccattgaattcatattacatctttgatctagtttaactgcgtatgttggttgggtaatattttttatatcatggaaaatcatagtttagagaccattgattttctctgatcatagtgtgtatgtatatttttagctatatatttatatttttacatgtgtatatgtgttactttgctttttcttacatgggagattttggtttttttttggggggggggtggattgttttttcagtagacctaatttaatggtataaaataacgggtttactaatttaaagtttgtagagtaatatattttagctctatatcatagaaaatgcaaagggtgatggtatggctcacactattttttaatttataataaaacatcaatatatagatttaaattattgatttaattgtcaagaatataaagaactaaattgatcataaaaccaacttatagttttcaaaagttaaaacatgcatggagccctccacgaagatgacactgacctaatttaaagttcgtagagtaatatattttatctctatatcatagaaaatgcaaagggtgaaggcatatatatatggctcacactattttataatttgataataaaacatcaatatatagatttaaattattgatttaattgtcaagaatataaagaactaaactgaccaaaagttaatacatgcatggagccctccacgaagatgacactgaccgtgataaccatgaaagtctacattcaatcgaagatataaatcaaatgttgtttagattttattatgctgtagatatctcaacaacctaaaaataagaagagcagataatgcatatacgtgcttgtgccgtgagctgatggtgattatcttggctgatcgtttgggctggtgcttttataattaatcttggcagtgattttttttcaatcatagttatcaatatctttggtttttatttcgttcgtacatacgtatagcttttgcctttttttcccggatgaattgtacgcaacgattttctcttgtatgtgaataggattttttttttcccggatgaattgtacgcaacgattttctcttgtatgtgaataggatttttttttaaccagatgaattgtacgcaacgattttctcttgtatgtgaataggattttttttttttgagaattacacagtacaacacagacactcacaacgcacgcgcactcacccctatgaacgcacgcacgcaaaccctactcctatgagcatcttcgaagactgggccggcaaatcctggagagattgatgaagtcaccgtaggcgtctcgctgtcgacgggtacgtcgcctaccactaaaagcacaacgccgttaaatcctggaaaattcgctcccacggggagtcgaacccaggacctcaggtgctactgaagctcttgtaaccactaggctatgtgaataggatattgggagcgagagattattttttatagatttaataatttgaacgggatattaggagggagagattattttttatagatataataatttaattgtctaaaataatggtctcttagctttaagtgaaaatcgagaattaaatgttttattttaactaagaatttatattattttatttaatttattatagcgctacttagcaacgtagaagcgtttgtagagtgacacatggtgacgtgagagcgtttgtaggaaatttaatggaaaagtataacaaaataaatgataattacatatttctttagtaaataaacatatgttcaaacgccaataatattatggaggtatattaggtaaagcaaaataataaaagaaggggaataaaaaaggaaaaaagtggggtatgttacgttcttactcatatgtacgtacttgcaggcggtgagggaggcatacgtatgagggtctatttttaatctaatctaatggtgtaaaattatggacccaccaatttaaatgaaaattaagggccagatgtttctaatatattaaaacgccacatggcgacttaggagtgtttatagaattgctacgtgacggcttaggagcgtttgtaggaagtttaatggacttttactatataatagatagatagatagatagatagatagatagatagatagatagatagatagatgtagcactctaaaacgagcgaagttcaaataaaattaagaacaccaaactaagaagaaaaataacccatataggataagaaatacacatttattaaagtttatttgtaaatctcaatttattatccttaaaaaaaattacatactcgtagtctcgagagatgagttagagatgggatgtacagtacattgggaggtgccagcactgtaaaatatctcactactctattcagtctatacccatcctgcctaagcacatacttccacaggcgcgtgagatggcgggagcatgcactgcggcggtggagcttccagcgggcgccacgaaccgccgacgatcaccaggtagaagcggctctccggcacggtggcgccgaagaggcggaacccgcggcgcttgaaggcccagatctgcacggcgtcgtgctccctcaggccggttccggcgatgaagtccatgtagccggtccccttgatgatggtgccatggctgctgtcccagagcaccagccgcagctccttcatggcgccgctcaggtgcagcaccgtcaccggcaccccgccgtggtccttcccctgcgccttcttcctcggctccttctccctccccttctgctgctgctgctgctcaccgtcggcgacgtcgacgctgcctttctccgttcgtcgcttcttcttcttcggcaccggctttgggcgaggaggagcctgatcctctccctccacgttcgtctccggcgtcgttccctgcggcttctgcagctccccgtcggcggcggcggtggcggcgatgacgacgctgcctttctccgtgcgtcgcttcttcttgggcctcggcctcgggcgaggaacccccttctcctcgtcgttctccaccaggttggcctccttggcctcgtcgacggtgagcatcgggaggaggcggcgctccacgccgaagatcgggaggcggaaccggttctggtgcgggtcgaggtcggtcctggtcaccgtcttcctcgcgatgaacaccaccggctggtcgtacgtcatccccagccgctcgagcagtatcttgcggatccacgccggctccgcggacggcaccgccgccgcctggtcgtcggcctccttcctccgcgcggccgcggcggcggcgagcgggacggcgcgtatgggccgggcgtcgatgggcgccacgtacgggaccagagcgcccgtcgccgcagccgccgccgcgcgcgcccgcttggcctcccgtcgtcgttcccgccgtttcgcagcggcagcggcagcggcattgcgcccgtcgacgtcgcacgacggcgccaccgcggcgagaggccgcttcatgccggcggagtagcccgcagcagccggcggcatattgcggggcagagagatcacgctgtttcgtcaacaccgaagtatcgcgatcgattttaatttgctcgtattcttcgatcgaattctccctcgggaactcaatatggaagggggtttggatggcgcatatgccctggatttataggcgcgaatgcgtatgcgcctcgagacctgatcggagtccagggcgatcgctgcgaacgcagggcaaactcatcgtgtccgacacggaatggaatgcaacgcaaccgactggataatcattttcgcttttattttgtcatagtatcgtcgtaagcagtcagggcgcagcccgattggcatacggcataccgactggtgagtgggtaacgcagcctgttagaatgagccggcgtggggaaggaggctttccataattttggtaacggatttttgcatttggacgcctgattggagttggagatggccagatggtggggttccggtttccgtgggttgaaagaaggaaagggcccactcgtatcgttggagttggcccgtttggttcagattactcctgggcccaagcacaaatggccattctgtatagtatctgaattcccgtaaaaaaatattgtatctgaatttgtgtttttatatctcaatgtataagttgagtttgaacctagtatttcgtagagtggtatatgtattatatgaatattatcatttttttaaaaaaaatggtaactattttatatggtgtataagtttgagttggaacttaatattttgtagagcggtatatgtatattatatgaatattatcaatttattaaaaaaaattggtaactatttatatggtttttaaaggaggttgctagtgggcgggtgatcgcttccctctcctcctagcgatcacccatccctccctcctaatacttatctttcatctctcttttttacttttttattacatcataaatttaaaaaaaatagtaaaagaaaattaggaaaaaaatctaatactctcattcatgtgcatagactttataccgtaaactttgcatgcataaactttgtgtatagaaatattttatatataaaatatttgaatccgaatttgaatttgaattggatacataaacttttaacttataaacattcggtgtacaaactttaggtggataaactttagatgggtaaactttaggtgtataaacttactaaaatagaaaaatataaaatatttgaattcgaatttgaatttgaatcgggtatataaacttttgacttataaacattcgctttacaaactttaggtggataaactttatatgtgtaaactttaggtgtataaacttactaaaataggaaaatatcaaatatttgaattcgaatttgaatttgaatcgggtacataaacttttgacttataaacattcgttgtaaaaactttaaatggataaactttagatgtgtaaactttaggtgtataaattttaggtgtataaacttactaaaagaggaaaatataaaatatttgaattcgaatttgaatttgaatcgggtatataaacttttaacttataaacattcgctttacaaattttagatggataaactttagatgtgtaaactttatgtgtataaacttactaaaagagaaaaagaaaaaaaaaacgatcgccgacagcaatcgatcgcccgttagcctttccacgtcaggtgagcttgcttgctttccgaaaatgctgagctctgaccataccttgcaatgcattaattttatactagtaggattttagttcaaatcccttaaaattaccacgaatttctccgttccaaaggaggctttacatagggaaatttcggtactacagctggtataggaagccaagccacgaacattctcagtgaatacatgatacattagcacgcaacacgatatttgcattgacaggaattcagagatcagaacagagcaaggtgcaacgcagctgaggagaatgaaatattgaaaaggaacttgcgagttaggaccaagcacaccattgtgtgtacaatctatggttttgatttaacctttgttcatgtatatcaaagagagtatctgctttgctcttcaacagttccaatggaggggaacattcacatctgtgaggtgatatgtatgtatataacggacagaaacgagaaaaaaaatgaaatgtacatggctatatctagctggatgaatatggggaaaaaatgaacatatagaaaagaatgcaacagagagaaaaactttcttttgtcaggcttctcacttttcaactgttactagtatgacattatttggaccagatcttggcagagcagcttctcatgatcctggacgctaccaagttcaggaaggcatcattcacactaggatggcaaacaaaaagaggagcagcaggacagttatgttattggcacaacagcatccagattcctctgcagcagccagccaattgggtagttgacttgaggaggttccagttcgaaattccagaccataacacgagtgcaattatccccaaggccttccatttgactctcgtcctcaa

SEQ ID NO: 69747 - DNA, 2358 bp, Oryza sativa
cccgtgacatcaacgacggtatcgtggggcgaccgcacgaccgcgcgctgtcgcaggaatgacgagcggtctcgctcatgcagagagcgacaccatcccaaactccatttggttagtgactaatgatctaattaactatttaactaataataattaatgattacttaataattgctaatcataataattaatcactaattaaccattttgaaatctggtatcgttctttcatttcgcaagaccgcgcagtctcgcgcgataccgcccgcgaagtcgcaccacctcacattcgcataatgattgtgcaagatcaacggtataatttttttaaaaaataaatctcgaatatttctaaaaataaaatgaattaacaatatattttcaaatttaattcgggcagcaacgagccaactatcgatttaagcataggcgacctctggaatgtgtgcgccacagtggcacactgccctggcgttgcgcacttcacagttctgaagtatggggttcttcttcaaaacattttttatgttctatttactccctctcaaaatattgttatattaagataagatatgatccataaaacaaaaacaaatctaaacatactctccgtagtttttttttttacaaaggtagtatggcacaacctttgttggttttttttgggacggagggagtatgcgacaatctctccgttttcaaagcaatttccacttcttgccttcggtaattggaccgcggaaatagtatagagacgaagacttaatcgtctccagtcttcacccctactcaactctagcaccgttacaaaacttgcaatgccgaagttgacaaaaaacatgcagaaaaaacgaaacaatcaccggctatatacgtggttgtcagatatgcaacgatgccagccgctactataccgcgaagtgccgaagtatactcgcatcgcatggcaagcagagtcgcgaggcaatacagcacaggaaagacgggcggcgaagctgtacgtacccaagaagtcgacgccgttgtacccgttgctgaaccggccggtgggccgcgacgtggggaagtcaatgccgttgtgcgggaagtttgcccgcggcacggcggcgccggtcaggtagttgttgttgccgacatcggccgtggagtcgccgaacacgtatatcgccggcaccttcgccgccgccgccgcggtgatacagatggccacagcaacaagcgcaatcggcggtagcatctgtccagccatgccggactgcgaggtgcagtccgctggctctgggtgggggctgaacggcaaacctatcccttgtttgcttttgggaaagggaggggccgcgaccggagcggcaatggcgcactttaaagggcgacgatggcgagctgcgtacggccaacgccttttattgagaccggcaaggcgtggcacagcacttagaccaagtagtagtacaaagttctttacttggcttagctttggtaaagagagatgtgaatgtgacctggtcacctggctatcgcgcaaaacgttgctcctcctcctgggttggtcatgggggtctcctggtcgaccaggagacagtctactactctcgtactcctacacgggaagagtaactggatatacagcgaagaaagtcgatcgatcaaggtatcctactatcctggctcctacatgtacttgtgacaaaaccaagaagatccctcagtctacttgtccagcaaaccccgtcaaatttactcgccacgatctcatgctccctggtggtcctacaggcgaattatatcggcatgatgttctaagtgcctttggatactctgtctctcaagagtaattactgctacttttcacagaaaatcgatccccgggaggccgggactgagtgggggtaacttagcttgatcagaaccgattacttggatcaaccccgttgtccataggaacatattctaccaaccactcgatgcatttgtacaggcaggaaccttaacacgtctacaagccttgaagcatagagaaaggcagccggaatccaatgatacggtaattactttcgatgtttgcatttgataatgctccagtgggatgaataggcagccttatggctgggcacacaagtttgcgctggccgattcttctacgcttaaataagcacccaataattatatctttacgtttagttcttttcatactgtattgttcttaccatcacttacaactgaagctagcctgccagatgcacctttttttgcccaggcagaaaaagaagatcccatgcacagcatggctttttttcaatctttctcctgttgaaagcaacgaaaataaaacgacagcagtgggcagcgcaacctttt

SEQ ID NO: 69748 - DNA, 1235 bp, Oryza sativa
aatgtctaaaaaagaagacaataaaaaatttctaactaaatactccctctgtttcacaatgtaagtcatttagcattttccacattcatatagctgttaatgaatctaacaactatatgaatatgagaaatactagaatgacttacactgtgaaacggaggaagtagtaatgaggagctttcttagaaaaagatcaggttgtttagaataaagcaacactctggttcctagaacactagaagaaacaatggacatttttgttgggtaagaacctgtaaaagatggaaggggagatttggaaagacccaaatatataaaaaagaaacagccaattctaaaataaaaaaaatctaattgatgtttttaatgggggtacttatcctacggtttaatagctggttaagcaacacgtggaacggcatatgaaattgatatatgcattatacttttcagtgatcgtgaaacgccctacttattataatttcctgaaaataaaaatcacatgctctcttggcggtaatttgaagtttggaatatccagcaagagctagtgatatttgacattatagagtctgtcaactccttgcaaaacacgacgccacatgaattaaacactctatttctttgagaagagccagtctattgtacgccctgaatttgatgagtcttaaaaaacacccttgaacttttaaactggataatatttaacactaaattattaaacatccacttctcaactttgatcatatttagagtagttttaagcaatgtggaaacacataacaaggttgtcaccatttttattcttaaattagcaaatggctttcaattattcagggaaaaaaaatacttacacgtatttagagtttgagtattactatagaaatatttgattattaattctattttgtaattgtactactccctccttcccaaaataaaacatagcaacatctagcgtttaaaatttatcttggaacctaccgcttcatctcaacaatcacaatcatgtatattcaaataatttttctacctattttctcatcttaaccgatcacaaccacccctcatttaatttcacgtattttcgtaatcaccttgtacaggtgacgatgccacttttatgctttatagttaaatttatcaaatcccaagtatatggatatattcagaaagctaaatgatactccatcatgtagccttgtcatctactaactagctgggacatcatcact

SEQ ID NO: 69749 - DNA, 2205 bp, Oryza sativa
gcaccaaactaacacacgccaaacacttccaaattccaaccatggcctggtcttcacacacgccccaattaagcgctgctcttgtgctcgccggtgacggcggcggcggtcttgtcttcctcgccggagcccttgtggtaaccgggcagtttctccatgatcttgcccagtatacccttcttctccttcccatccgggctgctcacttcctctgtagccggcggtgggtgtgctggcgccggagtagtggcaggagcagccggtgaggcggccggcggcggcacagcagttgcgtcttccggcttcttgtggccgccgggcagcttctccttgatcttgtcgaggaagcccttcttctcctcctcgggtgcacgtggcagggtcgcctccgtcttggcgtgatcaccctcgatcttctccacggggacggcggtgtcgtggtggtgatcgccgtgagtcaccacgggagcaggagctggcgtgggcgcggccgtcaccacggatgcaggcggagccggcgcggggaagcccgtcgccgcgggcggaggagcatgctcaccggcatggtccttgtggccgggcagcttctccttgatcttctccttgagccccttcttcttcttcctcttgaccacctcgccgttgtcatcgatcacctcctcttcctcatcactcgactgttgcacacaacgattaaaggtcatgaaaccttctataattactaaaaagtctgtaactaattaaagctagatcatgcatgtgtgcacttaccgagctggagctggagctggatcggtgcagcttggagaggaggctctccttcttctcgccctcggcgtggtgctcctccttctttggctcttccacggagaccttctccatgccggtgacaagctcctcctcatgcttcttctcctccggctgatcgtccttcttcctgccaaggaggttgtcgaagaggcccctgtccttcacctccacctgctctgcagcctcgccaccctggtggctctccgtgttcctctcatcctccatgatcgatcgatggattcagctaaagcctctcgagaactaaagtaatcaaacaacagatcagcaagaactattcgctcttgacttgtttgagctgtgacgagtcgcttttgctttcggatgaagaaggtggcgaggcagatgccctccttatatagcggaggggatcgaaaggtgcggcgtttgtatcgtacgtacgcgtaggcgacgcgaggacaagaagcgtgggcgggaaatggcgacgagatggggggcaggcagaggcaggcagcgggtgagccagtggcgccgcgacgcgtgtcggcaatcgcgtggggcggccggctggttccgacgtggcggtgcctcgggacgggtggacgcatcgggagaggtcggcgccatgtggagccagacggccgtgtcaccgagggagaggaggcgtgggcggcgcgtccgcctctccgctccctctgcttcgaggcctcgacgcctacgcgacgagacacttggcttcgggcgtcgctgtccgtcaatttcctaatcgatttttggttaagtgatgagcggagcgatccatttaggaacagtaacgtaagcgtttcttgttcggatacgattcgtcttagtgcgcagcagtagcgatagattaacatcagtttttttccatcggattctcatccctttttcctctttatcggcatcatcgcggccaatttttcttctctcccagcagaggaaggaagagtctgtgatcgcttttgtgacgagttgggagcgggacacggctcgagagcgacggcaccgcgcgcgcggtgtctgattaggacgacgggagagatccagagacctggacggtgacatatggggtccgtagatcagggtcccactgatccgtctttcacagcctaacaaatcgggtcttggtttggttggtggatttggtcggacgggataagttatccctgttgatcacactgattaatttgccacccccagatcgagtcgtccggggcttctctaatttccagccagttcttttccttttatttttctttctttccttcgctttgatgatagctgatgatagctttcgtggggggaaatgtcggtggcatgtcggccttttgatttctttcgcccgtcctgtcctgcgaaacgcattggggccacactctagtctgtagtacgggt

SEQ ID NO: 69750 - DNA, 9209 bp, Oryza sativa
tctccactaacaattctgcattcaactgagttatcacttactccccctatctcacacgtgatatattataatacaacaaatctggacaaagataagtccagattcgtagtagtataatgtgtcacatcccatcctaatttttttttacggggaagtagacctctagaaggctttcctttcagcaaaagaagagagagagaagaaaaagaacaaaaaagaattaaggaggtcaatattcacagtaatattcagaacactgagctagacaggtagtgagcccgtactatgacggccgaactggtacggcagaaaacggcaaaatttatagcaaaaaaaaaaaccaacttgaaagtgagtgacagccacctgaccgtggaacgaaacagcactgggaaagtcagacctctcgtcatcccacaggattctggcaccggcagatgattcatcgccttgcgaatagcacccctgaccggtcaaaaacgaagaaccaaacaaaatgttactaacccagggatgacattgacctcatgtcaacatacgagaaaatgtttcgatgaagacggttgaaaaatataatgcatttctagctatattttgaaagccatcaccactgaaattcatggttttggtcactgtctgcctcgttcaccttctgaatcttactgtactgtactgataggccaattcattaacatgtactgtaccattcatcaggctcaccatgaattttaggcagccactaaagcaaatgagtaacattcggtgctgcatggttttgagatgatgggtagcttcaagatcaacatctgaatatccaattatcctctaacaacaatcgagcgactcaacgcagaacatattttctttaatcaagtttcacacatcttcccccatttgttggcatggaacaggaaccacacttggatccagttggtacctcagtttttgtacatttccctgcatgccaagctaccagccatccacacgatcgagttaatttaagaatgattctgctgcctctgtataatccgcacgatgaactacagaagttagtaaaatgccatgttgtatgtgagcttccgcttgtgctgcttctcaaatgtaataatcaggtcatcaataatttcctcccaatcttcatctgccccttcaagctgaaaaaggaagcaatatatgaattaacttctcgtggttcaccaagtacattatctcatttcaaatatttcaatagtcccactttacagaagtgaatccttttaccagtctagcccgcacaaactaaggtaaaaaaaatattgtagtaggaactactgaagagaagcataatgagaaaacaatagtaatatatagatcaaattctactttcacacaatggattgctagtgtgcagattgatgtcaaaattcatttacaacataatcataccatcagatatgagatagctattgagacaatggttaattagtaatatgcagatgttatgtaacgcattcaagaaacagatgtggatagcatacaggtccaagaaagcaaagaagaatcatataactaaacttgttttaggaaagtataccacacacaaagaaacatcaaaatacacttcatcatcttttatgaaatggaaagttctttatggtgagtgttagatttgctccatagtccatacatggttttcaccacaatgagaatattcatggggactttttctatgttaatttagagcaacttggaggttcaaagttcattatactatataagtgattgaccatctaaatatatgagtaaacaaggttaccctgtctttattcctagaacacacttaccagcgactttgtcaactttcgaacagagtaggaaaaaaaacagaagtagcagttctctttttatgggaggaagcaacgcgaaacacattagggtcaaggatcgaacccgagtgggcaaaaaaataggtcgcagctagccacccgagcagcactcggctatagaaaataaaaggaacagcttggaggaactagctatcttttttaatagggagaagcaaccatcaacagggaacacctagtcgggagtcaaacatgggtgggtagcatttgagaaacatcgctatccaactgagcggcggtcatttgtcacttcccaacagaaagtcaaaagatcagaatgtagatatttgactgaaaaagtaatatgcaagcatttaatattctacaaacacaaatttgagcatgtcaatccacaaaaatagcaatcacagaagtatagaacccagcaaacacaatcactgagaataataagggaattcaattgggcttgtccacatggcctatgatttgaagggagcacaaggatgttattgaaggccaaatttgtcgccgatgtggaaacaaggaatacaatctattggcagaatattcttgacgtggcagtgaaccacttacattaagccctttgagtatacaaagacaccctttagtgccaacaatttcaatcctagttactagattcggcacaaaccaagtaaatagacttgttggactcaactaactgaacctttgtaggttatgaactttgtgtttgcaatgtaaattggctgaaaagtagtaaatttcaaagcaatccttgtaagccacaactcagaacgaacaacatttctggtaaaaacttgatcctagcatctaaacgttttgatttgggcttcatcttcatcttcacatcaagtagaatttgagcctccccgatatatatctttctcaactgaagccatgcatgtgtagtagctcatcgttgtgaaaattagtaagacacaggtacatagtacatgtgagaaatttgtgccatattgtcttgcatgatatgagatgtgaggcagtagtaggcctgcagtgagcttcttaagccttaagataataaccaactagagacattcacaaccctgaatgtggtattaatttgcatgtgttccctattctagagataattcaccaaccctcgatattggggtaatgatttgcatgtgctcccagtctagagactgcggatgagactgcggatgaggtacactacataaggctatgctatagcatagtgcatccagaaaattagtgatcttggcaggttcccaaattaattaatgatgcaccattgtgttataaatgtagggcagtacaagatgctattttttctctggaaatttgacaaaggagacatactgattgacattagtttgtttttatctaacactgctctctaattttgtatttgacacatacaaagacccagcccaacccatctagcatgtgttgatccaagaggctgggctgccgaacacaaatcacttcattaatatcagtagcaaacaacaagattaactagatcaataggtaaacaacataatcgaaggagtagctttatgagctatatatatgttatggtacttataccttctgacacaaatctaaagcaagctttgcaccaacaccagcttcttcatggttatctttcacatccatattgattatcagcgcgttctttagcatcctttgctcacggttatgcatatctgcagcaaaaagagaaaaaaaacatactagcccatcttagtgaatgattacatatccacgtaaatactagtatatggatactacaactgttactgtgatgcatttgatagaccgaaaaaacttgcccctattgttaattgttatcagttgattaccatcgacgattaagtcgaagaccctctcctcaaagctgaatatcacatcaaacagcccatcgccggcattgtcctgccacctctgcggcgccagcttgactgaggtgttcctcttcagcattggcagcaggccgttcctcttgtacctgaatggcacaccacataataatgcattaataagaaacttttctgccatttccgcaaatcaacaaggatcgcatatcgcaaaatcaaatattgtgaagagttatctaagccctaaggagcaatacatttagaacaaaacccccaaattgcaagacaacagctatctgttcccatcatgaccatcccagatttccgccaacaccaaccaaatcaccacaaataactcataaattcgaaatcgactctaaaaaggagatcctgccttctccagtgccaccaccaagagcccccggaaagaacacagaatcaagaagggaaaagagcagtaggacggacaggtcggggtccttgcggcggaggtcgtcgtagatgacgttgtagggggtgccgaagtcgtagacgttgggctcgtggagggaagggccggggagcttgacgtgggtgccggtgccgtaggaggcgacgtcgagccccgcgcggccgagcagcgagtgcgcctccatgctccggttcatgttcgacgagcacaccatcgcgaacctcatcttcctcctcgcctccatgcccatccgccgccgccgctcgccgccggcaaggtagggtcggttcgccgccgccgccgccgccgctccgaccgagctcgcctgtgaggggtgtgtggctgtccgctttgagattcgtgtgcgaagggagtgaacggactggatggcttggagttaggacgtgtagagctttgggctagcctgggccggcccagttcactaaaatactgtttcgggcctagtataatcatgttaacttgagagaataaactattttgcgtccttcaactcttgtttcttgttgaatcgcatcccttgaccgtaaaaccgggtataatgtatccctcgtctttaaaaaccggtgtatatcgcctcttttggcggttcgggaggttgttttctgatgtggcagctttgacctcgttgaatgcctgagttatcttgtagaccccatctgtcagtgacctactccatcatatcttcttcctcacctttcccctctctcacctcacagctgcatgcagggaggagctcgccggtcagccacaatgtgcgcacaggaaggagattgccgatagtgccgctagcgggccgcgggggaggtgttgccggctgcccgtgcgcggggaggagctcgctgtgtcctccaccaccttctcgcgagaacagatccgcggtgccgccgccgtgtccgcaaactccctatcttcctccctcaccttttacgtcgaggcctagtcaccaccgagcgttgcctcctcacgcaagtcagctcgcgggacgaccatcgacacatctacgtgaatggcacgcacgtagggcagagaggcacatgaactcagctgcgaacgttggattgctgttgtcgagcagctactcgtgaaaggtaactggctgtacatttttttcccatgtgtcactgacatgctgggcccattgtatacggtttcccatatcgcactgatatgtgggtcctatctgcaaaaaccacttttcaaaccaccgaaggattctatttatatcggttttgaaagataggggatgcgttataccggtttttatggctgagggatgcaatttcaacctagaacaagagatgagggaggtaaaatagacttattccaaatgactaatattgtatgaaagcactttcaactataacttttttttagcataacaagaactaagggcatcaccaatatatatggcaaagtgatccatatagatgaaacccacataaatagtttttatctatgacaatctccacaatgtatatggaaacgaggtatcattaggagaagagagaggagtagagatagataatataatttattccatatgggtagtccatatgcatatagataccttttgttattttttctatatggactagttgcacaatggtaataggtggctgaatggaatattctattgcttatgaactacttttacaccatattgtggatgccctaaatacattcataattttacttccaccgatcaaaatccataaagtttacatatatatacaccatataaaaacagcagaaagaaagaaatgtgtgttaatataattaagtaatcaatactattattataagttgataaaaatcggtgcaattttccgacacgtgcgaaagacctaaaaccctcgtcctcccactttgccgtgggacccaaccaaccgccctcccttctccccctccccaccaagtagggtttcaccgccgcctcctctgccgccatggcgcgcgccgccgcctccaggctcgccgccgcggcaacctccacctcgacggtgagttcgcccctcccctcctcctcctcctcctcttccatccggatccccggctcgctcaaggctaaccatcccctttgcctccttgctgacagctcgagatgttctcccgccacctcgcggccgcctcgtcggcgtggggcatcgcttcgtcgcgggctccctatccaggtgagtcgaactctctcacgagccccacgcatttcgggcgtggtgaattgaatacgtgttgattgtttttggtgtgttgctgatccggttggattgggattgattggacagggagggagaggaggagcgcgagctggtggtgccctaccaggtcgttccatggtatgttctctggtggttttgatgctctgttgcagatactgtcgtggtttccgtactaggattcataacagtaagccatttgaggttggcgagattcatttttgttacagccaatttttattagagtggaaagttataactccagaccaaaatttaatgctatattttttatttgtgttagtgtgcgtggttgctatctttctaggtcttgttaatatttagctttagtcggtaaaaaaaaaaggaactttgaagcttttatcgggtcactatgtctatgctaacttactaagtcattcgtatctgcacgatatgttatgtacttcctctgtttcacaatgtaagactttttagcattgcccacattcatttagatgttaatgaatctagacatatgtatgtgtttagattcattaacatctatatgtatatgagcaatgctagaaagtcttacattgtgaaacggagggagtagtcaatatgtactacatgatctatacaaaaaagttcagtagatgtattaacagtactacacatatgttgtattgtcaagttcccactgacttgttgataatgtttcaatcaatgaatggcaggtttgttcactcttatttcactttactatgattatataaaagagcgattgttgtcactttttttatttttgtttttactatgaatggggccattgctgatgctaatatttgtgatagttggctaatgccatttgtctgaataaacgaacaaaactcatccatgatggatatacaaatttataagatggatgccatatttatttgttctttttgccatttccctgtcaatgtatttgtgctttttccggttaaaaaaatgtagctgtgcctattcaaggctctcagacgcgatgcttgtgtaataaaatctctgatttgtaaaaactgcactgtatttgatttttgaaatgctagcatgattcctttattctttttgtctgattttgttattttggcaaagttctatgttcattctgtttttctttatgataattgattttgtttgtatgattttagccacaaggggaatgaatgcaagggattactatgatgttcttggagtgaacaaagatgcatctgcatcagacataaagaaggcatattatctggtatatatatactttactttttcttggttaaggtaatgcgatattgattactctagatttgatttgattgaatttttggagggtcctgctcctgtataattcctgaatgtttgtatgagagtattgaatgtgaactatggtctaaattctaagccaaatatatagagaagtataatgtgttgtttggcattccaccgtatgcttacacttaatttttctgatctacaatcttgactacagtgctcgagaattgtgtagtgctggaactcttaaacttcatattagcaggggaaagctgttatcttccctatggctttctgaactgtttctagtgtttactggctgtccagcaccatttgaatatgacagcatgggatggtcatacccagttttaaattttaagggcttctgcatagtagattaggcaggcagtcatgggcatttgcatgccagtttccagctgtacagaccatagaggtttgctctatctcctagattatgtgtgttctaacttctaagcctctatggagcaagagctgtgtatgtagttgcatggtgttttcaagaaactaaatattgtatccaactttttgtttcttgaattgtgtatttgctcatttatcggcatgctatgcccatgccacctgtggatttagcgagcatggcaagaatgaagaggaaacacttgatccttctcttgacttcatactaagatccagaacttttaggatgttgtctattgattagaaaatctagatattaccctctcaatgttttattagattgttgtcctgagaggtatgtaattcataatcatattatttgaatagaccattaggttagttgttacattcacacaaatactcaatttacagtcagtgttttatttatttctacatccaaaggtttttataaataaagaaaaggttacttcctgaagaggctcagatgatggggcttatgggagaagatatccctcactcacaggagaatgtgtcctgaaatcatattgcagtaatatttcttaattcttattgagtggtcaggcatttattgaatgctttgcttgctatacgttattctcaataacctgtgtttgctaggtatatttttgtctgtttctctacatttccctttattttttactcaaagttttaactaaactgattatgcttccccagctcgcaaagaaattccatcctgatactaataaagaagatgctgatgcagaaaagaaatttcaagaagttcagcatgcctacgaggtatagagtcctggttatgaatatttatttttcatttgattaacaataggacattcttattttaaaggtgctattcgttgtgcttatctcaggttttgaaggatgatgataagcgtgaaacatacgaccaggttataaactatttcctatgactatgataatatcataataacatgctttactctgcatgtgcttatctttttaagttgctctaggaacataaatctagcttcatggtaatttattttataaatcaatgaaggaa

SEQ ID NO: 69751 - DNA, 29704 bp, Oryza sativa
atggtcgcctctcccttccttctcatgtcgcagagactgtatagcaaatttaatttgctcgatctcgagcttcagatcacgatattccttgtctagacgttcctcctgtatgatcgtaaagggtctttcctaccttaaaaggtagccaatgatgtgaggggcttctccactacgtatatgttaggtcccttgtttttctacaaccaatgtgagactattcaacacctccttatcacctaattaatcaaagaacacaacatagaagaaaaaaagaccgttaaataaatatcaagactaaaattatatacaataattacttatggtgggaaagcatctatcactgcaatgaatactcgatcatgcatatttgctaggagccaggaaacgtttagagcacagacaaatttaagtatgtgaccatatcgagtgtttgctattattgttctgttttcaatcaccataataacccagtactaaatatgtccactgaacttacagatatattcctgaaaccgtacttatgataaaatacctcaatgaaaccaatttattctagatgttcttgtcgtagtaatcatgatcaatgcaaattaagcataaaatgattaattatatatgcaaattaagtgtgcaaaggtaataatgcgtgccatatacatattggagaaactacttaagcgatgcgatgcgatgatactcacgtaagcgatgcgacgctacccaggtctaacacgctgaggacgagataatcactcaacgcagagaacggtttgctcatactgcttcaaatcatcctcttttaaaagtgaaaacaattaattaagtataacaagctttaaatcaccctctgttaaaagtgaaaacaaatattgagtataacaaatccaaataaatttagtacatgcaaaccattcatctcatcctcgatttaaataattcagaacaagtaattaagatctacaaatccaaaattagtctaaccaataagtcaataacataaacgttgcatggagaggctttattatgccggtggggacatggctactgaaactgctgaagagctgatactactccgtccatcataatatgatataattaaggcgtccacatattttaagatttcacctttaaaacattttgatattttacttgctataaattatattattggattgacatttgaatttactttcatatgattataattttgttattacaaaccttataatatatgaaaaattataagacaagaattagttttggagatcactgtatcaaggttgatcatgccttatattatgggatagagagagtataatccttctatacacaaatgattggcacatataagcaatttttatcacagctacttgccatggaaaaaaaaaatccagacatttttgtgagcttgtcataaagttagctgaataccgttgctgctttatatcctgttaactataaagaaccaagtattgtaagtattgatctgccagcagagtatctacttgtttcatcgaactattattctggcattcaaatatacttaactaatgtgtgattgtctattgtcgccccaattggacatttttgtgcataatttttgaagttgtcaatatgcctacgtcattgtcaattatctctgctgccttttgtttgatcggttaattattaacagtctcatccaatgcaggtaatctcgatgtctggaggatgttgcttatctctcttagattttacttctggttaaaaatgtcttgaaaggagccgtattcatgttgagttttcaagttgaactgctgcatggaagttctccgtagttttgatgtcgaatgtatgcaccacttatattaaattatgtcatatgaagtcagagttggaacttgtaagcttgatttgtcatgtttcacaacatctcgtatcatcgtatcaggtgaagtttcttctaagtggaaagctgtaacatcctgaaaattaactattttctaattatgcattatgccgattcttatgttttcaataaccttttgaacctaggaaaatataattagagagacctcctagaactaacttgcataaaatccctctccgatatttaacttctgttgtgtttttcatttaaaaatatatttggttaaattgaggtatttcttgatttggttttaaattaaaaccttctttcgatgcaattccttttattcaaatttagttcgaaaacccttttcatttgtatgaattatggtccaagaaaaccctccaaaccaactatgtgcaattctaactttaattggaattaattgtcgacccatcctttgattctcgatccaaatatccaaatcctttcttttaatctagccaccaatttaattcttgtggcttgattttcttctcggcacaataaatattattattgcaaatattatgaataattgctcttgtgttaagaaaatagattatatctttgtcatccaaatttcctattagcctcaaacaattttttgaaacccatgccatatattttgaggctaaaaccctacttatccttctccaattatcttcttcccaccttcctatttacacattcaattttattcatatatcccttaccctttcatttgagcgcatcaaataaattccattatatgctacctctaaaatattgcactcaaataattaggaaatctctctttggaaattatctccaaaataaattcatctcaaaggttagccacttaaatttcttccaaatattaatttggatttaaactccatccctcaattccctacacaaattagaaagccttcctattcatttgggccgaattttctctctcttccttcggcccagaccagcccaagtcggcccagcccctcccactcaagccgactccctgctcctcctcccgtgggcgcttccaggcgccgccaccgtgcgccattactgccgccgtgcacgactcagctaccgccgccgccatcttgccgtcgacgcgaaggaaccgccacccgacgtcagctacacttcattccgccgacgtcagcaactgggacgaaccgccatcgtcggccaataagaggacagagccggcgccgtcattcttttctccacgtcgctgcagccgtgtcctcatcgaccttcccctctaaaccgccatcagccaccgcctctcgccgcctataaatataaggcgagccctccccttttctccacacatcaacagagcctcgagctccctttctctctctccatccatggccgatcgtcgacgccgtcggtcgatctccccatccgtagctccacctctcctatcctcgcgccaccggcttcgcctccatccggcgagtccgtttttcccctttcccctcttcctccacctctaagtcaacccaccaccgccatcatccatgccggctcgaggtgagcccttgccgccgccgttccggctatatatctctccctctcggccagccaccgacctccccgggtgcgcgtcgctcgggaacacgcgtggccgctgccgtcgaggccgttcatccaccggagcatcgacgcccctcctctcccttctctctgtttgctcggctggaagagaaaaagaagcagaagaaggaaggaggaagaagaaagagaaaagaagaagagacaaataactgacaggtgggcccctgtacagtactatttcgtaatttccctatttaattcaaattctattctttagaagcccatatctcataaaccgtagatccgattccagtgaaacttagacctaaattcatctaaattcaaaatctacattttgatatcaaatttgctattttaagattttatttgaatttattcaaataccgtttgaatttatatttgacttttcaaatattttcttttatcccaattaccctttagcaactaaaaaactgccggttggaatttttacgccttccatggggacgatcgtggttttctatccccgatgtcgaaccgttggttgtaaagcccggcataaaccaaacccaaggtcgaagtgctgctcctagcaccccacgcttcgatgcgtatagcggtcggagcttcactattccatcgacccccacagcacgccgcacagttgttagctctcgggctctgtgtgatcctagctgctccgccgccacccacggttgttggagtaacacttccaccctattaaacctgcacccacctcctattccctcttgccgatatgctgtctgctgacaccggctagagaagacactaaatctagtcgttatgctgccaactctagcaacgactagcaaacaaccaaaccctagccgataccggattgctagtcaaatcccagttgtcatccaaattccatcccctctacaataccacctatccaccatactctcagccacctactttctgtctaccagaacctatacataaaatatatagcctggccgatatattgccctactccttagtcggcctaaatataaccaaaccctaggtataatcttacccaaacctaccatcagccaataccagtcacatatctactcaaccaattcaattatccactatactccctatccactaaccaatcaaagtctgcaaaatttgtgatatgctaccctgacccacatgtcattggctcatgtgggtcctacatgtcattgagatacgggtggcatatctcaaattttgcaaaattagggtggcatgattccaacaaaccctaaaatataggtgatcttagccacttaattccctctccaccccagctgccaactctttataactgtcacgcccagaaattcccgaatagaattccaagcagaatgtgcattaaaatccccgtccaggaccagccggggtacacaaacgacaatgttgacatacagatccacgtcttacaaacattgtaaaatcttacataaatgcagcggaaaacaaaagaaactggagctaagccttgactaaactgcagcgggaacaccactccacaggcatcctcgacggcacggacgaagcctactcctcggggaaaccttcatctgacacatacccgtcctctggggttgggaaaagtagagcaagactgagtactacccactgtactcagcaagtcataccggaataggggtatgatgcagggaattaacaaagaagagctaaagtggttcatttgcataaatactggcatttataaacaggaatttaatgcgaaaactgttgtaataattaagcagtattaaacatccgctgtccaacgctaacccacgttgcgacaggcccaaccatccacctaaactatccaagttcaacagattacactagggtgagactaatcacggggaatctggttgaccgcccataaccgcgggcacggctattcgaatagttttactctgatcagaggtgtacaactgtacccacaagacacagccccacgacacgtttccgtgcgccggcatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgattcattttaattaaccaacaccggagcggtggtattgatccaacattaccattagaaccaacagtctaatcattaatatgattttccccattgtgaactagttgaactaagcatggctaagcaattcctagtccaaactctaatcatgttataacccaagctaacaaaggagcatggtatcaaaatagcatggctgtaacaataggtaaccatcccatagtaatattgcaaaaccaatgcggtatttgaaagaaaacattaggacatttgcaatataggatcaatatgatcaagtgacaagcatgacttgccttgctctgctgctggaggaacctcggcgactatctcgaagtacaccggagcgtcggagggatcggaatctaacgacatacaaagcaaacattgcaaacaggctataagactactgaaacagggaacaaaaccatttttaatggattctacacatttttcttgatttactgagacttgaatgggattaaacggagctcggatgaattagttatgaattttagaagattcactttgtttattactataaccataatccttaaatactttattgcgcaataaattccagggctgacgtcagcacgggggagtgcggcgcctacatgcgggacccaccggtcagcgacccgggagagagaaaggggtggcggctcgcgggcccactggtcagtggcacggggaggagagagggcgccgacacgcgggacccacaggtcagtggcgcgggagagggaaaggaaggggcggcggcactcggcgcgacccggctcaagaccggccgaccggccgcggcgacggcgacggcgcgcgcgcgaacgggttgccggcgacggcacccggcggcggaggcgacgcaaaagcggcggcagcggacggtggcaacgacccaaagcgacggcgagcgcgggtggcggcgacgcacggggaaacggggaaggagaggagaggagatgcctcaccgagggtggccggcgcggaggaagacgatggcgaacggcgacggcaggccacgggaggcgacggcgacggcggacgagcttcggcgtgccctaaggaaggagaagagagggattagagagagggagatagatcccggcgatcggaaaccatggccgaaggcggcggtggagatggagctcacccgtgcgcgtggggatgagggctccggcgacgaacctcgacggaggaggggtggacgaggtggacctcggccgcgcgaagctaacggcgacgacggcgcaagacggcggcgagcctagcggcggctagcggcggccgaagtagcaaaaacggcggcggcggatggttgcacggcgcgggagcgatggggagctcgggagaggtcggcgaaatggggaaaaaacgagagggggtgccggcgatgcttaaataggggatgagggaaccggacgtggccggaagaggcgggattcgccggccgacgtgggggagtggggaggagagagaggcgggattcggttttcgaatcccggccatctcgggcgcgggcgcgagcgggagagagaggggaacgggcgcgggggatgcggcgcacgcgcgggcgtggtcgacgtggcccggggaaggcggagacgtgggcgcggcggcggttgcgggcgcggcggcggttgcgggcgcggcgggaggtgggagacgggcccgacaggtgggccccacctgtcggcgaccccgagagaggagggaggcgggcggcctgggctgggcctcggcctgcggccggcccagcaaggaggagggaaggaaaaagggaaatgggccgacggcccatttgacaaaaaggaggaaaaagaaaggaaaaaaaaagaaaaagaaaaggaaaaaggattttccctggaataaaaatattgcttgctcaattttaattggttaaaattatttctagagctctgaaaattccactaaaaatcctgttaatgaattttgacatgtagaactcaagaaaaattccacatgtccaatccgattattatttgcattactttattagggttttttttcctgatttcacctgcattttcttggggtcatttgtaaattcaatttttggcttgggaggaaaacttcggggtgtgacaataacccacacataaaatatcagcccagtaatccatataccctataaaagagataggctataccctaaatcctaaccgtcccaaccgtttatctctttctttctattttatggcttttattgaatttggttcttcctcttctgtagtagagtctattatattttggatgacaacctgtggtatttcaaggatcagataatcaggttgtctatctcggatttatttacgttggagcaaggcaagttattattcctcccctttgagcataattaattcctatattttatatctctattattccatgcattagacatacatgattttgaatgcataacctgaacatagtaaaccagatatatgctagctttgcttagccctgcctagttagattatgcataaaatttaatgaagttagattgggacagtacaatataaatggttgatttccgggtggctagtactgttccaaccgacataaaattgccaagtacatgtgaaaaacatacgagtacgaccacaattctcgtatgggtatagacctagctgattaagttatctagcaaaagtggtgcctttgtacagtggttctattttaagtcctcgcgcaggaggcaaatttatgtcgcgaagggcaattgcgatatttaccgaggcgcaggtaaatatatgagatttattgatgtcgacttgtttgtgaaccctgattgcgatgacatggtgtcatacaatcagttctctctaaagacctcgggaacgccagaactcctctcgctgctgataacgttacgttcagagcgtatggggactagagttcatggaacatgtaccactgatgttagtaaccaaaaagctttgccatgacaaggctaatgtgtttggcacgtcatggattgcgggtaaagcgtacatttactacagtaaagtataaatgaatctattcgaatagccgtgctcacggatttgagcattgggactcatatggtatttggttagaaacttaattccaaattttattaaatactgttgcatttaaaacattttaggctttcttcctctatattctttgctttctgcaagtaaacctagctttactcagatattaccatttcatgcattcattattgaatataatagattgccgagtacgttgtactcacccttgcttcaacccctttttcagtcattttggagtccttgctaaagttgggagttcaaacacataagttagtttcattctaacttaattcgcaaatatagattagatagatggtttaagtctatagtcaaacattagagttaagtcattctataggttttgctgtaatagttagccacagccttgtaaataccctattattttacataaagaaatctcctttgtagccttgcatgatcaaatgtatgcgatgaagatccagattgttgaacttgtatcaatctactgatccagggcttgatacagttttaatatgtcggttttcgaatcattagtttcgggacccgacaaaagctaaatcagatttgatgtaaactagcatggtcacgtatgttagaaaacgataggcacataaacgatgaagaacaatagatcaatcatagacgacacgagattttaatgtggaaaacactcctaaggcaggagaggaaaaacccacgggcgccagccagcaaatcttcactacatcggatgaggttacaaaaacgccgaacgacggcttacaagaagtatatataaggtgaaaccctaaagtatgacgatccataccgcttcgctccgtcccaagcctccggcaacggacctccacttcgctccgtctgaagtcgccttttatatgtgcaaatgaatttggatcacaactcaacaacgtactccctcaaaatatagcaatctttgcgattcaaatttgtcctaactagagctatctaggattgtaaaaggtgattattttggaacggaggaggtacgtctttggacattcagacgtgccacggaggcatggactgcgttcagacaagcagtgcaagtgcaactcttcccttcggccccagttatttttctgaacttctcgtttttagttaacactctttttaaattgttagatgatacgtttttggcaaaaagtttctttgtagacactgttaaaaaaataaatctattttttaattttataatagttaatacttaattaatcatatgctaatgagttttctcatttcgtgtgagctgaaaatatctctccaaaatcgagacaacaaatggggccaaattacaaagccctcaaatgggccttacacttgcgcagttgggtggtgaggctaatcgagtggcccagtccgatgaggtgggccgacaccatccattagtggcgcctccactgtgccatgcgaaacaagtggcccatcagcgattgcccttctccctgccgctcggaggcctggtgacagacggggaagatagggtagagaggaggaagaatgttgcctaccgcccttctagtttgtagtgaccgttgtccttctagttcgctgcactcactgcccctctctaagtaggcggccgtccctctcctttctattcgctgcccacccgttagccctccttgttggctacccctctccaagttagtatccacccttctccctgccgctcaaaggctagttgagaatatgagagatgctgaagagagggaaggagggagaaaaagagttggccgctgacatgtggggctcactcgttgcgtcagccaaaattgggtactatactatcttgaacctcacaccagttttgcatgttaaagaaatgtgttatatttggtattatggttcaaaaacataattcaaactcagcgtcaagatacgagagatgtaaaatgaacttattccatctacaaatggattatgttcttcaccacgcctgtcgacgggtgatacctgtagaccggatctatagggtattggggtacgtcggtactaggatctacacgatacgacatcaagcaaacaagaagacaaggattatactggttcaggcccctcgtaaggtaatagccctaatccaatttatatgggattaatatggaaaaccacatattacaataaagaacaactgatcccaagattactggcgagatccttgtcgagatggattcgacgagatctctcggcgagtaggcttcacgtcctctggcttgtaggttatggtggtgatttggcacaaagattcgatgatccacacccctcagagggtgtggcttttataccgtgaatcaccttagtctcctagtagaactcggagaccacggaccctgcacgatatagtacaaaccaaatccttttcgagtaggactctattatcaccttgcctgcaaggattatttccataatatcttgtaaattccctgatcatatacgaaacacattgtgtacaaagaggtataccgtatccgtgtattctataagtcgtaggatataaggtatgccttatccttaaccatgacagtagcccccgatttcaactcaaatgagtcctcgttgtcatcccagacttcacggacgatgttgtcatactcacgtggtcgttctcgataagaatcaagaagatatggagtttgcgacatcatcgaaagaagatcaacggtccacaaatgaatttgaattgaagtctaaaacaactgccaataacgggcctcagaaaatttcggcggcaatctctctcctttcctcgaaatgtgaaccgttcggtagtgctcctataaaacttgactctaggatccattttaggtccgtttgcctaaaaaatcctttcgccttcctgttcatcttgcttccaagaacccctaattccttttcttcttcctcgccaccccaagatcgccctcatggatttgggtaaatccactatcgacaccaccgggatgaagaagctgcaggtggagggctcgatccctggacgccaaaacctggagcgctcagaaggaggtactgaaccccaacccgccctagggcaagtcgtagttttagaagatttcgtccgttgtggttttttgcctcctccttccgaattcctcctcttgatcttgaacttttatggcctcagccttctacacttgaatcctagctccattgccttcttgagcatttttgcttatctttgcgaggcctacatcggtgtagtgcctttccttgatctttttcgttattattacgaactctgatggatggagccccatagaatctcaggatgctgtgggttccgcgtccgagatgggatgaaggcggaatatatccccttcaactgcccttcttctcagagcagctagaggtcaaagtggttctaccttcatgtagacgagctcgatcctgttctcgttgtcctagaagatcagcctgagcggtcttctgactagacttcaaaaccatccttgattccatccctccaggcttttttagacatagttagcgacctctgaaaacaagggttggccgggtatgaagttgctgtagactttatacgccgtcgtattcaaccgctctaagctcgtgctcaccctgtgtacgagtacatgggggatgaagacgtgacgcgcgtttctcagtggggtactcgttctcgcgatgtcgcatgctcttcagaaaatatcattgactccccctttactgactttcattgttcccttgtaggtttgaatgacgacatcgtgaaggcaagggtcgggcaagtcctgataagccctccctcaggttccacgcagctgccaacccccgtctgcgacctccccgtcgccgacaaagatgcagccatcaatgtaagtatcttctgcttgatctgtagcaaggacctcggttgccgctttgcactttccgctctttctattccttttcttgctagactctggtgtatccttgttggttgttttcttctcgtcgcccgtttttcctttcccatctttctgacggagggcgtcatctgcatgggcgcatctatccacgatctcgaacagcttgcgtgcgaaggtaattcgccttgttgccaactcttgggtggtgtagcgatcttggacacctgacttgaacgcacgaataacagaagcgtcggcgatttcagggatcgtattctggcattcattaaaacaccgaatatagtccctcaaagattcacccggattctgcattaaggcgtggaggttgtcctcgatcgcgtgtcgcttgtagttccctggaagttggcgacgaattgttgccacaggtcttcccatgacggagcgggagatgaattagccacgaatgagcaaatcctttcaacgtggctagcaagtagttcgcgagtacgttatcatatgccccagtggcataaagaaccgtggaatagatatcgaggaactcctcggggtctgtaatcccatcgtacttttctatcgccactggtcaaaatttctcgggccaccgtacttctcgcagtgttggggtgaacacccttcatccgcccccaggcaatagaggtggtcgatgtccgtgttgtcgtcgaggggcaccagccgaagatgatgatgacgatgacgatgaggggtcgctagggttaggcatgcggtcccaaggttggcgtccttgttgtcaatcccgccgggaatctggagagcacgaatctcggtgtcgtctgtcgtcatcgtgatcgtggcgacctcaaccgatgtcgccctgagctcgccgtccacgttcactgtcatcgcggtggctttggcgatcctcacgatctcggttctcgtctgagcggcctcctcaattgccatcattgttgcgtcgatgcggagaccggcgctgatgtcgatgggtatcatcttgatctcgtggttcccgctggcgcccgttcaagtgatcatgtatgtcatgattgccatgaggcggtggggtctgctgacgaggttcgcgtgcattgcggggattatggcctggatcacagctgggatgatcgctggtagcattgacaatgccgtcaacttccatagcgtctcctcgaggtggaggtcgaggaggttccaaagtcgttggtccagccgccaccgcagaagcgctattgagatttgccactgtggaccgtaatcgttgcacccactgatcgccgtcgtggtgtaggtctggatcgaaagggccttctatcaatatagaattgatgatgtccaagtgctgggtaggcgtacgggtatgatccggggctactcgagtacttgtaccttgctcctcaataacgttcactttgcgtggagtatgagatgttgaagactcttggtcctccaagctgtgaagaaccaagggtttgtgggggtcgatgtcgatgatccccacaaagcgatctggagttccctccgggccctgtccctctgcaacgtttcgagtttgaactcgtcgttgttggatctgagggcacggaggtttgactgtaataccccgagtttcgaattagtatatttcgggagatcttaaaacgaacgcgcaaaagttcagtttttaaaccgtttttcgaataggcgatcaggtaccgtggatgcgtagagctcactgagtagtgtaaaatagactataagtttatagtaatcggagtccgaacgaagtcctggggattgaaacgatgtgggccgttagatcttgtgttttagtctctttatataacttaaaaaaaaagaaaaaggaaaaaaaaggagagatcgctacagaagccctagccaccgctactccagcgccctggcgctgctgctgccattcctgtcaccgccgccgcttttgtgtcgccaccactgccccgaccattgccggtcgctgcagccatcatcctccatcacaaccggtggattctttcggttccgcttcttcccggtgaggtcttactgctgccaatctgatctagggctgttgcttgtttgcttgctgccgctactaaccttcccctgctgctgctgctgctggtggctggtactgcatcggtcagagaggagaagggtgcagagagcagaggaagcaggggaacaggaggaagaagggaaggtaaaggccgagtaattttggggatttcggtgacttcgcaactagtgggtttgtttcgaaattctagtatcctcgctgcaacagtacttttggttactccctagaagtataagattcgaatagaaattgattcgatagtcgcttgtgcaatttttgaggttcttgattatgggctgaaacagtattttaaaatctggcattaaacaggccattgtgattcaggttagttgtcctaaataaagtttgtattcatcatcaatatctttctaatggcgctggtttcactcaattccgataaatggtttgggagaaacaatagaaacagtactaggacaataattcgttttccataatctgggactttcataggcttaatctgatttttttcacccacatgaaagttgtagagaattttgtctagatgtctaaagtgatatcggttgctactttttgttaggtggattgtgaaatatgtatataacattgtatagggctagtataggtggttttgtgtggttgccagataaataccaaatttaggttttgatctttcataatgttttggacatgtatagttagtctcaacgattcctcgatagaggttttacttgtagctttactccacaggtgtggagggggtttcgccaggttgccgtcaaggttaaaggcaagtgcatgacgaactaactgtgtgattcatagattgtttgctctatctatttatgtccgatatatttttatgtgatatgtgatatgtgattgcttatattcagattgtttgtttacgccatatatatttcaactttatcttgtgtttacgatgttattcttatttcaatattccagattatggttctgtttaaataattcaagttccatgcttgacatggatgtttcaatttgtttctttgtttccggtttcaactattcatgttccatgcgagtcatggatgtgctatctagtttttattcaggttcctgtgggtaagcgctgatcacgcttactcggctttgctggcaaatgctaggatgtattcataattgtccgggatggaaactactatttcaattcatgtttgcccgggatgggaactactattttctttaacttggtgtttgaaatgtgtttcttttcaaagaaagaaagtgtcctgttcagactttattgccaataatgtgtatacatgttttctagttctatattgtgcttgctgagtgatctacatatttgtgttcatttattaggtctattcattatttgtgcattggagtaaatgaacattgatgtatgcatccatgcacacatgtatttataacccacatgcaatatcttgatttgctattggctaggaaatagtggggatggtgtatgcattgagtttgttgctagagtaaatatactatgagagagttattagcttttcttggtcttggtgtacctatgaaatatgtagatcaatttggaatggagggaatggagggagtattagttaagcaaattatgtaaaaaaaatgcactctagctctaaataaactaattaaaactagttagaccagagaatctgtacattcatcctcattcaccaaaaacctagatgaacttagctgacctaataatctttaggttaaaagattaagtaacttacatagaatatttccctagcttataaaatgtgaagtaaagttatataatatctaaaatcatgaactaaaattatattggttaacaaaattagtcattttatacatctcaaacaagatagaacatgatctggacattaaactccaaaaccatatacacatgaaacactatatgcctacaacacgttataatttgcaaaaatacctaaagaattcataataactctaaaaattatgaaaccaaatgtgttaaccttataaaacacatctcaacacctaagatggaacatgatctggacattaaactccaaaaccatatacacataaaacactatatgcctacaacacgttataatttgcaaaaatacctaaagaattcataataactctaaaaattatgaaaccaaatgtgttagtcttataaaacacatctcaacacctctgtgaagtcaagtttaataaaaaaaatcactttataaaagtattttacaacactgcctaataaaatcctaaattataccgatataatttataaaattcataactctcaaatggaatgagataaaatagaaattctttcacctaaattcatcctagaccagtacctatccaatgtgcacaaatcatgcattttagagcattttggattttcgcatatttcggtgtttaattgcataacgtgtactttatatagataattgcataacggtgaagaagtgaattaggagctaacatttccaggatcaaggcaagtgtttcctcccttttcctttgatcacattgaaacccatgatttgggagatgaaaatgtttgtttgcaaagatgcatgtgaatttagactatatcgatatttaaaacttggttatggtagctatgacctatttgctgcattccctaccttgaataattgtgatccttgctgtttgtacccctagaatggttagagtacatatcttgtgctcaaatggatttatatatgcaactactagcttagccatgcttagaagtatgcaaatgcttatttcatcaataattaaaatgtgattttactaagtgaacccttgctggaattaaaatgaaaatgatgattatttgcgaactaaaatgtgtaaaagtatggttgtgatttgagcagcaagtggtatgcatatggtgttagttgcatactgatagggggagagcttgctcaagtccgtaaggaccgaacttgtgtcaccaacttaaagttatccgtacatcgacatgtgctcttatgggggggccttagctgattaatctacctagcatctagccttgcattatggtaggccggtgtgtatgaattagtcgataatttataggaacttatttgcccccgaggtggtagtttaggtgactcagtctgtccaatacaccggtattgtgccacgtggtggagtccgttcgatattcgccatcacggcgttaagtttaaggcatgggcccgccacttaacggttctaggtattattcccagtatgcctaggatgggggaacacgtattgtgctggtgcaaggctagatactagtagtgtaaagacttcgttgtgatctctagaacgtactcaatgtgtagagtatggtagtgctttggccggcacaagacaaactagagtgttcatatcatgtgggtaaagctgtacaaactttgcagagttctctaaactaatcgattagccgtgctcacggtcaagagcgctttggtgaagtgtcataagtatagactctatattttaaaattgtgaacatgagacttcatttgaaattggataaaatgtgttgagtattatgagattgatgatatatatattatgacttgttgtcaaggatgacaacaagatatttgaatatgatggaattgtaatgattaaatgatgaaatttaaaacttgttttgttagttgaaattgttaaattcttttcaaatgaattgaaaataaaacctgctttatgctaaaattgaactacatatagccttcctttgagtatatgtcttacatgtagtatgttaggattgacttgtgcttgctagttgttaacgaccaaatttggtaaatcaagtgttggatctgaagacagaactacagcggatttggaaggaagttggcggttacagaaacagagtacaaatcggctgacaaccgaatcggctatggtgtacatcggctgagacagaatcggactaggatagccgatgtaaccggttccgatagagagaaggctggatcattgtcgaattcggttggtgtgcttcatgaggattgccacgtgcggattaagtctggaaaaggcaattatatctattaattaggatattttgttagtttccttattagataggagtcgtgtccgacaaggacatcttatgtaattctgggtataaaaaggacccggggtcgtgtaaatcaataacaatcagttcaataacaaattcggtgcatcgccaccttttactgttttctatttcgacgagttcttggtttcgagttgggctgcatcgactttgatctccagcaggaggtaacacttgtcgtggcggtttgtgttctcgggattagtgcttccatctttatgatactctaatcttgtttatgtaaatcgtctagttatcatatatgctatataatctagaccaacattgccatatgacctcatcggctagcattcgttgccagaaaacagccgatagggttatataccaatattgattcagattatatagtgtatctaccatctcaaaaaggctttcatcgacctgatcgtctagatattgtgtttcttttcatacttagtgctgcatcagttaggtttgatctactaagtcgtgtttagaattataatctctagcctatttatgattgctaatagagatagcatcggggtttcagccggtcttacctgatttggttatcttgttcacttgatatactaaatccgccctttatattgagatcttagcacaataaaatatattaagcttactattaatctgattaggttatcatggttttagattgatgtttgtttagtgtattttgttcatgataatatctttatataaagtagtattggagtattaccgataccgatacatgttaagtttgattaatcggttatgctatgaatatatataatttctgtcttaatgtatatttagacataagtgatttatactgtcttggcgccctatccgatctatcccaatcacttggtttaaacatattttgagatatggactatattctattaatatctacagccaattgattaaatttaatgcatattgcatcggcttaatgttcaatgatatgtcatcggcaagccagccgatcggctatcattgatggatttactttgttttctttctatgtctcaacctatgagcatgctaaccgatttctggcccaatgtggtgaagcatcggctactgatgctctaagagttaggttgtttcctttgtctttgtctggattggctttcacatggttttcttctttaccatacaattctgttcatagatgggccgatttggagaaacagtttcataaatacttctatagtggaattcatgagatgaaactatccgatccgacagccatcaagcaaaaacatgaagagtctgtccaagattacattcaaagattcagagatgttagaactagatgctatagcttggcctagccgatttggctttccagggcttattatcaccaatcaaagaaagattttcggctcaagactttgagagtttagcccacttggctcagaaaatagcagcacatgaacaaaggttccaagaagccaagaaagcattgaaaaaggtttattatatcagctcttatgtctctgaatctgaggacgaagaggatcctgaagtagcagcaaccgaatgggtgagaagcaaaaaggtggtctcatgtcaatgggtgaaaaattccggaaaggaagaaatatatgattttgacattaccaaggctgatagaatttttgatttgttacttcgggagaaacagattcagctgtcgcgtcccaaatcgactctaaaattcatcctcaaaattgtgcaaaagaataagtaaaattcaatgtgaaagcctccaacaattactcctcctccccttcttgggccggctcggcccattccctccctctctctctctctttccccccccggcccatcggctccccgcgcgcgcgcgcgccgctgacaggcgggcccgcccgccactctcgctgacgggtgggacccacctgtcatccccctcctctcgccgcgcccgccgccagcgcccgtgccctagcgccgccgccgccgcgaatcccgccgctcccgtccgccccgcgtgcaatcaagaggggggaattactccccgtaatctcctcccccgtttccccctctttcccctctctctctccctcggattcgttcgaatcaatcccgcgaagttcgccggcgcatctatggcggccgagatttccgcgcgccgtttcctctctccccggccgcgctctccccctctcgtcgctataaaaacgttgcccgtgctctcctcctccgtttccgccgttcgccgctcgctctcgccgtcgaaatcgtgctcgcgccgtgctcctctctctccgccgtcgccgccgagcttcgttccgccgtcgccgccgctccggacctcctcccgactcggcgacccctccgtccgcttcgccgcatcgccgtcgacctcgtccgccgctccgcttcgtccgccgaccgtcggagcgccgtcgccatcgtcatcccgagccgcgccgccgtcttcttcctctccgtccgccgttctcgtcgtcgccgttgtctcggggtgagccgaagaccgccgttcgccttcccccttccctcctctctctcgggtgccactccgccgcgccgttggtcgccggcggcgaccatcggggcgcgggtgcgcgccgctcccgtcggccgcgccggcgaggccgcctttgggcgcgccctcgcggctgccaagtgggcccggccgtcagccgcccgcgcccgcgggtgaggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataatgggaatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgtcggtcgtgtagacgctgcagcttcggaagatccgctcttcgttgaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagacaaacaaaaccccaactagtggacactctctactcatagtaccactagtataattctaggtagatgcttcgcaagttaattaggcaacattaggtggttttacaactctagacttgggaaattctcatatcatttggacaccatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcggagggttggtgcccaatgccaggggctcagttccgtctgcctgtcccgggggtcccggccgtaggcggaattgggtcggtactcttgtctaaggctaggatgggttggaaactatgtcacgtctttcgtctgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttataattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtttagttctaggatcgtgtttacaactagctttgagcaactaaattcctttaaatgctgtttactgcaactctaaccccttatgttataattcccttgtactcccttgcatttattttgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattttatatacgcttccgcttgttaaactctgatttgtatcaacttttggtgtaccttgcctcctgggacaaggattaatgcacgcacgtaaggaatgcccgttgggttatttccggtcgtgacaagttggtatcagagcctcctttgaccctaggacgagccgtagatcccaagccttagctatatttttaaaaataaaaatcctttattatttgtgaaaacccgctattctctctctgtcttgctgcttcatttatcgtcaaaatctgatcttttaaatgttgtttttcttttgtttttgtttatagatggccggcagcgttacccgtcgtggtttggacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctccggctctcctgagcggacttcgctggcagtcactgcgggtggagattccttccccgccgcttgccagaacgccgctctcctcgccatcggcactcttcaccagcgctacccggacgagttgcagcactcgccctaccgctaccacccccgtcgcggaggagccagcgacctcgccaccttccgagacgccagctcggaggatgacgctaccgtcgtgcatctggcacgcatggtggaggcgtacgacgcggctcgtatcgacttccatcagatggtgcgtcgtggcatggtggagaacaacctgaagatcctggagctgcgccaagagaatctgcagctcaagaaggacctcgacgcgttggaggcgcagctgcatcagctcaaggtcgcccagggagagatctgccgccccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcctgcgcgtgtgtttttcttcgtttttcttcttgagttgtgtggggcatggttacaccggtgtgtggtgtaactatgtcggagcctgtcttattttgtttgcctaagcaacttgaacattaatgaaccaatttaatagcagtaataattttaagaataatagtagtcgtgggtggttagttttaatcgtcagctcttcttctctgtttgctggttctgtgtggggttttctgatggtgtcgaccaggagaaatgttaacaccggagaaggcaaccaacccgaaggcagcaaccccaacccccaaggcaacccacctccaccaccaccaccagacaccaacgccattctcaccccaaatcctcgcccagcaagccaacatgatgaatgctttcctccaccacctccaaaaatccgccacagcagaatgctcccccaccacctccccaacactccaaactcgccgaattcctccgcatccgtccacccaccttctctagctccaacaaccctgtggatgcgttggattggttgcatgccgtggggaagaagctagacacggtgcagtgcagcgacgaagagaaagtcatcttcgccgcccaccagctgcaggggcccgcatctctctggtgggaccacttccaggctacgcagccagagggacagccgattacttgggctcgcttcaccgccgccttccgaagaacccatgtgcccgctggagtcgtggctcttaagaaaagggaattccgggagttgaagcaaggcaaccgctccgtgatggagtatttgcatgagttcaacaatctagcccgttacgctccggaggatgtgcgggaagacgaggagaagcaagagaagttcttggcaggaatggaccctgagctgtctgttcgtctagtctctggagactacccggacttccaacgtctggtggacaagagcatccgcttggaagccaagcacaaggagctggaatcgcacaagcgccgcttggcgaacttccgcaatcagcagggtgctaaccagagggtccgctacaccaatccctacccagggggatcctcctcgcaacagcagcagcagcagcaacctcgctccgcgccccgacctcaattcgtggtgcgcgtcccacagcagcaacagcagcagaatcagcaagggactcgtgcgccccgtcctcctacgccagttgtgcagcccgttcaaggccgcagggacgcttcaggtccgcagcgtctgtgcttcaactacttcgagcccgggcactttgcggataaatgcccaaagccaaggcgtcagcaaggccaagcgcctccccgctccaacaacggtggcaaggacgtcatccgtggtcgtgtgaatcacgtgacggccgaggacgtgctgacaactcccgacgtcatcgttggtacgttcctcgtccattccatccctgctacaattttgttcgactctggagcttcccactcgtttatatctgtgccattcgtggggaaaaatcagttgggggtagaaaggcttagaaaccctctgctcatcaccacccctggcggggttatgacagcaaagtattatagccctgccgttcctatagaaattcaggggattccttttccttcggatctgattctgctagacacaaagaacttggatgtgatccttgggatgaattggctggcacaattccaaggagtcgtggattgcgcgagacgcactgtcaccctgtaccgaggaccagaacaaccggttgttttctttgcacctccaacctctgtcagaagttcagaactgcatcaggtaggtctgtcagaaatccccatagtcagagagttcggagacgtgtttccggaagaactacctggtatgccgcccaagcgagagattgagttccggatagatcttgctccaggaaccactcctctgcacaagcgaccctaccgtatggcagcaaatgagctagccgaagttaagaaacagttggaagaattgaaagaaaaggggtatatacgtccgagtacttccccatggggtgctcctgtgatttttgtagagaagaaagacaaaacgaaaaggatgtgcgttgactacagagctctcaatgaagtcaccatcaaaaacaagtaccctcttccccggatagatgatttgttcgatcagcttaaaggtgccactgtattctccaagattgatcttcgttccggatatcaccaattacgtattcgtgaagaagatattccgaagaccgcattcactacgcgatatggactatatgaattcacggtgatgtcgttcggcttgaccaatgctcctgccttcttcatgaacttaatgaataaagtgttcatggaatacttggataagtttgttgtggttttcattgacgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggatcccgaaacagtgaccgccgtcaccgattggaagcaacccaagacagtcactcagattcgcagtttcttgggattggcaggatactaccggaggttcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatgcaggacggtcatgtggtagcctatgcttcacgtcagctacgacctcatgaaggcaactaccctacacatgacttggagttagcagcagtggttcatgctctaaaaatctggcggcactatctcattgggaaccgctgtgaaatatatactgatcacaagagcttgaaatacatcttcacccagtcggatctgaatcttcggcaaaggagatggttagaactcatcaaggattatgatgtgggaatacactatcatcctggtaaggccaacgtggttgccgacgctctaagtcgaaagagccattgcaacactctcaacgtccgaggcattccgcccgagcttaatcaacagatggaagccctgaacctaagcatagttggtcgcggattcttggccgcgttagaagcaaagcccaccttgctcgatcaaatccgcgaggctcagaagaatgatccggacatgcatggactcctcaagaatatgaaacaaggtaaagccgctggtttcacagaggatgaacacggaactctatggaacggaaagcgggtatgcgttccagatagcagagaacttaaacagctgatacttcgggaagctcacgaaagtccttattccattcacccgggcagtaccaagatgtacttagacttgaaggagaaatactggtgggtcagcatgaagcgggaaatcgcagagtttgtggctctatgtgatgtgtgccagcgtgtcaaggcagaacaccaacgaccggccggactcctccaacctctccaagtgccagaatggaaatgggatgaaattgggatggatttcatcaccggacttccaaaaaacccaaggtggatatgattctatatgggtaatagtggatcgattaaccaaggtggctcgattcattcctgtgaagaccacctatggagggaataaactagcggagctctacttcgctaggatcgtgagtctccacggtgttcccaagaaaatcgtgtctgataggggaagccaattcacctctcacttttggaagaagctccaagaagagctgggtactcggttgaatttcagcaccgcatatcacccgcagacagatggacagaccgagcgtctgaatcagattctagaagatatgctccgcgcatgtgtcctagatttcgggaagacttgggataagagtctcccctatgccgagttctcctacaataacagctatcaagccagcatacaaatggcaccttatgaagcgttgtacgggcgcaaatgccggacaccgctattgtgggaccaagttggggaaagccaagtgttcgggactgacatcctaagagaagccgaagctaaagtcagaatcattcgggaaaatctaaaggtggcacagtcccggcagaaaagttatgcagataaccgtcgccgtgatctggaattcgcagtggatgattttgtgtatcttcgggtcacgccattgcgaggtgtgcacaggtttcagacaaaagggaagctcgcacctcggtatgtgggtcccttccgtatcactgctcgacgcggagaagttgcttaccagctggagttgcccgcctccttgggcaacgtgcatgatgtgttccatgtgtcgcaactcaagaaatgtctccgagtgccatccgagcaggccgattcagagcaaattgaagttcgcgaagacttgacctatgtggagaggccagtgaaagttctggacaccatggagcgcaggaccaggaaccgagtaatccgtttttgcaaggtccagtggagcaatcacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaattcatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaaaaggttttataaaaagaaaatcctaaaaagaagtctttttcccctcctcctccccttcttgggcccgctcggcccattccctccctctctct

SEQ ID NO: 69752 - DNA, 10845 bp, Oryza sativa
gagccctcggatatgggcaagcctagcaatgtacccaagtcagtgttataattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtttagttctaggatcgtgtttacaactagctttgagcaactaaattcctttaaatgctgtttactgcaactctaaccccttatgttataattccattgtactcccttgcatttattttgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattttatatacgcttccgcttgttaaactctgatttgtatcaacttttggtgtaccttgcctcctgggacaaggattaatgcacgcacgtaaggaatgcccgttgggttatttctggtcgtgacatcagctccctactggtcatgtgattccatcggcagatgaattaggaaagaggaaatattgtaaatggcacaatacagtgtctcacagtaccaacgaatgcaaagtttttagacagtagattcagttggccattgagcaaggtaaaatcaaatttgatgattcaaagaagccgatgaaaattgatggtaacccttttcctgttaacatggtttacacaagtgggaagatagccgacagaaagaacaatcggcttgactctgtaagaatgattaataaatatcagaagagatatgatcgacaggaggagcaatatttcaaggatgatgacagttttgatccacattggagttgtgagtttttcatattttgctggaatgaagggatgaaattgccatcaatagaggattgcccaggttgcagtgatatagacaagagttattcagggaatcctagccgatttcatattagagaagatcagtttgtgcagaggaagttgcctgttcatcagaggttgggcccaattcatcaagattatttccaggaagaagttgctgaagaggttgcaaattcacaatggtgtccttctgggattttttctaagagtcagaagagaagggttcaaaggatgaggaatagggagcaatttcaagaaaatcaacatgatatgggtcatcggctgaaaagagcaaagacaaaacaaatctgcagtgttaaaagcaaagtggtatcagccgatgagattaaagccgatgaagcaaaaagattggctaaaggaaaggccattacttcttcatcggttaacatggtgtttgtgttacctgcagaatttggagttgatcaaagtaatacagatatcatggaagaatcctgtgctcaattgatttcgtcaccagaacaagctatctttgagaagccagaaggaacagagaattggcacctcaagccattgtatgttaagggatttgtcaatggcaagccgatgtctaaaatgttagttgatggtggagctgctgtaaaattgatgccatatgttacattcaagaaattgggtaggagtgcagatgatctcatcaagactaacatggttctcaaagattttggtggcaatcctttataggctaaaggagttttgaatgtagagttgacaatcggcagcaagactgttcctaccacattttttgtcatcgatgggaagggttcatatagcctgtcgcttggaagggattggattcatgctaattgttgtattccttcaaccatgcatcagagtttgattcaatggcaaggtgacaagattgaagtggttccgaccaacaggtcagtaaatgttgccaatgccgatttatctgtttgggagatggatggtattgattgtttatctggaaaaatttggcaaggagattatttgaaagtatttgattgtgatatacaaccagttggagatggagaaccccaattgttactttgaaggtgttgtggagggttcaaatttctacaccaaagacactgtagatgatctcgatggcaaattaggtcaaggtttcatgtcggctgatgatttagaagaagtggatattggtccgggagatagacctaggccgacatttatcagtaaaactttatcatccgaatttaggaccaagttgattgaattattgaaagaatacagagactgctttgcttgggaatattttgagatgccagggcttagtcgatcaaatgttgaacatcggctacccatcaaaccaggatatcggccatataaacaaccacctaggaggtgcaaagcagatatgtatgacgcaattaaagctgaaattactagattatatgatgctggttttattcgtccatgccgatatgctgagtgggtttccaatatagttctagttatcaagaaaaatggcagacttagggtttgaattgatttgagagacttgaataaagccacacctaaggatgaataccgaatgccagttgtcgatcaattggtagatgctgcttcaggacacaaagttataagtttcatggatggcaatgctggatataatcaaatctttatggcagaggaagacattcacaagactgcttttagatgtcctggtgcaatcggcttgtatgaatgggttgtcatgacttttgggttaaaaagtgctggagctacatatcagagagccatgaattatatttttcatgatctgatcggcttgttggttgagatatacattgatgatgtggtagtgaagtccaaggaagttgatgaccatatagccgatctaaggaaagtttttgagagaacaagaaaatatggcttaaaaatgaatcctacaaagtgttcttttggtgtatcggctggacaatttttaggttttcttgtacatgaggggggtattgaggtaccacaaaggagtatcattgctattcagaagatcaaacctccagaagataagaaacaattgcaatctttgattggcaagataaattttattagaagatttattttaatttgtctgggagattagagccatttacatccttgctaagacttaaagccgatcatgaatttgcatggggtgcagagcagcaagaggctttggatagtattaaagaatatctaagttcccctccagttctaatttccccacaaaaggggtgccttttaggttgtacttatcagctgatgagaagtcaatcggctcaattttgattcaagagtttgagggtaaagagagagcaatcttttatttaagcagaagacttttggatgcagagacaaggtattcctcagtggagaagttatgcttgtgcttatatttttcttgtacaaagttaaggcattatttgttatccaatgagtgcaccgtggtttgcaaagccgatgtagttaagtatattctatcggctccagtgttgaaagggagaattggcaaggggatttatgccttaacagaatttgatcgttgatacgagtcacctaaagctattaagggacatgctatagctgatttcattgttgaacacagaaatgattcaatcggctcagttgaaatagcaccttggacattgttctttgacggttctgtttgtactcatggttctggcattggcttggtcatcatatcaccaaagggggcaagttttgagtttgcttatactataaaaccttatgctacaaataatcaagctgaatatgaagcggttcttaacggtttgcaacttttgaaggaagttgaagctgaagctattgaaattatgggtgattctttattagtaattaatcaactagctagagaatatgagtgtaaaaatgattcattgatgatttatcatgagatgtgcaaagaattgatgagtgaatttcgactagtcacattgaaacatgtttcttgagagcaaaacatggaggctaatgatttggctcagggggcatcgggatataagccgatggtaaaagatgttgacatagaaattgctacaattacagccgatgattggagatatgatgtgttcaattatttgaagaatccttctcaatcggcttcaaggaaattaagatataaagctttaagatatgttttattggatgatgaactatattataggaccattgatgggatattgcttaaatgtctaagtgctgatagagctaaggttgtaatgggagaggtgcatgaaggtatttgtggtactcatcaatcggctcacaagatgaagtggttgcttagaagagttggatatttttggccaacaatgttggaggattgtttcagatattacaaaggatgtaaagattgtcaaaagttttgggcaattaaaagagcaccagcatcggctatgaatccaattattaaaccatggccgttcagaggttggggtattgatatgatcggccagattaatccaccttcaggtaaaggacataaatttatattggtggcaatcgattattttactaagagggtggaggcagtcccattgaaaaaagttgattcaggagatgcaattcaatttgttaaggaatatattatttaccgatttggtgttccacaaacaattacaaccgatcagggttctatctttgtgtcagatgagtttgttcaatttgcagagagtatggaaatcaaattgctaaattcttcaccatattatgcacaagccaatggacaagcagaagcatctaaataagagtttgatcaaattgataaagaggaagattgctgattttccaaggcaatggcataaccgattggctgaggcattgtggtcctataggatggcttgttatgggttaattcaagttcctccttataagttagtttatggacatgaagcagttttgccatgggaacgtgtcatcgcctcaagaaggattcaatcgcaagatgagctcacaaccgatgattatcataatctcatggtggatgagtcagaagatttggttcagtctagaatgcatgctttggagaaagtgacaagagataaggagataattgcacgacattataataaaaaggttgtgccaaaatcttttgaggaaggtgaattggtttggaagttgattctgccgattggtactcgtgataataaatttggcaagtggtcaccaaattgggaagggccttatagaatttataaatctgtctctaagggagcttacatgttgcaaggacttgatggagaaatttttggaagggctcttaatggaaagtatttgaaaaagtattatccaagtgtttggattaattcataattcggctatatcatgccgatacatgttagccgatgcgttgacatcgccttgagatggccgatatgagtaatatcgcccttagtcatttttacttattataatcggttgtgttctgaccctatttcttagccgattgtaattttgtgatgattgttatacattacaaaattagggggcaaacatatagttgaaaatatggattttcaaaaacaaatttatattacacaacagggagtttcatattacacaacttgttcagcctattacatgcttatgaatagccgatattgccctttgtctgatttgttctacctcttcaattgcttgggcatcggctgcatctgtgcctggaattggtttcacagtcttgttcagttcgactaagtgcttgattgaagacttcaacttggatttttgtgcttcaatggctctgggtagatctgcaagcttttgctcttctaaggctagctcagcattgcatccttcaagttcaactagcagttcaatttttctattttttagccgatctatgttgaattaaataggattgggtccagaaatcaatgcatcaagcttggctttttcttcattgatggattgccgatttgattggatggtagcttcaaggtcttttctttccctcctatcggctatcctttgtcttgctctctccagtttgtaccgatattgctcaaggaagactgctggagagatgacttcagctgcattatcagggatttgatcttgtatttcttcaaaccttgccctgattggaccacagtccacaactaaagcatctaaggagctctcaagccgatgtgctatgtctttgagtatggttttaagatcatcggctagaggagcttgtgctttgcttgacgtttcttcctcttcatccatgaactgcctaatgtcaaatgaaaacatatccgctaaggcctggaaaggggaaatgatgattttttagtcaatgaagatgcttggagtagccgatttttggttataagaattgtacaagtacttacagggatggcaggaatcggctgatcttcaatgtggtgactgcctctagccgatggagtatgctcgcttgtttcatgctggattggagttggagaatgaattggctaaaagttttgtgaagaaagaattgagttatcactaagtaactgagaattgaagaaaatttgaaataatatattgccgatggagatggtgctggtttctttctggcagctagcttctttttctgcaaataaaaggagttaaagtcaaaatcggcagagggaataagaagaaagatcaggttatagattcatacccgaggttgataagtcaaatgtattggagccggtggagttctttgaggagcaggggtgctagctggaggtgctttagctattgcttcacttgattcagtagctgcttcatcaatggcttcttcaattttctcttcatctaggaacttttccacctctgggtctatagtggccagatcatcggttgctacttttttctgtttctttgaggctctagtttttctagccgatggagtagcagccgatggtttggtccttttctttgtccctacttcataggggatcggctcacgtgtttgcctatgcagaagtgaagaagtttttggggcattatgtcacgcccagaaattcccgaatagaattccaagcagaatgtgcattagaacccccgtccaggaccggccggggtacacaaacgacaatgttgacatacagatccacgtcttacaaacattataaaagtcttacataaatgcagcggaaaaacaaaaggataactggagctaagcctggccttgaactgcagcggaaacaccactccacaggcatcctcgacggcacggacgaagcctactcctcggagaacccgccatcgaacacatactcaaactctggggttgggggaaaatagagcaagactgagtactatccactgtactcagcaagtcatactggaataggggtatgatgcagggatttaacaagggatagctatacaggttcatttgcataaatactggcatttataaacagaagttgaatgtgaaaacagttgtaataattaaccaatattaatcatccactgtccaacgttacaccacgttgcaacagacccaaccatccacctgtactatccaattccattaaactaaactaggatgtgactaatcacggtgaatctggttgactgcccataaccgcgggcacaactattcgaatagttttactctgatcagaggtgtaaaactgtacccacaagacacagccccacaacacgtttccgtgcaccgacatgccaccacgacatatcggaaagagactgtgacaggacccttcgcataaccccctctagccaagcacaccacacctcaggtttcacccccgtccccagcgggcgacgggcagtcccctctcgtgcctaggtgaatccggaagcgacagaggctgtcgcagggcccgccccgctccatcactcccacccttgcctggatgcgtcagctagagaaaagctatactacaagcccagccgttgcccacgctggcttgtggtaagtacgagttcttccagggtttcccgcgaaccggtccttacttgccatgggtgcgactggcagaaccatgcacccacagcccaccatgtgattcattttaattaaccaacaccaaagtggtggtactaatccaacattatcatatgaacctacagtctatattttaaatgagatttccccattgtgtgctagttgaactaagcatggctaagcaactcctagtccaaagtctattcatgttataacccgagctaacaaaggagcaaggtaccaaaatagcatggctgtaacaataggtaaacatcccatagtgttattgcaaaacaaatgcagtatttgaaggaaaacaatagaacatttgcaatgtaggatcaacatgatcaagtgacaagcatgacttgccttgctctactgctggaggaacctcggcgactatttcgaagtacaccggagcgtcggaagaaccggaatctagcgacatacaaggtaaacaatgcaaacaggctataggactactgaaacagagaacaaaaccatttttaatggattctacacatttttcttgatttactgagacttgaatgggcttaaacggagctcggatgaattagttatgaattttagaagattcactgtgtttattactataacaaaaagtccttaaataatttattgcgcaataattcccagggctgacgtcatcaggtgggcggcaccgacaggcgggtcccactggtcagtggctcgggagagaggggaaggggcgccggcacgcgggccccactcagcagcggctcaaaggggggcacggctggcaagcgggccccacggctccggctccatgagccgatgtaccggccaggcccggcaaggcatcaagccaggcccggcaaggcggcatgcgaccgccggcgacgccgagcggcggcgcgggcggcgggcggcggcgtgagcaacgacgactgaaagcgacggcgcacggggaaaaagggaaggaaaggaaggggagggagacctcaccggaggggcggcaacggccggcggcgggaaacgagggaggcggcgaagaccggcgatgccgaggtgtggacgagcgacggctgacacttaaggaaagagaggagaggaattagggcggaggaaaaccctcatggcgaccatccacgccggccggagtcggaggggagagagaactcaccggcgacgcgagggaaatggggtttcggtggaattccggcgacgcagagcggtggccgggaagggtcttgcggctgcgaagctaggggtggtggtggcttagcgcggcggcggctctggtgacggtggcacacggccggagtgcggcggtgggcggcggcgcaagtggcggcggcgcgagctcggtagggggcccgggatggagcggtgagagcggaaaacgagagaggagggcatgggtagcattttataggcggagggggaagcggacgtggccgggagacgctccaatttcgccggcgacgtgggggaggagagagagaaggtggggggattcaaaatcgaatcctgctccatacgagagcgggcgcggccggcagatcaggggagagagggcgcaacgatggcgtgggcgcggggggcgtgacgtgggctcgggtaaatcggcgaggatgggtgcggcgacggtggatacggaggggtggtgaccggcgcgggcggcgggaggttgggggaggacccgacaggtgggccccacctgtcggcgaccccgggagaggagggagtcggggcggcctggctgggcctcggcctgcggccggcccagcggggagggggaaaaggagagaatgggccggcggcccattcgaaaagggaaggggaaaaagaaaaagaaaaggaagaaaaggattttccctggaattaaaatattgcttgctcaattttaattggttaaaattatttctaggactctgaaaattccactaaaaatcctggtagtgaatttcaacatgtagaactcaagaaaaattccacatgccagattcgattattatttgtattactttcttagggttttctcttgatttacatcggcattttcttagggtcatttataaattaaattttaggcttgggaggtgaacttcagggtgacaaacctaccccccttaaacggaatctcggccccgagattcggaggagctggcgaagaggtgcggatgggcggctttcaactcatcttccctttcccaggttgcttcctcctctgaatggtgactccactgaactcggcaaaacctggtgaccttgtttctggttcttctttcgctggtatcaagtatacgaaccggcttctccacatatgtcaggtcctcctggatatcaatatgctccgagtcagcctgttcttcaggtactcttaagcacttctttagttgggacacgtggaacacgtcatggatgccgatcatattggatggaagttctagctgataagcaacttctccccttcgttccaagattttgtagggtcccacgaaacgtggtgccaacttgcctttggtttgaaaacggtgcaccccccggagcggagtgacacgaagatacacgtaatcccctgcttcaaaagtgagctcccttcggcggttatccgcgtagctcttctgtcgagactgggcaatcctcaacctttccttgatggttctgactttctcttctgcttccgctaatacctctatccctaacagttgacgctcgcctgtctgatcccaaaagagaggtgtgcggcacttccggccgtataaagcttcaaacggtgccatctgtagactggcttggtagctgttgttgtacgagaattccgcatatgg

SEQ ID NO: 69753 - DNA, 534 bp, Oryza sativa
aatttacatgcattttatgtcttagcttacaagggtcccgttgtcgatgtgtaggtttcgcccagttcgctatgatgcaggccgcccacttctcccaggctgcagggtcagcgtctcaggcagctgtgtcgacctcgcactcagcgcagttctggcagtacaccgggacttcgtcacaggcagccggcacgttgagtcagggtccaccactggaccatgctgggacctcgtcggaccgcttgctgccttccacctttctcttagacatcactgacttcgacttcgcttcaggctcgacagaggacgtcatcggcccctcacagttgggaggcgcaccgccggtgcagacgcaggatcaggcgcaggccactcctccgcgggacactcgtgctacccgtgctgtgccaccggatcgtttcacctactcctaggaccacgtgcgagcacaggcccggaggaccaagcgtggtcgcggcgcggggcagcgccagtagagcagtcttctctttgtttacttgcttcactttccagaac

SEQ ID NO: 69754 - DNA, 1389 bp, Oryza sativa
cctgcagcccaacacgaggtaaaatccaatccgttgtaatggaacaagtgttgatgctaacagtaatcctgctaattctagaaaattttacttgctgttgaaatctgtactaccattggcattaactcatgtctgaagctccggccgaaatatgtaggccatcattccagcaatatacactactaggtgatattacaacaagctgggctggcttctatgacatagcagttgtcaatttactatctgaagaagaatccttcccttccctgatggagatttgcagaggaataggggaatagtcattcgcccatcaggatagtagacaatgggatggtttcacgttggccaaatttacaatgtacagtatgtaaatttacaatggtttcaggttggccaaatttacaatctactagcatactcatcatgcttgctcatgctgcacaatggccaacatctcacttgcaccagattgccctgctcgcatcctcatgctgataatgaaggcaatgagctgcagagtagatatactctattcttagtatggcataaaaagtgtgcactgaacatattcagttgaaatcttaccgtacaaaagccagcacacatgatactgaaacctttgaatttgaatggcgctgtttctgaaaggacccatgctgccgcaagaaagcaaaagctatggagtaaattaaaggaaacaagggttataaactaggatttatttacaaatgaaaaaaatacctgttagaggggtaaaaattagtggagctaatatgctggcaaacgagcttatgcccgatatacagccttgagcaattccctaagaggcaacaccaaagtaataggaataatgagcgaaacttagcagtcatgtcaactaatacaacacaggtcatcatttgaaatactcaaagacaatgatcagcaacaataggaaaaaccaacctgctcatttgatccaacactcttcgatacattggttcttatctagaaaaacagagaagaagatgattaatattgttctgaattgcttggaaggaaaaaagtttttaataaactgttgggaaaaatatggcttacagaagggtgaacaaaagcactcagaattataaacaccgcagataaatatggtacctgtagatgattaagacaacgttagcgaagatatgtgtaatggatgactgatattggtttagtgaatgctggaaacgcactattgcactgctgaaccagcaagcaactaaacctgattgcaaattagtgcaaaacaagagcgtagttctgtctatacatttggatatagccacaattgcattcttttgggtaagagtctaataagactacaagagaattattgccaagtccaaaggaagtacccagggctgcagg

SEQ ID NO: 69755 - DNA, 8382 bp, Oryza sativa
agatgaatctgtgatgtatttgacttcggtgtattttctagcatttgtgatgtatttgataagcttgtatttttttagaatttgtgatgtatttgatttgtgtgtataaggaacttaagatttgggatgttcctttgaattgaggatttgaggatatacatggcactagattcgggagaaaatatagggattaactctaagaaacaataaaaaaaaggatcatctgcactgcactgccgctaccctctctttagtcccggttggtgttatcaaccgggactaaagatctatttttagtctcgggtatttgaaatctttagtcccggattcgtactcccggttggaaaaccgggattatagaggggttaccaaccgagagtaaaaagtctttctccaccagtgatttctatctttttacctactgttgatcagcaaatagatgagtttggttccttcaatatcttttatcgacctaccagcgatactactttcgtactattgaaggtatttcgatcttttttttctctatattaatttgaaacgcagttgctagaagtgaaattattttggaacagaaaatagtacttttttaaaaaagctaccactgcccttagcctcacagtaatttagcaataatgtcttccatgctatatctacattcaattcaagaacacattcgaagtgctaaaattttattcaacaactttagttgccagttggtacgaaattcgtcctacaatgcgtccaaattaaggaggaaggtttctgactgacaaacgtgcaaaagtttcaataaattaaaacagccaagtcttattttaaaccagtattttttttatcttatttatttagaaaagaagcattcttctattacaagaaagacgtacggacgcacattgttctcacatcacccattatttttaaaaaggggtacacagtacttagatcgattaaaccagcaatctttctgataattaagcagtaattaacaacgcacatatgttcattgcctaattattcatcgttcatgctcatccaaacaagaaggcaaagcctacccaaattcatccgtcaatcactaccggccagccgactactgaaactgaaaggcaacgggattttttgtaaaaaaaaaaaagaaagaaagaaactgaaaggcaatagacaaactgagattccaacgtggtcaaaatggaatgcgaaacctaacctagctaatactctacaatatctggtcaaacccaattgcgctccaaattcctaattcgctttctttgctagaaactgcaagcctgcctgccagaaaacgagattgattaatttgaaaaatacatgactaactgaaccgtaaattataatagtactgtagtgaattaaagatatctatgggtgtcatcatatttttcttgggaccaacatagctctattatttgattagattagatcagattataactccatattgtacagggtagctaggaacagaatttgcagaggtaggttgtatagatgatagtaccacattgcagcccatatgcattgtatctgtatgcatgaatccaagatagatagataaacttagcaggttaaattactgtgtctatggcggcacaagtggttaattatcacttggtacttatccttactcttcttgattctactaccaatcagggttggaaatttcggtatatcactgacttccgatcaaatcggttaaaccgaaaaagtaaacctgctgccaattactctacacatgcatagaaacaaatcttctgacacaccttttattctgactttcaatctatgataatcttgacatgtggacttgtttgataaatgatttacatatatcagtgacccgtgtttgaggaaagtaagtcgtaggatcttaatcctacatacatgcacttaacctgtatttaattatcctagatagcttaattagttacatgcatatgctttaggttattagcgatttccttcgtttcaggtcacgagactttttaactttagttaaagtcaaactgctttaagtttgtagataaaatggtaacatttttaatccaagataaatttattatgaaaatatattcaattattgtcttgataaaactaatttagtattataaatattattatatttgtctataaacttaatcaaacttaaaatagtttgacttatatgcggctagcttgcatgtcttaccatcttgttaggttgtacatgccacctagctcacatccatgcatggaagctatatatatcactcgccattgctgcccctgcaatcaacggaagcttagctgagttgggtttggtctcgccgctggccggagtagagcggtccatgtgctgtaccggcgacgaggtggcgggacccggagagcagcggcggcggccgctcgacgccgacgccggcggcgacaagggcgcggtggcgacgacgtcgtcgtcgttgttggcggcgccgatgctgtcgcggcggaggcaggcggaggagatggcggcgatggtgtcggcgctggcgagtgtcgtggccggcggcggcggcacgtcgttgccggcgaagaggccagccgagagagagcccgaggagggcgccgccgtggagggggtgtggtggtcgtactgcagtgagctcgccgccgccgccgccgcgccgtcgccggcggctccatttccggccggtacgtacgtgtacgtaagcagagcagtatagtaaaagttgaatgcaacatgattaattaaagtctacctcggactttgttaattaaccaaactaatataatcatgattacattgatcacaaagtgacttgcttgttctctctatcaccttttctaattaaccattaggttgatgattaacattaactaaaatgcatgcatctctcttttcctttggtgaaaaaaaaggaggattgattttgaaccttattgatatgaaaaattacaattgagaaaatgatgaacaaaacagtaaaactacgtatactttgcaattttatatgactaataataagagaaattttaatgactgattaagcacaattaaaatgaatgataaagctttttttttattattttctctttgttttattcaaaagtaatcacaaagatgttagcctggtaggagtatattgttatagtttagtggtgtttacactaacacacacgacgtgcacgcatcttgcagcatatgcataagcaaagcatatgggttggtcaatgtgcacgtgtggatccacgcgtcacacgagcagaggctgctccaaccaccgccacatcgcaactaatataatcattgttatggacaaaattaagagatcccatgggcttaatttattcattagggaaaaagattaagagaaacaatgggatgggtagctcactaacaaccaaacacgtgttccttaatcgccacgtttcgtcattcttagcatcaaacacacgaaatgaactttgttttaaaaacaaacacacgaaatgaacttgtgactagttaaaaccagtagtccgcattgacattaaaatataggaacattctgatcatccaagagaagtttgcatgtcaccttttgtattagtttaacacaaaaacagagcaagtgagaagaaaatcagagtatctcaaagagagagaagcaaaacagagtaaccaaattaaccagatcaaattacttttaaaaatcacagctcaaatcactgtgttacaaactttttttactacatagtttctggatattattagtatggatacatgaaaataattgaattttattactatagataattaagcgctaatcaaaacaggttcttgtcctaatctcccctgttttttttttcttttttttacgcgttcgcaggctacgtgccatcgccggggcaacactcgcctgcgtcggcggcggccggcgacgaggaggagctcccgtcgccgtcctcggccgactccagcggcggcacggcgaggaagcggtacagaggggtgcggcagcggccgtgggggaagtgggcggcggagatccgggacccgcacaaggcggcgcgcgtgtggctcggcaccttcgacaccgccgaggacgccgcccgcgcctacgacggggccgccctccgtttccgcggcagccgcgccaagctcaacttccccgagcacgccaccctcccaccgccgccgacgacgacgacggccgccgctcaccggtgcccgccaccgccgcggacggacgcgctgctggagtcgcaggagctctctcccggcgccggcggcggtgacccgtactctcagtacgcgaggttcttgcagggctccggcggcgacggtggcgaggcggcggcgcggcccggcggtggcgcctcgcaaagaacgccacccgccactacactgctctacagcttcgagggagacgctgcttccgccgcctgcctctggcagccggagagcggcggcggcgggatggggtggccggcgacttcgccggcggcgtggttggagtacggtttctacccgccgccggagcggcgcgacacggacacgtagggttaatcacgatgtgatcctgagcggaataggcggtgacgctgacaggtggggcctacttttgccaggtgcggtcaacggtcaacctgaagttgacgtggcatgccacgtaatgcggcggtcaacgggttcagacggaagtgggtcatggacggcacgagacgccgtcagaaataaatgctcgaaactgacacgatggattacattgttcgtcaaattctcagagggccacatagttgcaggagggggaattattattcagcattgtttttttcgtaaaattcatcgctccaaaaacatcacacatctcaagcttgtacgaatgaaactagtgcagtctgaagattttctttttctggttttatagaacaaaagatttttgaagaaacccaatcctatgaaaaaaaatttcttatatgaaaggaatgggcatccaaaattcctgtaaaatttctctgaattggctcaaaacatggctatgacatggcttgtgtctcatgatgaatgtactccgtcctaatttgcctttgattaataattctctttcaaaaataaatcctcttgggaaaaaaattctcttattattcatgtagttttccgtaagatttggagttctaggaaacttgagtcctataccttctttgactcgtattatttgagaatcatgtattcatataagctctaaaattggctattacccaagactgtacgactcgtttgttgttatcagtgttgtgtaacaaggagtcttcaaaaaagaaaaggaaaaagaaaagaaacagcaccgaggaaattagtatcgacatcaaagaaataatgaaaaattacaaaaatctgtcgaccgctccagttgacaaaaattcgtaatattttgttttttatgatagagccactagtagctaggtactcttactcgcatgtcattttgttctcttcccttttcttccgtacgaaaaccgagtgtacttcggcaaattcgttacgcctcccgccacgacacaagagccaatcgcgatatcgcaccgtgtgcattcgtccacgtcagcaccagggcatgcgtacacacctgcaccacgttaacgaaagaaaaaaaaaagatcagtcacaatgccattggttgataatatcttattataaactgtattctcttcgtttcacaatgtaatactttctaccattttccacatacatatagatgttaattaatctataaatatatatatatatatatatatatatatatatatatatatatatatatatatatatatatattaaatcattaacatctatatgaatgtagacaattcttgaaagccttacattataaaacggatagagtaagatttaatagtgattaaaaaataatttaaaagtataaattttatatatgtgttcttaccgacttaaaagacaataaaagtactctttaattaacttcaaaactaaatttaaattttaaattttaacaacgatttattctttataggggaacaatgaggccctatgctaataaggaccatgactccataagctgaagaccggtgaagacagacatgacacatttttacaggtcaatgcaaatgcagttgacgctatcactggctgatggatttggttcctacgcagtttctagtatgacattttagcctattagccgcttacacttattagggaagacattcaaatagcgcacgattagttaaaagcagttgcatcaacaagaacacaaatggctattccttgccaatttcaacatggaatatgcatgcgacactgccccttttgcataagtacagaatttttcgagcactcccaaaggtgttgtgactggagcacatgaaattccaaagattagctgtccttatgctgaagatttccaaaattcagctcagtgtctttcgaacttaactgaagcggtatggaattttgattcctcaagtgactcaaggcactgaccagcatcttctcgatggcaaaagtcagtgatttgtgcatactaaatagaatcatcctagcaagtatcgacatttctttttctcataaggatttgttctcaataaacatactttatatgtcccctgaagggaactcttttttcaggggggacccgaagaaatgacacctgacattatgattgtggtacattgcacagaaatttagaacctttcttcagtaaacataaaatatgtttgcattttattttccatatagaagcttggaggtttttccactaacatggcaaaatttgaagagcatactcaacatagcaccacgcgtatccacacaataaatacttttcaagaacatgtacatatgtactgatatttgaagagctatgggaagtgatattttgtttcctccaggttcaaactaagtggtttgacattttaatgatatctgcgtctgcatgttcttagaaatttctcaatttgcaaaaatagatgtgcacgactttttgttcaaataagattagttaagatagatacacatactcaatcatcaccgtcttcgttttcttcttcttcgctgcgctgttggtggtagcttctcagaagggccacaaggaagtgtagttcctgtttcactctctatgcgtctcttcagctcctgtagaattcggatttggcccaatttctctggagataacttttcccagtaaatccctgcatgcagaagttccccaaaaatctggtcacataaggtttttttgccggtttaccaaaatattaaataatacaatcattcataccttgtggtttcgcgatcgtggtatttgtgaatatgacctgagttggagtgcagataatgtcaactggtacatcatgaactaacagcttctcaactggaatgtcattcactaattgtttgtcatgcactgcagtcatagacacagttggcaatttacattagttattaatcaaggaacaaatgagctaaaaggcaattaatttaaatttgataaaaaatatataaaggttatccaagaagggataaccagctgaatcaatataaaaaaactcaccagttgttactatcatggttgaatcgcttatagatcccatataacgcagcatcccatattccagctctgcaaatccctatagaccattttgatgaaataaaggagtgggaataagtagtttcagtagatagagcatgattcaacatttcaacatagtgccaacattggacagaagtgaaaagcctatcgctcaatttttctctcaaaggaagaaggaaagcaggtcaaacctcattatttcctctattaatttcttccatacaaatgtacaggagagaaacaaattaaactctgcgtcaagtcttcaactgcagaaatgcaattacaagcagagaatagttacctcgccctttcctagtcgtgctcctgtgcttggatcaactgcaaccgatccaatcacaatcaaatccactttaattttttcatctagacctataggtctcccgtatttggctgcaccaacagaagtacatgcttctggaatacatccaatgggtatcatgtgagattccagaactgagaaaaatcctgtccttagccgaggtgcggagtcagcaactttttatctcctgtgaggatccaagtttaacctgattagtgcatatggctatcatagatttataattagttgattaagatgcgcaacagattcaaaagcaacaaatggcatttaaaagcatcaagcactaataagaacagtatggtttgtcttgcaacacaaaagtcaacaaatgatctgtcttcaccggttttcatcaaatgaaacaagaacctacagagccttgagaaaactgctaaaaaaaccactaaaaaaaat

SEQ ID NO: 69756 - DNA, 4305 bp, Oryza sativa
gaagccattcttctgggcctaaaaatggcgaaagcattgggggttcggcgcttgctaatccgaaccgactccaagctggtggcaagtcatgtcaacaaatcctttgaggtagaagaagaaggaatgaagaggtatttggaggttgttcgatctatggaaaagtgcttcgccggcataacggtcaaacatttacctagaggccagaacgaggaagcagacgccttggcgaaatctgctgcttgtgggggcccacactctccgggcatcttttttgaagtcctatacgcaccaagtgtgcccgtggagagcctggatgtcatggcaatcgaccaggcagaactgggcgaagatccaggcgactggcgaaccccgttcgtgaaataccttgaaactggctggcttctggaagatgaagcagaagcaaagcgcttgcaactcagagccgcaaagtacaagatggtctcgggccagctatactgctccggggtgcttcaacccttgtttcgctgcatctcctttgccgaaggcgaggaaatggcaaagaaaatacaccaggggctctgtggcgcacaccaggccgcaagaacagttgcctccaaagtgtttcaacaaggtgtatactagcccaccgtgttgaaagtctgtgttgagcaagtcaagaagtgcgaaagctaccagtgccatggccgaagccaaactgcgtcccaatatgagctgcagcccattgcaccaatctggcccttcgctagatgggggttggacatcattgggctgttcccagtggcacgaaatcgctacaagttcgcaattgtggccatcgaatacttctcccgatggattgaggccgaacccctcggagcattcacttcggcagcagtacagaagtttgtatggaaaaacattatttgccgtttcggagtgccaaaagagttcatcactgacaacggcaagcagttcgactctaacaagttcagagaaatgtgcgaagggcttaatctggaaatcaggttcgcgtcggtcgcgcacccacagtcaaatggggcagccgagcgcacaaatggtaagatcctagaagcactaaagaaaaggcttgagggggcagcgaagggcaaatggccggatgaaatgctgtctgttctctgggcccttcggacgacccccacaaggccaaccaagttcagcccattcatgctcctctatggcgatgaggcaatgaccacgacagagctaggggctaattcatcaaaggtgatattctctgggagcgaagaggggcgcgaggtatcgctcgaactcttggagggggtaagagtcaaagcactcgaacacatgcgcaagtatgccacaggcacttcggcaacttacaacaaaaaagttcgaccgatggagctgttgcctggccatcttgtcctaaggaagaaggcgaacccggtagccgttggcaagcctgaatcgaagtgggaaggaccgtacctcatcaaacacatgtctaggacgggatcctttcgactggcgacactcgaaggcgaagagttcgaccattcctagaacactgcatctctcaagcgtttctttgtctagaacgggtggcacccaaatcgccaacttgtaaaaatgtacataccattatgtaagcctttcggcactatgtaagcctttcggcacaaaaatacaaaaaaaaagaggaaaatgaaaaaagaaaaaaaaactggatgtagggctattatccatcccggaggcctgaaccagtataaaatctttgtgtctttcgcctttttatttgtgtaattgattatttgtggaaaaaccctaagacaaacgcctgatcagcgaaaataccggggggggggggggggcgaaacgaatcggccgaagcatcgctcgccgaatgttgaaaccgtaacagcttgtttcgggaaacaactaaccgaacaccattgcactcgatcaaaatgaaagcacgaagtgcttcctccaacgtagaataaaatggatcgaaaatggaagccgaaagctgaaaagtcaaaaacatatttcgctaatatacgcaaaggggtcgacacgttccggcccaacgaaagcacgcgaagtgacaatgcaaaaatagcgaaaaggaaataaaacacatctttattgacttcgaataaaaatatatcggagaatacaaacccaacaacatggtacaagtaaaagaaaaagcaatagctttacagcccagcttatagataaattacatcttcgcccccacaatcactctccctttctaaggaagggtcgggcgaactgggttcgtcgtcactactaatatcatacacgactctaagaggagaagggggcgaaacacagactagactgtaacgacgctgggagatcgcctcctgccgatcaatcttcatttgccctagagatgtccatcgacccccgactttgtctatctccatccgtgtacttttgtttataaccagactgagccacaaactaagccttacccactagacatgtggaagtacggtagtgctttgcaacagaggcccgaagaccggtccttatatggccgaggtgctaccatcaaaaccatgcaccccgtgcccagcctaaaaccattttgagggttttgaatagagggggaggtgtgaatccaattccacaataatccaaccattccatagtgtccaggtgatatgaatattcccaaagtctaaagttgtaaaaccacctaatgttgcctaattaaccagcgaagcatctacctaaattcatactagtggtaccatgagtggagtgcccactagttggggttttgtttattctagggtgaacaaggtaataataataacaatagaaataataataaggtcataacaaaggtaaataggcatggctgaataaaacagtgataacgcgggaatttaaataaagcgataatgcaataatttaaatcaaaataattttataaaatgggattcaatatgttcaaggatgatgtgacttgccttgctcgctttcccaaaggtcggcttcaacctccacgaagagcggatcttccgaagctgcagcgtctacacgaccaacggaaagaaaaaaaaggcttttactctaataaactccatataacaagcaggaacaaagcacaaaaatgggttcttgacttcttaaggaaaaattagagacttgaatggtccaattctgagttcaaatggccaagttatggccatttgaaggttatatgctctttaaatgaatatttgcgaattgattcatttaaatttaaatttaaaaagggtttattgcgtcagccgagggggaggggcgcgcggaccgggtctacgggcgccggccgccgtgggccttcgctgccgcctcctagcccctttaaaaggacccccggtgtcttctctacccgtcgccaccttcgccttcgcctctcgtcgtccgtagcgccctagcgccgtgtagcttcgcgccgccgtcgccgccgtcgctccagccgtgcgccgccgccgttccggtcatcgccgtcgctcgggaagaccgccgtcgtggtcgccaagtcaccgccgtcctcgtccgccccttcgccgtcgccgaagaccgcccgagcaccgtcgccatcgtcaagccgaagagctccgccgtttcaacctcgtcactgtcgccgtccgttggtcttccgccgctcctttcgtcgtcagtgagttcgccgcgtcgcgctctacccgttggtgtcctccgttcgtgccgaagcaccgccgttcgccggtgagcttgcgccgtccgagctgtcgagccgccgagccgccgccgccggtggtgacgtcatcgctgacgtcatcgtccccgtctcccgtgagccggtcgtggaccgatcgatctcggccgtccgttttggatggatcgatctcggccgtccgttcgcgtgaaccgtcgccgtgcgcccggtccaccgtgaaaccctagccgctgacgcaataaatccctttttccttttcaaaaataattcattattgcgtcataattcaattaaaatcaatataagtgttttaatccgattaaatcttcaaaaattcataactaattcatcttagctcggatttagttggttcaagtctctaaatttttataaaattgagatctacatgttaaaaatatccacatgtactgttcatgcttgtttatgtgctgttttggtgattttgctcttttctgtttagattctgtcgtttccgaagagtccgttttcgcagcagaagagtttgaagagttccaaggccagcaaggcaagtcacacagatcccaaacaaccct

SEQ ID NO: 69757 - DNA, 1475 bp, Oryza sativa
ataagccagctgcaaacatatttaaagaagataaataaagagagaagagcagtgggctacagatttgtagccagctgtagcacggactccaagacatagtgtgtgtatgacaggtgggaccaggtattaatattatagtatataactattgtataaatgagttattagattgactatagatgaattagagttagtagttggctatactattaaacttgctctaagagcacccgcaatgttaaagtaaggtgctatctataaaacatgtatctctcagcaatagactagattaatagtaaaccatctcaatagtatgtctacatgggtatctatagctctctaatacattgtctcgtttttctctgtatactatctccaggttagtagatagctttgttctctctcttcatttaatctctttcaagtaggaaaatatgttgatatggatctcttagagcctgtagataactatctctcttcatttaatctctttcaagtaggaaaatatgttgatatggatctcttagagcctatagataactattgtggatgccctaatcagtctccgctcactttcagatttttctgacagctgcacgaacaccttttcacccgtttaccgtgccactgcagaggttgaatgattgcatcacttcttttttttactgtgtgcaagtagctattctccaagacgtacgctagcgatatggtggttagtactcgtagtttaatcctttgatcgagttggcaccacgagtgcagagagtacttaagcgggatctttgcaaactctagtttattgcgcctttttttctccactccccaaaggcacataatcgtatccaccaacttggtactagaactctcgtctttttcatccttcctactagtagtactattttcaattctacgtgcaggccagagcactcgattcgttgatcacgcacgcgcgacaagcctcgacagtcgacaagtgcaccggcacacggtcgtacgatttccagtatgtctctctctgtatcttctcgcatctaggagtagagctataggccgtcgtaggatcgcgtagaacatgggctgctttggcatcaacgtgaccatgaggcccaagagcgctggcacggacgaagttaccagccaccacgtcgttttctctcctctgttcctttgcgcgcgcgtgcgggagcgcgtgcaggctcgtgtaccgtgcggattccgtcgccaagaggtttggtacatgacacgctggggcgtgtgtttggttggcatgttctcaaacccgcattgctgcttgagcgcaagcgccaaagtgtacacgcttgttctgttcgcgtacgctgcaatatccgtctctcggagaggaggcccagatattgtcttctctctcacttctcgattacaaggcccatccaaagatggatggcccaagaaaatattacgccttgccaactgaaaagcccataagagtttcaaaa

SEQ ID NO: 69758 - DNA, 1596 bp, Oryza sativa
atgtgtgtccttttagtatattaaagtaaaatttatttaaggagaaaaataccataaaactcttaattttctgatagagaattaaatgtatatagcacatttacatcgttgtcggcaacagtggcggacacagttttaaaatatagatggggcggagaataaagatgtttactcgataagtaatcgaacacaacacatatcatatttatatatcaatcgtatacttgtctcattattgtttgtggcgtgtatgcgttgtgaagagacagactaatatattggacgttcacaccttgttatacctaattttgatggcctataactattgtaaggggtaggaagggtcttgggggtgtgaggcgacacgggtcatagctgggacggtccacgcaccctacctaataggtagatccgcccctggtcggcaaagtctacaataggaaaatatagcaatgtcgtctttaaggtttttgtccaaccaaagacatactaccacataaccagagagggaaacatgatgagtagtgacacgtgcatgaaagaacctaaagcacacacatgaaaagggtagaaaaggttgacccttttttggacaagatgaatttgtattatagaatttttcacataataaaacatctcaatttatatggctttagtttccccttttataatgttagctagagtagatgatgttaaacctccatagttacatgttaaacctcaatgcagttgatataaacaattttgacttctctgtagtcgatattgctacttgctagtaccgtcagcatggtagaaatgaagacttattacacgtatagcatatttccgtcaacgtagtactccctctgtactcgtaaagtcgttttggacagcgacacagtctccaaaacacaactttgattacttgtttctataaaaatatttattgaaaagtgatatatgtatatttttatgaaaatatttttcaagacaaatctattcatataatttctaaattttcaaacccaacaactcgagagttattcatgatttatattcccaaggtttgactaaaacattgtcctaaacgacttcctttacgagtacggagggagtatttgctaaagaaattataagtctgttgtatttaaagtcaactcaggcataagaaagaagatatgcaaatatgacatttcttttctagatttatgtaattttgacattacgttgtcaatgttccatagcatctttaggtcaactggtatgactacaagaggaataagaatatcattaggcaactaatcccccctcttaaaataagtatttttacatctaaaacttatttcaaaatgaattcattcactactagagaaacgatctttgctgggtcgacccaaaatcacaatagtcccggttccaaaaagaaccgtccctgtttaaaaacccacagctattttataatttttaatcccggttggtaacaccaaccgggactaaaaatcatctttagtcccgattcattccctgtcagtaggatgtcagggggccgaggatctttaatcccggttggtgtcaccaaccgggactaaagatcatctttatagtcccggttgg

SEQ ID NO: 69759 - DNA, 1557 bp, Oryza sativa
acatgcgagtgatggatgatgtactgatgtgttttttagagtgcactccactctactttcggagctactgctcgctgattgggtcttttgtagcttgcagccctggaactctgtttactcgtggaatacggacaccgttggtcttgcttctgggaaaagctgggataatcttgcttggctctttctgcatttggtgctggaagtttgcttcttcagtgggggaaatagcttagcgcactcttgattactagggagattagatctatgtttggtagtagctgagcctcaacgacagttgaagtctcaaccctgaaccgaacagaactactgaagtgcaggggagtatcagagaaggatcggcatttttttgatgtactagtactagaaatatcggaagaactgtatccttcaagactgttgctcctatatattttactatggtccatatactaatttacatttctaagttctatcctcatttttcacgtatatgtttttcaaattataaaatttttctatagaaaagttacttttaaaataatattaatcggttttcaagtttttaaactaatacgcaagtaattatgcgttaattcatcatcaccctgttttctgtgcccaagggaaaattcccaacccctactcccgaacacaccctagattggtgataaattggttgtcgtcaatgccaataattttatctacaaagtgaaatatcgtatttactattcagaggggcacttttttttttcatcaatccaaaacagccctacattccaaactcaataaaacgcaactggaacggatgatgggcttggtgacccactgaaaattgcagagtccgtccaattgacgataggggatgtcgtgggctgtggcctgcctgtgattcttccaaacttaactcggaagccaatatgcgggcgtaaatttcactccgtattccgcctcgacccacctacgaacgtcagcctaagtttatttttggcccctcatttatgtcgctgagactgaaattcgtcctcaaatcgcagtacaacgtgcctctcaactccccaaaccagtggccccgagatggtacggatggttgtttctactgccgtggcgtggcgttgatatggcacttaaagtatataaaaaaacccgtgagactgataccaatgaatgttcggttaaaaaaaaaatggtacgtcctattgcggtttaaggatgaattttagactgacaataaattgtggggcaatagatgagccccatgggcaggcttgtcgaggtcagcttcaaactgtgttggaatatcgaccataagctggaataacgtcagttcacgtaccgtacatctgtatgagcagacgtttgtctactccggaacatacatgcgagcagcagacgccgtccttttcattcctgatcagtttgtttgtttgtttttttttaaaaaaaagaacttgttcattgttgatcaatttgttcgatcagctgttcgaagacaggccgcctcgtctacaagaggaatatcaaacccctgcaaacaattaattccttctccccacgcat

SEQ ID NO: 69760 - DNA, 851 bp, Oryza sativa
atcgacgaatctatacacaactacgtgcgtatagagacactcgtcctacttagtactcctgccgtacgtatttattgtacgtactcccttcagttggattaatttcatgagaaaagcgagagtccgatccgaatatattcatgtgggttgatatataagtttttcatttagcaactgaagacatgcttggaagtttgaaagcgcgcagggagtttcgcagcaaagttcactgcaaatgattagatcctaattcccagacaggaactaatttcaatttgtctgctacaacggatatgtcatgagtatacacggttgaaaaaatatttcaagattattattcgtgtagtacatgcagctagcatatacttatacttttgtgcatgcatggcaggcaaaactttttcttgcccgcaggctaatacagcgaacagtccacttgtaaagctgttgaaaaatccggaccaaacctgcaggggagcactagtgctagtctccgatcagaaattcgccaatagcatgtgatgtatgggcccaagctagctagcgtccatgcaaatagggtttgacacagataactatactacttattcacatctgagtatgcatcaatattaaaacgaccgaactaactaatcccattgaaaaaaaaatgattccacctattgcgtggcgtccctttctaatctttacacagacaggtgcctatgagctgtctaattcgtaaacctctctaaataaaactctagcttcagacacgcagaaatgtaattttaatatatctatatattctcgttctccactgctcattaggacagccagtttgcgagaactctagaaagggctgcaggaat

SEQ ID NO: 69761 - DNA, 21504 bp, Oryza sativa
tcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtgatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccacatagactgaaggccgattcggaggacaccgtcaacacgggcaccgtcaacacattccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgtcaccaccttggattgaagacgatccaccccaaatcctacccactgtatcttcttcttacctgtagtggggataggagggggtctctgttggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaattagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctcatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccatcggggcatgtttcctttatctcgtcgaagttttgccacacaccggaggttctcgatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaaccccgacatgtagttggggtcgaaatcacccaaggtgaatgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtcagtgcgccgctggcccgctttcggcctgacgggccgccggcgaaacgggccgtgccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctagcggcgggcggcgcatcgcaggaggataggttttcttttttttttctttttcggcggcggtggattcttttctttttattttcacttactttcactaaccgctgtttaccgacgtgggaatctagggttgaattttaatataaacagttgcatgaatagatctaagagtcacgagagggaggtgtttgatgaactagtgctttttatattagtatggatgaagtcgaatgaaaaaatgatatataatgtagaattgagagttgggaatatatgaaatggaaaattgagaaaaaaaaatgttaccaaaaatcttggataacaccactaatcgatcatggtaattaacaagtataattaataaaataatgtacttctacttagtaggtagctagagagcatgcatggaaggctataaatatagcttgatttattaaagctttatgtgattgatgagggagctggcagtgtagagacaatttccaagggtttcctgagcggggagatcatcattataagtgtacaggtaacctgtctcgcaatcggacccagccgcgttccctccgacgtagtgtttgtccacccctttgatccacttctgcacattctccagatcctccttgctgcgcttgccatctccggcggcggcaagacggccgaggctgtccagcgcctccttggtgatgttcacgttggtggcatcggtaaagccatcgacgcaggccatcaggttctggtcccccttgccggccccgtcctggaccttgcgcaactcgtcgaggtaggccgagaggttgttgctcaggatggtggcggccacctcggtgaccttcacctggttgcctccgaaggagtcagcgtatgggagcagctcgtcgtagcaaaagctggaggcgtcgcgctcggccggcagggcggtttcgcagcaggagcggacgaacgctgccgcctccgcgaagggcgcctcccctggcgccgccgctggtggcagcaccaccactggcttctcctccttcgctgcggccgcacatggtggggataaaccgccggtgctgacgaccatcaacaccacgaggacggtggccatgctcgagctcgacctgctcatttctgtatattctctctctatctctctgcttgtttcgctactgcaggatgaattacttcataacaacgaggtacaatttatactagtaggctcgattggtcgttaacaaattaaccacaacctttctttctaatttattcaatggctgttctagaatcacggcatgtctttttggtgttgtgatgtagtgccatgcttgcaattataaactactatattaatgcaactaattgtccatatatagacagcctgctcgctttttgtttcatgtccattcacttagccgcctagcattggcgtctatatttttgtcaaatccttgcattttttccttggttaatcattaggtctagaaatataatgatatatagtttaaaatttatttaatataatataagaatatctacaacaatttatttatcttaaccaatcacaactactactcgtttaattttctcacataactactcatctcattcaataataactctttagtcacaaactcattgttaatatccaaaaaaaaaaagctccaaatatatagttagacggagagaattattattttggaagcaactgcaccacaggccagaagccaaattcagctatataactactctctccgtcccataatataaatgattttgccctttaaatttgtcccaaatgtaagacatattttgtgatctcgcgacaatattttatacccaacctattaacttagtgctactttttttcccatctactaattttaccaatttattttccatctatcaattttgtttattccctccgttctatattgtaaaactttctagccctgccaatataatatcaacccaattgatgagagagaaccacataaaataatagttttgtgcttatgtttctctcttcttttggtcttcttctgacgctcctctcagttctcacgcgcccctgctgcgcgtaaggtcataggccacgcacgtgtgccccgctgccccatcctcactgctacaccgctctgccgcgagggctccacggccaacaccccgcaatcacgctactactcctcgcgcgtgtacccccgctgcgtgtgaggtaaaaggccgccactacaccgcggagtcctcatcgtttccgcggcgaccatgttgtcgaccccaccatccacgattccccgccagaaggcctccgcaactgtcatcttgtcgctctggaggagtaggtccctcctgttcatggtgtcgttgaacttctgtcggattagcttggcgaagacgtcgatgatgttgaggccggtgtcaacctcgcttatgtacaagaacaagcggtcgttgtcgaccagtttcgaccatcaatattatccaatatatgaagactacctatgcttgcaatgcataattcccaaataaaataattacttccactatatgctatgctaataacatgtatggaggagaagcactcataaatgaagagaaggaggtggaaatatatcgatcaatcaatcgaaagtctgtcggtgatctgcaattgcatgagaaggcccaaaagtccaatttaacaatcacaaatgggcctagaatgtatgtcacggatttgggggcccacttgaaagtctcctgaagaaagctgggggccagaagagcccataggtggttggccaaccccttgttgagtccaatccagccgcattttggctaagagataagggaggccgaggaggaagcagcaagccagaaaccaggcctgttgggccagtctagggttcggccgaaccctgatctcagccgttggctctcccctttggcttggacgttccggatgaactcctgacggcggttgcggggcatttccgacaattcccatctctacaaccgtcattttgagctataaaaggacctcacctccttcactttcaacacacactcaagcaaggattgaagctccatttctccaaagttagaattagtatagtactagtggaatagaattagagtagttccgagttgcggaagcttcaggaagttcggtaaagttcttagcttttcctttctttttttgtaagacttcctttttattaatataatatttcttctttatacaagttcggtactttattccaatcatagaatatgagtaccattcttagtttatttataatcagtataatcttagtagttaaaccttttgtgatttgcactgatgctggtataatgtctgattaccgggtcataagtctgctctggataggccgagagctatggcccggggactcagatgctctgcatcgattgcaaggctgtagagtaataagtagtaacttaagcatgggtttaggttatcacttatcattatttgggggtatattcgccgggagagtagcaggccgctaatggtgatagctcagtacgagcgtcttccctgcagtttatatttctacatacaatttcctggggttggatacacctctgtatcctacttcagttggagagttattgtcatgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataaaataaacggcgcagacggctccactccacaggcagcttgaccaaggctacacctaatcgtccacaccatcagcctcacggtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtaataattaaacaatattaatccaacgctatacaacataccctgttgtataggcccaaccattctgaacaaccaccccggctgcacagttttaactccaaaccaggaatataccattccaaaccaggagctaatcaaattattaccaattatagcatcttctattatggtgagaagggtgagactaatcacgaaagacattgttagacccgtccataaccgcgggcacggctattcgaatagttttactctgatcagaggtgtaccactgtacccacaagacacaaccccacatcatgttaccatgtgcctcaataccaccacggtacctaggaaaggagttgtgacaataccccttgtataacacaatccattacagcgcacctttcctggatcataatcacccccttataaacaaggcatggactccccagcgacccccgtgggcttatctccgccacttctcagtctggtgctccgcaatgaaccatgctatataaaagataaagccgttgcccacgctggcttgtggctggcacggttaatgtttcacaaccgaaactcgtgaaccagtccttaattgtcatgagcacgaccatcaaaaccatgtgctcacaacccaccattatcaggttttagttggcacattaattaactaatcacgattgaccatcgtgaactatcattaagccatcattaaataatagtgagtcataagttatcccaatagtgtgctaatgtttctaagcagggctaggtaatcacatctaatatctagctgaaccaatatatatagcccaactagtcaagttataataacccaaggtatcaaagaagaaagtaatcaagaacaagagggctataataaagaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttctgctgcgaaaacggactctccggaaacgtcagaatctaaacagaaaagagcaaaatcaccaaaacagcacataaacaagcatgaacagtacatgtggatatttttaacatgtagatctcaattttataaaaatttagagacttgaaccaactaaatccgagctaagatgaattagttatgaatttttgaagatttaatcggattaaaacacttatattgattttaattgaattatgacgcaataatgaattatttttgaaaaggaaaaagggatttattgcgtcagcggctagggtttcacggtggaccgggcgcacggcgacggttcacgcgaacggacggccgagatcgatccatccaaaacggacggtcgagatcgatcggtccacgaccggctcacgggagagggcgacgatgacgtcggcgatgacgtcaccaccggcggcggcggctcggcggctcggacggcgcacgctcgccggcgaacggcggcgctttggcacgaacggagggcaccaacgggtagcggacggcacggtgaactcaccggcgaccaaagcgacggtggaagaggaacggacggcgacggcgactaagaagaagcggcggcgctcttcggcttgacgacgccgacggtgctccggcggtctacagcgatggcaaaggggcggacgaggacggcgacgacttggcgaccacgacgacggtcttcccgagcgacggcgacgtctggaacggcggtggcgcacggctggagcgacggcggcgacggcggcgctagggcacacggcgctagggcgctacggacgacgagaggcgaaggcgaaggtggcggcgggtagagaagagctcgggggtccttttaaaggggctaggaggcaacggcgaaggcccacggcggctggcgacgagatggaaagctcgagctcggagagagaaaagccgatccgattcgaactcgaatccatcgatttccaaacctatttagccgatgtttccaaaggagaaaaggtagaggagatctcgaggatcatttcccctcttttgattcggccggagaaggaaaggagcggccgaatttggaagggaacagcggcggcggcgcgctagggtttcgggcggcggcggcgcgacgaagacgacgaccctgacaggtggggcccacctgtcagcgggagagagagaggagagcggcggctcggactgggccggctgggccgaggagagagagagagcggttttgggccgaatttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaaatttatctggccccattttatattggaatttattaattaaaattagatcttctcttctaggcttttaaaataaattctaaaaattccatttaaacaacaatttatatattttgaattttcagggtgtgacagttatgacaaggttgtcgtaagaaactcggcaacccggggtaactttgcgatgcatcgggagggcatagctgagttctggcttagctatgctgcattgttaaaggggttattgttaacgaccaaatttggtaatctagggatcggatatgaagaagaaatcgagaaggaatcgagaaattgtccctgatggcggtatagcatggggcccttcgactggacctgccgaaaccatgcaaccgatggagggttcaagcccgagatgtcgagtgtgtcggggcgaagcccccatggcgaagactatgaaacaaagatggcgaagggcggagaatcgtgctggtatcccataaggttgaaggcattttgggcgaagactatatggtggagaaggtatggcgaaggcggatgacttcgccatagcaagtccagcctcaaggaggcccaagaggccgtctcagccgatcaagcccgggggccactaggccagcgttcgccagtcggcccattagaggcccatgtatctcaattacactgtatacccatgtaaatgtcccgttcataagggcaaccatgtaaatttccctgtataacctaaaccctagtagtaagaacccgtaatgaggctataaatagtctcatggggccatgtaacagggggatgggaagaaaaattctcattttaatacattttactttctttccaaccactgttgagtaaccacgtctttcaacgtatgcagttgtcgttccgacaatagttggcgtcgaccgtggggacctccgagcgaaaccactaagagcgaatgccaccgaagagggtcgtgaaggagaaggttacaaggcgaaaggaaagcgaagtcggggggggggatggtcgccgaacagggagcagagccttcggcgcttatcgccgaagatagaggagcgccgcctgcctccgcacttgcgccatcacaaccgccttcggctcctgtagcttctgggcaggtgccgaacgcggctgacatggcgaaggagccgcgacggcaagggcacttcagaccagggcggaaatcctctcgacaagccaactgctggtgccccaagccgctccgacgcagccggcagcggctccgactgcgctcgccgccgctcaagtcaatcctgacctcgaaactcaagccgaagccgacatggaggccatgcgaaagaacatgacacggctccaggacatgcttcgacagatgcaagagcagcagcagccgtatgaggcagcaaggcgggccaaggcctcttcgaccccaatcctccagtattcgacaggttacgtcccaccccaagtacatccacaagcgccaatccaactccttccgccacaagtcacgcaagcgccagcatacttcgccgggcagccttcgaccacggctattcatccagccccttacgtgcagctgcaagctcagcacgctgcccaagcacattctcaaccgcttggccaagtatcacaagcaatggcggaaggggcttcggctctgcaggcgcagcttcaagctttccttcagcaattcagccaaccccacaatatttcaagtatagccccttcggcccagccggaggggaatacaagtcaaggtgcgcctagttggttaccgtcgaaccagctgggtccgggggcttcgccttggagtcaaggaccgcagttcgacttcatcaatgctgctctggcaccaaccgcttggccacaagcaccaacaccgggcttgggggcaaaccaagcaccaaaccaggccgccatggcgtggccccaacctacgttcgacctgcccatggcggctcaccaagcatcaacaatcggagtcgggcagccgaatgccatggcccaacctcatgcgcaagccgtgacttcgcccttcgccacgctgtacccatagcaaggtaccgtgaacagggcaaggggcgaaaaggggctaccgctgagcgggggaatcaagatccgtccaatcccaccccagttcaagttcccacccgtcccacgctactcaggcgaaactgatccaaaggaattcctctccatttacgagtccgcgatcgaagcggctcatggcgacaaaaataccaaggcaaaagtaataaatctcgctctagacggcatcgcccgctcttggtactttaatttaccagccaatagtatttactcatgggagcaattgcgcgatgtctttgtccttaactttcgaggcacctacgaagagccgaagacatagcagcatttgctcggcattcgccagaggcccgggagaatcaataagggagtacatgcgtcgcttctcgcaggctcggtgctaagtgcaagacataaccgaggcgtctgtcatcaacgccgcttcagccgggctactcgagggcgaactcacaagaaaaatcgccaacaaagagcagcaaacgcttgaacacctgcttcgcatcattgacgggtacgcaaggggcgaagaggattccaagcaacggcaagcaattcaagctgagtatgataaggcctctgtcgccgctgcccatgcccaagcacaagcttaggtcgccgaaccacctcctctcgctgttcgccagcctcaaccagcgatccaaggacaaccgccaaggcaaggccaagcccccatgacctggaggaagttcagaaccgaccgtgcgggcaagcttgtgatggctgtcgaagaagttcaagccctccgcaaggagttcgacgcccagcaagctggcaaccatcagcagcctgtccgcaagaaggtccgaaaagacctctaccgcgccttccacggacgctcttcgtataccacggagcaatgccaaaacattcggcaacgtggcaacgcgcaagatgcaaggccgcagcagggagcagctatcgaagcacctcgcgaagccgttcaagaacaggcacccccggccgaacaacgccaagatgtgcagcgcagagtaatccaagtgattacacgggccgactcgccgggccagttgtcaaagcggcaaaagaagatgcagctccgaacggtccacaacatcacttcggcgggcgaaggggccccgtagtatctgaaccagctaatctcttttgggccggaagatgctgaaggagtaatgttcccgcatcaaaatcctctggtgatctcagctgagatagctggcttcgaggtccgacgaatcctggtcgatggagagagttcggctgatgtcatcttcgccgaagcatatgccaagatgggattacccaccctagcccttaccccagcaccgacctcgctccgtggtttcggcggagaagcagttcaagttctaggccaaacacaattgctggtagctttcggcgcaggcgaaaacagacaagaagagtaagtattgttcgacgttgtcgatatcccatacaactacaatgccatctttggcagtgcgaccttgaacaagtttgaagccatctcccactataattatctcaagctcaagatgcctggctcgacatgagtgatcgtggtcaaggggctacagcctttggctacttctaagggagatctggccataatcaacagagcagtgcataatgttgaggctgaaccacatgaccgggcgaagcacgcgccaaaacccgcccctcattgcaagataatcaagatacagattgatgacgccgaccccacaaagctcgtatcgctggggggcgacatgggtgaagaagaggttgagaacatcctaaaggtactcaagaaaaacattgatatcttcgcctggggacctgatgaggtgggaggtgtttcgacagatctcatcatgcatcacctggcagtcaaaccggatgccaagccaaggaaacagaagctacgcaagatgtccactgatcgccaagaagcagcaaaagccgaagtccaaaaattgctcaaggctggggtcattcaagagatcgaccatcctgagtggctggcgaatccagtgctggtgcggaaatcaaacggcaaatgacgcatgtgtgtcgatttcacagacctgaacaaggcatgtccgaaggacgatttccccttgccacggatcgaccaactcgtggattcgacagccggctgcgaactcatgagcttcctggatgcatactccggctatcaccagatccacatgaacccggctgacatccccaagacagccttcatcacaccatttggtaccttttgtcacctcaggatgcctttcggcatgaggaatgccggggcaaccttcgccaggctagtgtacaaggtcctttacaagcagttggggcgaaatgtggaagcttatgtcgacgatatcatcgtaaaaagccgcaaggctttcaaccacgcgtccgacctacaggagactttcgacaacttacacacggcgggtatgaaactgaatcctgagaagtgtgtttttggtgttcgcgcgggcaagttgttgggtttccttgtttctgaaagaggcattgaggcgaaccccgagaaaatcgatgccattcagcaaatgaagcttccgtcgagcgtatgtgaagtacaaaagctcgcaggccgaattgcggcactcagtcgattcttctcaaaggtagccgaaagaggtttgcccttcttcaagaccctccagggcacgggaaagtttagctggacacccgaatgccaagcagcgttcgatgagctaaagcaatatttgcaaagcccgcccgctctgatcagcccagcactaggaagcgaactgctactatacctggcagcttcgctagtggcagtcagtgctgccctcgtccaagaaatagagtcaggccagaaaccggtctatttcgtctccaaagcattgcaaggagcgaagacaagatacattgaaatggaaaagcttgcttaactttcaggcccacaaagtcactgtgccatcacagtaccctttggcgaagtactctgaggcaaggaagttactggccggcttagcaagtgggtggcggagctatcccctttcaacttgcattttgttgcccgcactgctgtcaagtctcaagtgctagctgacttcgtggccgaatggacaccggcatttgcccctgagcccgagcccgtcgaacaaccctgggtgatgtatgtcacgcccagaaatttaacccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccactccaacgatgcagacgtgcaaggggatacaaggatggtttgtggctatttgcataacgccggttgtaaaacattttattgagcaaaacagtaaaactgttgagtatttagagtaacattaaatctccactgatcaacgctacactacgttgaacaggcccagccaacccaccagaactacagtgcattgagtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagcgacagaggccgtcgcagggcccgtcccgctccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattgtagttggataattacgaccatgaagcatggccagatgtctcgagcacgcagctcactctgatactaaaaaggtctaatattgtaattatcccatcaactgagctagtggtaaataagcatggctaagcatatagttctggctaagtcacataagtaacatgagctagtcgatttattacccaaggttgacaaaggatagatatcaagtaaacatggcacaagcgagcagataggtaaaaccctgatcccgtgtaattagcaaaacatgcatatttatttgcaaacagtaaaacatttgtaaattaggatcaaaatgctaaaggggaatgtgtgacttgccttgcttcttcactttgatcttccgaactcttttccttgcgaccgcggacttccgaaacgacggaaactacacgctggcacgcaaaatgaggaaaaactctaataaaaaccaaggaaacagtacataaaaactcaacaaacatgtagagctcaattttagatgaattttgcaagttgaatggctcaattcgtagttcgaatgaattagatatgaattttagaagttttgggtcatttaaatgaatttctagaattaaacacgatttattgcgcaattattaaatattttctcaaaggaaatggcattcgctgacgtcagcaaggggcgccgacgccgacaggtgggcccaacacgtcagcgggtcaaggaggtgcgggcttggaccgggtccaccaaatgagcgggccccacgcgtcagcgggcaaaaggatctagcccaccgtggaccgagtccacggtagaggtgtaaggcggaggggtgggttggctcgccgaccaacccgaccagacggcggcgcgcggccggacgtccaccggcggcgacaccggcggcggcgcggcgcggcgcgacggcgacacgcatgcggcggccggcgggcaaagagagaaaaagaaagggaggggaggaggagggagatgctcaccgacgcgggaaggacgacgacgacaacggtgatggcggcgtcggcccgacgagcgagggggcggccggggagcggcgaaaacgagcggaggaggcgaaaagggaggcggcggagctcaccgaggggcatggcggcgaaggaggcggctgatggggctcgagcagagggaggcggtagcactccacggggcgaagacgacggcggtgattcggcggtctccaacgaaggtggaagagcggccggggtaccacgcgatgcagcgaagccgacggtggtagggcgcggcttggcagtggctggagcggcgaggagcggcggccggagctcgtcggtgagtggtggagagagggagcgcggtggggaggtggttccggcgatgaaatgggaaaacggagtggggccgaggtgcggcaaggcacggcgaagccggtggtgcaagcggcgcggcgcggggacgtcgacagtggcggcagcggccggctgaagggtcgccggcgatcggcggcgcttgggctcgtgtggggagagcgggagagagcgcggggagtgcgggaaagttggggaaaagggagaggatggccgggggattgtttttataggggaggggaggcgggatcgagcccgggagaggcggagtcggggcggcaaccgccggtggcgtgggcggcatcgtggggtgtgggtggcggttttggaggggagaggtggggggaaacggcgcggacgtgggcggcgaggtcccacggacgagcgcgcgcgcggggtggagaaggtggtcggaaacggccgcatcgtggggcggctcgggcggccatggcagcaacggcagctgccggcctgaggttggggatgacaggtggggtccacgggtcccatctgtcggagagagagggagggagaggccggctggggaggcaaaacagacttgagggagagagagagagccgagcgggccgagggagaaggccggcccgagagggagagagggggggggggggggaattgggccgaaaggggcccaaagagaggagggaggattttattttttttctttttattttaattggttaaatgatcttcgtgactttaaaactatttctcgagctccgaaaattcacggaaaattccggagagtacattagggcacaaagaatattacaaaatatttccggccaatgatttttaagggaaaattttaattctcccattattttacttgattaaattgatttaacttttatttaatttctagaaaatgtattattaattgatttttattcccgaacgaaaatcggggcgtcacaaatctaccccccttacaggaatctcgtcccgagattctgggatggctagaaagaaagctggcattggcgggcggtctgactgatctacacattgcacttccacattctgcttcgaactgactgattaattgagtgatcaaacctgcacgactgaactgattggattcgacttttctgttcctttgctttgccaagactggattgactggttttttcttaaactgacccagaccaggactgtggatgctcatggaacttacttatcttggactgaagtgttgatgctgacaattcaccatgctggctggaagaggatgaagttgttcctgaaacttgcatctgacatttgtaaatcattgactctacatccgcttgaactggtcttgactcgaatgacaagtaaattccaggaaacctgcttgacctgtctttcgtctgaactgcaactgtcctcgctgttgcttctctaagctgaactgttgacatgcttcacaggtgtaccttagaattgaacctgtcgacctgagattggggtgactctgctaatggttcgcaactgactcctttaattactaaccaatttgctgcactgggttgaacctacaactgaaacgacaacgaggttagccaaaactcatctctgagacctaccccccttacagtgggtagtcatactttcgcctaactggaaacacttgaactgctatccttgaaaaacaaccattacttctcggatttacaaaagaccctgactttggaaactggcacttcatcgatcaatcaaaatggagcaatgacgatgcactttcatccaggtcaagacttggaacttaacccttagttgctgataggaaattccacataaagaaattctcatttagctcgtgatcttactaactcttgactacttccccgaccagttctaactgctggtacaactgtcttggttctgacttgatttttgttgtcatatacctaaacagattgcatagttgaccttccttgaaacaagcactgatcacttaacagatcgaactcaagaggtccttcccatggcatgacatttcacttcttcgaccatcctttgctgactcttcctgggttgacggaccatagatcctgcaaccgttttccggaggctattgcaatctgaacaactatcggaaactggcttcgatgctgccaagagtttctgctctttgatcataacaacttcgctttcatatttttggtggagatgatccgttaaaaggggatactctgccatataccctgcttgactacacatttctggacttgactctatatacttctgatccatgtatggaacaattttttttttcaacttccgagaaacattgaaatgattcctggaacttatactggttgccttgaactaaggaaacacatactgaattcatgctcgcaccattagggtgtaactatcgattacaaccccctaacagcttccaaggttagaaagttctcaagattctttatatgatgtcgtttttcaaatattccattactcttttcatttgagtaccactgacactgcctttagagagatcccatcatgttgagtgttgagtgtccaaccattttcactccgttggttaaccactcctctattggctcgcaaataggttttggagctcaacgaaattgcgatgagttagaagagaaactcttggtttcttgagacactgacagatacaaatttggatttgctttttcatgctcgagatggatcagataagtggaaaactaattgactcatactttattcaatattcccttttcattacataactgccatagacatctatatacagagagaagtgctacaaagttaaacatttgtagactgctgctgattagagctgcccttttcacgactgaacttgaaaagaagaagtcttgtctagaactgctattgcttccattattcaaacctgactgacttgtttcttcagttcctactaatagaagtctcaccgggaacgttgctctacttgttgatcttcgatggtggagtggcaactgtcttgacagctgtaacaggtaggttcttcttgcccgtgggattaccaagcggtgatttgctgatgagcctctggattggagcaatacgaggtgcattgctagaactgacaacagttgggcggcctagtgctgacaacacttgctgcgggtgctgacgaaggaccgtactgcctttttgtagctgtagcgagctgttgttctcctggcattgcctaccctactggtgctggtgctgtaggcttgaaacgatggccggtggaacaatgtgacctttgacggtgcccttgacgataatccgttgaggcggaggttgcacattcaggtgtcgattggtgtcatgggcagtgctggtaacttgggaatcacgacgaactgcctttgctgctcttggaagaggacaatcactgaaacgatgtcctggcttacgacagttgcgacagaatcgacttgctgggtctcggggtgcaggcttctgattatgcactttggcagctgaaactggaacacatagtgattcatgaacatccctggcgacgttgcttcttccaaggttggcttccactggagctgtggttggtgaaagagtagaagggttgagactgttgttgtcgaccaccattggttgacgaatgggttgcacggttgccccttgttctttcttggtcatagctaggaccgcgttcaactgacagtccttaggcacatgatctgttccttcacacaagaaacatgtgaccttcctcaaagggcatgcatctgagtaatgggtgtattcaccacagcgacatgtggggaggcataaactagcagtatgttcgactatcccacatctagcacatgctttgcacttcaactctctttccctgaaactgtcaagggtcgcatcatcattgtcatcattatcatcatcgtggtcgtcattgtcatcagcagaaaaccgttctcctgattcatcatcttcgggtctgggtggaccgtactttatgagatgacgggttagctgacgcgctcctcggaaggtatttcttcctctccgacgcttgggtatccttgctgcgtcttcaggagtaaattctgaaccggtgatgatcatggtcctaccattatccatcttccatatcactgtcctattcgctccagagttgcgctgcaaagtaccatccttcttgtcggtagactgacttggagcttggttactccctgggcactgcttctcgtctttttcaggtgacctggcaaacaccttccatggacagttccttacataatgaccttgctcaccacagtcataacaggtagcacttattttcctttggtccgacggtgagttggctgaagttatcttcggggatctggacatcattttgacaggggtcttaggtgccgatattgggaactcctgactctgattcaggttccgggctggcacctggacttgcatttgtggctggtg

SEQ ID NO: 69762 - DNA, 649 bp, Oryza sativa
ctgcaccccttggccattttgatagcagtttcgtcatacatggtgctcataaatcccacatgtcagtgagaaaaaaaataacgccccaccccccctctttaccctttatctctatttatgattctcgccaaaccggagtcagatcagtgatgcgtagtcgatgaaacttggaaaggagtgtcccgaagagcgtgttcccaagcacaagcggcttgttgagtttctacatcgcgaacaccttgtcgaggatgcggccggcaaggcggttcttggataggtcgatcggcggtggatggtgtccacatagctccccgtgctggacccatcgacctccactgccgctgaggtctctaggaaggtagacagtggccgacatcagcgagctcgtaggggagctggggtaggatcaaccgggagctactctagaaattgtcatcgctgccttgctcctctcctgccgaccactagcctagacatcacgaggtggcatgggatggggaggatgccggccacaatagccatctgtcgcagttcggacgagatgggaaggcaccaacgatgagttccacacgtgacaaggagggccatggcagggagggtgtgacggtgaagctggatctgccttcgggcccttcgcgtgtagattggg

SEQ ID NO: 69763 - DNA, 717 bp, Oryza sativa
gactatgtcactgtactcctctatgactcgtctgctgcctcccttctttattgtcattgagattttaaaatcaaacatgactatcattagggtttatttttttttactttttagaagccgaaacctttaaaattggacaatatagtttttagagtttattgtctcgttgggtttcattttttataattttttgaaatcccgtcaaatattgccactatactcctctactacatgttcgtcgcctactctttattgtcattgggattataaaatcgaacataactatcattggaattcattttttactttttaaaagtcccaccagccatcggccgctctgccattgtactcatgtatgacctgcccactacctctcatttttattgtcattgagattttaaaaatcaaatataattatcattcaggtttattttttttactttctaaaagtcccgcctaccaccttgaccgattgcttcatgatctgcccgtcgtccttccttttaatcgtcattaggattctatttagtgttttattaatattttttagatgtctcatcaaccaccaccactttactactttatatgcatattacttaattaatctccacatgtgttttatatagtgttttctttcaatagtccttattttttttatcaccaattgtagttatttataaattgtattcctagttgaatttttttctactttcagaa

SEQ ID NO: 69764 - DNA, 671 bp, Oryza sativa
cccgatggcaagcccggccttgtcgtcgttgccagcgccaatcatgcatttgtcgccaacgtgcaagtttggagccgccggctgttaaaaaagaacgtgcttggcgtcgccgccggctgctgataacctcgcgttcatcgtcacggctagagtcatcctcatgccaacgacgacggcgtcatgctcgccaacctcgtccgttcgatgacgaaacccttatatttatatatatgacccgccatttactgcttgtttgctgatggcgaagtcctccaactcgtcgccgccaacggcgtcatcatcatatgaatcctcacctcaccgtctagtgatcacgagctcggcatccctaccggtgtctctgtcactccacagcgcctatacactgacggcttctttgtggcaaccatcggctcactcccgagtcaagccgttacgatcggaggtggctcaacatcatttgagtccggccccgattgtcggcgcatatacaagagggccaccccactcctggaacgcatctcatcgtttccaggctaggctacgcccctaacatcccctaaaactactcaatactaagtgtttactgcagtgatcagacgactgaccattgtaccatgacgatggtcggccattgccgtggaaactagaagggcgatgctaccccaact

SEQ ID NO: 69765 - DNA, 695 bp, Oryza sativa
catttaaatgtccaaagtacgtacttggcaacgtcatatttgccaacataaaatttccacatagttcttattaatcttgtattatgattaatcagtgaacggtacccttttcgtccgaaaagcatattccgtcttccacaacaatggttttttcatcaacttcgatttccacgcattcttgcatcacgtccagaaacaggcatcaccatggcgtcacaaattttaggccatgcgtgtgtttgcagtcactataatttaggccctgtttagattccatcttttttctttaaacttctaacttttccgtcacatcgaactttcctacacacacaaacttccagcttttccaccacatcgtttcaacttcttcaaacttttaattttggtgtggaactaaacacaaccctagtcacaaactaataccttctgacctaatttagagtagattatagttatttttttaactcagaatagttgtatatattatatatttgagttttgagattgcaaagcaaagcacgggtacaatactaatgtttgtatagggaaaaaaaatgaaaattcagctcaaacgaattaccaggtctaaactctaaacactgggaataatgcctttctgatgttccagaatcagatgtccaccggtgaaagtatttttcacaacaattccgtcaaatggcttgcttgctagcttg

SEQ ID NO: 69766 - DNA, 1193 bp, Oryza sativa
aaaaggaaaaaaaaatccatgcatgcatacttgtgagttgtgatgattaatacgggagctaattagatccatttctaatgtaccaaatcctgaatcaaatgtacaagtacgaacacctacaaaaaatacagtcacattattaccgtggaaatactcagtagtataaggtactccgtacaaaatactactctacatcaatagtacacgtacagagtatagaagcaaagagtacatccccacatttacacatcgccaccacttcgcttgcagccacacgtacgtacgtacacacaacacacacgtcatcacatcccgtgccgctacccgtgggccccaccacccctgagtcactgacagcgccggggcccaccgcgacgctccacgtcgtcgtcgcgcgcgggcgacacgagggccccccacaccgcgtctctgagtcactgacaggtgtgggccccacgggcgaaacccagagtgaccgacaaactcgaaccgtcgtcgggtgcaccaccggaatctcgccgccaattaatcactgtacttagagcatgcccaacagcttcctttttcaattccctatcctgtgatttagggaattttgatcaagaaacagatccaacagattctctaactaatatcccaatatctctggttcctcagtccgcatatatcgttcctcacaaacagggaagcgattttgttcccaatatttcctcgtcggtctctctcgcgcgcaaagcagtctctcgcgcgcgcaaagggaaaatgttcccgcgcacttctccgcgccctcgctcctcagcggcgaagccttctccgcgccctcgctcctcggcggctacaccttcttcctcggtgggggcaccctcttcctcggcggcggcgtcctcttcatcggcggcagctcccttttcccttttgcaaggcacggggcgtggtgtcccgatgacggccggaggtatgccgtttccgcggtacggcgagttctggcccggcggccatccgtgccctccaccaccgcctggcggccatccgcgccccacaccgccgcccggcggccatgcgcggcccccaccgccgcccggcggccatgcgcgccctccacaacgctactccggttttcaggcatccgaggccatggagaagctgacatctagcgagccattggatcccctttcacacgaagcttctatcgg

SEQ ID NO: 69767 - DNA, 4876 bp, Oryza sativa
gaatccgcgtgcaaaccgcgagacgaatttattaagtctaattaatctgtcattagcaaatatttactgtagcaccacattgtcaaattatagcataattagggttaaaagattcgtctcgcaatttacacacaattttggtaattagttatcttttcgtctatatttaatactctatacatgtttctaaacattcgatgtgagtcacgtgacagggcgtaaaattttgccagggatctgtcaggcctaaaatatcttgaatgattgaaccagttctaaccagaacaagtccgcacgatcacgtggatctagcaattttcgaggcatgtgcgtgtttattaaaaaagaaaagaaaaaactatgcttatataatacgtagtactatgtgagaaggacaatgtcaaaaggtacaatgaattgaacttgattaattaaaccataaacttggaacgatggcatgatggccggagagcttaatttgtcatatgggttatgcgaccccactaatcaccaattaattattcatttcctagtgatcatcattatactttcgtacaaaaaattctccacttcaagtaaggtattccctcagaacaaaatccataaagtaaaaaaggtatgcataataatttatgaaatttatcgatatctctaagaacatttaagccaaaaaggaggaggacaaaaataattaaaaaacaataaattacaaaccgtttgtgcgaacacactaatcaccaattgaaaatcattattcatttcgtaatgatcatcattagactttactatccactccaagtaaggcatttccccggaacaaaataaaatgcataaagttaaaaagaaatttaagtatgcataataattaataaaatctatcaatatctgagaacatttaataagccaagaaggagaagaacataaaataaatgaacaatagaaataaatgacaaaccgtttaggaaaaaaaaccgtgagaaaaaagaatactaaaaaaataattaaaaataccgtgagagtaatttggaggggaagtttccgaccacggttgtcttcttcctcccctctcctctgcccaagaaaaagatagataatcatcactcatcagcatgctccccccacatgccctaacaatccaaaattccattccaatttgcaaaagagagccaaaattaatcatcaaaagccggttcttttgatccccaatccatcctcacatggagcaaaaatctaatatttgcttgtgacctcacctggaaaatcccctcgcaaagaatccacccaagaaaggggagagaaaaaaaagagagcaatcaatcaatcaatcaatccctcccattgcttcacatttcttccttcccttttgcctccataaacctcccctaaagctcctatttttaccccccaaatcgcccaagaatcgccctacccgagagcccttgatccaagatccaatcttttctttcccttttttatttttaatttttttgcgttggtgtgtgttgttcaatccaaatccctataggaggcgagagagagagagagagagagatagagagagagagagagagagagagagagaaaaggttcgaaatttttgatcggaaaatgcagcctgacccgcagccgcatgggcgggggagggagaaggcggcgggggcgggcccgcggctcccgccgccggtgaccgcgccgtcggtggggcggccggcgtcggtgctcccccacaagacggcgaacgtgcgggaccactaccgcatcgggaagaagctggggcaggggcagttcgggaccacgtacctgtgcgtggggaagcccgacggcggcgagtacgcgtgcaagtccatccccaagcggaagctgctgtgccgggaggactacgaggacgtgtggcgcgagatccagatcatgcaccacctctccgagcacccaaacgtcgtccgcatccggggcgcctacgaggacgcgctgttcgtccacatcgtcatggagctctgcgccggcggcgagctcttcgaccgcatcgtcgccaagggccactacaccgagcgcgccgccgcgctgctcatcaggaccatcgtcggggtcgtcgaagggtgccactcgctcggcgtcatgcaccgcgacctcaagccggagaacttcctcttcgccagcaccgccgaggacgccccgctcaaggccaccgatttcgggctctccgtgttctacaagcccggtgagcatcctcggattctgcgcactttgcttgattcggtaatcggcattataatcgtagctcaatgttgttatttggtccaactgatccgacaatggtatgtgggcaaactgctgtcattgcatttagcagagagtgaactcgttagcattttacatatattagatgatggttcattatgctactataaaagcgttcgctgcaatatccataatgtagaatgttggaatttatatggtaggagcaattgcactggattgaaacttcgccaaaactataagcaggagattatagtagttgatggttgaataaattagtaatactatataaatgattagagaggattattcctttggtctgactagtttgattttctaaggtatttctggttgttggcatatttcttttggtaattttcataagctaatttttttagggaaattcattttgatcaccagtagcagttctcactaggatgtgagggtagatgtgggggttatgcagcattgtcttgttgaaattctggtgtgataccatgggggatttgaaaatgatttccagttttaacagtaatggtgcgatgggtgattattcttgtggagtaatctgagttcatagcatataaaatgaaactttaggtgtgtcagttcatatgtgcatgcttcagacataaaatcattctttttgtgctaatctccatgcacttgtctaagcactgtatcagatagtagaggcatttagacaaattctggtataccagaaacatcacattctttgtttttaactttggcaggcttatcattcctgaaaaagtttcctatactatcttttctgaaatgatacacttccagcatagcaatatcaatttcagtagacaatcttgccagtgattacctttttcacaatttggacatgagctatcttgcatacgatggtttttttggcagtaatatatttccttcaagcagattcccaaaaatggttacgctatgctgtacaatatgctgcataaaaggaacaggagcccttacgtgttaccttctaattacttgtttgcatagttgggccagttattctttccgggaatacgcaaaagaattgtgcatctttgtattaagactttaaaagtgccaaagttttacaagactatagccatggaagggtatactcaggaaaataagaaaaacacaccatgccacgtgccaacaccaccaccacactctgaggtagaggcctagcaccttgacggccgccactagcctaaatgatcgtcgccgggcctaaatgcagccacaaccaaaagaacctccaaaacaacgcctccaaggaggttgcgacgttgaataaactgctgattttttagaactttgccttcaattgagtgtggccctatggacaggaatttcctgttatccactccatcagggagtgaattatttagtttatgtagcatttgcttgtgtttattataaataaccaattaaaagttgaaattcacactcaaagtttgttggcaatgaataatgttcctttacatttcttcaggtgacaaattttctgatgttgttgggagcccttattatgtcgcacctgaggtgcttcaaaaaatctatggcccagaagctgacgtctggagtgctggggtaatcctgtacattttgctgtgtggtgtgcccccattttgggcaggtaaaattatctgttgtttctggatattgaattgtgagtatggaatttccggattaccatgtttacataggtaaaattttccttttgcagaaactgaatctggaatcttcaggcaaattcttagaggcaaacttgatttggaatctgatccgtggcctagtatatctgatagtgctaaagatctagtccgtaatatgcttatccgtgatcctacaaagagatttactgctcacgaggttctctgtaagtctttattgccccctccctctccctttctgagggttgatgtgtgcttaagaacctatgtcatgaaagtgtattttactaaaaattgtttgcctacgccaggtcatccatggattgttgatgatgctgtggcacctgataagcctattgattctgctgttttgtcaaggctgaaacacttttctgcaatgaacaagctcaagaagatggctttgagggtatggggatctttcatgtagctgatttgcgtgcaattttatttttcccattgacctattgttcgcactaagtttagtacttcagtagcgctacattagattaatgagcctcacttctattagcatcgccttattattttgatgcattcaagttgactctatattttgtgaccttacattcaagttaactatgcacaaatatatttcctgccttctctggttactcttgtagtttgttaacagtcctcatgttgtagtatgtaatgagaacgaaatatttattaagattagaaagaatttcactcaaaatggaagtgtctaattgaacttatgtcagtcatttgcacatttttaatggagaagattaggacttgcatatccgaactatcgtgtaactgttatgttattaggcttgtctcttcctcatttattagaggtgcagcctgttccattagatattgttcaactggcatcaggggcggagctagcaccaaaactaaggctg

SEQ ID NO: 69768 - DNA, 1460 bp, Oryza sativa
caagtattagagtagtaattaataacttagatgtggtgtctaggttagagattacctttgtttgttgtgtatcccacggatttgtcagaggtagacggcaggtggtgacagccctgaatcccgtcctagtaatcctccacgttcggatatatcatagacctatagccggaaccacgctagcagaccagcaggggtcggtgcctgaagcaacagagaggaaattaccgttaacttagcttagataattaaaacacatagaaagtcctctctagcctagcctgcctaccatcagttgttgtccttggatagtcttaaccttaggtagattacacacgttccttgagttcgatgtccttttggggtcacccgaaggttaagcgctacagcagtattccgtgcgcttgcggatttatctgtggtcgtaagaaataccaacaaacatgctcttgggtttgttgtccttggtcttctcttcaccattgtcttccttcttgcctctcccaagcttaggacaatgcgaatgaatgtgatcaagaccaccacattcaaagcaatgagctggaccatattttttcctgtacctaacattgttcatagcttgagaaatcttattagcagccaaagccaagtcctcgtcctcgaactgttcgagttgctcatcggacatggcatgaatcaaagcaaggacaatagaatttgatgaagaagcacctacatccaaagaagtcgatgaagaaaccaaagcgctagacttagaatcaactttatgagaaagaatattcatctcatgtgttttgagtttgtgtaaagcgaatccaaagtcaaagtagacatatcaacagactcttgaatagatgtgacttttatctcccaaatagacatatcaagaccattcaaaaagtggcgaaaatcctcagattgtgtatagttaatatcctaagcaaaatcaacatatcaaagatcactcaaaatcttattaaatctaccaagataatcatccaaagcttctccaggtttcatctcacattttatgtactcctttttgaaaagatctcgacgaagttctttaatgttggtagttccttgacgaaagtttttcaaagcactccaaatttcattggcagttttaagatgcgaaacacgataaaaatccgtacaaaaaatttcactcaaaagaatattgcgagctttgcaattgttattaaaataagttttcaaagcaatagtgtcaatctgttcaggaatcacatatggctgtgcaacttttttccaaacatcataatcctcagccataatgtatgattgcatcttatcacatcaataagcaaaatccgaaccatcgaaaacatggggcgtagtagtaaacttgttagctatggctaaagctctatatcggttaaaatccaaagaagaaaacaaggctctgataccacttgtagaatcaaatagcaagaactaag

SEQ ID NO: 69769 - DNA, 795 bp, Oryza sativa
tttgattaattaaaagacactaaatatctggttttatagttggggaacgacgttgttactcgataacaagttgagggaccttgcgtgcactttttccccactgaaggtaccggagaaaattcttgtattccaaggcctaacccgtgttagaatcacagcccttttaacaaccggaggatagcccattccgctgttttggtcacctcccgcacagatcatggtggattcaactttcacttcttcactaagtagccggctacgctactgtggcattgctcgcaggctgtgtagggttgttcagtttggtaccactttccaccttagcagtttttcgtattacgaaaacattgtaagctaacaaactaaatattttattgccattgataccttaccaaaatttggtatttctagaaactcatacaaacaatccaagaattggtttgacaacaaattaaacacatccaatgctaccaaaaatttgttaacgtcaaaatatgccaactttttgacgaagctaaattttagtaaggttgattttgacaccaaactaaacaagcccatatagcccgtggggccgcttcgcatgtgggcagctataccatctagctagtcgtgcactcatactgcttccagtcagttagcgtaagggtagcaggcgacgacatcctcgaattgccactactacaaaataggtatcacctctgttggttcatttaaaacctatacttattagctattaacatttaattctcaccttatcaagataaaaaaaataaaactgacatgtttgagcaa

SEQ ID NO: 69770 - DNA, 1108 bp, Oryza sativa
ggctcaaccccatcctcatcggcgccgcaccaagtcgcgccacattgctgtcatcggccaccagacgaggagcaaagtgagagagagagaggaagggagagaagaggggaaagagattgtcctacgtggcatcctgacatgtgggacccacgtgggtcacacgctgactcagccgccacataggacaaatccgacgtcaatactgtcctgggatctcgggtgaccggttttgtatagttaagggaccccgcatatctggttttgcggttcgaggacatttttgtatctttgtgacaagttgagggaccttccgtgtactttttccccagaattagccatttcttaacatcttgggctttactatttgggcttatactattcgagcccactgcacgaagaaaaattagacctccaaaaatcccattgggttgtgactgaagaaaccttttcgtttatcttttatagagagaaactgaagaaacaagctgcagacttgcagagtctctcctccatagcgaggagcaaacacatcatgatttgctgaaaatctttccaacaccgatgtaccttgattcagaagcagtatgatttcttgggttacagcacatgcgcacagatcaattgcatttccgcaccaccatgatctaatcctaacggattagagcgctgctggtttgtagtagcttgttgcgatccattctcgcacaaacctgcactgttgcagccagctgcatgcggactcgtgagcatgcatgctactccagctctcgtagcctcacacgcacctacagtcgcatccaccacctggtgatcggaaaagccaattgtttacatcatttttctactgggccaggtgttcgcttaagcatgcagatgcagctcgtgctttcgtttgaaagaacagaatctctggaaggctggtggtcagccaccaaccggctcctccatcatgatccgcggatcagaggcaggcatggatgcgtccggttaatttttagggaggttcatgtgctaatcttggcttctggatacggcacagagctgcatattcttgtgtagcagaagcagtataaaatgtgtttgggttgcccacatgcatgcacacatg

SEQ ID NO: 69771 - DNA, 9309 bp, Oryza sativa
attgataatacatgtagcgactgttatgctcgttagcttggcatgtgttaagaatgttactttctgaaacatatttgcaatgtcaatggtgaatgagcttttggttttgcacataaatgaagagttatagccttgtaaaatgtagcatgcactagatgaggtaggggcactttagaatgatatgtctatatgcttcttcttcgagtcctagagtattaaaaaagaggaagtgatgaagtactcttagtcaactatgggaatgatgctagacagctagagggtgaagataagaagcacacacaatttccttgactattgaaaaatacaatgttgttgagatatcaccagttcaccccctgtacttctatgttacatcctaaacttaatttagtatgagaatgttattgtgactttgtagatcatgtgaatggtgtgcaaactgcatcttcttttctatagtatcagactctgaaatttgttagagtgcttgtgttggttttgtttgtcaaagggcgttgtctttttctgttcattccatgcacgttttgagtattactccatttctttgattccctctttatgctgcagcttttattgaccaccattttattttactgttaagcattccaagcatgtttaccccttaacatacatattgtgccatctgtgcttttaaacctttcgttgtaatactcatgtttggttatacatgatgtttgaaatagcgtagccatacttgtttctttttatgtgcaatctaatttgtgacatgatgaaatgaatgctacctttctttgtaaattactagctaaattgtgtgttcaactgtctatactcttatgtacaaaacaaattcttgtttgtaacttagtggaccattgtagctatctaatagatcttagtcatgcagctataactgtcttagataataacaaagccaccttgcttccgaatgcatttgtaccgctgcatggtaaattttcaaaatctcactattctttggttatttgtagctatacacggtgtttactttgatggaacttgttacgtaaacttttttcatgtgaacaacctcatatctaaacacttaagcttttttcactgtaattatttacctcggtctttgtgttttctaactcagaagatatttacttcattttctgcagcttctggagtatgttgaagaatccaaactaattgatcttggagaacgtgattatgcttcacgcgtggatttggtagctaaaacccacagtatttacaaagctgaaaagtacattgagaatgttcctgcatctcataggggtgagattgtatacaggactcttttggctaactgtgtggctatagccaatgtgaaaaaagcagaacaagtcttcaataagatgaaggaccttggatttccagttagcgtattttcttgcaatcagcttctgctactctacaagagagtggacaagaagaagcttggtgatgttctcacaatgatggaaaaggagaatgtgaagccttccctcttcacttataagctccttgtagataccaagggtgctgctagagatattgaagatatggaaaaggtcattcaggcaatgcaagcggatggaattgaaccagatcttctgtttcaagccacaattgcaaggcactacatatttggtggttatcgtgagaaatctgaggcaattttggagcaaatggtgggggatgatatcaatgaaaaccgttctgcttgcaaatttgttttacccctgtatgcttttcttggcaaaaatgatgatgttgaaaggatctggaaggtttgtgaggccaatgctcgtctagatgagtgcatgtctgcaatagaggcttttggtaagcttggggatgttgaaaaggctgaggagatatttgacaatatgttcaagacatggaagacactttcgtccaaatactacaatgctatgctgaaggtgtatgccaacaaaaagctttttgacaaggggaaggagctagcaaagcggatgggtgatgatggttgcagactagggccctatacattggattcacttgtgaagctctattcggatgcaggagaggtggagaaagctgattccatattgcataagctatcatataagaacaagattaagcctatgtacaccacatacttgatgctgcttgatagttattccaagaaaggagacgtccataatgcagagaaattgttcagcaaggtgcggcagatgggttatactgggaggattagacagtatcagctgcttcttgaggcatatctgaatgcaaagaccccaccttatggattcaaggagaggatgaaggctgatgacattttccccaatagggctgtggcgtctttgcttgctgctaccgatccattcaacaggaagaacgcaatgtctgaattgctcgattaggttcttctgttagcttcattttgtgcccatctaatacatgtgctggttgtccttctgccaaaatatatatgacatgacgatgagataataaattagccttagcgatgtaatgaactagtagtgtttgcttaccttttgcggctattgccttaccgagcaggcgagtaggattggaatcttatgaatgttaatcttagttctattttgtctacttcattgacgtgtcactatctcttgacttgttaattagcaaacaaatgtcagttttgctagtccttaagctaatgatatattaaggtttctttaggcattcttaaccattttgccctatgaacttattatgtttgtttgcgttgcactgtgctgtactctatcaacatttctttactgatagagaaaatgatactcttgctgcactgtgatctgacatatgttgcaaccttcagtttgtttaatatactggtttatcaagacaacattctttcctgagctggagcgatacgaaattctattttgatttgacttaaaaaaaaaggcatttccatcgttccagatttgcaaagatacaaaattcatctttgacacaggatcaaaactgcttcgatccatgcgaacacttatactgtcactactcaggatacaagcaaggggagattagatatggcgataatgtgtctttggcttaagcattctgaattctgacacaaatcccccaagcaaaaaaccgggctttgatctctctattctctacaggtagctgctgacgacgagcgacctgctcatgtctcggaacacgctctccaccacgccaccacggacagctccgtcgccgtcgtgtcggcgccgcagaacgccgcccagtcgttcaccgccatgccggcggccaccacctcgctgccccggttgatggcgtctgcgggtgaacctgcatcatcatatcattcacaggtttcagagagctgcaaactccagtgccagcctagctaattgggggtagtagtagtgattagtgacgctgatttagttaattactccctccgtttcacaatgtaagtcattgtgaaacggaggaagtagttgtgataagaacttacagaagctccccaccaggatgtttcctgcaatagtttgcctgaaacacttccacaccaagaacatctgagatgacctcttcggttccctgtttgcacgcaatatatatagtttggtcagatggacttatatgctggcattgtttgctaattgctcctatatgctcaactctgtgattttggagtagatttatagatgcatcagctgcctccatggttggtgttttcatcgctattgatggatgaactttttcccacattggccatctctgtcgtcatcaagggaaatactgaaaagctaagtcatcattagtttttttctttatatgataatttccttatcctctgcctcactacatcaatcggttctccattgagcagtgagtcgggggctacagatgttatatcatattttttcaataattttcataatatctatcttgattgcttgtgaaataatccgagtaaaaataaagtgtcgatcgagttatggagttctatcttcctatgctttccgtttggtttgtcgatggatagttgcctttgggccgattcctagcacccggaggctcgttggatggaccgagtaacgcaaggtgctaagaattacttggaagaaatcaacagcatagagataagatgatttgttttatgctcttaacaattgcaaaattacccgagtagtaaattctgatccgtgaaactctgttccattaatgatgaactcaagtcactcatatgcatgtctgggaagtgctttggccaactcccggtgtgtgggggctatgactagtcgggcagagtgtttaaacgtaaggagtcatttgctcggggaaattaaaattgacaagaggagaaatacatatttataaacatcttaaaatacttgaattttcctcaagtactgtatttacatcatatactactcatcctatatgtttgttctgcaggatctagatccagatatgtataatggggattcatgactttaagcttatctcctaagattcaagaatggatcagtcagaacatcaccatcggcttgcctccgccgttgccgactggtgtctttgcctatacggttgtgtaacatcctgaaaattcctaacaataaaaatcactaaaattttgaacttttgaaatataagaacacatgaaatgatcacgactataatgatcgtgtttataaataagtaattcaccggaatatatagattgatacttagaacatttcaccgagttcctcatgacatgaaaatcactcatataaaataatggtcatataaataaattaagctttatatataaataagaatatgttaatgtttaattaaacaattagattaatgttgtaccgagtctcaatttatatttatagaataaataaatccacgtaaaatacattgttatacaaataagtttgttcaatgtgctattgtaataataatggccacattaggatattttaattaattttagaaccctcaaagcctccaaaattatctaggttaattttggaattagacctcatttaaataatgcaatagaaatatatatatatatatatatatatatatatatatatatatatatatatatatatgggtaatattaaaaaatcgagtaaactttcatctaaattaacacatatattgggtaaacatcatttgtgtgaaatctagaatttatgggatgagaattagatgggaaatagactaaaataaggtttaattagaaataacactgttcattgcacattagatgtttgattgtgtccctagccaccctagccctcttcctccccactgccactgcacctagctggcttggagccccgagccgccgtcgccgtcgcgctgagtcccgcgctgcctcgcgccccgctccgtcccatcgccgcgccgcgccaacttcacatcgtcgcgcctcgcgcgtgcgccgtgcgaacgtcgcgtcgccacgccaacgtcgcatcgtcgccgcactgtcgccatcgccacgccgcgccgctgccgcccactgcgtgcgtgtcccgtcgccgctgccgcgccgtgtcgccatcgccgtcgccgcgttttcgccatcgcgccgcgccgtgccgctgccacaccgcctgcctcgagacccgcccgcgccgcgcgcgtcccatccgtcaccgccgcgtcggctacctcttccctccgccctatataaacccctcttggccaccctttcaccccgcaccacttccatcccctttcccctctttttctcccctttccggccgccgtagccaccgccgccaatccgccatgccccggcgcctcgccaccgccgcgccgccgttcccgccgtcggtccgggtaagccctctttcccccttcgccgctcttcgccgcgccacgccgcctcgctcggccgagagagagaagaaaggagcggagtagcgagaggaagaaaagagaaggatgagagagagaagataaggataggaggggtagattagagtgggccccaccgagattagggaatagtaatcaccctgttaatctgcattagactagcctatgacctgtgggcccgggtgattaaaaatctaattatgggtagtttttcatctatagcctatgacatgggggccccaccgggatttaaaggccggattgaccttgagtgccgatcacagaacttgtcgcaatcctagccaatgcagagttcaaagtctgataaagatatcctagcagatatttgcctaagggaaattgttttttgtctacaagggcttcggctatgtgttgccagttggtggtaggaccaccaacttgaccacagaacaaaaatttttccagccacatcaccagaaaagctatgtgttctctgggggacataggacctgtacccatattcatggtgatatagccagtccagccacctatagtcctggttttgaaagagaacttgctcttggtattcatactgactgggttagccgatggtgtgatgtccaaaccagtgatcataactatgtccaaaagggttggtgtcatcggtccttggttgaataagaaagcattgtgttggaccagaaatagcttgcagccgataacataggttcatccttattcattttggctaggatcagagccacgcactatgctattccaagttcttcccaatgagtttgtttgctagccgataccctcttataccaatccggccaggttttgacagcagatggccaagatttgaaagcaatagtccagtggcctaaactagggtttgtcagtctgaagggaactctattgttttcggcattaataagctcagtgggatctgtgttgccgattgggcccaagaaaaactaattctgaagagctaaactaggaactgcgacctgatgggaaagatgctacaacagagaagagaagaaaaaagcggatcatgaaaggaagacaatctgtagcaaggaagaagaaagatctaactgatgggacttacctcagggaactcggtcgttggagcgcttgagggattggtggaagtcgacatcgttagatctagggttgtcgccagacttgggggtcgcctgcgggctcgccgatggtttcaaagggatcgccggagaggttggtgactaaagcagtgaaaacggaaatgacggcgtgaaaagcggtggtaactatttaaagaggcgcggtaacggtcgaaatggaaaagaagccctagattctctcggggataagattgaataaatccgcaacattacaaatgtaacggacttgggggccatgtgttaacgaccaaatttggtaaatcatacattggacttggagttaaagccaaagcggatttggaggaaatcgatattctcagaatcaaagtgcgcatcggttgcaaaccgaatcggctacggtgtacatcggttgataccgagttggacagggaagccgatacagccgatttcggtaaagggatcttagaatcattgtcggatttgttttcagtgcttcatgagaattgccatgtgcggattgagtccgaagaaggcaattttatctattaattaggttattttatgtaatttccttatatatattttcggtaaaagtccgcctaagggacttgatcgtatcttgagttgtaatagatataggagtcgtgtccgacaaggacatgttatgtattttgggtataaatataacccaagacagtgtaatcaaacaagaatcagttcaataacacttacgacgcatcgccaccttttttactttcattgttttcgacgagttcttgctttcgagttgggctgcatcggtttcgatctccgacaagaggtaaagcttgttatgacaggttgcgttctcggaattagtgcttacatcttcatgacactctaattttgtttatgtaaatcgtcaaattatcatatatgctatataatttagatcaattaattacacgttattacaacctcgttttacgtgaaacacttaatcttcatcttcatccttatcttcagcacattcaaacaccaccttagtagagctctaacttctaagtttaactattagagttggatttagggtgtacttgtagagtagtctaaactttactccatctctctaaatttttttttgtaagagtactcaagcccgctccgcttcctttttttaacgctgaggacctcatgttttcgcttatgcttagatttatcagccaaaatttgaattttcaaccttaaatttggagctgattttgggggtttttttttatcgaaatttatttttcagccttgcttttagatcgctaagaacacgtatataaaagttttatttacaaatttcttttcgtccgtaaatatgtgtttggtttatttcacaaataagcgaaacaatggggctctgaaactatttggttgagttttaactcaaaaagagatgaagctcgaagtctaccatcagacccttatcaaggaatacatgtgggcttgcttggtagaacgctcagatctcagtgacccatgctagaggaaattaacataccactgtcaacgggatagaaaaaaaaataaacatgcgggtacaaatgaatagctgattagctcaagattttgcaatcactcttgatggatacaacacaaatgaattaactactataaacttaaaaaattatctaaaacattttttgaaaaaaattaaagtgtttataaaaaacacatcgttggaagctgaaagaagcatatcgccttaatccattcttctattcattcgagaagaacacgcatcatatttgtaatcaatgagatgggtgtagatgcgtagtataacatattcattatcaatacttactttaatactgtattgtgttactagcagaaaataacgctgaatcattcatcaaggtgccttcagatacgtcatgttgtcgtcatgcaagtacaacgatgagctcagctgccatggttgagtttcacctaccatttcccccacatccatcatgcaaataacactactcataactcaatggaggacatcatcattcatctcctcttccattcaaacaagctatatatatatatatatatatatatatatatatatatatatatatatatatatatatatatataatattcatttccatgatggaaatagggaaaaaaggaacaaatagccaagagcattgggagataacaaagataaaataataataataaaaagttagaaaaccattgtcacttatgtaaacctattttatatacgagctaggcttatactacctccgttttttaaaagatgacgccgttgactttttctcacatg

SEQ ID NO: 69772 - DNA, 6510 bp, Oryza sativa
aactttgtttatttcttcttaattattatttgtgctctgaaaattccactaaaatttatttacacattttaggcttttaggaaatatacaaaaatcctctaagccttgtttgacttttactttgcacattttaatttttggaggctttcacacggattttaattgttctaggcataatttaaaggatatattttagggttgttttggcacgtcacaaacctaccccccttaaacggaatctcgaccccgagattcggaagaactggcgaggagatcgggatgggctgccttcagctcgtcttcacgttcccaagtggcttcttcctcggcgtggttgctccattggaccttgcaaaaacggatgacccggttcctggtcctgcgctccatggtgtccaggattttcactggcctctccacgtaggtcaagtcttcgcgaacttcaatttactctgaatcggcctgctcggatggcacacgaagacatttcttgagttgcaacacatggaacacatcatgcacgttgcccaatgaggcgggcagctccaactggtaagctacttctccgcgtcgagcaatgatgcggaaaggacccacgaaccgaggtgcgagcttccctttcgtctgaaacctgtgtacgccccgcaatggcgtgacccgaaggtacacaaaatcgtccactgcgaattctaggttacggcgtcggttgtctgcataacttttctgccgagactgtgccaccttagattatcccaaatggttctgactttagcttcagcttctctcaggatattagtcccgaacatttggctttccccaacttggtcccacaatagcggtgtccggcatttgcgaccatacaacgcttcatagggtgccatttgtaggctggcttggtagctgttattgtaggagaactcggcataggggagactcttatcccaggtcttcctgaaatctagaacacaggcacggagcatatcttctaggatctgatttagacgctcggtctgttcatctgtctgcgggtgatacgcggtgctgaaatttaatcgggtacccaactcttcttggagcttcttccagaagtgagaggtgaattggcttcccctatcagatacaattttcttaggaacgccatggagactcacgatcctagcgaagtagagttcggctagtttgttccctccataggtggtcttcacaggaataaaccgagctaccttggttagtcgatccacgactacccatatagaatcatacccgccttgggtttttggaagtccggtgatgaaatccatcccaatttcatcccatttccattctggtacttgtagaggttggagaagtccggccggtcgttggtgctctgccttgacacgctgacacacatcacaaagggccacgaactctgcaatttcccgcttcatactaacccaccattatttctctttcaagtctaagtacatcttcgtactgccagggtggatggaataaggactttcgtgagcttcctgaagtatcagctatttaagttccttgtcgtccggaacgcatacacgatttccgttccatagggttccatgttcatcttttgtgaaaccagcagctttaccctgtttcatattcttgacgatcccatgcatatctggatcattcttctgagcatcgcggatttgatcgagcaaggtaggcttggcttctagagtagccaagaatccatggctaacgatgcttaggttcagggcttccatctgttgattaagttccggtggaatgccacggacgccaagagtgttgcaacggctttttcgactcaacgcgtctctgaccacgttggccttaatagggtgatagtggattcccacatcataatccttgatgagctctaaccatcttctctgccgaagattcagatccgactgagtgaggatgtatttcaaactcttatgatcagtatatatttcacagcgattcccaatgagatagtgccgccagatctttagagcatgaaccacagcggctaactccaaatcatgggtagggtagttgccttcatggggccgtagctggcgtgaggcataggctaccacatgaccttcctgcatgagcacgcaccccaatccttggcgcgaagcgtcacagtacactaggaagtccttgcgagtatccggtaagattaacactggcgaggaaaccagcttttctttgagagtttggaatgccttctcgcattgcgggctccacacaaatttttcctccttcttcagcaactgtgtcatgggtcgagctattttggagaagttctcgatgaatcttcggtagtatcctgccaaacccaaaaaactgcggacttgagtgactgccttcaccggtagcagcacttctcctggtcgtcaccatctgaaaaccccacaaagaaccagcaaacagagagagatgacaattaaaactagccacccatgactaccacaattcttgaatttattactgctattaaattggttcattaaagttcaagttgcttaggcaaataaaataaagacaggctccgacacagttataccacacaccggcataaccatgccccacacgactccaacaagaagacaaacgagaaagaacacacgcgcaagcctactaactgctcgtctaccgctgcgacgggccaggacggaaggtgagcagcagcgcatcctccgtgctaccaacgccggaggctttcccctcctgaggaaccacgggcgcgggctcggcacgaggggtctccacgaagcaggtccatgccaaggattggcgaacaagctcgggcctggaggtactcttgcaggcggtgatcttctggctgcggcagacgcggcgacgcttggggcgacagacctctccctgggcgatcttgagctgatgcagctgcgcctccactgcgtctaggtccttcttcagctgcagattctcctgacgcagctccaggatcttcatgttgttctcgaccatcccacggcgcaccatctgatggaagtcgatacgagccgcgtcgtacgcctccaccatgcgcgccaggtgcatgatggtagcggtagggcgagtgctgcaactcgtccgggtagagctggtgaagagtgccgatggcgaggagtgcggcgttctggcaagcggcggagaaggaatctccacccgcggtgaccgccaacgaagacctctcgggtgagccagtgaggatcactgcagtaacctcccgagcagcgtggggctctgcatcgtcaccctcctgctccgggagctgcttgccctggtagtccactccatgcggataccccaggacaatgcacatgccccgcagctccaaaacgaagccagtcaggtccagaccacgacggttgatgctgccggccatctacaaacaaaaacaaaaagaaatgcaacattttaaaggtcagattttggcgataaatgaagcagcaggacagagagagactagaggattttcacaaataacaaaggatttttttttatttcgaaaatattgctaaggcttgggatctaaggcttgtcctagggtcaagggggctctgataccaacttgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcagcgaaggcccagcacacacaaagacaaacgggaaacagcggaagactagggcgacgaccacaggcgcttgacggcaggcacgagctagacaccaaagccttcatcttccagaggctcctcttctgggtttgggaaaaaattgagcaagactgagtacaaccaccgtactcaacaagacacacccacaagtgcagaataaaatgcaagggagtacaagggagttacaatataaagggttagggtttgcagtaaacagcattaaaagacacttagttgctcaaagctattttgcaaatacggtcctagagctatacaatattattaatcaaggccgtgaacccacacgaacctgccttaacccaaggcctacgatgatttagaccgaactggcaacccgaccctgggtcccagctcgtcccaagccaacccaggccaaccattccacattttagttgttaagcaggttttaagaattaaaacactaacttgggtacattgctcggcttgcccataaccaagggcgcggctattcgaataggttatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaatccaattccacaataatccaacaattccatagtgtccaggtgatgagaatatcccaaagtctagagttgtaaaatcacctaatgttacctaattaaacagcgaagcatctacctaaaatcatactagtggtaccatgagtagagtgtccactagttggggttttgtttaatctagggtgaacaaggtaataataatagtaacaataataataattattatttgtgctctgaaaattccactaaaatttatttacgcattttaggcttttaggaaatatacaaaaatcctccaagccttatttgacttttaactttgcacattttaattgttggaggctttcacatggattttaattattctaggcatcatttaaaggatatattttagagtcgttttgggacgcgacactttccttgaagcctgcattaaacacttatttcccatggcttgctgagtactcccacactcacccttgctctatataaataacccccccagttgctgaagaagatgaagcggaacctgctgatgaggagttcttccaggagcaagccggctacgatgagttatagggtttcggcctagttcccacgtcgcgcctgtgttgattggtccaagtcctgacttccgtttcccttttgtaatgcagttgtgagctcggggtctgtccgcagcccaacatgactgtacctctactctataataaagagacttctgttgctgtgatattctgtcttcctgtgataccagcactatttcctgggactggtattgattaacaggttaatttggagcgtcacgggctagttccggtcggtactagttcggggcgtgacataactggactttgaaatttccaaatactttggttaaacccttggctagatctatctctgaccataccacctgtgttgtgcaatattggtactgatattccgaaagcaaatattttcagatttgaaaatttttgggttaaccatgagggtttctttgagcttgtagattgaatctggaccaatcatggaaatgaccctaatgcagctagaaatatttctgctaaattgaaagctttaatttgagaaagggtttgagaatttggagtaaaaacctttctaagttgcagaaactaattcaaaactgtaatgctatgattcaattcctggactctattgagaagtatagagatctcactttgttggaatggagatttagagtcttaattaggactaagcttttagcttatttgaaatacaagcagtcttattgacagaaaagatgtacaatagatgggctaaatttggaggtgaaaatacaaagttttttcatgccatggctactgaatctttttaggagaaactttatttcttctttactagattcccagacttcatatgagttgagatagaaacattcattaatggtgtacctaaatcacaaggatgaaatgcatggacatcaagctatatgtatcactttttctctccgagcacatattgatatattcatatataatattttcatgtgattgacatatatgtatgtgaggctaatgttttgtttgagtcttatcgcttgtttagtctatttacgttgaggatgtggagatgatgaaggtatgcatttattttaatatctataaaaattgccaccacccgcccgtgccatgccaccggcgccgccggagaccttccctccgggcacaccgacactggatctgggagggagagggagagggagaggga

SEQ ID NO: 69773 - DNA, 2248 bp, Oryza sativa
ggcaggggcagcgccctcccctctatcggatccagcgggaggggaggaagcggcagcccgatgtccctgcgacgatggcaccctccccttccggcgtcggtgtttttgtgcttgtgatgttcttgtgttgtcgttgttgttgatgaaatatgttcttgtgttcttgtaacagtgttttctctaggatttggccaaatttgattcggactcgcattaagtgtcaaatcgaattggactttctttttttttatgttattttcgcccttttttttgttattacggacgatggaagcaaattgaatcggatttttttttaaaaaattttttttcaccctttttggttattaaggatgatgacacctcttattttttttaagtagtagagattagaaaaaatgcccgtgtgttgtaacgggtgaagtctatttttaatcttattattgttatatggtttagttaagatgaagttcactctggaagtttgcttggatatatatatatatatatatatatatatatatatatatatatatatatatatatatatatagaaaatcatgagctgcagttagcaatctgatcatctcaagttagcatgtaagtttttttaaacatatttcttatatggtttcttctatatcaccaaaagtgaacgatcttaaaaactgactcaaatatggatatgtatttccaaaagcaaacgaacttaaaaaccaatttatacacggatgacgtatcaaaatatcgacaaaaacatctttaatttttataactagtagagattaaatataatcttatcgtattttcaatcggtacttgtatgcagcttgtgtggttatagccatttatctcaaagcttgatatagccggttcaactcttggcacctcaatttatgcttcttttttttttattttttttggtgtgttgcgcgagctgcttggtgacgcctgtcatcacgtcgtcttctagcgcatggctcgacgtttatctcaccatgttgcacgagctgtttggtgatgctttgttttcacgtcatattctagcacaacctgacccggcccatggttatgacgctggcattctggcaatcacatcgtcctcctacgtgacgccatcacacaacttcttgggctccatgacgtcagcgagcggctagaggcaagccaaggtgagcatgcagccgcacttgcaattaaaatgcacacaggagtttatgcgttgttggctggttgtctaggaactcgttggagttgatgcactgttggagacgaaagcattcgagtgtatgcaagggtatagaagtccaaagtaatcattcaaatgccaaaacatcaagaattctcatgcaaaggacccaagcgtcaaacatcaagaaatatagtacctagggagtagatttttttgacagtatggtggtgtttgaaaatcctgaagataaagattaagtgtttcacgcaaaacgagatggtagtagcgtgtgattaattgagttttaattattagaaacttgaaaaatggattaatctggtattttagagcaactttcatatagaaagtttttacgggaaacacactgtttagcagtttgaaatgcgtgtcacgagaatctaaaatttcattcaacaattgttggacattcgaacgcagcctatggcttttcataacacgttgattatttgatcaagctgaaataagaacactcaattacatagtcactttcattttgcggtcaagcacggattggaataagcgccggtttgacatgaagttcttgaaaacacagggcatcgagataaaataaaaatttatatgcttgttattcatacatctggttaggttagagggtcaacctagattttcacgagcataagcagatcctagattgcacatcaagggtgctagccacatcctcgcgcgagagagagagagatcgaggtgctagcgcatagtgtaaccatcaccatgcgcaccttgcatctcagcacaatgaaatgtgtaacctatcttttatccaaaatcaatcatttcatttcgtttaattcgtagcacaccagagataaccatttctcaaattcctctttcttatatcgattaatgtgtatagctgttcttttcaatgcatctttcctttggcacaaatgcagtaagcaagcttatttcgttaaatagtagcttccgcactctttctacttactaaaattaatgtgaatgatcagggccctttagaggttctaatcatggagcaca

SEQ ID NO: 69774 - DNA, 7937 bp, Oryza sativa
  unsure (1)..(7937): unsure at all n locations
catatgcttgtggctaatgtcaggtgttacaaggactggcgtgagtttcttatagagctatacagatgctgctgcggtctgatttgaggtacgaatcaagctctttgcaatagttgaacttaagttttcattatacctgcatgcgagccaaaacatcggaggtgtgtcttgttctgaacctattcttctggaactctatccgtgcagcctcaaccgcctcccgctcttcacttgttccaaaatttgggtcaaattcccatgtttctcttccaacatgactgtttccactctttagccatggtcctccctcggcaatcttgagcttccacatattgtagaaactattctgctacttgtaagtcttacctgttggaacaaaaaaagagtttttaggacaaaccgatatatattatcgttgtagaagtttccaaaaaggatattttatatctagatattgagattatatcatttactgttgtacgttggagtttttccagctgcaagaaagctagtcggtttcacatatatgtgtacgtgcttgtggcagatctgactgaggtgacaatgatttggcacagctagctactttcttacacagcaaatttaggttggtgtatgccctttctgatcatacaaatattaaaactttttacttgacaggttgattcttattcctccttgaaagatctgaaatattgtgtcatgaaactttcgttagtatgagcatttcctttctgaaaccattgttacattttatgcgattcttgtctacaagcaagtagcaaatcttttcgatgtgcaccttaaccttaaaagcagcaatgcatcatcatcatggtcataaacagatgctaaaatgtaggaaaacaaagaggggcattgtacttacacttaagctttaattgccttagtttcaggtgtataaaagcaaccatttatcagaagatgaaagttggccagaccaaattgggtggatcgattgatgagggtgatcgaatggagatgccacggntagattatttatgcccttaggattctgggagntgaggaggaggatgatcacatggaagtgatgaggtggtttcacttgagctgtgcacgcacgggaggagtgaaccgcaagccgtgntgggtgaagcttggcagctgaaagcatgagagaaatggcttntgcgtgcatgatgagcatgagccttgttctggcttcctctgcctcctggtcatgcgagtctgatgcaactgggtgcatgtgtgtgcaagcaaatgcctccttgttcaattggagctctgggagagccagaaccaaccactgaaatctatctcaggaggaggggatcagccaagtgttcatggaatacttggataagtttgttgtggttttcattgacgacatcctggtatactcacaatcagagaaagaccatcagcagcatctccgtctggtgttgggaaagttgcgggaacatcaattgtatgccaagcttagcaagtgtgagttctggttgtccgaagtcaaattcttagggcacgtgatatccgctaaaggagttgctgtggaccctgaaatagtgaccgccgtcactgactggaagcaacccaagacagtcactcaagtccgcagatttttgggtttggcaggatactaccgaagattcatcgagaacttctccaaaatcgctcaacccatgacacagttgctgaagaaggaggaaaaatttgtgtggacaccgcaatgcgagaagacattccaaactctcaaagaaaagctggtttcctcgccagtgttaatcttaccggatactcgcaaggacttcctagtgtactgtgacgcttcgcgccaaggattggggtgcgtgctcacgcaggaaggccacgtggtagcctatgcctcccgccagcttcggcctcatgaaggcaactaccctacccatgatttggagttagccgctgtggttcatgctctaaagatctggcggcactatctcattgagaatcgctgtgaaatatatactgatcataagagtttgaaatacatcttcactcagtcggatctgaatcttcggcagaggagatggttagagctcatcaaggattatgatgtgggaattcactatcaccctggtaaggccaacgtggtcgcagacgctctaagtcgaaagagccattgcaacactcttaacgtccgtggcattccacccgaacttaaccaacagatggaagccctgaatctgagcatagtgggtcgtggattcttggctacgctggaagccaagcccaccttgctcgatcaaatccgcgaggctcagaagaacgacccggacatgcgtggactcctcaaaaatatgaaacagggtaaagccgcgggtttcacagaggatgaacacggagccctatggaacggaaatcgggtatgcgttccggatgtcagagaactcaaacagctgatacttcaggaagctcacgaaagtccttattccatccaccctggcagtacgaagatgtacttagacttgaaggagaaatactggtgggttagtatgaagcgggaaattgcagagttcgtggtcctttgtgatgtgtgccagcgtgtcaaggcagagcaccaacgaccggccggacttctccaacctctccaagtaccagaatggaaatgggatgaaattgggatggacttcatcaccggacttccaaaaacccaaggtggatatgattctatatgggtagttgtggaccggttaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccttatgaagcgttgtatgggcgcaaatgccggacaccgctcttgtgggaccaagttggggaaagtcaagtgttcgggactgatatcctgagagaagctgaagcgaaggtcagaaccattcgggataatttaaaggtggcacagccacggcagaaaagttatgcagataaccgtcgccgtaacctggaattcgcggtggacgattttgtgtaccttcgaatcacgccattgcggggtgtacacaggtttcggacaaaagggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgtctccgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcccgatctcttcgccagttcttccgaatctcggggtcgagattccgtttaaggggggtaggtttgtcgcgtcccaaaacgactctaaaatacatcctcgaaattatgcatataataagtaaaatccatgtgaaagcctccaacaattaaaatgtgctaagttaaaagtcaaataaggcttggaggatttttgtatatttcctaaaagcctaaaatgcgtaaataaattttagtggaattttcagagcacaaatattaattaagaagaaaaaaacaaagttaaaatggttttgtaaaaagaaaaaccctaaaagtcttttccccccctctccccctcttgggccggctcggcctcctccccgcgcgcgtgccgctgacggacgggcccgcccgccaccctcgctgacgggtggggcccacccgtcatccccttcctcccgccgctcctgccgcctcgcccgtgccctagcgccgccgccgccgcgaatcccgccgctcccgtccgccccgcgcgcaatcaagaggggggaaacactccccgtgattccctccctctttccccccacttttctctctctctccctcggatttgttcggaaacgtttccccctaaacctcgccggcgcatcaatggcggccggatcttccgcggccgattccccctcatccggccgctctctccccctcccaaccctatataaacactccccgtgcctccctccaccgtttccgccactcgccgctctctctctccgccggaatcgagctcgcgccgtcgctctctctctccgccgtcaccgccgagctccagtccgccgccgtcgtcgccccggaccttctcccgcttcggcgtcgccttctccgggttcgccgcaacctcgccgacctcgtccacccctctgtttcacccgccgaccgccggaacgccgccgtccccgtcgacccgagccgcgccgccgccttcgtccgctccggtcgccgttcccgtcgtcgctgtcgacccggggtgagccgtggaccgccgtttcgcttcccccttccctcatctctctcgggcgccgctccgccgcgctggtggtcgccggcggcgaccatcggggcgcgggtgcgccacctcccgtcggctgtgccggcgtggccgccttcgggcgcgccccgcggctgccatgtggggcccggtcgtcagccgcccgcgccctcgggtgcggctgacgcgtgggacccacggcgccggccggtgtgagccgggtgcacccggtccaccgtggaccgtgaggctgccgcgtgggccccactcccgtggacccggtccgcgcgctcctcccctcggctaacgcaataaatccgattttaaattaaaatttaaatgaagaaattcgcaaatatccatttaaagagcatataaacttcaaatggccataacttgaccatttgaactcggaattggaccgttcaagtctctaatttctccttaagaagtcaagaacccatttttgtgctttgtttctgcttgttatatggagtttattagagtataagccttttcttttccgttggtcgtgtagatgctgcagcttcggaagatccgctcttcgtggaggttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgtattgttattattaccttgttcaccctagaataaacaaaaccccaactagtggacactctactcatggtatcacttgtatgattttagttagatgcttcgctttttaattaggtaacattaggtggtttttcaactctagactttgggaatattcatatcacctggatactatggaatggtttggttattgtggaattggcttcacaccgctccttctattcaaaatccccaaaatggttttaggctgggctcggggtgcatggttttgatagtagcacctcggccatataaggaccggtcttcgggcctccgttgcatagcactaccgtacttccacatgtctagtgggtaaggcttagtttgtggctcagtctggttataaacaaaagtacacggatggagatggaagaagtcgggggtcgatggacatctccagggcaaatgaaggctacacgagctgcggcccagtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttctgtctgtataccgtggtggtatgtggcacgtggttacacgtgaggaagatgtgtcttgtgggtaaagatgtacacctctgatcagagtataatttattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtgtgggttcacggccttgataaataatattgtttagttctagaatcgtgtttaccaaatagctttgagcaactaaagatctttaaatgctgtttactgcaaccctaaccctttatagtgtaactcctttgtactcccttgcatttattctgcacttgtgggtgtgtcttgttgagtacggtggttgtactcagtcttgctcaatttttcccaaacccagaagaggagcccctagaagatgaaggctttggtgtctagctcgtgcctgccgtcaagcgcctgtggtcgtcgccctagtcttccgctgtttctcgattgtctttgtgtgtgctgggccttcgctgcccatgtaataaattaactatttacgctaccgcttgttaaactctgaattgtatcaacttctggtgtaccttgcctcctgggacaaggaataatacacgcacgtaaggaacgcccgttgggttatttccggtcgtgacagcatctaaatcagatcctagaagatatgctccgtgcctgtgttctagatttcgggaagacctgggataagagtctcccctatgccgagttctcctacaataacagctaccaagccagcctacaaatggcaccctatgaagcgttgtatggccgcaaatgccggacaccgctattgtgggaccaagttggggaaagccaagtgttcgggactgatatcctgagagaagctgaagctaaagtcaaaaccattcgggataatctaaaggtggcacagtctcggcagaaaagttatgcagacaaccgacgccgtaacctagaatttgcagtggatgattttgtgtaccttcgggtcacgccattgcggggcgtacacaggtttcagacgaaagggaagctcgcacctcggtttgtgggtcctttccgtatcgttgctcgacgcggagaagtcgcttaccagttggagctgcccgcatccttgggcaacgtgcatgatgtgttccatgtgtcgcaactcaagaaatgtcttcgagtgccatccgagcaggccgattcagagcaaattgacgttcgcgaagacttgacctatgtagagagaccagtaaaaatcctggacaccatggagcgcaggaccaagaaccgggtaatccgtttttgcaaggtctaatggagcaaccacgctgaggaagaaggtacttgggaacgtgaagacgagctgaaggcagcccatcccgatctcttcgccagttcttccgaatcctggggtcaagattccgtttaaggggggtaggtttgtcacgtcccaaaatgaccctaaaatatatcctttaaattatgcctagaataattaaaatccatgtgaaagcctccaaaaattaaaatgtgcaaagtaaaagtcaaacaaggcttagaggatttttgtatatttcctaaaagcctaaaatgtgtaaataaattttagtggaattttcagagcacaaataataattaagaagaaataaacaaagttaaaatgattttataaaaagaaaaaccttaaaatttcccccctccccctcttgggccggctcggcccatctccccccctct

SEQ ID NO: 69775 - DNA, 604 bp, Oryza sativa
tgatcgatatatatcgttctctttaccctctcctcaaaatcagcataccccttcttagcatcttcatcagattccatgggaaggccaaatctgtggtaaacagtaaatggaaaccgttattaagagtgccaaggtttcagtgcaaacaataagctctttttcaacttctgtttacccatgcaaaaacctcagaagaaattgatgattctattgacagggtgtcaaactgagcaatataatagatgcaagattttgtcctatcctgaacttgaaagggccatgctggaaaaaagaacttttcagcaattaagctgcagtgtcttctattcaatagagatttgcttagatgcggtgaagataagtttgtaaattattcatgaagaggctgcatgcaactcttttctgatattgttggatttagaaactccgtgaactggcaacgtacacaagcatgtggtgctccttggcaatagacacaaatcatgaatgatattacatcagagtatcagactatatcagggacaacaaggaggattagggatcaaggacttaagaacacataacacagcgttactcttaaaactagcaaacaaggtactctcag

SEQ ID NO: 69776 - DNA, 1956 bp, Oryza sativa
caatcccgcttccaaaccgcgaaggcgtaaatcctcaatttcccgtcttcgaagcgatatttccactccactccacgcaatcaccgtccacctgcctcgccgcgcgccacgcgcgggaaccggacgaacacccacctcccaccgcccaccgcccaccgccgcgccggccatggctcccctcctcctcctcctccccccactccgcctcctccccgccaccctcctccgcgccacaagccgcccggcgtcgccaaggcgcggcctctcctactcctaccccaggcgcgtcgccgccgtcctgcgacaatgccgcgccgcggcgccgcctccgcctgctcctccggatgccgtgccccggtggcacgcggcgctcgcggctgcggcggggctgtacccggcgtacgtgacggccggcgccgcggtggccgtggcgcggcccgatgcgttccggtggttcgtcgcgctggcgccggggtcgtacacgttcgccctgggactcatcatgctcgccatgggcctcaccctcgagctccgggagttcttggctctcctccgcgagaggcccctctccgtaagcaccccaccccaccctgcaaattttggcactaaatatttctccatttctaggtgtacaattccatggcaatctttcaaatttcaattgtgtccttgaatccaagatcccaaaattgtgactgatccaaaggaaataaattgtgtgttttggccgctgtagatattgtttggttgtgctgcacagtacaccataatgcctgcctttggagcaattgttagccgggtgctggggctctctccaccaatatcagtgggactaattctgctaggatgctgtcctggaggaactgcttccaatgtggtaagattctcaaacttgctcagagaatatgccccatttgagatggatcctcgactggattattgccgcgaactgtctactttattgtggagataaattaaacattttgagaaataaacttaacaaaataatttagaacaagtggtctaagcaatgtagtagaatttgtttttaaagaaaatgtatttttagaggcgtgaagccaggggcggacccagcccagaggcaaggcccggaccggcctatagtatttgttttcataatattagcccatgggatattgggctttcaaccccaggccccgtgccatggcctagggtgcccggggtcggggtccgcccctgcatatagcaaataatacatggctcgactatgagtctatgacccgttttgtactgaaggggaattaaggatcaacacttcaacagacacatagtagtgtaaatcaagaattcaaatgtgcatattatttgaatgttcgagtgttctagcaatttcacagtgccacagtccaatgttgaattttaaatttccaactaggattaagatcaagtgtgctttatgaaggtatatcgactatttaaacgattgattccaacagttaacatatgttttctgagtgccaagaaacacacaattatctagagcaccaagttatttttggtggttcctttaggttatttctacataagacgttctgttattttactttatcttcttggctttatgaaccctgagctctccaagtatatgctgtgtgagtcaaatatgcatgattaaacaaagggtctctcattcaagataaaatcatgatggttggaggcagagtatcccacataggttgtccatgtatgtggatgatgtagttatgttcttcctagcaatattcggggaagcgtcgggtctaaataccaagttcgcaaaattctcggtgtttctgagctgcctagtgtggaattgcccctgtgctgttcatgattcccatgtaccttgggttgcctctgtatgaaaaggcacacaaatattttgcatgctgaaaaaatcatttgtacctggattttctttgttatgtattgacc

SEQ ID NO: 69777 - DNA, 920 bp, Oryza sativa
aggtaacgtgtacgacttggggccagaattaggaaaaagtacaccgaaggtccctcaacttgtcagcgaaataaaaaacatcctcaaatcacaaaaccagatatgcggggtcccttaactatacaaaaccggtcgcaataggtccctcggctgataccggttttatcctatgtggcgctttgaccacggtcatcggtggctgagtcaccgtgggactcacgtgggcctcacgtgtcagcttgtccaggtcagcctactctctctttcctctcttctctccctttctcctctctctctctatctctctcactcttctctctggggttctgggcaggccagcgtcgccagccaacaggtgggaaggagagcaaggcggcggcgggggaacaaggcggcgacgacgcaggagcaagggaggggcgttggcgccgttgtcgtcgccgagcaccaccaccacctgcagggggcatggacatcgcgtcgaggatgagcagtggtgaaagggggagatggaattcgagaggcgaggggcgcgcgcgcaccgaggtggttcttccgcttcctggtctcgtgacggcgatcccccgccgcgatctcctcgatctccagccggacgctgccatcgccgtctcctgtggcctccgcgacgccgacctctgctctcggcgccgccgctcttccccgaggaggaggagcccaccgacgagaacgcactcgccttctcctgccagatctcccgcttcagtggttgcggcggcgagatcggctcctcctcctcctttccttcctcggcggcggcgagatcggcttcacttcctcatcgacaactctaaggattcaagagcaaatgtaagaagcgtaaagaatgaggaaaaaatttggggataatttgaattcgaggtggcttctctgggctgcag

SEQ ID NO: 69778 - DNA, 1646 bp, Oryza sativa
cctcgagtctcggttcactctgctcgagcagttgagcttgagctagacctctctgattgtgggtgtcgcagcctgatttgcttgccgtctctttggttggcagtaacgcaggtgcttagcacatgggagcacttgtttatatcagcttgattatactatggtttagtggagggtagatcaggcctttgcgtgtgattgtatttgttttcagacggggtcctctccgtagggtttgcaatatcgcacggttacaccacggttattgtgcggtaaccttctttccggttttttaaactttatgattcgtaacctccggttttcgcggtaatcgtgatactattgggtagagataatcctcaccaatatggtagtaaaggaaagtctgcctctccactattatgtggccaccgagaactgatatagaactgaaagaaaaatatgagattatttttaagggcacatttgaaatgcaggattatagaaatatattaacattcatgtacgatagccaatctataggattttgcacagtccatttctttgttttaaatgaccttatacaaatatttcccaagaaatgaaatccttcagattttcttttagggcccctttgaaacgcaggataggaaaaacacaggaataggaaaaacgtaggaattgaagttgtatgtttttccaatcctacagaaattgaaaacacaagaaatggagagaggagccctttgattataccacaggataaactcaacaaaggaaagtttcacaagaggtctaatctcttgcttattttcctatggaattgatcataggaatgcaatcctatggaagttttcttatcctctccctatgaatcaaagggctctataggaataaatccttaggaaaatgaatcctccaaaattcctttgctaatcctccattttaaaggggcccttaaatcctttcaatctcaaggagccctaagatgttggtgtttttgttaccttatttttgttggaaatttagtgaggttcactgatgtatcaatggcctttactaggtttagcacttatatttactttacgccatgctatatattgtacaaagttccagttagcattgttccagttagcatcatgatatacatcatcaaacatatagaaatttcattaaacctcacaaaatcaaaatgaaacttcatgaaacatgatctatatttgttaagtctggtatgtctcgctcatgtttttgtgatatttccctctgattatatgaaataacctagtgcaaaagtaaaacttatttccaaatacactagtataaagtgaaagtatacactagaccccatgcaaagtgaaactagatacactatacccaatgtaaagtgcaatttgatcttaatgtatgttagaagagacacattcgtaggtgtgcgagtaaacagtacatgtgtgtattttgtgcaattgaaaaagaatataaatcattacaacaacagaacagttttgtttatatgtacttatgtttgacatattccttggctgtcaactccacactgagatttatgcaaccttcatggcacaggcaaagtttgcacatgggctggtaggcctatagatgtggggtaaggaagaaagggtgaattgtaagagttagataaaaagaat

SEQ ID NO: 69779 - DNA, 655 bp, Oryza sativa
tggtgtagtatatacttataagtaactattgtatgaatgagctattagattggctataaataaattgaagctagtagttggctatactattaaacttgctctaatagttagtattattatggggaatgtgtaagccacgagcacggagtagcgcttgcatttttgttgtatatctcgaggatcacaatattcttcaacctctgtcagctcttaacatgggattcaggcgcagccccccaccgttcctcgccgtggctaacaaaaccagcaacccattgttcagggggctccagggaacaaactttgcctctgcaggatcaggcattctcgactcaacagtaagcacgtcggcataaacccaaagccactgcacgatttttcgctgaacaccggctgatgacgacgaaacacgtgtgtgcagggtcaatccatcatcccaatgagcaagcaagtgcagcaattcgccgccgtgcaacgcaacatctcagcacgcatcagccagcaagccgctgacaccgtgctgtcgagatccctgttcctgatcagcaccggcggcaacgacatcttcgccttcttctccgcgaacagcacgccgtcgtccgcggagatgcagcggttcgtcaccaatctcgtatcgctctacacaaatcatgtc

SEQ ID NO: 69780 - DNA, 1231 bp, Oryza sativa
cttgtactcgtcgccgtgcccgcgcatgtgcatccgcaggttcgcgtcgcgcttgaaccccttgccgcagatgccgcagaagtgcgtgtgcggcgccaggatctcgtcctcctccagctgcagcacctcgtacttctcctcctccgccgccgccgccggattctccctcgcatcctgctcgtcgccggcagcgccgacgcattcgtccatggcgccgccgttagtccataccttgaagagctcgtcgtagtcggggctacccatctgctcctcctcatcttccctgttcgtctcgttattacgagccgagctggagctctcgccggcggcgaggctgaccgcttgtgcggctccggccgcggcggcgggcggcggggtggtgcggctgaggaacgaggagttcttgagcgacgggaggaggctgccggcggtggagatgagctggacgatgaggcatgtcaggtcggcgttgacaagctgctgctccggcgtcgccgccgacgacgacgaggcgcggcggccggccatggatcggatgacgtccttgacctgccggatcttctcctcgatgaaggtgaggttgtccagcatcgtgtccgggctccagtccatgtgctggatgctaaccgacggcagcagctgctgcggcggcggcggcgccatgccgaggagagcgtcatccgccatgaacgggtagaagagaggattcatggaggtcaggttcgcagcctgatcgcgcatcgtgttcgtcatctggtcgcgatccattgcaagcttctgaataatctcgcgtgatctttattaggaaaagagatggcgcctctgaaatctgcagaggaagaggaatcaagatcgttagccagttcaaagattgttcttgttttttttcccccaagaaactatttgatgttatttttgagttggttgaaaagtcaagaaactgggaactaattagtagtagtaatctactagattatcaagtgatgcaagatttgcaatctgctccatccttttcactgacacagtcagcaatgctaaaatgaagtttaaatcgattttttttcccataaattacttgatcaaggttcttctctgaacgaatatgctacgaattaaaagatactaccagctttgatcattttcagaatcactaatttattactaacacaagacaggagaaaccaacatcctttttttttcctaagaacaaagaaaaaattttgcaactact

SEQ ID NO: 69781 - DNA, 7395 bp, Oryza sativa
aatgaaagatttcatgtgtaaggtaaactaaaacaggataggcactaaacagtacctgatccatcgtgaagcactttccaattaaaggaccaactggaaagtcttcacggaattgatcttttagatctttcaactctctctccctttctgacagtccctcagaatcctaaacatatgttaaaatatatatgacatagcagaataagatggcctggttgaaacaaccagaatatccaagagattcataaaaaaggggaacaactcagcaggagcattcataagatcaaaaggcaccatcagcatgagtagacaagacgagttatatggaaaaaaaaagagagagagagaaattaagcacacatacctcattgttcgtaactggttgtataaatttcatgtgagaggatataggcaaaatgttgagttcgtcatccatgacgacacatgatttgcaagacgctatggatagcaagaacctctcgttgaacctagcagcagcctgggtatgcgactctgtccggaatctttcatggacatcctgttggagcaggaacaactcaacttagtcaagttatctcagcaccgaagctaagatgtagcatgtaaaccaaaattgtcccaagtttattgatagaaatgggatcatgtatgtatgcatgagagaacaagagaagcagaaggtccaacagagaattgagctcaccatgaccattgtataaagactggtgagagaggaaagggagcggagcagcaggatgatcaaaccaccaccctcaaccgtctcgatggtcctcgcgagtaggttgggcgtgagcgcctcaaaatcctgcggcgccaacaaacaccatatcagtacaggggaattacactacaccacaccacagcagcaccaaaaaggagaaaaaccaagctaagcttgatgttagacagacagacctgcaggatgcacatgccgaatgtgttgccaagaaccctctcggagtccttgtagaggcagtaggtgatgtcagacgtctccaagaagagcgagaaggggtcggccttctcggggtccatgagccccctctgcatgagcttcttgatctgcttggcccgcttcttcttgtggctacacaaagcattccatacaggtaactggaacggcattgctcacacatctccaattcaattcaacaatcaatcaatcggtgcagcaaccaatcgagtactcgaatcgaatcttaagctaagcgaatatggtagagtagggatgggtaaggaacctgctgatctcgagcttgtcgcggtagcaccagaggacggaggggcgggacttgacgcgggacttggcgagcatgtagttgaggttgacgatctggtcgcgcgacttgtcgccgacgatgacgaacatggaccgctgccgctcccgcacgccgttctcgatcagcgtccggatgcgctcgtccaccttcttcctcatcctcgccctcctctcctcttccccgccgccgggccggtctcgtgtggtcacaggagatgagagcgcgcgacggatagcgcggggcggacggcggcggaggcgggctagaggaaggaaggcgccggcggagggtggtgcggcgaggcgcggaggcgcgtacgaggtacgagtgatggagaggaggaggtccggaagcgtggggatttagggtttaagacatagatgggcctttcatgggctcaaacttgaatctacggagataggagatgctgataactttttctataaatttagggtaaatttaattaaatctttattaggactttgactagtaaatttaattaaatctaaatttggctgtgctcttctccctcctttcccaactaacctccctctttttaccgtctgcacgctgctaaacgttgtattttttgcaaaagaatttctgtagaaaaattgttttacaaaatcatattaatccattttttaaaaaaaaattaatacttaattaattatgtttcatgagtcgtacgtgcgcgtggatgagttcctaacttatggtgccgaactcatgatgaaacggagggagtaataatctaatgcataccgacactgaaaaggagccctaatcgaactcatacaattcttaaccagaacaaacaaactccaataccacaacacagtccatcttgccttgcatgaacgaatttagctgtgcagactaaagttctctgcactctggaactctactgtagtagcatctacacaaaataagcgcagagcttactctattgtagcctctccatagaattggttaggcattaagcagcatacacattttctagttaatgctgattctgtattatcacatttcttcaagacatcagtatgacagatggtcataaagaccgtataatattagcgatataatgtgcattcataccttttttttttcctacaaacatgaatccctaactactgtatacatctctcaactctggagacaaaaagaaattcaaaaaacgcaaaagaaacaaagtgtgttatgacaacaatatcaaactattttcttctgatatccgagcacttcatcttcattgacataccaactaggtacatgtcctgcatttgagttcaagtcatttgattatcgtcaaaagtatagccacaaaaatatcacctcgtagtacgaaagttttatcagactatgttaacaacaaagtgaacattagtatgcaagtcaggatactaaccagtctatcacaattcacaatgcatctgcatttctaccacctctcttactaactagttcacaaagtcggcaaggcagtgtgtcaaggctcatttcacgcgaccttccaaagttacccagggtaccacacctcctccatgcatggtattctgcataggctacgggatcatttgcaacagctttcacatatgatgccaactcacggagtgagctgaattttgaggcatctataatagaattgggaggaatgaagtcccagacattgggtgccccgaagtatattggcactgacccagcctccaaggcatagaacaatttctcggtcacatagctttctgtcttagtattctcaattgcaagaacaaacttgtaatgtgacattgcgcagtgaagatgatcccaccagtgtggttttccattatcattggttgaacaaactggatacatggataatgccatgtcaggaccatcaacattattcaagcatttcccgaaagagtggtgcggaaccaatgacaggaaatcttttgcaaccttgtctctatgaggaagacaccttgaagatgaccagtaaataagtgcatcctgacaccatacaggagatcagacattgagatgattaaataaactttttttaaaaaaaaaaaagtactactacagcagaactgattgtgtctcagagtgtgcaaaaataacaaagcaatagacatccacaatttcatatttacaaaaagcattcaggtataccggtaagtaacaggagcaccttagcccccgctgagttatgttgttaacttgttttgaacactacacacaatcggatcttgttggcagttgaaaattgtatgaagtttaaaataaaaatatgagaaaaaatgaaatacagaaaaaaaaaagtatcgaagggaacagctcgacctaaatgtgtgaggttgtgcagctgtggtgcactggtgcctgctaaagtcttaatattatacttctacagtcaactacgcacacttaatcctatcatgctatgatgagcagtgagctagcagagtcaggaacaatgatgtcatgcgccatgtttacataatatattattggcaatacgcaatgaatggaaagttaagcatcatgttgggcttacatttctcttttcagttgatacatggtaacttcggctagtgtggaatgattttccagcatatgttacttgcacatcatctttagcatggtaacctataaaaatgtcctcgaaaccagttggtttcctagcagcctccagatccagatatacacgaagaggcaggcctttcattctctgcaaaacatgttcaagaatatgttaaacttggaaatcagaaagatgttaacatttactttgtttaaaacagcatccttacataagtaatgaaatacagtatcctcaggaaaaagagaactaaactactaacggaaatggtatgtaatggttagtaaaaaaaccaattgtatttgattccatgattaagttttgtcagaattgtaagcctgtaactcatgccactcaatactggcactatatatgtgaatccacaaatattttcgtggagactcttcatgctgttttcgacaagatgaaactaacaatcattgggtttttttattgtatggtggctatatgtgcctaggcagttgttggcacttccatttgggccaggcaggtcaacggctagagtcttttaggaaatatatgtggtgcattagacatcatttgccatatggctacaaggttcattagcacgacatacaaccatttgctgggtaataaggaagcatcaaaactgagcatgtcttcggaataagatgatctgatctcctgctgaggacattgtgctttttcattcctggaattttggacaggccttcagggagcgaatgtcaaagaagtgatgaaggcaggggctgcaacacagccaacactacaggatgaaccacttcggtggcatgaggctcctaaacaccaagcccaaaacgaaaacagagaggaataccatgctgttgcttctgactttatgagagaagggaacatcaaccaaatgttgctgatttcacgtaacctggataccatacaagattactccgttcatcatgtgtttgagggataactctgggagaatgaacagcaatatgtccatatttcaatagttagcaacgcaatccaagagtacgcaatatttacaaactaagggtgcttgtggatcagtgagacgcattgcctagccagcaaaaaataactgcctgcggctatagcccacgcaacaagcgacctgtttcaagtctagctgaggatgtatgaccctctgaaaactaccaagttattacttggcaatgccactaagatacaaaagcagaaaagggggcaagcaatctataggaattaaaaaaaactggcacaattaagtaaggttgtttctctaactgatagtacttccagatatgcattaacactcgaagaattttattaaggccttgttcggtttggaggggattgaagaggattggaggggattgagggggaataatttcacaccacagtaggtgtggaataaatcctctccaatccctctctcatggggattaaccgaacatgacctaaggaacttgttagtccagctgaactatcatcacactcgagcattgcccttttacacctataacactgaaagtgaaaaattgcattcgcgaattcttcaattccgccacacaacccttaccagataaagaagtgtatgaatttgtccataattaacaggaaagtatggaattcacaggaattgaccagcgaagtgagaatcccagtggctacctgcggcggcggcgtggcgccctcgaagagcagcgcgtcgggccggtcgacggcggcggcggacttgctccacacgcagctcaccccgcaccggcacgtgtacaccccgtcgagcgcgtcggggatccacgtccaccccttgacgagcaccccgacgtggcgcgtcctcacgccctcgcacctcccgccgccgccgccgccccacccggccccgccggtgatcgacgcggccgccgccgcggtcgagttggcgccgtacccgggcgcccccacggcgtcgagcttggcgcggatgcgcgggcacccgacggcggcgtcccagtcggcgaaggccgagagaagcgacgtgaacggcgaccgctcgcgggtgccgacggcgtccagcgccgtggcgaagagcggcggcgccggcgcggcggagtaggaggagatggacgggagctcgaagtagccggagacgaggaggaggaggatgacggcggaggccagcatcggggccatgtagttgatccgcttcgggaagagcatcgaggtggcgcgcccctcctcctcctccggaagcttctggaagcttcgcctcctcgccggagcgcgagatctcggtctcggaggagggggaggcgataggtaggaggattcaggattaggtggagtggaattaaaagtttttcgaggggctcttttggaaaagatgtcagttcgcgtatcggaggtttatttcagctacggtgttttttgcgattaggtccttggaagtttgagattttacagtggaaagggtgggaggttgtcgccggcggctgccggtcgtttaccaggtgagaattacgatggtgttgactttgaccatagatgggctgggccctgcattgaaaggccaggcggcccaggcccaacgccaaaatgtaggagtattattttttagatttttcataaacctccatccatttcaaggttgacctcacttgacaacttctaacttgtagccaatgtttggaaatgggtttgggatatgatttcccactcccaaagagtaagtttcaattttagccatccattcatctcaccccatttcatcctatccctctattcatttttatttctcaatcccacctctcataagtcataacccattttccaaacacacatgtagagagagttgtacgaatttatgcctctcccttcccaattcctctaccaaaatccttttatactatttttccccgtagtttgcagaaaatcatcaaatgcagaaatgtttgcaacatcatctgcataactatcttaataaagaagtgcatataagatggtacaagatgggaagaacaacttcttccactttagataacacaatgctattacaccatgaaatacatacgtcatatatatatatatatatatatatatatgatcatatgcaactcgctacgcatcatgtgcaccttcacttgtcaccattctcctcctgatgatcacccgcgaattgctcggatggcagcagcatcgcgagcgaagcatccaactgcccgaatccgaaatccatggcgccgaagcttcccgcggagaagaactcatccccaccaccggagccggacccgacgccggcgatccctttgacgtcaagaaactcattgccgccgccgccgccccacgtgaactccggctcctcctgcttgtggcggcggcgacccgacgtcggcggcggcgggggaggggggagagcgggggcgtggccctggaagagggcgacgtgggcgaagagcttgtccttgcgggagaagctggtgccgcaggagcagagccagcggtcgcggccgcagtgcttctcgtgggtcttgaggtcggccatga

SEQ ID NO: 69782 - DNA, 3736 bp, Oryza sativa
agttgagggacggaatcgcaaaaaatacatctcgtgtgtgggacccggagaaagcggttggtggagaagtccagccgagctcccccaaaacgaggagagagagagagaggagaagagaaaacgaggagagagaagagaagagaagagaagagagaagcgcacgcacgcgcgcgcggagaggagaggaggagaagcgcgcgcccgccgccgccgccgccgccgccgacgggaatctcgccggggccgtcgttccgccccgatctcggtccgtctctccatctttaccttccgtcctcgtgtgatgtatgtgcttcggtttcgccggcgctttgcattgctcgaacgagggagaatccgtaatttatttatttatttattttttttgggttgggggagcggcggcgcctctcattgaatctcgcgccttttgttcttgggagcacgcggaatttgtgctattatgaatatatgcctttttttaaagaaaaaatgattttgattctctttgatagatagtataggtttggtggttggttcgcgggcggatgggacggcgtttgatgtctcaattgtttgcggggattccgatggggggagggatttgaaacatgtctcccaaaatttgtgcttgttttgtttgtttggattgccagttcactcttttagaatctgtttcgttgttaagttggttgctcatagttgactggtgtgcaaaaaaaaaaaaagttgagctttggcgtgagcaatcggaaccgatttcttctctcgttttgttaattttttttactagtaactagtacttgtctaaactatgctatggcatgaagaacgaaagataaattcgtttgtcaaggctagtgttgccacctttggaatggtggatcatggttccgtttgtcgtcagatttcctttatttggcttaaaataatacatgttccagtggctatcctgtttgatttgtgatgcctggtgatatagaaggaacatttcgcatcgtgctttgtattgtatattgaagttgttgttatgagatgacctgatggggaaaggtagaacacggttcatgcaatcagcgtgcattgtttggctagcattggctgtcgttatgtggcttcctgcaaacgcaacatgagtctgttgtgtattcctaacatatttttcttctcgcgctgtagcttgatgaaatatctggtggttaggatttgtccagcttgacttggtagctaaccacattagtaaatgttagctatttcttgtgcttatgcgtctaatatctgtcaaacctttcgcaataaattatttttaaaaaaggcactttccttctatccaatcactttcttttgtttataaaataataaagaaattaggatgaatcttcattggttggacaacgacacgatttccatctctgtgtataccactatcctttcgtgtcacaattctgtcaactgtgggatctcattttggttgtttattctctgttttttcagatatagtaccaagataatacacctgcttgtcaaatgatgatgggtttgctagcgtttgagagcaaccaagggctctggaatagtggatattattcccagctgtttgggattggaggagttatggtcactgttgccattctttggttatcgacaggctactttggaggaattggtgctccttttgccccatatttttggccatatctagcacaacttccaaagaagaaggaacggaaaaggcctgtgagagtgtacatggatggatgctttgacctcatgcattatggccatgcaaatgcattacggcaggccaagttgttgggagatcaacttgtagtgggagttgttagtgatgaggagattgtggcgaacaagggtccacctgtgctttcaatggaagagaggtactgcagaaaatagttcttgttttgtgcaatacgctatcaatttctccttaaaattatgctgttgacgttagcaataggattgcaaaattgactgggaaagcttgtagaatcaccatcttatcatttgatatccaaaacatttaaaagctagagttctagacctcttggaattggcaatcatggaattacacaatcttcaattgtacattaactctaaaatgtaggtttccttggctctttgctagtattgtgaggcatgctataaaatattctgaattcattttgctgaagtactctactatgttattgatgatcttgcatgcccttaaaccttcagcttctattttttaagggatcaacttaagatattgtcctctcaagagattataaactgcctagtcctaggttattttaatattttaatattaacacaatattctggttccccattgacttgctatttctgtataggttgacacttgttagtggattgaagtgggtggatgaggtcattcccaacgcgccctatgagatcacggaagaatttatgaataccctcttcaataaatataacattgattacattatacatggagatgatccttgtcttctacctgatggaacggatgcttatgcgttggcaaagaaggttggacgctacaagcaaatcaaacgcactgaaggtgtctcaagcactgatatagtcggtaagatgaccacatggttcagtatcggcactattcttttggggattgtattctcttggtggccatcaatgtcatatattcccagtctattgtaatcttaatgtgggaactgtgttctttttccacccagggaggatactactgacattcaagcagaaagaagctggcagtatggaagctaccacagatgcaaatgttgctgtcaatcagaacactggagctgatacatatgataaagtgaaaagtcagctatccaattttcttccaacatctcgccggataatgcagttttcaaatggacaggtatgaaattttaaggaactctgttttactcacttgtgttggggctaaggttactcaacattcttatggttccatgtgagtgttctttatttagcacggttatggataaaaaactaactcagctattctgactgatcacgcacattaatgataatacacccatttgtattgtttcaatcttggtcatgaatgataatgttgacagtataaagttgatatttttttttttacatatttctatgacatgtcactctattgcttttattgaacaatagctcatatgcactcaggctcctttgccaggtgctcgcgttgtgtatatagatggtgcttttgacctttttcatgccggccatgttgaggtaatttttatggttcattttatcatataccaataattttaccataattctcccagtggttcacacatgttccagagtcaagtatatattgtttttgtttaatgcagatcctcagaagtgctaggcaacttggtgacttccttcttgttggtgtccatgatgaccaggcaatcaggtacttatttggtatcagaaactagttaatcataagcgaacgtaaaatacatttgagaccaattcatgttatgtgatttctcttttgaaagttcatataagatgcttatgcaaattaaatgtccagggatagaagagggtatcgtcctatcatgcacctccacgagcgtactcttagtgtacttgcatgtcgctatgttgatgaagttataataggcgccccatgggaggtttcaagggatatggtatgttcacacatgtttagctatgtttgcatgaataggtttaaaga

SEQ ID NO: 69783 - DNA, 723 bp, Oryza sativa
gagcgcgaactggcgtgggcggcgtggccagttcgacgatcgccggagcagtttgggggtttgggggcggcggcgcggcggcgttcgtcgcgcgtcggcggtgtcgtgggccagccgaaacgcgaggagagtagatgcgctgacgtggcgtcgatagctttcacggctccagctggaaagttcgggagtaacacggcgtgtttagcgagaaaatctcttgattttctttttaaagaccaagaagaaaaccattgggaactcgttgagcatacatcaattgcttcacgcgaacgagaatcacgccttccaccgcgcgagcgatattcaactgtggcatatatttaggatgtagtgatgtagtactaccgaattaattgcttagttaagggtcatttgcgaatatgatgttgcgaaaaatatactaaaacataatgagccgtttaatgcgttttcagggaacttttattatctcctttgaaacatgaaacgcatgataaaaaaacagagaaatagaaaataaaattgtaagtgtaaaatatagaactataaataaaatataggaaaaatttaggaataattgcttgattagacagcaagaaaacatatatgaattagaggagatcaaaggaaactttccttggggttcaatctcatatttaaaattcctccaaaatatatacagatagaggcatttcttagaaatattgtaggattcaatagggg

SEQ ID NO: 69784 - DNA, 17720 bp, Oryza sativa
caagctctttatgggcggccaaaattgcaattagccccttgccgccagggcctaatcgcaattttggccgacggcggcagacggcgcggtcgacccaccgtctgccacgttagcttgccgcccaccattagggcggcaggggctatttctgcaatttttttttggtcgatagattatttctgtaaatattaaaaaaaaatctaaaaacgaaaaaaattcggtcgcccacattctccggctcgagacgacgcaatcggcggccagcgtcggcggcgcgcaccgccggccggtgcgccggcaggccgtcttctcctcctcctcctcctcctgcactaacgcctgcagcttacttgcaagccgccccagaagcagtcaggtacgggccgccgcctagtcgtagctgcggtttggtcaccaagctctctggctcctttgctgtcttggtgttcttgattaatttcgtaagtggtagtagctcgttggttggtgtcgttgtgaaatgttgttagcgagggacgtcaggtgcggattgatgtacaatggtctcactgctaaaaatcaatggcaagagagaacaatgatctccttgacctagggattgttgatttcgatccgtggataaactatatattattaaattaagtctgtattccgtgatgcgatttgtggagtctatgaattcttccaggtctatctatttggcggtgtatatatttttttgttcttggaagttggccatgatgtattttcagaatatgttatccgaactgtcgtttcctttccttttctgcccatcttttcagatctatgtgaccatcaagttcattgtagtataatgcactgattgtgccgacattgttaaaggaatggtcatgctatataaggacatgaatcatcttcagatctgcttatggataaattctaaactatttagttgggcgataaattctaaactactgttctgtattgcagggcaatgctgttctcagaagaactgcagttacagtaaatttgtctgtgtactcaggcacgtacataaaactggagctaaccttctccacttcgtatgtactaactcgcttctagttcttaaaatgcctacctatttttccttgctcatattctgcataataatataccaaggataaaggatgcatgttctgcatacatggtctgtgctgctgtgccaaggctaaaactagaccttataagatcgcatagtgggatttcctacaggaactcagggagaactcctgtaattgttgactgagtttcctgcagtcacaaaaagaactaaaaactagaatattgttgaaaatgtcttattacataggccatggattgtttccttaggaatgtccaagttgttgccaccagttcttttcaatcttttgctttgcttgctgtgcaaaatttagtgctgttgtatgtaaacattctctccaactatgagcaaatagtaacgtctttcttctacctaatattagatccaaagaaatattcagttcatctctttctttgcttctggttatgtacttccctttttgacttttatttttcgagggtagtcatttatgtcgcacttattttagggggaaatgtgattctttgactagcataaatgcagaaattctattggctagcatcattttttcttttagttttacaacttgatgatgaactagcttccatttattttcagttattcacatatctcgtgctaagctgctcctattatgtggctagggatggagttttttttacttataaactaatattttataagttatcatgaatcaaccttgctgctctggtgacaacaacgagagtttgttaaaagaatcctatactgtttctttatgccccattctctcctttgctcatttgtctgtcgtatgacttttgagtaagtaatatattccaatgggctacctacgccttctgttgagttctaaagaaaaatactaaatttgttaaatcataatcccttatatatcatgcagattgcagaaggaacaactctgtattacctctatatatgtataaaaatccacaagctgatcatccaacctgcatactgcataacaacacaccatgtcaatggattcatccatgcttctagctctgctgcttgccttgttcatacccatcctcctccaccttgtcactaggcgcaagtatgcatcctataatctcccttcaggttcccttggctttccattgattggacagactatctccctactccgtgccctccgcaaaaacactgattaccagtggtaccaagacaggatcaagaagtatggtcctgtgtccaagatgtcagtgtttggttcaccgacagtgctgttgactggcccggcagccaatcgctttgcattttgcaacccagacctcattttcacccagacaaaggcgctgaacgccctcgttggcggtccattctgatgctctcaggtgaggagctaaagcaagtccgcagtgcagtccagggctatctgaggccagagatggtgacaaagtacatttggaagatggataaggaagtcaggaggcacattgacctgcactgggttggtcaaaagactctcacggtatgaactttgtgttttttttttcatttttccgcttaatgttttcagcattgctagatccttatgtataactcaaaacaacttttcatgatatggaaatgtatatgtgtgattctttcatgattataggttgcaccattggcgaagaggctcacctttaacatcacctgctcagtcttctttggagaagaggcaggtcctatcagagaagccctggcaaccgacttcgaggcattggtgaaggctacactatcaattccagtaaatattcccttcaccaagttcaacaagggtttgagtgcgagttggaggatcaggaagttgctcagtcggattgctcgtgagagggaagcagcgttgcagcaaggccgttgcagttcaactgatgatttcttcacatacatgattgcattacgctccgaaggcacacacttacagtggaggacattgtggacaatgcaatcttactccttactgcaggttatgagacaacttctgttcttatcatcttcttgctccggtacctagccaatgagccagacatcctgggcaatataactgagggtgagcagctagtacttttgatttttcaatcttcttagtatcactgctatcattggtacttatggagttatggtgaatccgcagaacaagaggagatcgctaggaacaaaggacctaatgagcctttgacctgggatgatgtgtcaaggatgaagtacacatggaaggtggcaatggagacactccggactgttcctgcaatctttggaagcttccgaacagctatcaaagacatcgaataccagggctatcacattccaaaaggctggcaagtaagtgtttttctgtcaagtaattccgttgtgtcattgaatatctttttggtcgcccatgtgcatttgtgtatcagtaatatgcccatctgaacaatatacccaactgttaaattcctccaacacattttctgttctatgccagatcttcactgatcaaattgtcacacatttggacacaaattttttcgatgggccgaggaagtttgaccctgctagatttcataaccagtcttcaatcccaccctattgctttgtgccatttgggggaggcccaagaatgtgccctggaaacgaatttgcaaagactgggacattggtggccatgcactacctagtgaggcagttcaggtggaaattatgctgcaaagaagaaggttacaggaaagatcctactccaatgcctcttcttggactcccaattgatcttgagaccagaagcccccctggatatgctcattcttagagtaatccacatgtttctgtttactttttgcgttttaatttatgctttcgctagttggtttaagagttgcgagtgttgcagatatgaaggtttggtaaagttgttcagaaatgtagtgacttatgatcaaaggtggtacagttttgctgataaatgtgtattggtgtataaactatgatgcaataaataaacacagatgccttatgagttatttttcttttgtttttttcttaaaaagaatgtctaggttatgctattgggtaaatcagccagctggttactctgatatgcaatgaaccaaaatataaaaatggtactgcaatttacccatagaaaaggtaatgcactaaaacacaatcgcactgtactagcaaacaatagtacttgtcctttgtctcagacttgctatctgatgattgtatcggcagcaaaggtcagtccttttacattgcttatgactttttcattcacggtggaggacatcgtggataatgcaatcttccttctgattgcaggttatgagacaacatctgttcttatcaccttcattccctggcacctagacaaggagccggaaatccttggcaagtcgcccagttgcagctgcctgtggtttggtcactacacctcttgtgtcttggattcatgatttctagcttgcagttggttggtgagatattgtttgatttgttcatgggggatgagcgagctgtcatggctcagacgcaaatctgcattcctgatgcgatatcaagatctatattgtggagtctatgccttcaaagtttatctagatttgtctacataatttttttgttcttggaagttgaccatagtggattttcagattatgttattctaaacttgtcgttttcccttttttgccaggttttcaggatctatgtggccctcaaggtcgttgttgtgtatcctgataatgcactgattgtgccaacattgttaaaaaatatgtcatgctatattaagggatgaatcttctgcttatggataattctaaaagttctgtattgcagggccataccattttcagaagaattgcaggtacagtgaacttgtccttgtgtgcacaggcacatacatagaactggagctaaccttctcaaatctcaactatgtacgtaattcgcttcttgtttttaaaatatctacctattttttacatgggtcatattctacttaataatataccaaaaacaaaaggataggtgtcctgcatacatgcctgtgccaaggctaccttaagatcgcatagtggcttacctgcagggagaacttttgatcgagagccctgcaattagaagaattaaaatcttgaatattgatcaaaatttctcattacgtaggacattgatcgtttccttaggaacgacatcagatcttctcaatgttttgcttttgcttgctttgcaaaatttagtgctgttgtatgtaatcattctctccaacaatgagaaaacagtagcatctttcttctacctaatattagatccaaagaaatattcagttcatccaaagaaatttttttagggaatttgtttctatgtcttcatttgacagggaaatgtggattctttgactagcataaatacagaaattctattggctagcagcacctttttttaaaaaaatttcaagctgatgttgaagtggcttccatttattttctgtaattcaccatgtcgtgctgagctgctcctatcatgtggctagggatggaattgtttacttatgaactaatattttaagttatcatgaatcaaactcattgctctggtatgacaactaacaacagcgagggtttctttaagtaacctgtattctgtcttctcgcctcctctgaatttgatgtctttgccttggcctatgctttggtcatctgtatgttgtatgaattttgagaaagtagtataatcaggtgggccacctagccttctgttgagttctgaagataataatcaaatttgttaaatcattctttcttgtctatcattgagaaaggaacaactctggtttacctatatatatacatgtatacatatccacaagttgatcacccaaccttcatagtgcataacaacataccatatcaatggattcatccatgccttttgctctgctgcttgccttgctcatacccatcctcctccactttgtcatcaggcgcaagtactcatcctataatctccctccaggttcccttggcttcccagtgattggccagagcatctccctacttcgcgccctccgcagtaatactgattaccagtggtaccaggacaggatcaagaagtatggtccagtgtccaagatgtcagtgtttggctcaccgacggtgctgttgactggcccagcagccaatcgctttgtattcagcaaccaagacctcattatcaccgagacgaaggcagcgaacgccctcattgggcggtccatattgacactatcaggtgaggagctaaagcaagtccgcagtgcactgcagggctatctgaggacagagatggtgacaaagtgtattcggaagatggatgaggaggtcaggaggcacatcgacctgaattgggttggtcaaaagacagtcacggtatgagtgttgtgttttcttcttcttttcccacttaatgttctttgaattgctagacccttatgtgtacttaaaacaacttttcgtagtattgatatgtatatgtgtgatactttcgcgattacaggttgcaccattggcgaagaggctcacctttgacatcatctgctcagtcatcttcggacagggggcaggtcccatcagggaagcccttgctgctgacttcaagaaaatggtgcaggcaatgctatcgattccagtgaatatacccttcaccaagttcaacaagggcttgagtgcgagccggagggtgaggaaggtgctcaggcaaattgctcgtgacagggaagcagcattgcagcaaggccattctagttcagctgatgatttcttcacatacatgcttgttttgcgctccgaaggcacccactcactcacagtggaggacattgtggacaatgcaatcttactcctacttgctggttatgagacatcgtctgttcttatcaccttcttgctccggtacctagccaatgagccagatatcctgggcaagataactgaaggtgagcaactagtactctgtattgtcctcatattttgatatttgaatcttctgagtagcatcaatatcatttgtacttattgtgaccaacagaacaagaggagatcgctaggtacaaaggacctgatgaacctttgacctgggatgatgtttcaaggatgaagtacacgtggaaggtggcaatggagacactacagactgttcccccaatatttggaagcctccgaacagctattaaagacatcgaataccagggctatcacattccaaaaggctggcaagtaagttttctttttttctgtgaactgattccattttgtgacattgagtaacttttccattcccttatgacattaatgtatcagtgatatgtccatctgaacaatatacccaactgttataggcttacagctctcttaacacattttctgtgctatgccaggtcttcactgctataattatcacacatttggacgcaaatttttccgatgacccgaacaagttcaaccctgctagatttcataaccagtcttcagtcccaccctattgctttgttccgtttgggggaggtccaagaatgtgccctggaaatgaatttgcgaggaccgagacattggtagccatgcactatctggtgaggcagttcaggtggaaattgtgctgcaaagatgaaggttacaggaaagatcctgttccgatgcctcttgaactcccaattgaacttgagaccagaagctccccctggatatgcttaaaatgatccacctgtttttagtttatgctttcactagttggttgaagagttggaaatgttgcagttgtgaagatcttggtaaagttgttcagaaatgcagtgacttatgatcaaagctttggttcagttgcgcagataaatgtgtaatattccctctgttatttaatagataacggcgttgacttttgaacacatgtttgaccattcgtcttattctaaaaatttatgtaaatgtatagaatataaatcatgcttaaagtattttgagtgataaaacatctcacaacaaaataaataataattatgtttttttaataagacgaatggtcaaatgttcaacggcatcatctattaagaaacagagttagtaagacatctgcttagggggttccttttcttttgtttttctgaaaacaatgtctacgttgtgctattgttgggtaaatcagccagctgtttactttatttggatgcaatgaacaaaaaaaggataatttaaaattaccattagaaaatgcaatactctaaacacaatcgccatgtactagcaaacaaaatacttgtcatttgtctcagaatttgctatcgatgattgtatcgctagcagaggtaagtccttttcctttgcttttttttttttcattcacagtggaggacaatgtttagttgtcacagtgtattactctattccctaaatgattataaatatttgatgtttaggataagatttagtcaaagttttgaaaattcgagaaaaaagtctatagtgctagggaacaaagtctatcaaccaaagaaaaaaaagggtctatgggttattagtctcataattctctttcttataaagaatttgcacaaattttataatattgtagtgacaaagtccctgtgtgaggtatgtgggttctttctggtggtaaaatatgttttaaaaattttaaaaaactttttcagaggtattgccaagtgaaatgtcaaggatggtaaaacatgcttattttttgcatctcaggacattgatttaacttatataagatgcaagagagactttcatgcatattttctttgaatgtcactttagccaagaatgtttggtcaaggctgcttatcatgtggaacacaagcctaagctttgagcagatgttgcagtcggctatggataattgcaatgccagggtttaaactttgtggaaaaagttctatatgcttcccgaaatatttggaaaacagaggaatgacttcattttgaagataaagcaccttgccaccttttgtacatccctggagttgccttttaaaggatgatctacttttacttttctttcttttaagtcatgtataaagagatattctatcatcatggattgacttgttgtaatttcagtttggtacttttttatttcttggccctacttaatgtatcacatggctattcttagtcaacatttctattagaaaatgtcccttttgcccttacttttcgtaccatgtaaaaagagaaaaacaaagatgaataaatagaattataaatgtacttcctattatttcattatgtgcacacaaggttgagctttaattacataattattttctttttacataaattactatgcatctatagcaaaattcattatatgtgatttcaaaaaaaatcatataattattggatgtatgtttgatagaaagttgggtatttaaagctcaactttaggggatcttgtcataaagtttcactgcctcattagtaaggtatgttcttcatttttgttatatatgtgaatgaggggtataagggtaatttatcaagagatattgattatgtttagccatgtggctccttaaatgggttcaaggatgagtttgagctagaattaaaacttgaaagagtaagatgggcagattaaaatgtcaaagaccaaactaaaccttagatgaaacttagaggaccaatttagctattcacccttaaaatttttttaaaaaaatttaaccaccaataacttcttaaatgtttaattaaaaaagataatatttttacttgaaaaacactttcataatattgttagctattaggttttaaaaaacttgttctgctaaaatagtgagagtaaatttcataaaatcccacgtattatgattcaaattgcacaaaactacaggaatttcggcacgtatcacataacctctaatatgattctaaagtttcacaaaaccgtacaggtaactttgatctaccacattttaaaattctacgataacatcttaaatttataaggatttaatccatcatgtaaacgttaaatccactttttaaaattttgatataggaatatgtcaaaatggttcatggtgtgatttttgtgaaattttatgaccatacaacgcgaggatgtgtcatgttccaaaatccctatgtttttgtgtggcctagatggcagtcttataaacaatctactttaaaaaccatgatcgaagcttaaaatcctgatcaaagttaattaccatgaggggcggacataaaaccggccttccatggaggtagggctggtcatccgggcatgggcctaggcaaggcaggtcgcccacattctccggctcgagcggcggctcgtcagctgcgcggggctccccgtcggcggcgcgcaccgctcggcctgtggcggtgcgccagcgtgcaagcttcccctcctgcatattacctgcatgacgccccccaacaagcagacagcgcagtaagaggtttgagtcactagctattaggtgtcctaggattattgatttctagctttgcaattgattggtgagatgtagtattgatttgtcccacccgggcggctgaacgagtctgtgaatctgtgttggcgcagatgcagttggggtgggtttcggtcaggtctggtggtgtggattaaaaacagtgacactgcctaaaatcgatgtaggagaataatgatctcctggcctgatgattgctgatttcgatccgtggacaaattatattattaaatcaaatctgcattcgtgatgtgatctccaaatctatattggggagagtctatcccttcgaagtcttacctatctatatatctatctatctgtctttatacatattttgttcttggaagttgactatagtggattttcagaatatgttatccgacctgtcgttttccttcccttttttttgaaagtttttcaggatctacgtgatcctcaaagtcaatttcgtgcatcctgataatgcattgattatgccaacgttgttaaaagaaatggtcatgctatattaggggaggaatcatctgcttatggataaagtctaaagtattgttctgtaatctgtattgcagggccatgccattttcagaagaattgaggcaacggtaaatgtgtctttttgtgcacaggcacatatatagaactggagctaaccttttccactaagtacgtagtaatttgcttcgtttttaaaatgtctagctatttttcgtggcagatattctgcatactaatataccaaaaaaagaatagctatcctgcatacatggcttgtgccaaggctagaactatacttgttgatcgagtgctaaggctagaagtgttgatcgagagccctgcaattatgcagaagaattataatctagaatattgttcacaatttctcattacatagaacatggattgtttccttagggatgaccaaattgttgtcaccagatcttttcaatggtttgctttgcttgttttataaaatttagtacttctgtgtaaactcatctaccagcaaaacagtagtatctttcctcaagctaatattagatccaaaggaatattcagttcatctctttatttgcttctgtctatgtacttctttttatagttcttttttttttaattttagggaattcgtttttatgtctttcatttgagggcgaaatgcgattctttgactagcataaatgcagaaattctattggctagcataaatgtgattcgttgaactggcttctatttatttccagtaattcacaagatggaattgtttacttataaactaatattttaatttatcatgaatcagactcattactctggtgacaaacgatggtttgttaatgttatattgtcttcccgtccttctctcaatttgtaatctttgcttgtttgttgtatgacttttgagaaagtgatatattcagctttgccaactagtccttttgttgagatcaaaagaaaatatcaaatttgttaaaccatactcccttatatatcatggagaaaggaacaactctggtttacctatatatatacatgtatacaaatccacaagctgatcatccaacgcataacaacataccatgtcaatggattcatccattccttttgctctgctgcttgccttgctcatacccatcctcctccacgttgtcatcaggcgcaagtactcatcctataatctccctccaggttcccttggcttcccagtgattggccagaccatctccctacttcgtgctctccatagtaatactgattaccagtggtgccaggacaggatcgagaagtatggtgctgtgtccaagatgtcactttttggctcgccgacagtgctgttggctggcccaggggccaatcactttgtattcagcaaccaggacctcattttcaccgagacaaaggcgatcaacgccctcgttgggcggtccattctgacactctcaggtgaggagctaaagcaagtccgcggtgctctacatggctatctgaggccagagatggttacaaagtatatgcggaagatggatgaggaagtcaggaggcacattgacctgaattgggttggtcataagactgtcacggtatgaaagttgtaataatgttctttgaatttctagacccttttatgtatagttcaaaaaaactttttgtagtatggatatgtatgtgagctacttttgtgattataggttgcgccattggcaaggaggcttgcctttgacatcatctgctcagtcatctttggacaaggggtaggtcccatcagagaagcccttgctgccgactttgagacgatggtgaaggccatgctatcaattccagtgaatatacccttcaccaagttcaacaaaggcttgaacgctagccggaggatcaggaaggtgctgaggcaaattgctcgtgacatggaaggagcattgcagcaaggctattctagttcagctgatgatttcttcacatacatgcttgttttgcgctccaaaggcacacactcgctcacagtagaggacattgtggacaatgcaatcgttctcctggctgccggttatgaaacatcgtctgttcttatcaccttcttgatccggtgcctagccaatgagccagacatctttggcaagataactgatggtaaacaactagtactctgtatcgtgtcgtgtgcctgtaccttgatgttttaatcttctgactagaactgctaccatttgcaactatcgtgaaccacagaacaagaggagattgctaggagcaaaggacctaatgagcctttaacctgggatgatgtctcaaggatgaagtacacatggaaggtggcattggagatactacggacaatttctccaatttttggaagcttccgaacagctatcaaagacattgaatacccggggctatcacattccaaaaggctggcaagtaagtatttttctattgaccaattcccctttttgttactggatatcttttccatcccagttatgacatacgtgtcactatattttccattcccaagtgctatatttatttttttaccctcccaatcttgcgatgcaggtcttccatgctcaaagtatcacacatttggacgggaagtttttcaacgatccgatcaagtttgatcctactaggtttgacaaccagtctttgatcccaccttattgctttgtgccatttgggggaggtccaagtatgtgccctggaaacgagtttccgaggactgagacattggtagccatgcactacctagtgagacagttcaggtggaaattgtgctgcaaagaagaaggttacaggaaagatcctcttccgacgcctgttcttggactcccaattgaacttgagaccagaaccccccctgaatatgctcatgcttaaaatgatccatatgtttctgtctactaccatgaatttcagtttttggtttctccagatggtttacagagttgggagtgttgtagatgtgaaggttgtggtaaattattcagaaatgcagtgacacgttatcattgtgtagaaaaatgtggactggcgtatagtattataatctaattataaaaacagatgcctaaggggttcattttctttctgtttttatttaaaaaaagaaaggtctacggtgtgccattaggtaattaaatcagccagctagctagtttatctgcacatttagctcttctgatgtgaagttctagttaggttagtttcaagcgtttttgcagcctctcctccctgccaggccttatagtactcatagatgtgctcctgcatgtatactctatgattctgttaggttttctttgaattctggtttaaagaaaccagttcatatccagccttttttttcttaatctgtatctatctttttaacttgtgtctaataatatgggattgtgatctgatccagcttaccctatattttactctattatttgtgttcccacaatggttcatgttcattctgacttggacaaggcttcctaggtgaataacattgtaacatgacacatgagaaaccactgtgtcattactacagactgcatcttatgttgacaaacaaatgactttgttttctttgcatggaataacatattattcctatatacttgtacaattaatcctcacttaggtggttaataccattttcctgttctcttgtgaagccacatcatctaaattaggccagaccattggatgaaccatatgactttgtttaaaacgccttgatacaagagaaccatattgcaaggagccaagtagaggcatggatcacaatcccgatacaggatcaaaaactgctcgcgagcgatatcttcagaattagcgaaaaccattgataaactgacaaaaacgagaattagcgaaaaccattgataaactgacaaaaacgacaaaattcggacaaattttgtcaaaaaattaaaattcagtttgattttgtttaacttgacaaaaaaaaaatctagcggtttatgttttttatctgtcccaagaagtttggatccattggttttaaaccttgactagaggtagacacattactagatggaataagttcactttgactccctcaaaaatagctccaatctagtttatatttctgaaccggaataagttcactttgtgaccctcaaaagtgatcgaaatctaatccatgaccctaaaccacaaaaccggatatatggaccccccaactctcaaaaccggtgtaatttgactccctcggcggttttggagggcggtttcgctgacgtggcgcctacgtggcagtgttgactcggtctcctttccacgtggcattgacgtggcacttaggtggcattagaaataaaaaatatgtgtgggacccatttgacatggaaccactgacatgtggggcccacataaaatcatcctctcctcatcctccccctctttctcttccatttgctgtccgagcgctggcaggtgggccccactcgccaggagcttcttccacctctgtccgtcgtctatttcatctctcccgtgaaactcaagcactgccgcctccgttgatcttcctgccctatcgtttctcctccaaattaattgcaaaaatcgattccttgtgtagtgggcatcaatttccccaacaaatcccacttaatcccgcactaaatcgccctcaatcgatttcttaaaccggtgtcttcaatagggagctccaccgtcgccgacgttgttttccgtccgtgcggtcgacctcctcccctccggcctatataaagagagcccccgtgatctgctctttcccatctcctgcatcgctgtggagatttcataattaacaggtggttttcaccgtgctttgtggtgaatttgcaccggatggctgattttttttttggttttattggtgggtcacgacgcagaccctctcggcggcggcgcacatgacgccgtcgacgagctgcggcatggagcatttggccagggcccccgggccgcagccgacgcggagcccgacgccggccatgtagttgcagacttctgtgcgaatcatctcctgcatcgtgtagatgagatcggtgttgaacgggtatggggacggagatgttgccggcggcggcggcggcgagggcggtagcgaagggaagcaggagggggaggggaactcctggaagtggctccatgcgctgtcgtggtggaaccccgggtcctgctgccccgggagggagagggacagcgaggtgagcgtgtcatcgtcgttgagagcgcgatagactcaacacaatagattggattgatatcgggtgcggagtacatataggctcgaaacctcccttatccactcaaccgacttatagaaacagaatcgggagagacattaggagggatcggcacaaaaggaaacaaacatgcacaagatatatatctatctaacaccccccccccccccgcagtcgcaacggcgctggagcgaacattgagactagaacgaaattccgtgaagacagatgtcggcagccctttggtgaagatatcagcatattgcgatgtggttggcacatgaaggacacgaacaactccagccgcaacacgatcacgaacaaagtgaagatcgatctcaatgtgcttagtccgttgatgttgtactggatttgtagaaaggtagacagcgctgacattatcacaatagacaaccatagctttggagggtggagtatgtaactcgtgcaataactggcgaagccaacatgtttccgccacggcgttggccacggctcggtactctgcttcggcgctggaacgggagactgtgttctgtcgcttgtcgcttggaggaccaagaaatcaggttggcaccaagaaacacggcatagcccgaggtggacttcctcgtgtcgggacaaccggcccaatcagcatcagaataagcaaccaagtcaacagttcgagagcgctgaaaatgcaatccatgatcgatggtgccctgagtgtagcgaagtatacgcttgagagcggcaaggtgcggctcccgggggtcatgcatgtgaaggcagatttgctggacagcataggatatatctggcctggtgaaagtgagatattgtaatgcaccagcgaggctcctgtaatcagtcaggtcagcaactggggcaccatcgacagctgagagcttggcattagtgtcgaccggcgtagaacatggcttgcactcggacatgccagcacgagcaagaacatcaagaatgtactgttgctggctgaggaacaaaccagtggatgtgcgggtaacactgattccaaggaagtggtggagaggcctgaggtccttcatggagaattcagcttgcaaggcggaaattgtccaacgaagaagactgtcagaggaggctgtgagcacaatatcatcgacatatagcaggagatagaccacatcggaaccacgatgatagataaacaatgatgtgtccgaccgagcctcagagaagccaagtgtgagtaagaaactggcaaaccggctgtaccatgcacgaggcgcttgcttcaaccatacagggacttgttgaggcggcagatcatgtcgggtttggtaggatcaatgaaaccagcaggctgagagcagtaaacagtttcctggagagtaccatgaaggaaggc

SEQ ID NO: 69785 - DNA, 5230 bp, Oryza sativa
  unsure (1)..(5230): unsure at all n locations
gtatagttaagagcaggtgagccattctcactgcattattgtcccgtgacatgagctgcagtgtttttcttgtggatccactttgtgcattcaaatcccatgccatgtagcctcaggtgcacatggatctcaacaatcctctgttttgtgtagaagcctgctgctgcgtcccgtaattaagctcagattgaattattgatctcctctaccgccaaaatgcgtacaccggtgtttaaatgcgtgcagccggatgtagttgatgcagtctgtattgggtactctgcagtacccggtttgccgtgtgtacaatgtcacgctggacattggttaggccctctttgtttaggcttaggcttattggcctagacttttaagttagcttattggcttatatgatttataagccggtggatttaatgtcctaagtttagtggttgagccatacatctacctcacataagcaaaaaaaagcttctccaacctagcttttggcttaatagtgttagagtggcttatggcttcaaaaaagacaaacggaaaagctgcctgtttgtttaggcttagacttttcgacttataagttgtcttataagcctagccgatggtcctctcctcccccttttttgtgaactgccagcaggtgacctatgataaagagaggtcgatgcatcatgtcctgtttgcatctccatgactccatgcgtatgtacagtttctgcttcaatgctgcaacagataatgatggaagaggtagttggaaatgtcctgttattaacacgctgataatgatatggttattggatcggtgagacctggttggctggttggctcacaaggctcaactgtcaaatgcaggtgatctcaacggtaactgatcgagtgagctcgcgctgcactgcaactgaaagcctggggattgttactgattggcgatggacctggagacagagacagtgacattcgcgtgcaacgtactactcctgcttaacctctggagtagggcatcatcaagcattaatcgcctcctttccaacacgtacaattacccccttggaaatcaatcagctggggcattcagatggataaaatcaagaattgtttggctgaggaatttcacgaagaacaccaaatgtttgtttggattaggagaagtacagtactacgcactatggagactttggacaggaaaacaaggttcgccttggaatggacggcactacggtctacgacaaatctggcgtggcaccatctccgatcagccatttctgaattcaaaaaacacatagccatatgtccgggtgtttttaaggttgtgtttggttcacactgaagtttgaaagtttggttaaaattggtacgatatgatagaaaagttgtgtgtatgaaaggtttgatgtgatggaaagttgaaagtttggaaaaaaaactttggaactaaacagggctgttcacgcaaaaattgaaagtttggttgaaattggaacgatgtgacagaaaagttgaaaatttgtgtgtagaaaaattttgatgtgatgaaaaagttaaaagtttaaagaaaaaaattgtaactaaacagtcgaactgttgaagttatcatcggaatagcagcaaaagcctgaattcaaaaaacccctctagtcctttccactatccgtctctctctgactgcagcggatgtcagccaaaaagccgtaaaaaagtcccctgctggcacgcagacgcagccacgcaagcccggcccaattcaaaatggctgccaccctcaaacggtcggatcccaccagcagccaaagcagcgatccccaccacccgctcccccgatccgacggtccagatcttcccccagaattcaaaacctcgtttgaaacggcggagcacaacgcccatcggggccaatccagctattgagtgagtcctcgtctcctcgggaataaattccgaaactcatccccaacgcgagggcagagggacctgtcgggcagcggctacaactacaagagaggaagagcgaggctgtgaaggaggaggaggaggacggccgcgtggggtgagttggtgtaatgattcaccaatcctctctccatagctgaagcttctcgctatgatgatggccggcgcttgatggtgattagcgtctcgttgatcgcagcagcagcagcagcagcaggaggaggagcggctattcttctcggcgcgctggcgatcggcgtcgcttcgaggagggggagagcggcggccgccggaggcggaggagaaggggaggagcggatcggaggtaactatagccagaccttgccttttcttcccccctcgcgtaattcttttttttgttactactgtctttacgcctcgctttctttctcgctcgtgctcggttggtacgcttccaagctaagcatccgtttctctcgcctccacctttcnggccgccgcctccctttctccgcngtgttcactttacattagatcctctttaactttcttattttttttaaaaaaaaatcaactctcagactgatcgagagatcgatttgagtgagctctagttttgaaaaccacatataagagataggtttccttctctagagtgttcgccggcgatgccaacgccgccggcaacgacacggcacggcggcggttaattccgtagctttggaggggtagaaaagtcacttcacctcacctcaccccaacccacccacccgctccccccaaacagcgccgttactgcgtgcggtccagttgtctagcgaccaccacccaatgacacctgggccccgcacgacagatccccgactttggatgccaaaaacggcggggccccgcaccctcgccacctgtgcgtaatcgagtactagtccgttccgatccgtgggcccgatggtgtgtggcgcttcgggctcggtcggtttgcttgattcggctcatgatgcggtccggccgtgtgaggctgacatggtgggccccacaaacccggtgcgcgcgccatgccaagttgccacgagcccccacgagcttttaatccgtgcggaaaaaagtggttggttgacgcgaaaaggcgccgtgtaatcgccaggtcgcatgcgcggtggccgccactgacgtgtgggccctgcccgtcctttttttcattcttaacctttttttcatttactttcgtagctaaaccatggttaagttgttaattatactaccaataatctcgagtcagtcaaggtggagtctttttggttctttttattttccttcgatgtgcatgcgtggtaggttagggttcatgataaaaatgtgtaaaagcatcctggtggagttatatatggctgcagcttttgacaagaactcggttcgtttacgatacgttcccccacgcaattatttcgccatgattcttctgtgttaagaaagggcgagatctttgggttagaatacaagaaagtcgtgtgaaaattgtgggcgattaaatcttcccctttcgcaaagcttgtcttaagcactcatctttcgctttaaatcgcaatcttttctttcagatcaaagcaaatactaggagaactagctaggtagcccgcgcaattgctagcacccatataaaattatatattttttaatatgattttacttaaaatttatttaatagttatctcgttgtcttgagatttgaaagatcaaatcttatcatcctcgtgtttctaattttataatttttctaatagtataagagttttaatttcagtttttctttaattgtgagaactgcgtcgcatgggccagtctgtttagttgagatgtaacatgcagaatcgaatgctgtagctcacaacagtatacattagttttagtattcaatccacttgttgatttcatccacttttcctttcggttgttctcattcactctccaccaaccttgccaccattctgtccagtcaaaacttgaatttgttaaaccaagcattgataatttgtcagaaaattccgggaattttgaataggactttttgtacccagcacgtcgtttttattctttgtcacgagcatttacttctccggaattcacatttcgatccagagaagaacatcgggctggggcactgtagcagctcatctcagtggggcgaatggttagcggtagctttccaagatcagatttttgattcgttttttaagtaggattccttgcccatgtctgcttctagcttcttctcggctgattgctcttttttcccagatttgtctgcttcgttcttggctgaactgagagtgagcactaatctactccatactccgaacactgcagatcacgaggtgcggtgttgtagcttcgaccgaggaatgagcttgcattgctgtccggcggccggcgacccgccggcgccggccgggacggcggaggagctgctggagcgggcgcggtcgctggtgccggcggcgctggacgcggcgcgcgcggcgaccggcttcggcggccggtggaaggttatcgcggcgaggctggagagggtgccgccgtgcctgtccgacctgtccagccacccgtgcttctccaagaactcgctctgccgcgagcttctgcagtcggtggccgccacgctcgccgaggccgccgagctcggggcgcgctgccgcgagccgccgagggccgggaagctgcagatgcagagtgacctcgacgcgctcgccgggaagctcgacctgaacctccgggattgcgcgctgcttatcaagaccggtgtgctgtccgacgcgaccgtgccaccggtggcgccggcggctgaggcggcggcgcagacggatgtgcgggagctgcttgcgaggcttcagatcgggcacgcggaggcgaagcaccgggcggtggatgggctcctcgacgcgctacgcgaggacgagaagagcgtgctgtcggcgctcggccgcggcaacgtggcggcgctggtgcagctgctgacggcgacggcgcccaagatcagggagaaggcggccaccgtcctctgcttgctggccgagtccggcagctgcgagtgcttgctggtgtcggagggcgcgctgccgccgctcatccggctggtcgagtccggcagcctggtcggccgggagaaggccgtgatcacgctgcagcggctgtccatgtcgcccgacattgcccgcgccatcgtcggccacagcggcgtccgcccgctgatcgacatctgccagaccggggactcctactcgcagtccgcggcggccggcgc

SEQ ID NO: 69786 - DNA, 2017 bp, Oryza sativa
tccagaatggggctggttagcgtgtggtttcatcacgcatgatttgttttgggttgtcacagccacaaaatgatgctagtgcgtcacctgggaaccaacttatatgtcaaaataaacgagtttgtgggttagtttagtctataagtgggttttcacggatagccgcttgaaccctcagccacaagcatgtaaatccggtctttacttaaagaaactacagccaacatatttattttatacttttacatatcttcgatgtaataattattttaaaataaacgataaaagaaaaaaataaacatattctaagatggagaggacagaactgaacaacaaataagcacgctaataaactaaacgaaagcctttcgaaaaggaaagggtgttgggggagtattggaaaagatgatcatgccatctgcaccaccatggttttgtttttttgtttttcttttttttttaaaaaaaaacaccatggctttggttggtagcactgttcacttcaccatcaagtcatctgtgagaatccttggacactttctcccacatgtgagtgcgattccaagcaaaatttggctaataagggcacgtaccgaggcctggttttgatcagatgaagatataagataattaatccattcggttggaaatatttagtactcgttccatcccaaaatataatactccctccatccacaaaagttacacatatttcacatttgagtttttctaaataagttgttcctatttgtagtttttgtgtattcaagacttaaataaagagataaattaaatgtttgattagaaccaagaagtcatctaaatgctcattggttgcatgcttacattcacttcttgattttgtaccatccaagacgatttaatttctccttgaccttgatgaaaaaagtaatatgtgtaacttttgtggatggagggagtaacaaccttacaggtttgtcccagaatatacaacttcttcaccaacattctcttctcaactaattataaccttccatcattcaattttctcacatacctccacttctcaatcaatcacaacattctctcatttaattccacctactttctgtgaaagggcctgtagcctagtggttacgagagcctcgttagcacatgaggttttgggttcgactcccattgggagcaaattttccaggatttaacggcgttatgcttttagtggtaggcgacgtacccgtcgacagcgaggcgcctgtggtgtcttcgtcaatctctctagaatttgccggcccagtcttcgaagatgctcataggggtgagtgcgcgtgcgttgtgagtgtctgcgttgtactgtgtaattttcaaaaaaaaaattccacctactttcttaatatatgtgtccaacactaaaaatcattatattctagaatttgccggcccagtcttcgaagatgctcataggggtgagtgcgcgtgcgttgtgagtgtctgcgttgtactgtgtaattttcaaaaaaaaaattccacctactttcttaatatatgtgtccaacactaaaaatcattatattctattctgtcatggaggaagtaatactgacatttaagatatgatgattcgataaaatctttgaccgcatataatttcttaaattagttttttctcgaagaaaaagtgtgccaaatttgtcttcaaaagtattatcataaacttaccggattatataaatttgttctaaaaaaagttatattacgtgttaaataagttcaggagaagcatatcatttttttttgttttcaagatagttattacccctttatcttaaaatataaaaattttggttgaatcagatatatcataatattacgaatctggacatcggatgtagtgcatcgaaccaaaggccccgttcttttctccaacaaaagttggaagaaaatttggatattcgtggtatgcatttcaaactgcttaacgatgtgtttcatgcgaaaactttttatatggaagttgctctaaaatattagataa

SEQ ID NO: 69787 - DNA, 1990 bp, Oryza sativa
cctgcagcccccataaaacatacagaaatataaaactagctgcaaccatgtcattaaactcatctcttcaattccagaagtaaccaataccaaaacacagcttgaaaacgtaatattacaggaaaacacatcaagattgattacagtccaatgactccattataaaatgcctccaatactacaggaacggcaagagcatgacaaatttatcaaacgtctagaacaaattgtgtgcttgtacttcatatccatctcaaacatcttcttgtactttcctgaaattgtaagcttcactcatccatggccgaacacgcacgcatacatcgaagtcccgcgacgatttggacaaggggaaaaaggcggtgtcgagaggaatggatgaggcgccgccgcgaaggggagaatggcaaaccgatggtttgccttctgcagctcttcccagagaaccaaggatgcgccgccgccgccgccgccgccgcgaacgggataccaccgccgccacctagggttctgctactctgccgcgcttccccaactcagccaaaccttgcaccgatccaaaaatccctccatttacgattatacccttccaccgtggctctctcgcgctaaccacaccaatgaccaacaacggtcaggattttagtatctcatggtactagtaccacgtggtacaaaaagaaggaccgaaacaacactctaaactgtaactatggattacttttaaatttttcatcatgtaaataattactacctctatttcaggttataagatgttttaactttagttaaagtcaaactgattcaagcttgactaaacttgtaaaaaaaatattttcaacctaagataaatttattataaaaatatatttaattatcgatttaatgaaactacttatttataaatttagtcgaatttaaagtagtttgattttaatcaaagtcaaagcgtgttgtaacctacaacggagagggtatccctttaattattcttttacattcgtccaatcctatcacagtagttaaagtgctaatctcctttctacctgaccgggctcacctggctctgacgaagcatatacctccttttcatttgccatgatacttgataaatactcccgactggtgtgcgtgcccgactgcccgcatgcctatccttctttttggtctgccttaactgcttgcaagttcgtgttgtcctctcgttgaactctacaaacgcgaagctaacaagtaacaactcacgacgtaacgcgcgagcctagtttacgtgatagacgacgccacgagaggccaaaaaaacggaggacagaaaatacatctgaaaacaccaggcgcgtcgcgcagtgcatgggcacatcactgtcgacggcaagccgccaaaaccgaacagccgaacacgcacacctactactacgatttccgcggaaacacgccacgcgacagccggcgcgtgtctggtactctggtttggcccatacaactgtaccgtcctccccttgcgcatgcagagcgccatggccgctcgcgctgccgcgtcaccggccggtatgaaacgagacgaaggcgcaatctagcagcgcacgtactgtacatccttgcagttgccggagggaggctgcatagccggccgaggcgtaaagtagctggcaccgtggtgtgaactgaaatctcagggcctcgtcgcggtcgttggattgacctgctacgagccagctcaggccgtgcgcgtttactgaacagtaaatatacagacgaaaaaaaaaattgcagcagcttttcgttgcctgcaggtcgtctctcttgcgtatgaccgcacttatctgtctgtcgcgagatttcgcacgtacacgtatcgttcttctttaccggtattgatgcggtgagcatatctaggaacatatgcgaggtaggaactgtgctttttttaggtctcaagtcaagctactagggagtagaaagggagcacacacacatgatgctcggttga

SEQ ID NO: 69788 - DNA, 3036 bp, Oryza sativa
atatatatatatatatatatatatatatatatatatatatatatatatatatatatatttaggaaagtatttcagattttaatgctttatctgtcttgtactttcaataattgagtggagatgaaggaacatagttacttgtttgaacaaatatactgtgtttattaggcaaatacatctattggttccatgttaattgctaatatttgtaactgataccgatatatttgttctgcagtgcatgctttaaataagctaccatattctaagatagactctaaggccgttggaatcacaactggagttatttttgtaacttatagcagcttgatagcatcctctgagaaaggccgttcccgtttgcagcaattgatagagtggtgtgggtctgagttcgatggtcttctggtgtttgatgaggtaaagaagactctggtataaatattaatcgattgtgctaggcatcttctagttagcatgcaattttctattcaatccgctgcaaattaatctggtatgcttaaatgatgtgtttcttgcagtgccacaaagcaaaaaatctgattcctgaggcagggagccagcccactcgaactggtaaagcagttcttgagatccaggtgtgtgactatatatatattttgggttgattagatacgtgccattaaaaaattgtggaaatatgccattactatttgcgtatttgtaacgatgccactgctacttgttgataatcttagtggtgccactgagatacatattttgcttgtattggacgaaatgcccttatcttctacctctctcttccctcatcttctacctctctctcttccctcatcctttcccatctctctgacccgaatcgacgcctcaccgctacttctcgactaggttggcccgtcaacgtcacgtcaggtgccgaggtggcagagagcaccggacaggtccccacggctcttcacgaaggcgatcctcgccgcgtcaggtgccgaggtggtcggcggcggggaggtggagagcgtcaggcggctgctcgctcctcggtcctcgtttcttcgtcgcctagggactcttcgtggtgaggagaggtgaccggatttgggactcattggcctccctcttttccgactccgccttgccagccgcgtagagggataaagggagggaggagatatgccatcggcgccggtgaccgtgagccttgcagtgacatcgtcgtcgtcagtgtggagctctacaggagatggtcggcggtggcgcgaggtggagggagacataggtgtcgtggatgaagagcgccagaaagggaggcggcggcgactgcggtggtcatgtccattgacagctgtgcttgtggtcgccgctgtcaagccatcgctgtctcaggttgtcgaagagaagagggggaaaggggaggaaggaagaagaagggcaattttgtccaatctttttttgtacatgcatccaaggggtaaatagtggcatgtctcaaatatgtctaaaattataatggcacggttccaaatacttgaatactagtggcaaatttcaaaaccagcatatttttaatggcatggatctaattaaccctttttttcttgctctggtctccctatgatcaacagaacattactagtatacatttattgcggtcatcttatgtagccgactttttgaatataaattctttggccctggaaagcaaacactttcctagagtgatagcatatacttcctctgtccatgaatataaagcacttttggaacagtgctaagtaatttttttttaacttttgtctatcatcaatagcacaaaaattataacaattgactacataagaataatgtttctagatctatcgtgaaacaaaatatcataatatgcaactctttgtatttaaaatagtttatttttatagatgttattagtcaaagtagcatatcgaagaccgtgttgatgcccaaaagtgcttatatttgtggatggagggagtatttttcaaatatcaaaccagaagtcaatgaccttatgttgtatgttgtgatgttatagtattattcctcattcctcaatttgatagattatgtggtatctgggatgggatgattctttcaaagaaattctactgatgatctgttcttaattattgtcaccaaacattgcaggaaatgttacctgaagctcgggtggtttactgctcagcaactggtgcatcagagcctcgaaatctgggttatatggttcgccttggtctctggggagatggaacatcatttcagaattttcagaaatttctaggtttatttttgttcctttatacttatattttatttttttatatacctttccatttgtgtttgcatgttatcgtaattcatacaaaaatttcaaataattatttccaatgccgaccagctaccatcataataacaatttcaatatataagggcatgagcagtagtagactagtagttgtctcttatcaaagcatagcagtagttgtccactttccctgcaaaatgcgaatcagaagcaggtcaataggctaagagacgaaatgagcagatctttttgctgcattatttcctttttcaacagatagtaaagtactatccgctgtctgtgttcggtaaagttatcttgaaaggcttagtgatcaccactgtcgagcactttttttttttctttgggagaaaaaatatataccaagagctgtttacaactagcactggtattagtggaagaagaatttcctccattcactattgatggacctggcaattttgcccacaagttacccatagtacaacatatcctttatgttattttttgtgcttaaataactatgatgagaaacggcacttgtgaaatccaatagaaaattaagacaaagttcactttcaactctgaattttcattttttggccttggttcattttccccctgaactgcacaggtcaccacccttcatccgatcttaattttctattggatttcacaagtgccatttctcatcatagttctaaagcataaaa

SEQ ID NO: 69789 - DNA, 632 bp, Oryza sativa
cgatcctcacaagtgttgacggccgttaagtgcaaactttaaccgtaatctcctacataaaggatatcaaatatactatcaaaacttagtggtaggagtttactactaaccacttacactagttttggtaaatatatgtatgcgggtcatttaaggagaaaatacacccgccagacgacaaaaatgaacctccgactaatcatgtacgagtacaaagattggagggcccaaaagtcagtcgaaaccgagtaaagtggggcaagccatccttactgccataagagcccaccagtaagactcctggataaagcagaaaccagaaggaggggctcaggggtcagccgaactaccactagcccctcttaccttggctttccacgtgtaggtcctagatggctcaccaatggcgattatgcccggttctcggcctggataactttcacaaccgccatatggaggctataaaaggaggaggcctcacacacttcaacacacaactcttgagctcaagtagagtacaactcacttgtagtttcaattttagtatgttggcgagtaagggaagctccagaaggagtgccccgaaatatcatagtttcttcgagaattttacaaaggatacagaggagtgt

SEQ ID NO: 69790 - DNA, 1251 bp, Oryza sativa
caatgggggtccgccaaggccgcacgataggtgcgaggcaccggcgacaagggtgcggcgtggaggttgaggcgatcgatcggtcgtcgtatgccagatttgccacgcgtgaccatggcatgttcattgtcggccggagaagcatcgaggatcggtggaggagcgcggccgccagggactcgcgcgctgcgagggcgcgtgggcgcgcctgtcggtggaggccgcagggaagacgcacctgtggtgggagctaggccggtcgacaggggcggctcgttggaggagccggtgttggagggggccgccgaatgggtggaccggggggacagcatggggtcccaagcgcccggtccagcggaggaaggcccagcctctgtgggccgagctggtgaagaggccggggacgcctgcctagccgagccggatggcgtgccgacggaggcacgcggcccagggggtgttccagccggccggctggagctgctgcctatgcgtcgaccgatgggagctggcagaggagatgaaaaatcctcaagaaagtccaaattaggagcatctgcactgttagtcatctcagcaaaaggaaacgagtgctcatcaaacaccacatgatgtgaaatatagaccctattggagacaggatcaaaacaccggtaccctttgtgattctcgggatatcctaaaaacacacacatgatggagcgaggggcaagcttatggggggtagtggcagataagtttgggtaacacttgcatccaaagactcgaaggtgtgtgtaggatgggtgagcaccatagagggcaaaaaacggggtgtggtgatgaagggttttggtgggatgacgattaatgagatgtgtggcagtatggagggcctcgacccaaaaagaaggtggtaggctagcttgaaacagcagggagcgaactatgttattgagagaacgtagcatgcgctcggccttaccattctgaggggaggtgtgggggcacgacatccgcaaggagacaccgttggtgaggaaaaaggtgcgggcggtagagttgtcaaactcacgaccgttttcacactggatgttccggatgctagctgcaaattgagtcttcacaaaggcaaaaaagcgtgataaggtggcaaaggtatcggatttaaaacgaagtgggaaggtccatacatagtgagagaaatcatctagaatgacatcgagcatagttgccggcgacgaggtctaatgtcacggggacgagagcctt

SEQ ID NO: 69791 - DNA, 776 bp, Oryza sativa
caactccttgagctaaatttagtagttggagctctaaaaaaagcccatagtaagcaaaatgagcttcataattccatataaacacatgcatatcagcagcagtctcctcactgaaccaagaaggacactaaagcagtagtctagtctcccggccaagcaagaaccaaaaagcaattaagatcgaactcgagcaaacatgtcgtcgactaacaacagttcaggcgagccgccgccggcggtgcgcgtgctgggcggttgggcgagccccttcacgaaccgcgtggtggtggcgctgaagctgaagggcgtggagcacgagatgttgcaggagacggtggggaagaagagcgagctgctgctccggtccaacccggtgcacaagaagttccccgtgctgctccaccacagcaagcccctccccgagtctctcgtcatcgtcgagtacatcgacgaggtctggccggcctccaatggcggcgccccggccattcttcctcgcgacccccacggccgcgccgtcgagcggttctgggcacggtacgtcgatgacaaggtaagggcatgtcttgcgtaatttttttttgtctctgaacattttcttcttgtttcttggagaatttttgctcttgctttgatgatatttttgcagattctaccagggctttgggttttgagaggatcggtggccggagacaaggaccaaaccgaaggtgaaatgtccacgactttacagcgtctggaggaaggatttgtcaagtgcacccaagggaaggaat

SEQ ID NO: 69792 - DNA, 969 bp, Oryza sativa
gatcagtcagcaccacagtgccactgccacccacaaatcaccacaaccttgagatccatcaccaagatgctaaacttttcccgtcgccgttacccaatacaaaaatggccactagccacagcagttcacgttctcaccacacagcctttttagtgccctgattatataatcttcctcgttaatcacagtttctaaatcttagttaccgaatgctaattccacttacaatcatttttatttctttacaaaatgctaattgcgacacgcactcccgaatccccgccgctagtctcgcccacagaagattcgaacacatacagaattacacggaccacaatcgtttggttaccactaatcacatattctaattgatcctgttcctgatcatgtaccgaacacctgccatgccatgccacgtacgtggagtggccaccaaaccccgcgccgctcgttgccgccggcgcgagtggctgtgccggtacacggaagacgcggcttccgtgcgcgccccgatgcgggggtggcggaaaggaggacaagcgttggcagctagctgcgcgcctccacgttgttccggaacgttccatcgcatcgttaactgaaacgagaggcagtattaatcccctagttaaactctggctaagtatagcagagacgccggccgagaggagtggggggagagggaggaggaggaggagagtggctactagtactagctatctttggagtgggcgtttcttggccggcggcgatggagcaggtgcggcggaagagtagcctgaggtcgcatggctcaggcaagtcctcgccgcgggtgggatcgggggtgttcgatgagcggtccggactggcggccgatcgtgacggcggcgaggaaggggaggtggtcgtgaggatcgacggggaggggccttgccgcgagccgttcgcgttccccggccaggatggcggtggggcgggggctgcagg

SEQ ID NO: 69793 - DNA, 539 bp, Oryza sativa
atttttttatttttaattttttttattaaaagttttacaaaaataatttttcattttgaaaattgacggatgtagtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccctccgctagggcgattttgtactgtggggggggccgcctgcaaatgggcgattttgtactgtggggggccgcctgcaaatgggcggcggggggcctggaattttgcaggcggcccccttgccgccctccgctacggcgattttgtactgtgggggggggccgcctacaaatgggcggcggggggcctggaattttgcaggcggcccccttgccgcccttggggagggcgattttatactgtgctttatatttttgtataaatattaatagttatcaaatctttttatattgaaaactatacaagattaaaatctccaagactggtaaaata

SEQ ID NO: 69794 - DNA, 1655 bp, Oryza sativa
tgtatatattaacgtgtgatatatcactacacatatatacaagttcaaacttaacttctacatttcgcaacgaaaaaaataaattggctgagaatatacgttaactagttgtatttaatttgttttctttgttgcgagctgtagaagttgaattgatcgtgtttttggagtgatatatcatatgttaaaacaacgaggggacgacatcccctcgagagggatcaaaatagtttctgtttcccctactcaggtcaatgtgtgtgcgcacaattatataacggtgtgttctcacgtcagagttgggcgcactaacacaataagccctcacacattttgagcagacatcatatccaaacttactaaaccatttcggctacgatcgagaaagtgcaagcgacggctggcacctggttctggttgtggtgatccatggaggcaaatgctcctgctgtactgcccatggacgccaaactgatggtggccacagcccatggcgactgccagcagctgaaggatgtcgtgaacaaggaggatgctgccatgatggtgctggtgatggcgtcaagcaacggcacgccggcttccgccgcggcggcaagtcctccggtggccatgcatccgctgctgcacgcctcagcttcctccggggattggaagggtgtgaattttcttctcaacagggaagaagcatatgcagattcatctgttcagcccagtaaaaagtttctgaagtccctagaagcatgcatccccggcaactgcaccaacggaaggtgccgacctcgccgcaagcttttaatgacatacaagaaggtgcaaacatgccattgttgttgtctcccgagtcgcttctggagggtgtcaccatcgagggagacactgcgctccatgtggtggccacacatggggatggccacaactacttgaaatgtgttgacacaatctgtgccaagggcaagcacctcctgtttaagccaaacaataaggatgatacacccttgcactgtgctgccagggctgggaatcacgaaatggtcaataagcttattggtctagctattggacctagtagaagggaggaaagtgttgacagcatagcgaataacctgatccttaaaagtgataatctttctacagagacattcttgagcgatgatgtccgtgttgcaaataatcttacagtcggagatagtattagcataagtgaagacaatgtccacaggggagtggaatatctcagaatggaaaatgacagtaatgaaacggccttgcatgcggcaattcgcattggtcatagtcctatagtaacggagctattgacatatgattctgaattggcgctatttccgcaagaaggcacatcaccattgtacctagctatcttgctgaagcaatttgacatcgcgcggacattataccagatgagtagacaaaatattctctcatattctgggccaagtggacaaaatgcattgcatgttgcagttctccgaagcagaggtaatcgacaagttttagatgcccattctatttggttactatgttggctcttttttacttgatgatttggccaatgacacaaacctccgatggacaatcatcattatttttaaactgcatatttataaaaattattacaactataacatatgaaa

SEQ ID NO: 69795 - DNA, 8170 bp, Oryza sativa
aataagcgcttgtgctcttggctctccttagtttccttccatctctcttctttcactttagcttctttctctttggcgtcgagcaaatctttcatcgcctccttgtatggtccatcttctccattcttcatcttctcctttgcttgcttcctacccattggtctttttttagcacttggctgtaataaatcaggagttgtactcttcctagcatcatctccttcttcatcttcttcaccagcactcttaattggggtggaagacttcctagaccttggcctcttgtgggattctagagtttgaaactttggagaattcctcaacttgagccaacaatgattaaacttaaatgccctattcttcgatgcattggatgagtacaatgcctcagcttcaagaacctgaagcaaaattcaagtgttagttcacatacatacaagattgttattaataataatgaataaacaatttaacttacaagctcttgatgtggtatgccacttggatgtcgacgctcaatttgctcgtagcagccctgaaacttgcttacttccttctgaatgttaccccaaagtgctcaagagagtttgcattcctatcagactcaaaatcacagttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttccttttgcaccatttgttgaagtatgaaggtcttcattttgcattggcaaggaatatgcctcaacatgggtctcttcggacatcatgcacataaaggaatcacattcatttgccatcacaatctagtcactgcaataagtagataaattgacaacttctccaatcaatctcaggaaaaatggcagatgctagctaatatatgttggtagaatgcataatggtagcaaatttttccaatcattagaatttagaacaggttatgctagagctctacaaaattgaattaaaaagaaaaccatatagcaccccaaagcagcttattttttttctcttttttaacagtctactcgaagaacctgcatataactaacatcggtacaaataaaattgtgtagctcaggaaattaagcagcactacacccataccctctagaatacgatcacaagatttcaactggcacagtgtctcaaagtcatgcatattgaaaatcacactgaaaaccatatagcactatccaaaacttacaattcccaaaaccatattagcttgatccaatttatctttccccctgctaatttcagttacagtttttttttgtgttgaccttattactaatgcaattgtttaactacttgaaatcaatcatcattacatgagctcacctgaccatattatacatggattcagattttcatttgtcaatgaaggagttactatccaaactatgtttcctatacgcgtatgcatggctatttttcatatttctgaaactacaagattaggaacctactttcaataaattagattattcaggaaaaaatcaatcagatcattccaaagaaagtataattacatatggattatgagattaattattgtattaattaacagtcaaacatttgaggaaaacaaaatcacataataaaacaacaaaaccatctcatcgtggaaggttagttcctacccatttcttctccaaatatacattttcgtactgacaacttttctctcaaacacgctaggtgctaccatataactcaatccacaaatccactagaaaaatgaaaacatgataccttcaactagcgcaactagcaccagggagaagggcgtcaggatccaggaggatattgccaggtgggcaggtggccggccaggaaggagggcaccagggaggacgcctgcaggggaggagggtgccgccgcgccagccaggaggaggatgttgggaaggaggaggcctaccggggaggagtgtgacgggcagggaggagggcgccacccgggatgagggcgtcggcaggggaggagggcgccggccaggaggagcggcgtagatccgtggaggcgcagctagcgggatatttcacgtgaaaaaagaagtgcccgcgtgtctctgccgcggatgggggctgcggagaaagcccctgggactgggggcctgaggggataatttggaggccttcctattttaggggctttagtaggggccttattggacctgattttttagtctcaactctcaaaattagtataggggctgtgtttagaacctctactggagatgctctaagggaaaatatatggaatggagcctctgcaaccctaattagtgtggatccatcttatatatattgtcatcacataatatttcatgataggaaaaactataagctatagaactttaacaccgctgaggtcgataacatagcacacctcaaagtttaggtggatcaaacacgttagccacttgccactaggtcatggctgatcagtgacagtacatggtggattggtgccgccctgatgcttagaccattgctaagattttcagcccgtgtcaaaagacaaaaaaagaggtttctatttaacaaatactaaataaacagagtacattttacttcaatctatataaatatagaaaaattgcatgaatttcatgtgatcaacgtcaactagagctataccaaaggaacttactaactgacaacgatggtgatgatcatgactaagtaggaactaagaagaattatcatatcataaagcagtgattcagttctccttactaagcgaacaaatatagtggaacctttactgcctggaatgcacattcacatcatcatcatgagctttagttctttgaggtagctgtagccgagaaaaaacaagcttgttctagctaaataagtgaaagagaaaaagagactttaaaaaatagaacaagaagatcttaaaattatattaaaagtgcatttggctttgactggattataaaataagaggttattttttgaagggaagatgttgggttctggacagcaaagttgggtcacgtgttccactatgtcatataggacgctccgtctttggttgaggtagtgcactatgattaaatttacaatttttgtaacctgttattgaatttaggtttcgtagaactcccatccggttaatgaaatggtcgacaattttgtcgacaagagtttttttctttaagaattttgtgtaacacaatatataatatatgttttgagataggagatacagtaggtagcaaggccctcgtagcgatgtcgcaaacttacaatagaaggtcaggccaaagttataaaatttgataatttgattgtattaacacttgtggcaatgaccacgtgggaccttctcgagtctacgacggtaagtcaggatgtcaaataatcaaagtactccctccgtctcaaaaaaagtaaacctaggaggggatgtgacattttctggtacaacaaatctagataaagggctgtccagatttattgtattaggagatgtcacatatttgcttgagtttttttttttgacggagtacagtttatataggatgttaaaaaaagaagagagagagagagaaagatatctctgggccaaaggtagggtcggacaaatgggcccaacagccaatacggtactagttacgtagcccagcaacatggcgccatccgtggaacggaacgggcgtccccttcccgtgtcttatccactcccaacgttccattctgtggatgcttccgccaccgccaccgcccaacgaccagcagcaagcagctcagccaaggggctccccatcgtatcgatccccattcgcgccgtcctcttcttcttcttcttcttctcgattcataggtgtggtttccatttcttgctgtggttgctggttgaactagcttttgctttgcttggattgtgttttgattgaggggtttgttagtgttagcaatctaacccaagatatctttgcaattatatgctccagttaatccgtcaggcttttgttgcttgctgctgctgctgcggtggcgggtggggaggaaggatgctgattgcggctgatttcccgggagattcgacggtgtcccgatgcgcattccccggtttgttctgagtgatgatgcggtctccgtttcgtgatctttgattgatgagccgttccgcggtaagctctgaaggcggcattgcgctccggctcttcgtggactggaggatccggcgccggagggtctgcgcatgcaagatgttcgacactggttcccaaaggggtagggtgaagcagctggtggcttttgccaagaagaggaggcggcccaagaagcagccgtcgcggcggccatggtggaaggcgtggttctcggactggaacgacgaggaggagagcttgtctggctggagggaggatgaggagctgctcgaggaggttggcggcgaggaagggctgtcggacgacgagaagtttgagacgtggaagaggaaggccgaggctattgtcgagctgcgggaggcgcggcaggatgccatgaacgcggaagggcgctcgtgggaggattggattggcgggggcagtagcacagcgggggatggcggcggtgactggggtggggatttggatgtgtcagacctgataacggatgatcctacagagatagtgagggataaaggtttgattgaaactttcagagactctgtagatgaagattacaatgacatgctgtttgaagaccgggtttttctgtatgcttcaacgaattcggtgagctctttacctatcttgttttctgtcaccaaatgttataacccactgtccagtgataaccatgagatacttgtaatgctttttgaatatgatgaactacttcctccgtttcatattttaagtcgttttgacttttttcttcatcaaacttctttaaatttgaccaaatttgtagaaaaaattagcaacacctatcacaccaaattagtttcattaaatatagcattgaatatattttgatagtacgtttgttttatgttggaaatgttaccatatttttctataaacttggtcaaactaaaaaaagtttgactggtaaaaaagccaaaacgacgtataatatgaaatagaggtagtactatataatattggagtgcataatatagcaacaaactttaatctttacaccttacaatattatcgaacgctgagggtccattttgatggtaatgattttgcatctggtggctggtgtattttgaccattttgatgattaaaaattaaaaatgttaaaaagtgtagcagcattatattgttatattaagaccctagcaaattggatctaacaaaagaaagtttgcactttcaggccaaatttctagcattattgattgtgattccatgggtgttggattttctggttcatgactatgttctgatgccatttttggaaaggtaaatcctctcacagtgttccatttttactttcttaactttttcccctcacttcttaatgtaagaaaatgcattccatgtacacccaatctgatgtttaggaatttataaggtgaagtttcaagcactgatgatattctcagtttctcactctctgtgcttctgaaattacatgcgatcaataatcatctatgctaaatgcagaattgattacatggaacattacacaataacaggtacgtccagaaggtaccacttgctgctgagctgcttgatgtaaggcgcagccagaaactcctgatggtaaaggacataaatactgagaaagcaagatatcgttttgaagtagagattggtaaatctcctccactttctgatgatgagctctggtcagagttacgggaaaaagcgtgagaaacactctaactattatactttcttgccttgttgtaacttctgttgatgcactagcattgtctgacatgagcaatggaccttctatcctgcaatttcatatgttcaatcttaacagatctgctctgctacttgatcaggatagagttgagagatgaatggagattagaaaaccgaaaagcgtttgcaaatatctggtctgacatggtttatggaatttccctattccttcttatgtacttcaaccagagtaaagtatgttttatcagataagcagctttgttttttttttccatctttgattgtgttccaataaatttttcagctttctgagtgtgcatgtgagctaagtgattggttataaataaacaccccacaagttgacaaatttctgcactattaggcctctctcagagttatccgatttctgctgttaatacatagtacatgatgattttgtgccaaaagaactgcagtgatgaactgaccagagtattcccccattctatttgtacctggttatacatcatacttttctgacctagtgcagtagtaagaccacctcagtttctgcaatatgtttgattgttagtatcatttagtaacacatactggaagtccatgatttatgtacaatgaattcatcaatctatcttatccatcatcgtagcctatttttctctcccattgaatgcttagtgttatcctgcgtacaacttattcttattgcctgctaagctttcaggttgcgatgctgaaattcacaggatataagttactaaataatatttcagacagtgggaaagcattccttataattctagtttcagacatccttctagggtgagttacaattcatttttcttgagttcatatatacatgtggttttagtgtgaacctagtttgtaacaaagcatacactaaacaattgtgctatttcttttgctggataatggatgtcagcaacctaactaaaggcaaataacatgagttctaacctacctctctcatgtgttacctgcttatctaaaaaatcatacatttaaataagtaattcttgttaaaagaagattcgtccaaaatgttcaaagaagttaaagaggaggccagagctccctccaggggagagtgccttttcttttcagaaactaatatcagggggatactcagcagcatgttttagaaagcaattcattatatcttgtcatcatgattcatgagcgattttttaaatattctctcataagtatggataagtttgtaaaaatgcatggaagaaatattatagctattttttttgtcaggaatgaggcagatggttctgtgtttcttcttcgttcgcacttcaaatatgatcttaatatttcttcatttttctctctcttcaaagatgtttgtagcattcgtgtggcagaatcttatttatcatctagttagaaacttagaatagtgaacctaagtggtacagtatcccgttagaagttaattcacacaaatgcatatgaactgctttgcgaataatggaattcttcctgttcatgcttatgttatacatcatgacatcttttctgtttcaaacaaactatggatagtttgtaattttgtttctgctttttttcttgttttcatgtaaacgtaacacaaggttaacattgttttggtttgtctgtgatcttgttgactatattaacatcatttagctgcattttcacaggtaccattcagagtcaggttggcattctttggtagaagtcattctcgagcactacggccttgaagccgatcaagctgcaatcaccttctttgtttgtctggttcctgttgccttggatgtatttataaaattttgggtcagtccacttcttgccttcacacaatcaagctaatagggctatgaacatttattttattctttaaaaaacatttatttcattttatctttttttaaaaaagaatataagtgtttgttaaggcctcataatttatgactagtttcacccaaagttgataacattatagattcacgtttggctactcagcgctaacatttcagataatattaactgaaagttttatagtctttctacaaagtgatttgaactttattgctgggccgacagttattaggaagacaaccttttgtagatacaatttcatttcctgacactgctcttaaatcaattgttcaccttgcatgtgctagaacccattgcattttttaataactggaaatacatgttctcttgata

SEQ ID NO: 69796 - DNA, 623 bp, Oryza sativa
ttctgaaataaggaggatgctcgatacccatttaatccattgtgttgcatacgctggtacttcattttttaagtctaaacttctcaaccacaactaacttttttcatttcattttctcagcatgtccttgtaaacgcatggtaacacttaatttgatggagctgtttcctccatgaagaagctgttattttcctatgaatatctcatcaggttaacaggtttcttgcaagttcagaacaagaaagttgcctgagatgatgcaaactgactgcacaaacagaaaggcaaccagttggttacttcatcgatattacaggctagatcgatgtagcctggagactctgcaagtatgcatagaaacagagtggtctttactcttgttcattaatcaggatagccttgctgatgctgaagcagcaaaacggaagccggttagagattgcagcataaattggttccagtaatgctttgcacttcttttgtgggaccggaacttttttttaaaaaaattattcccctttggtgggtgtgtaaaacctcttttaacacaccccttttttttttccgtgtagaaatataagtgattctagcatttcccacatctatctatctattatattatt

SEQ ID NO: 69797 - DNA, 1084 bp, Oryza sativa
  unsure (1)..(1084): unsure at all n locations
aacgacagtagcggaaaaggtgatcctagggggggcttcagctctactccacaggcaaaactcaactggggtctgagccttggtcctctaacttcgtcttcagctcggaagcactacacttctgaaaagggggaaccatagtaaggctcaatataaccaccatactcagcaagccataccaatgatgcagacgtgcaaggagacacaagagaggtttgtggctatttgcataaatgcggttgcaaaacatttattgagcaaaacagtaaaactgtagagtaattaaggtaatattaaatatccactgatcaatgctacaccacattgaacaggcccaaccaacccacctgagctaaccaatgcattcagtcgatttattaagggtgagacaaatcacggtgaatctggtcgatcgcccataaccgcgggcacggctattcgaataattttactctggccagaggtgcagaactgtacccacaagacacaatccaccggcatgtcaccgtgccatgcatgacatgtcaccatgtcgagtgattttgacaagacccttcatataaccccctctgaccaagcacaccacacctcaggtttcacccccactcctcaacaggcagcgggcagtcccttctcgtgctagatgaatccagaagcgacanaggttgtcgcaggggccatcccgctccatcacacccactcttgcttggatgcttgatgccttccagggtttcccgtgaaccggtccttatttgttataggtgcgaccagcaaaatcatgcatccatagcccaccattaagtcgcattttaattggataattacgaccaatgaaacatggtcagatttcttgagcacatagctcgccatgatactaagatgtctaatactgtaattatcccatcaactgagctagttgtaattaagcatggctaagcatatagttctagctcgatcatcaaagtaacacaagctagtcgatttatcacccaaggttgagaaaggacatgtatcaattaatatggcacaagcaaacagataagtaaaccccgatcctatgtaattagtaaaacatgcatattta

SEQ ID NO: 69798 - DNA, 2036 bp, Oryza sativa
aacaccaaccggtactaaagattggaaactaccccctagagctttaaaaccgggactaaagatatttttagtcctggtttttaatataaccgggactattgtgaaatctggtcgaccgaccaaagatggtttctccaccagtggatgtgccctggaaacgaattcgcgaggactgaaacattggtagcttgcgttacctagtgaggcaattccggtggaaattgtgctgcaaggaagaaggttacaggaatgctactccgatgcctgttcttggactcccaattgaacttgagaccagaagtccccctgattatgctcatgcttaaaatgatccatatgtttctttatattatcatgtatttcactttctcagtttatgctttctacagatggttgaagagttggagtgttgtaggtgtaatggtattcagaaatgctgtgagttgtgatcattgtgtaaaaaaatgtggaatggcgcataatattataatgcgattataaaaatagatgcctaagaggttccttttcttttctttttactaaaagaggatctacggtatgccactaggtaaactagatgaaacctgacgcgttgttgcgtgagttttataggataatagtacaaataacatgcagatagctacacggtataactttatatgtttttcatctgtgatcaaccatgggaaaaaatataaacaattaaaataatatggtttctaacaatttaaattatatataaatatattattcgaaagcaaaactaaggtgatatgcctcaatgacagaaggaaaataaaacgaaaaaaaagacgatatagattaatcattcaaagagaaaacaaatatgatgtgacttcgtaggagaaagaaaggagggacataatttcgaccataaatcaatcgttcaagggctagaaacaattaaggtgatgtggctcaaacagataatagagaaatagcattcactacacgtagtggggatgactttatagatttataggatgagccagctggttactttatctggtatgcatagaagaaaaacgataatgcaaaattacccataagaaaaggtaatactctataatcagtaatcacaacaaatcagcggtaggcaggtgatttccgccagtttgggcccaaactggccttgggctggtctgaagctggctacccccatcatgggcctaggctttttttcggttttagattttttttttaatatttacagaaataatctatcgaccaaaaaaattgcagaaatagcccctgccgcccacctctgaggcggcaagctgacgtggcaaacgggggaggaacgggcggtgacggagggagggttttttgcaggaaaacccttgccgccctctggtggggcggcaaggggcccgaatgcaaaaaagccagtcggggccggttattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgctgatttcaggtaatattcatagatcctatatgtgactattgagttaaatagtgtgtattctttaaaaatttgtttgaataaatgcattatatttttagggttttagttgtactaacctagaagtgcgtattgtagatattggtaactacgtagatctgctagttcggaattaatacattaccgttgcatttggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttatataaaaggatggttaatgaggggcttgagagttggg

SEQ ID NO: 69799 - DNA, 20233 bp, Oryza sativa
tgctaatcggtatttgtgttttcagcctcctcgtcctccaactcatgttcctgaatcaagtgaaaacactccatcggctgcagacagccatcatgtggatgaagaagaaaaagctacaccagctcctgctattcctgtaagtatataccttaagtctgcaaatcatatcggctgccatctctttttacataactcataatcccaacgtttctcttttttaggttttagctgacatgttctcttttgacattaggcaattcttggatgaagaggaagaaacaacaagcaaaactctggtgcccttagctgatgatatcaagtcaactctactacacatctcaaaaaggcttgaaggctctctagaaatcttggtgacaagctgtggatccatccgagatagacttaatgaaatccatgacaagatcccggatgagctagcgaatgccatcactccagcagcataccttaagcagcatcggcttaaacttgaaaaagcccaaaggaggattgccgatcagcgtgaaagaagagatcttgaggcaaccatccaagctaacagggtttctatcaatgaaaagaaggcaaagcttgatgaattggaggctggtacaaaccccactcaaactaacattgatcggctgaatgctcgaaagatagaactcttggctgagttggagcagtgcaatgcaccggtcgcccttgaacagcaaaagcttgctgacttgccaaaaggcattgaggatcagaagtcaaagttgaaagtatctgtcaagcacttggccgatctgaccaaatctctgaaggtgttcccaagcactgatgcagccgatgcccaaatcatagacgaagtagatcatattaggcaaagggcaatatcggtcatccaaaaatacatgtctggatgagctaagtcttgtaattccaactttaaatttgcaaacttaacttttgggacgtaatataactttctgcttgtgaagcttgctcttgaattttgcttttgaaatccagacttgtcatatatatttgcccccctaattatgcaatgttgaagacattgataaaattataatttggactaaggacgatatgtcaaatatcggccatcatacatcggcaaagcacaaccgattatgataagaaaaatccactaagggcaatataatctatatcggccatcatatatcggcaaatacagccgattatggtagaaaaaactgctaagggcgatataacttatatcggccatctcaaggcgatgtcagcacatcggctaacatgtatcggcaacacttagccgatcatgaattgatccgaacacttggataatatttctttaagtattttccattacgagctcgtccaaaaacttcaccatcaagttcttgcaacatataagcccctttgtacacaactttgtatatttgaaacggtccttcccaattaggtaaccacttgcagaatttattatcgcgagttcctattgacaagatcaatttccaaactagctcccctttagaaaaggatttgggcaccacctttttgttgtaatgccaagcaacttgttctttatctttagtcacctttgcaagggctctcaatctggactgaactagatcttctgtttcatctaccataagattgtaatactcatcggctgttaagttatcttgtagatctattctccttgagccgattgtagtttcccatggtaagctgcctcatgtccacaaacaagcttataaggaggaacttgaatcgatccatgacaaccatccgataagaccataatgcttcagccaaccttgtatgccattgccgaggaaaatcagaaatctttctcttgattaatttaatcaggctcttgttagatgcctcggcttgcccattagcttgcgcataatatggtgaagaattcaacaatttgatgcccatgctatcggcaaactaagcaaattcatcagaaacaaagattgatcattgatcggttgttatagtctgaggaatcccagatcggtagataatatactccttgacaaactgtattgcatccccagaatcgactttcttcaaaggaattgctttcacccacttggtaaaatagtcggttgccaccaatataaacttatgccccttgcttgaaggtggattgatctgaccgatcatatcaattccccaacctctgaacggccatggcttgattataggattcatagccgatgctagtgctctctgaattgctccaaacttctgacaatcttgacattctttgtaatatcggaagcaatcctctaacattgtcggccaaaaataccttgtacgccgaagcaaccacttcatcttgtgagctgattggtgagtaccgcaaataccttcatgtacttcgcccatcacaaccttagcttgatcggcactcaaacatttaagcaatacctcatcaatcgtctgataatacagctcatcatccaataaggtatatttcaaagccttatagcgcaattttcgtgaagccgactgagatgaattctgcaaatactgataaacatcatacctccaatcatcggctgtgattgcagctacctccacctcaatatccttcatcatcggcttgtatcctaacgctccatgagccaagtcattagcttcaacgttctgctcccgagagacatgcttcaaagtcaccagacgaaaataattcattagttctcggcacttctcgttgtagatcatcaaaacatcatttttgcattcatattctcttgccaattgattgatcactaacaaagaatctcccatgatctccacagcatcggcttcaacctccttgagcaattgcaaccccttgagatctgcttcatactcagcctggttgttggtcgcataaggtttgatagtataagcaaattcaaaacttgccccccgaggagaaattataaccaagtcgataccacaaccaggagtgcaaagtgacccatcaaaaaataaagtccagggcacaatctcaaccgagccgattgaatcatcaggatgttccacaataaaatcggctatagcttgccccttgattgccttgggtgattcatatctgaggtcaaattctgttaaagcatatatccacttcccaactctccctttgaggaccagagccgacagcatatatttgatcacatcagctttgcataccacagtgcattcattggataacaaataatgcctcaactttgtgcaggagaagtacaaacacaagcataatttttccatcggagaataccttgtttctgcatccaagagccttcgacttaaataaaaaatagctctctccttgccttctagctcctgaatcaaaaccgagttgattgacttctcatcggccgatagatacaacctaaaaggcactcccttttgtggaggaattaaaactggaggggaactcaaatatgccttaatattgtccaaagccttctgctgctctgccccccaagtgaattcttgatcggctttcaaccttaacaaaggtctaaaaggttccaatctcccagataggttagatataaaccttcgaacaaaattaatcttgccgatcaatgattgtagttgtgtcttatcttctggaggttgaattttcttgatttcatttatgctcctttgagatacttcaatccctctctcatgaataagaaaacccaagaactgtccagctgatacaccaaaagcacacgtcgtgggattcatcattaggccatattttctggttctctcaaaaaccttcctcaaatcggctatgtggtcctctacctgttttgatttaacaaccacatcatcaatatagacctcaaccaacaagccgatcagatcatggaatatgtagttcatggccttctgatatgtagctccagcactcttcaagccgaaagtcatcacaacccactcaaataagctgattgcaccaggacatctaaaagcagtcttatgaatgtcttcttttgccataaaaatctgattgtaaccagcattgccatccataaaacttataattttgtgacctgaagtagcatcaatcaattgatcggcaatcggcattgggtactcatccttaggggtagccttatttaagtctcgaaaatcaatgcacaccctaagtttgccttttttttcttgatcattggaactatattggaaactcactcgacatatcggcacggttgaataaaaccagcatcatataatcgagtaatcttagccttgatagcatcatacatttgggccttacatctccttagaggctgctgatgtggtttatatcctagcttaataggaagccgatgttcgacaatcgatcggctgaatcctggcatctcataatattctcaagcaaagcaatttctatattctttcaatagctctattaacttggttctgaattctgcatataaattcttactgataaatgtcggccttggtctatccctggaccaatgtcaacttcttccaaatcatcggccgacatgaaaccctgtccttgcttgtcatcgagatcatctactgtgtccttagtgtagaaatagaaatttgaaccctccacgatgctgttaacgccaaaatttggtaagcccgaagtcatcatcggcctagagtcagtatcggcttcagagtcttagaatcggccgatgggagttgtcaagtcgccaccagttgtgttcttgatggaatcggatcaattaaagaaaatttatctagaagagtccgaattcaaggaggatgcggcatgtcaagttatctattaattaggaatagttttttttgccgccggagcagagctcttgcctgcgcaagaccaccaagacaaaccccatcttctcctctacaaccgtgttgacgtataacacgaggcctgggagatctgcttaactccagtgcaagtccaaaactcgccttccggtatgctagcatgccagttgatttgatcttgcaatcaacaagaaataaagacaaagaaaccgtggttaaatccataaatgatagccgatcggctaagtgccgatgatatatcatttatcttcgagccgatgtcatatgtaaatcgatcggcagttataaatagataataaagaactaaatctattcgatcggctgtagatattaaaaatatataatcctggtgtcgatatatacttaaatcaagtgattgggatagatcggtcaccgtgctgagacagtataaatcacttagatcgaaatatatattaacaacaaaactatatatgttcatagcatagccgatcaaatagatctagcatgtatcggctaatactccgatacaactctatgttaagatattaaaacaagcagaatataccagacagaaacttaatatacttagatgcaataagatcttaatataaaaggcagatttaacatgtcaacgaagcatatagagcaaatataattaaaccagataagatcggctgacactccgatgctaccctaatcagcaaccagaaggcaggctagagattgatattctaagcacgacttaatagatcaaactcaactgatgcaacattaagtatgaaaagaagagcaatatctagacaatcaagtcgctggaagtttcacagggtggtagatatcttatataatctaaatcaacaccgatgtctaacctaatcggctgccctctaccgatagatattagccgattgtaggttagatagcgatattgccagagattatgtaagatatataataactcgacgaattacataaacaagattagagtatcataaagatggaagcactaatcccgagaacgcaagccgtcataacaagttttacctcttgttgaagatcgaaaccgatgcagctcaacccgaaagcaagaactcgtcgaaataaaactaaagcaaaagggtggcgatgcgccgaaattgtattgaacatgtgtgttaattgattacatggggttcaggatctatttatacccgaaaattacaaactatgtccatatcggacatgactcttatctctaacaaactctaagataccataagtctttacggcagacttttacccaaacatatctgtaaggaatttacataaaatatcctaattaatagatacaattgacttctcaggactctatccatacgtggcaatcatcttgaagcatatcaactcaactcgatgtcgtacataagtcatattgccggaatcggctgtatcacttaacccagtctgactcggacttagccgatccaatcgtagccgatccggactccagccgattcctactctgtttctgcaacaatcttcatctttgattctacttcgatcttatcctcatctccgatactgatataaccaaatttggttgttaacaaaccgacttgattcaccgcctctcactgcctataaaaggacgacgaggtcgcccttttcttccatatccatccgagctctctctctctttcttcttcatgtccagctatggccggccgtctgccgatctcccttaccggagcgttgtcggccaagtcctcgcgccactagcttcgtctcatcgaggcgaatccatttcacccctttcccctttcccttcctgaaacaagccaccacaacctcctcttttgctgccagagcagagctcttgcctgcaccgttccagcctcctctctcactttctctgccgactgtcaccctccccgggtgcgcgtcgctcgagaacatgttttaccaccgacgttgcagcctctcaaccaccggagtaccggcgcccctcctctcccttctctctgtttgttcatggagaaagagagaagaagcaggaggaaggaggaagaagaagaagaagaaaaagagagaaaaacaaaaagaaaaagaaaaagtctgacaggtgggcccctgcacagtactactttatattttctagatttaacttgaatcctattctttagaagcccatatctcctaaaccgtagatccgattccagttaaacttggacctaaattcatctaaattcaaaccctaccttttgataccaaatttgctatttaaatattttatttgaatttccttgatttatttaaatgtcatttgcttttcaaatatctccttttactccaaaataccctttagccactaaaagtcgccggttagaactttacgccttccatggagacgttcgtgtggtatattggccccgacgtcgaaccgttggttgtaaagcccggcaaaacccaaacccaaggtcaaagtgctgctctaggtaccccacgcctcgatgcgtacaacggtcggagcttcactattccctcgacctccacagcacgtcgcacaattagctctcgggctctgtgtgatcttagccgctccacaaccactcacggttgtcggagtaacacttccgccccactaaattaacctgcacccaccccctattcctccagccgatatgttgtctgctgacaccggctagagaagacaccaaatctagtcgttatgctgttcaacactagcatcgactagcacacaatcaaaccctagctgataccttgctagataaatcctagccgtcatccaaattccacacccaccagtatcgcctatccaccctactctcagtcacctactctccaaacaaccaagacccacacatgaaatataagtgacatttgttgcttgatcccctttctatcttagcctccaaccctttagaacccatacatgaaatattagccaataatccctataccttataaaggagatatttataccccaaacccaacatttcttgcccttcatcgctttcttgttattttctgacttttattgaatttggttctttctcttctttagtagagtctattttggatggcagcctgtgatatttcgaggatcggataatcaggttgcctatcttggatatatttgcattggagcaaggcaagttattattccttccctttgagcataaatgccctatattctatattctattctatgccctagccatacatgattttgaatgcataatctgaacatatagcgaactagttatatgctagcttttgcttagccctgcctagttagactgcataaaatataatgaacttagattggaacagtacgtaagatttggttgattttcgggtggctagtactgttttggtcgatataagtttaccaagtacttatgtcaaatgaacgagtacgaccgcagcttctagaatggggacagacctagatattatgttaattaacaatgtggtacctctgtatagtggttcttatgtaagtcctcgcgaaggaggcaaacttacgccgagcagggtgattgtaatatttaccgaggcgcaggtaaatatttgagataaattgtaatatcacgaactctgtgtgtattgtgaaaacctggttgagatgacgggagtctctcaaccagttctctccaaaaaccccgggaacgccagaactcctttcgctgctgataacgttacgttcagagcacatggggactcaagttcatggaacaggtaccacaattgttgataacctaatactgggccgtgactaagctaatgaatattggcaagtcgtggattgcgagtaaagcgtacatttactgcagtaaagtataaatgaatctattcgaatagttgtgctcatggatttgagtattgggactcatatggtatttggttagaaacttaattccgaaacttaaatactgttgcatttaaaacattctaggctttcttactctatattctttgctttctgcaagtaaacctagctctactcaaatattaccatttcatgcattcattattgaatataatagcttgctgagtacgttgtactcgcccttgcttcaacccgctttttcagagtcaatttgatgttcttaccgaagccgggagttcaatcatataagttagttccattctaacttaattctcaagtatagactagataaatggtttaagtctatatcaaaacattagagttgagtcattctatagcttctgctgtaatagttagccacaaacttgtaaataccctaatattattctgtaataatatctcctttgaaaccttgaccaaatatatgcaatgaagaaccaaattgttgaacctgtatcaatctactaatccagggcttgatacagtctaaccatgtcggtttccgaatcattagttttgggacccgacatgtccgcagccgatgttatggtttgagcctaagtgatgagcaactagccgatctcgccttccaaggattgtcagcagctatcagagagagattcttttgccacgagtttgacaaccatgctcatctaatgcaaatagtatcagctcatgaaagccgattacaagaagcaaaggaatattagttttggggttatcaagatcagaaagaagataattttgaagcatgagttctcatactccaaaactggggggcatgtgttaacgttaaaatttggtaagcccgaagtcatcatcggcctagagttattatcggcttcagagtcttagaatcggccgatgggagttgtcaagtcgccagcagttgtgttcttgatagagtcggatcaattaaaggaaatttatctaaggattactggtgtggtggccctgttctctttttttttttgagcttcttttcgttaaattcatttttctctcttagatgtgacatgactaaatacagcgctgctgtaaataaaaaataaacatcttctgttttcattgttttaataggtaaatataaagatttttaagtaatatttaaaaatagtgctgatcaacgacattgtcactttattaaaagttttagtttgttttttctccttttgagtttgggcatataccaatattgagataggtaggctaaagttaattatgttctatttttaatggattgggtttgtaatatcttgcatgcactcatatttgtatgttttgccttgtgagagaaatctatacagtttttgtgtgcgtggatgctgggaatgactagaaattcatagcggaaggtttcaatgaaatgaaagaaaaaaaagcagtgtaggaaacaacgcggaaggcatggacttctagttgtagattgggtctttgtgaataaacctggactcctaacctgctctggacggacctggactccagatggacatgggcacaatgaaggaatgtacatgtaaatttttttcctattaaagagctccgattatgaaaattaaatcaaactgataattttctgttcgtcacatcggtatttcatccgtaaatccaatccagcgatgccctagcctccgttctcgtacgcactttgtccctaccattggtgattgctttccctgcggaaaagaaaaacgcatccgcacggtgcaggattgaattcctgatcgactaggatcgggactgaatggatcgtgttagctcctcaccgtcaccggtgtgcctcgcgtcgttctgcatagagatggccactttgcatagcgatggcctccctggtgggccagcttgttcgtcgggagcacctccgcgacgccgcacgccaagccttgagtgtcgtggccttgagctggggatgaccctggacaggcaaatagccccgtgacactcatctcggcggcctgcactgacgccatgttggcggggtcgacatgcttggatccgcggaaaggttgccgatggttgtagtggtaacttatcaacgttgagatacatagcaaatgcaaattcgttgagctacaccctccaaaattatcaccatagatgggctcatcagtaatgctccatatcaacacgacaatatggaattcacacgatttacacaactcatatgtataaaatttggagatatttgcgaggtatatacaaattcaatgtttttatgcacatgtgttataagtacacaagcaatcttatctatcaatatttatattcacccggtgcaatgcacgggtatatttgctagtacagtaataataattcttgttgtagtagtaatcctgggaaaaatatataggaggatttcccatctagaatatccaaaacgaccaaacccatctagaatcccagatttcccattttacccccgggcgcaaaccctcgccgcgtctccccgatggccggcggcggcggcggcggcggctccccctcgccggtagccgcctcggcggcccccgtgcaggtgcgctgcgccggatgccgcggcgtcctcgccgtggcccccggcatgaccgagttcatctgccccaagtgccgcatggcgcagcgcctcccccccgagctcatgcccccttccccgcccaaggcctcccctactccgccgcctcagccacagcctcatcctcagcttcagccgccgcctcttcctgctcctctccctcccccttcccgccgctccgcgccgcgagcgcagggcgtggaccccacgaagatccagctgccgtgcgcgcgctgcaaggccatcctcaatgtgccccatggcctcgctcgcttccgctgcccccagtgcgacgtcgacctcgccgtagacctctccaaactccgcaatttcctcgccacggccggtccaggcttcgcccctccgcttccgcttccgccgccgccaccaccgccgatgccgcccatcccgctgccgcacatgcccttcctcccgatgatgccacatgttccggtgccgatgccgccgatggcatcgcccgctgaattgcccgaggagattaatgaggtgagcaaccagcattgtactggttacagatttacagttgtggtggaatgtgtgtgttatttcaggccgaaatattacagttatggtcctactgctagctgactgaatttatgtctgaaggcttaccgttttctcagaatctgtcatgtatggatgcccatgctcatgttatgcttaggagagctttggctcactggaacccttttagagtttttttttaattttgctgtcaaatcacctctacattcgtggttacccgatacccatggggaaccgcattatagtacatgtgttcttttaccaggaatcctataaaagatggtattgttgcctcatgctcatcatctatttccccccagttggtaataataggagagcagtgaacccataagttgggtaggctatggcctatgggacacaacttctaggcttgtgatttccagaaacgaaacttcatggaatgaaaagctataacttgcaccattgcatggacatgggcttgatttatttttcttgtttgcttctggacaaacaactcggtatgatgactgtgacttgttacgtcatgcttgttttggggttgggagtgtcggatggtatcttttatgatcctatcaataaaggaattttgagattggcaccagaaacctgtttctacccttgattctataaaatataagtgtggcttctcacaattccatgtgattctataaaatataagtgtggcttctcacgattccatgtgaatggtgaacctgtttttaccctttgatactgttgtttgggcactgcccatacagtttggcccacacccagtttctatacgctttccatactgaagacaatgggctgaattattatttaggtatttgtctcatcattttcaatttttttttgtctatatgcaagcatgaaaaaataaaccttatatttttgtttggagggagtatcattggtgcacgtgaagtcttgagtattccataacattctgtcataaacattcagttgttttagcgcattttcactcaagaaccaatgccactgccttcttgctattatactggggttctaactgtagctatcttcaagcaggttgcagttgatgttgagcgtgaggaagatgaaggtggtactgtcggggaaacttttatggattacgtaagattttaggtttttgactgcttttatagaaaatggagggtagttccttcaagtccaagatctgtttctgactttctgttttattttttatgagctctaattttttgccatatttgttttctatttccagaggcctcccaagctatctcttggtcttcctcatccagaccctgtggtagaaacttcatctttgtctgcagtgcaacctcctgaacctacatatgacttgactattatggatgaattggatgagaccaaggtgttatcttgcttacaaattgaaacgatagtgtatgcttctcaggttagttatcttcttgctgttgacacgtccttatttttaaatttatgtatgtattgcatctgttgtaagtctagattcttgtatgcagaggcacctttatcatctgcctactggtgctagagcaggtttctttattggcgatggagctggtgttggtaaaggccgaacgattgctggattgatctgggaaaattggaaacagggaaggcataaggcattgtaagaacatatgaaacaaaaagaattcagtaacttatctgacaaaagcacctaactatttgttttggctgtactcatgttgtttctgcccttatgcttctgacgatgaattaattatccaggtggatttccattggttcagatctgaaatatgatgctcgcagagatttggatgatgttggtgcaaaatatgtggaaggtatgattctacgcatgcatcttacaacagttatctagcaaaaacaaaaaaagagttgtaactcacttggattgatgctactgtatgcaaatacaatattggagaacagacacagcaatgtggtcgtgtttgaatcttctatccaaacatataagctggcatgcaatgttatttataggccctgcttgggggagcttttggcagctgcagcttctgccagaatctcaagctcccccaaacagtccagattcttactcagattgtgagaatctgtacttttagaatccataaaatggattagaagccagaagctaggaaactcaccttctccagattctcaccagcagattctcagaattttaagctctcccaaacaggggccgtattaacatattagatcataacagagaacaggtgacttgaaaataaaaatgcaataaaccagagaaattatcaaatccatttgtggacatttgcctgcataactaaaacaggaaagggtctaagaaagtaaactcgaattcattttcatgtatatgtcaatgcttagcaagtttacattgggcataaatttctgagagtaccaaaacacaactctgtgcatccaaattggtggttagcttcatggttgttaaggcattgctgtggtgtcgacaaagcggtaagcaggtgcaggggctaaggcgttggctctgctttttaggaaaaccagaggagcaaggaaaaaaggacttaagctcatcatggaaccctagttggcggtgtttctgtcccgcctcagatctgtgctaccatcctccactctgcctcacggtcaatgtcctccctgtcccgtcgttgagaaaattgatagaattccattcttcaaagtgggctttgataagatgatatccccttacattgcactctttaaaatgccagaaattatctcttctatatatttttttcatttaggagattttaagtctgctttagttcttttccatagcctggacatgtggcttagtcaggacctgactgagccgcacccatctgtctagagcacatgtccccgttcctcccacgcaggtggccgcaactgcaagactagcaagagttcttcctcccccgggacttttggctctctcctaacctcacgctgcagccgctgctacgtatctgatcttgcaccaccctgagctgttgctgtcgcattggatgctggatgggatgtagaccagtgccacgaactccagtggaatgggcatgagggcatggcggttgttgccgcgggtggttcggttgtcacttgcttgttgaagaagcctcaagtcatgccttcggagaaaaagggacatgcgagataaatgtgtcttctcaagtacccagaatttggaatagaaattaaaatagacttagccaaagatggcaaaatatacaagaggcaaggtagagtggcattttaaaccatgcactttgaggagtggcctttatgaatcctctcctggcatgggtggagagagaacctgtttggctggagttaagtgcaacgtactatagtgtggtggctggctggatgtaattctgtgccatatcttttctcatttttttttattgtgcaaggcatggctcgcgttatgctgtctgtaaggcagggtcagggtcgccttacaaccattgttagtgctgtcaataaactggcctcggcttcagctcaatacaaaacttagtgttctagggatcctagtgcatgcttcgtggaggcaggctctgagcccagatcaaggtttgagcaggctggtgcttatattaaggaagcttgataacaaatgcggatccaagttctttatctttagttattgtgacaaatcaagtataatcaacactagactcatcaagattttgagaccaaaagagaatggattcataccaaatgcctagatcatgtaaaacatgggcatcaggacatgtctagaacttgtaaattcacagcaactgagctctgatagacaaagctcacgattctgggcagctctagctaggatcatctggagctctagcctagtttgaatcaagctcagagtgggcggagttcaagcaggttgtaattaataagaattatctatttcttaaataattaatcaatatagtagtctagggattagtgaactggtatcctatctgttagtttagaaggctattggtttgttcaagatgttagagatatgatttttgttagttaggcaagtattctattcttgtaggtcaagtactgtacacatcagcagtacccatggctgccatatccgcataaaagtgctcacgtatgcaagtatcaatcaactagccttagggcctctgttccatatcaggaagaagcctagctggcgaccagatgagggtgtctttggacacctaccaatccaattcatataaacaaatcttggtaaatcttttcatggatttttctaaactggacttttaagaatgtctttgtaaaactgcatgtgccctacagaaactatcactaaacagcacttttaacccattctccattctatccaatggcttctccccatctagaatggggagaggataaatctgtagccacatggatggacattgcatatcagcatctgacctattactctctttaactgacatcgtgaatgtgacggcatgctggcgcatgagttgtgccctttgactacttcctattacaagaagggtagacactgtcgtatgtcacatgtgggtcctggccaaattaaattatacactttagtggtagttttgaagtgatggaatgccaaatactcagcaataattatatatatatatatatatatatatatatatatatatatatatatatatatatatatatatatatatatatatatatatatatagaaaatcatgagctgcagttaccaatctgatcatctcaagttagcatgtaagtttttttaacatatttcttatatggtttcctctatatcaccaaaagtgaacgatcttaaaaactgactcaaatatggatatgtatttccaaaagcaaacgaacttaaaaaccaatttatacacggatgacgtatcaaatatcgacaaaaacatctttaatttttataatagtagagattaaatataatcttatcgtattttcaatcggtacttgtatgcagcttgtgtggttatagccatttatctcaaagcttgatatagccggttcaactcttggcacctcaatttatgcttcttttttttttattttttttggtgtgttgcgcgagctgcttggtgacgcctgtcatcacgtcgtcttctagcgcatggctcgacgtttatctcaccatgttgcacgagctgtttggtgatgctttgttttcacgtcatattctagcacaacctgacccggcccatggttatgacgctggcattctggcaatcacatcgtcctcctacgtgacgccatcacacaacttcttgggctccatgacgtcagcgagcggctagaggcaagccaaggtgagcatgcagccgcacttgcaattaaaatgcacacaggagtttatgcgttgttggctggttgtctaggaactcgttggagttgatgcactgttggagacgaaagcattcgagtgtatgcaagggtatagaagtccaaagtaatcattcaaatgccaaaacatcaagaattctcatgcaaaggacccaagcgtcaaacatcaagaaatatagtacctagggagtagatttttttgacagtatggtggtgtttgaaaatcctgaagataaagattaagtgtttcacgcaaaacgagatggtagtagcgtgtgattaattgagttttaattattagaaacttgaaaaatggattaatctggtattttagagcaactttcatatagaaagtttttacgggaaacacactgtttagcagtttgaaatgcgtgtcacgagaatctaaaatttcattcaacaattgttggacattcgaacgcagcctatggcttttcataacacgttgattatttgatcaagctgaaataagaacactcaattacatagtcactttcattttgcggtcaagcacggattggaataagcgccggtttgacatgaagttcttgaaaacacagggcatcgagataaaataaaaatttatatgcttgttattcatacatctggttaggttagagggtcaacctagattttcacgagcataagcagatcctagattgcacatcaagggtgctagccacatcctcgcgcgagagagagagagatcgaggtgctagcgcatagtgtaaccatcaccatgcgcaccttgcatctcagcacaatgaaatgtgtaacctatcttttatccaaaatcaatcatttcatttcgtttaattcgtagcacaccagagataaccatttctcaaattcctctttcttatatcgattaatgtgtatagctgttcttttcaatgcatctttcctttggcacaaatgcagtaagcaagcttatttcgttaaatagtagcttccgcactctttctacttactaaaattaatgtgaatgatcagggccctttagaggttctaatcatggagcacaaagctaccaaaaatgcatagtttccttcaaaaataactactcccattatatgtagtggctatctctcttaacttatcttacatgtattggtatctctcataactccttatcattctttcttttacttaaatgttaatttgcactaatatttttctcataatcaaatacataatcaactgctttttcctagttctccactacggtgagcactggaaaatacagtgtaagattcaaaaattatagtataaatatatggaatttaaagtataagatatagcatagtataagatttaacctttttccttgaaaaatatgacaacagaaatatagctagccattattaaatattggttatccatgcaagcatactaccatcgaaaataatcagtcaaatctgccattcacaaatatagacatttcttcttgctacgcatgtagagaaatacttccttcatttcatattataagttgtttgactttttttaagttaaaattctttagttttgaccaaatttatagaaaaagcaataacatctatgacaccatattagtgtcattaaattttacattgaatatattttgataatatttttgttttatatttaaaatattaatatatttttctataaatttaatcaagcataaagaaggttaactaagaaaaaaaatgcgtaacaagacttatcgaagtgcgtaacaggatggaggtagtaatcactaggcactcaaacgctgaagcaactacgtcagtttttgactcgagtagttagagataagtactattagtactatgtttgtgcttataagaagaatgtaatgaagcacgtcaccagcattttgttcagcttaaaagcatcccattagaaccaagtaattttccagatttgtgcagaaaattgaactagctcttgtgaaaatatttccaatttctcataaaattcatgtggtcggaagtaggaggatcagatcttttcaggaagtcaggaatgttcagatcgacttctgcaaacaggccttcaacctgtacccaccttttctgttcatcagacaaaattcctgctacatattgcagcatgcaattaaaccaggcacaaagatattttttttaaaaaaaaatccaacgcatagatcgaattcaccgcttgtaaaaaagggagcaatttctgattgaagcataggtatttcctcacatgcatgaattgaataatttcctgcaggaacaagaaaatagtctcatcccgcacaccaaattggacctaaattattttcttagactggcctaaattccttgataacattacaaatgccacaaggaactacaatggagaaaaaagggggaaaggcaaattcctactgcagcctctgctgtttgtatacatatacatagttgtttcgaatttcacataacaaaaagatgaaaacacagaaggttcgatatgtgagcatcctgggacaaaatcgctcattatcggtgaataccgcatcaacctgaatattcctggatgatatgtgtaatcagcacattttttttatgtggagagtatatatactacagaatgttatgtatgccttttgtagggtaagcactggttagggcgacctccgaaattgcaatccatggcaactatgttggcatttcatcaatcagacactagccccgagtgagccctgcagcagagtagctttcttcagaaactcagattcaaatttgctttctcaatgaacgattaactgctcacagcaatatgtaactagttcttttgtcaatcagacatgtttatctctgtttcattcacagtctggttcaaaaagaaagaaagaaagaaagaaagaaagccaatatttcaacaatttaagaaagaatcaagaagcacctcgcaaacaccatcacaaaaagttgctaatgaacctttgataacaacacaatacaagccaaaggtatataacaccgaatacatacctggaaggatggtctttccttcaaattcttaatggaatgaattaagcagatcaaattcctgat

SEQ ID NO: 69800 - DNA, 754 bp, Oryza sativa
gcaacaacacacactttgcaacccgtcgaagaacggccacgccacaaacaaccgcaacacaccatagccccatcggagatcacccgatcggcgtgattggcggaagcatcgatcgatcgaccgagctcctcgcacgggctccgcccctgccgatcgcgctggaaaaaagcctgcagaagtgcagatccccgtctcccgatctcatctcatccaccacgaaatccacgatccctccacctctacggctctacagcgactccacgtgacctgacccaacccaaccaacgatcgggagccagccgcctcaaccgcgcaacagctagccagcgacgactataacggcagccgtatccttcgcaggtagaacagtatgaaaatcaccggtgattgagcagtataccaaaaagatccactctttgttagtatctgaacgatctttgattctttatcctgaagctaatgctttggctcccatgtgaatactagcagtatgctagtagtacgatgatgatgatgatgaaacaaaggaaatggagctctctaaacatgccagtactatgattatcaaaagcctaaaaaagggccccatttttatgtacagatgtctttcaaagtagcaaaattcgatcgagtttgcgtttctagtgatgtttggttgggaattcatcagaagcttgtgctcagaatgttgagcagtgagactgtggtgttcaccagagcgcggaacaccttctcgccgatgctctccacgtcc

SEQ ID NO: 69801 - DNA, 1110 bp, Oryza sativa
tcctgcagcccgggcctaatcgccgtattttccgtttgttcagttgtactgtattggtagtttgtcctttactcctttttgtgtggtagtatacattctttctgttgtcgtaattgtacaggtcacatgttctcgttaaatatacgtattcgttattcaggatgcgtatctcaataactttgaaatatgtatttggatgatcgatctatcatagtgaggttttcattaccacgtaggcgagcaagaggcaatgcatgctgccctcgcagaagatgccggcgaggaccttaacgacgtagtacacgtagaagtacaccttggagcggttgcaggccagtataactgccagaaaaaaaagtggaaaacatatgaaaatgtgcacagatgcattatgcagtttcatcaagctagggtgacccaagtcatgctgcaaagagcatacacaacggcagaatggccacggtcaccggcagtgtcatcagcgccttcctgccgtatttgtccgacaaattccccacgatgggagtcaccacaagagcccccatccctgtgatctgcgcaaattagccaaaagccgttccattttcacaaatcccacccgcaaaatgtgacttaaataatccgaaacgcgcgatactcacggcgctctggaagccgctgaggtagatggcgacggagcactcgtcgcggccggggcagacggcgtccatcgtcacgtcggtgatcgccgggatgaccatgtaggaggcgaagtggaacatgaacgccgccacgaacaagtgccccagcacagccaagtccttcatcctggcgtctctaccaaatcgacagcttaagagaaacacggttaatttgcatgccaaaactccgggtctacgttttatactcgcatgcacggcacgcaaggacaagaaaaatatacatatcgccaatgcaacgcttccaagtaagagaagcagaaaaaccgaagcatcgatcagtcgctcttgcttagggtgatcacccacttgatctcgtcactaaaagtgaccctgcatttttgccaggtttgcacagttatattgcgccttgtgaacatacttttacgtgcccaattccccaaacaagcca

SEQ ID NO: 69802 - DNA, 684 bp, Oryza sativa
cgccgctgtcgtcgcgctgctgcgcagccgttgttcgtgccgccgcgctcgccactttgaagccgccgcgcagtcgccccggagccgccgcgccgtgcgtcgccgccttgcgccgccgtcgccgtcgtcgccgccaccgccgccgccggtgagccgtctcccccccccctcacctcgcgcccaccgccgtcgccgcccggggaagcaaagagctgagagagagagagatagaaagaagctgggagggagcagagaaaaagaaaagagaggaaaggaggaaggagccgggaggagagaaagaaaagaaaagagaaaagagagaaaaagaaagagaggagagaaaaagagggaaaatagaaaagaagaaaaggagaaaatagaagggaaattggggtagaaattaggaggatttaggaaataaaaatggtcggggttaatcgtagattatttttggaaattcctcgagcgtaatagtatttcggtcgaaattccgagttaattataaaaatatgtttcttgatcagattagattaaaattggtagtaatttagatataattaataactaaacaattagatgaattcttatagattattatagattatttttggtaatctctaaaagtcatcggttcacggtagaaattcggatttaattactagggattttagccgtgtattatat

SEQ ID NO: 69803 - DNA, 10343 bp, Oryza sativa
  unsure (1)..(10343): unsure at all n locations
cgataacctcgcattggcagtacccgctccgtgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacccatacgagaagtgcggttgtacgggggttgtttcatgcttaacttcatggctcggtccttaattgaccggggacggtactagccttttccagataccacccaaatcctccgtccgccccagtcgaaaacagttatttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcgtcattgcatgcaattttatttgtaaacaaaacaatttcgcaattgggatcaacatgttcaaggaatagtgatgacttgccttgctcagagtcttgcgggtcttggccttcgcttggatccgcaactccctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaatttcgacttaaactattttgcgggtataaatattttgttgtcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaaccgatgacttttagagattaccaaaaataatctataataatctataagaattcatctaattgtttagttattaattatatctaaattactaccaattttaatctaatctgatcaagaaatatatttttataattaactcggaatttcgaccgaaatactattacgctcaaggaattttccctctttttctctcctctctttctttttctctcttttctcttttcttttctttctctcctcccggctccttcctcctttcctctcttttctttttctctgctccctcccggcttctttctatctctctctctctcggctctttgcttccccgagcggcgacggcggtgggcgcgaggtgagaggggggggagacggctcaccggcggcggcggtggcggcgacgacggcgacggcggcgcaaggcggcgacgcacggcgcggcggctccggggcgacggcgcggcggcttcgaaggtggcggcgcagcggcgcgacaacagcggcgcatcggcgcgacgacagcggcgcgtggagaaggggaagatggagaagatgagggaatggagtggggtggagaaggggggattgggccggggtctttataggggagaggggaagaaagagaggggaaggagggggaggggtgaaacgacggcggcgcggcggcgcggggcgcgaggcggcgggctcgcggcgcgaggcgacgagacggcgcgcggcgcggcagcggcaatgggacgcgcgcggcgacgggacgtcgatggcgacggcgacagcggtggcgcgcggctcggggcgggatgcgatgggcggcgacacgacggcacggcgcgacagcgacgatgggacggcccggcagcggcacagctcgaggcggcgatggaacgcgcacgcggcgacgggatggcgacggcgacagagcggcagtggtggcgcgcggcgcgaggcgggacgcgacggcgacggcgcggccgcggcgatgagatggtgacggcgacaggcggcgatggcgacggtggcgcggcggcaggcgacgatggcgacggcgcgcggcagctggcgacgatggcgacggcgcgtggtgacggtggcgacaaagagagggggaaaggggaggagctgggttaggggaccccgtcgaacaccttaggtgcaatgaacagtgccgttttctaattaacccgattttagtgtattttccatataaatttgattccacaattcctaattttgcatatatgcattttactcaatatttgtgttatcttaactaatgaattcaccctagattaatattactcatattttatttttatgtaatttatttgagttttaattagggttaattcttattccatcgtatttaaatttaattgatccaaatatggttgcgataatattttatttatttctatccccacctaatctttattttaatttgtatttattttaccaatttgtttttaagttttattcctaattaactattctttactcacgattagtaatcttcgagatcaaatccagataaaatagacgaataagattggcatgatgcaattagtttaaaaagtttttttgaaaatccgtatttttagagttttgattttgtcggtcgaattttcagggtgttacaaacctaccccccttaaataaatctcgtcccgagatttcttaccagttttcgaatatatgcgggtactccgtcctcaagaattcttcgctttcccatgtggcttcatcctcagtgtgattgctccattgtaccttgtacatacgccacactttgctcctagtcctcttttcggcttcatccaatatccggatcgggtgttctggatatgtgagatcattgctaatgtgaatctcttccagcggagcttgctcttccggcactcgtaaacatttctttagctgagacacatggaagactgggtgcacatccgcgatattctctggtaactgtaactgatatgcaacttctcctcgcttggcgatgatctggaatggtcccacatatcttggtgccagttttcctttgaccttaaacctttttgtttccctcatcggagaaacctttagataaacgtaatctccctccttaaattccaggtttcttcttcgggtgtcggcgtaactcttttgtcgtgattgtgctacttttagacggtcacggatcaagcgaaccttttcttcggcttcttgaataatgtcaggtccaaataccgcccgttctccagtctcggaccacattagcggggtacgacattgtcgaccaaacaatgcctcattggttgacatttttaggcttgcttgaaagctgttgttgtaggagaattcggcgtagggcaaacatctctcccagtccttgctaaaatccagagcacaagccctcagcatgtcctccaggacctggttggttctctccgtctggccatctgtctggggatgataagctgtgctaactgcgaggtaacttcctagggcttcatggactttctcccagaaatgtgaggtaaactgtgtgccccgatcagatataattttcttaggtacaccatgaagacatactatcctggtcatgtataactcggctagcttagcactgctataatttgtcttaacgggaatgaatctcgccgtcnnnnnnnnnnnnnnnnnnnnnnnnnaaatagaatcatatcctgttgcggttttgggcaatccaacaataaaatccatacctatctcatcccatttccattcgggaatcctaaggggttgcagcaagcctgccggtcgctgatgctcagccttcactttttggcacacgtcacagagtgctacgtattccaccacatctctcttcatgttgggccaccagtatccttccttcagatcttggtacatcttcgtacttccggggtgcaatgaatatgccgattcgtgagcttcctttaaaattaatcccctcagtccaccctgttcgggtacgtaaattctctttttataccatagaacatctttttcgtcggttgaaaattcctttgcacgtcctgcagctaagcgttccttcacctctcggacttcctcgttgtccttctgggcttcttctatttgggttctcaaaagaggttgaatgtccagggtgtttatccgtccacgaggtactatatgtaggttcagctgagctatttcctccctaagctcagggaccatcccttccattctcagatgattgcaatggctcttacgactcagagcttcggccaccacgtttgctttgcctgggtgatagtgaacctctaaatcatagtccttgattaattctaaccatcgcctttgcctcaagttgagatctgactgggtgaagatatactttagactcttgtggtcagtgtagatatcgcaatggtttccaattagataatgtctctaaatctttagcgcatgaaccacagttgcgagttctaggtcatgggtagggtagttttcctcatgtggtcgcaattgtcgtgacgcataggccacaactttcccgtcctgcatcaatactcctcctagtccttgccttgaagcatcacaatatataacaaagtctttcctgatgtcgggaagaactaaaataggtgccgaggtcagcttttctttgagctgctcaaagctttcctgacactgttctgaccacacaaacttcttttccttcttgagtagttgtgtcattggtcgggctatcttagagaacccttcaatgaaccgtcggtagtatccagccaagcctagaaaactccgaatttcagtcacagatttgggtgctttccattccgtgacagcctctactttagcaggatccactgctactccaccggccgagattacgtggcctagaaaagcgacttcttttaaccagaactcacacttgctgaattttgcatataacttatgcttccgaagtttctcgagtaccaatcgcaagtgttccgcatgttcttcctcatctttagagtagattagaatatcatcgatgaataccaccacaaatttgtccaagtagtccatgaacactttgttcataagattcataaagtatgccggagcgttggttaaaccaaacgacattacggtgaactcatataatccatagcatgttgagaacgcggttttgggtatgtccccggttctaattttcaattggtggtatcctgaccgaaggtcaatcttagagaacaccttagctccgttgagttgatcaaaaagatcatcaatccgtggtagtggatacttgtttttaatagttacttcgttcagtgatcggtagtctacacacattctcatgctaccgtctttctttttaacaaataacactggggctccccaaggtgatgaactggggcgtacaaatcccttctcttgcaactccctgatttgctttttaagttcttctaactcattgaccggcatctgatatggtctcttggatatggaggcagttccgggtatcaggtcaataatgaactctatgtcacgatctggtggcattccaggtaaatcttctgggaacacatcaggaaatcgctgcactacgggcattccctttaggggtagcatggtaaatatacctccggcacgttcggttagcctaggatcttgatccatggttgctctcatatccgatccccagggtgtggtcagggtaacttctctatgtctacagtcaattattcctctatgctttgctaaccaatccatacccaaaatgacatcaagagtttggggtattagcaccataagattgtagagaaataccacatccctaaggcggatgggtacgtcaatgcaagctgtatccactgctatctcaaccccaggtgaatgtactaacattggttgtcttagtttaactctggttaaattgtgttgttgacttgctttcaaagatataaatgaatgcgatgctcctgaatcgaagagaactttaactggagtggagttgagtgaaaacatacccatcagtacgccttggtcttcctgggcctcttcagctcgaacgtggttcacttgcccgcgtccaaatccggtagcggtcctgttagtctgcggagtcctgaatagacctcgtccagcagcaggggtagcagtcccgtgaatagccgttgcattagctccggtgcgaatgggtgtcttgtttggatgaggacatttattggcgaaatgctcgtactctccacagttgaaacagcttcctgtccttactgatccagtggcggcctgattcggtgcaggagctcggttctgaatggtaaccgacctgtggaaattgctggaggcggcaggtcgactggttgtcaccactgttggtctccatgccgaggaggttgtccctttaggacgctggggtgcggtctgaggcgagcggttcatggcaagcctccttttacgattgtgctccacgaccttccggtcgttctccagcctaacgaccttattgattaaactctggaaactatcgtgatcttgtccaatcatgggcccgcgtaactcgtcattcaagccttcaatgaatttgtcgatcttttcctcctcgtcggcaagatctctagtcgcgtagcgcgctagctgagtgaaacggttcaggtactcttgtactgtggtattccctttccgtagtctcctgaactcattcttcttcatccgcatcaccgcggcaggcacgaagttgtcacggaaggctgtggtaaattcctcccagtttggttctccagcatcttcttctcgggcttctttgtacgtgtcccaccagtctccggctggtccttccaattggtttgccgcaaagatcactttattggcctcacgtactcgaacaagagttagcttcttctcaatgatccttaaccaatcttcagcatccataggttcttcagctgtggcgaatgtgggtggcttggtcctcataaactctccaaagcttgaccctccgcggttgccttggttgttcgcgatagcttgcagaagttgagtttgggtggccataactccggccagagtggttaagtcgggtgtctgagtttcgtcattgctggttgttgcccgacgtcggcttgccatctgtgtaggttgatggagtaagtatcctaattttctaactagctcctatggctttatcccattaagggagttgtgttgatatgaactttgttttgcaagcatggtggaataaactcatttataacacaacaacaatagatatcataaataatatcacagagtttcacaaatggtacataaatcatgatgcaatcgactgcatacatacgcagtccaaataaggttcatccaaaagatacatcaaactaatcatcaaactactcgtcaatctaggtaagggaggggggtgtctcgcatactatccaaaaatccatctgatacgagatcgaagctgcaaggagtccgtcagtctagtcctccagccatccgcaggatcctggggcaggtagagggtggtcgcttgcacacgcaaacctgagtccccacggctcagaagtagtggcctctggatctggcttgggcctcttgcccggaggtcgtgtgctcttgcgagcagtgctgagggtgcgaggacctccaaggaaggtgatgcggggaacaggggtctcatcctctgaaggatcagtgatgtctggctcgatctctggctcggtgtcggtcccctctgtctcggagtcgacctggatcggagtctccaaactggaacccagctgcggagaaggtgtagggatcagtggagtgtgcaccatctccgggacaggtggctgtgccgctgtcgggtccactaggtaaagtgctaactcggtagctagcatactagcctctcccagaagagcgtggaacgccggtgggtacggcggggtgaggaagaagtagcggtcacggcctactgctgtggaagtagaagcccctgtggtgctgatcttggctactcgaagctgctcctccagctggctgacgtgctcctgactctctctcagctgctcctcaagagtatccatcatcccgcggcgatcgttgtactggtcagataactgctggaactggtcgccgtggacctggagctgtgccttcagtgagtctatctcactgccccaagcctggtgctcctcctccaactgaagctgctgcactgagaggtcagtcaactcagtctccagctctcccatacgtctctggtggtcgtcaatctccaacagagcctcctcgtagtagtcatctactgcctcagcccatcgtgacaaccaagtcaccatcgggttgtagcagcagggcgtgtcctgaactgtgcaaactgagttgctctcctcccggaacgggtgatgagcaaactcgatactcactaactcagctcggtggatagagctgagtcggaggaaggcctcccgggctgcatcctgcatcgcggtctccggcaggtctcggtggtgacgtgtctgaaagctgtagtccaactcggaagggactcgggggtgaacctcgacccgagcctcccaaactgagccatactgtctcactcggtatgacgggaacccagagtatcgcagacgcctcaacatccgatgcagctcaatgacatacccctctgattgaggtaagctcaactcccaggtagcgggtgaatccggatctgccatctaattttaagaaaaacccaaagttagttgagagtaaaacttgttttgtaaagaaaatagttaagagtaagatgaaaattgtaccgagttttgtaaacatagcgtttttatttttgaaagtattactaaatgggaatttctcccttggccaacttagaaaaggggtggggcgccttttggtcttttcctacggttgtatggctctgataccagctctgtggacccctgtttttataacaggaatcaatcgtgtaaacagtaccatttccctggatcaagtagtctggtacacacgaattcatagctgaaataccaagtgcacatacacgagtgtctaatacgaattattacatcataaccccgcaggcgtagtctcaaattatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgagtcgttatggttttctgaggacgtccacgttcccgcctctcaggaagtggctccatcagcataaaaatcatcatgcaatatcccatcccacacaagttaaagaatttagagtctagccaagtgtaatacatgtcccggtgctcaataaccgcgagcacgactatttgaatagatttggtttactcacactgcagtggatgtacactttacccgcactccgcgattgcccaacacatgagcctcgtcccaacacatgagacgcgtcacggcaaagcttttcgataacctcgcattggcagtacccgctccgtgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacccatacgagaagtgcggttgtacgggggttgtttcatgcttaacttcatggctcggt

SEQ ID NO: 69804 - DNA, 528 bp, Oryza sativa
ttaatttcaaaaccagtaattaaggtggtagctgcttcattcgttcacaaatataagcatttctcattaaagcactattttccctattcaactatttctcatgattcgtaaggtaactctcatggatatcaaattaattttacctcaacattaatctgtgctaaaacccttagaaatggttatatatatatatatatatatatatatatatatatatatatatatatatatatatatatatatttctgaccataacaaaattcctatccaaatttgaatctcagaattcaaattctgctattcgaattgtccctccaaaatcatccatatctcctagtattcaaaattccataaaattcctctccttataaatttaccaccaaaacctctctcctaaaaccctggttcaaattttggaaatcacattatctttcgaacccctcacctttccctccatatgatctcctggaactcataaaaatatcgtgccaaaaatattaaaaatctcagtcagggccctgtttgctt

SEQ ID NO: 69805 - DNA, 816 bp, Oryza sativa
ccatcgacaagcgcaacttcctaaaaatgtcatcgtacaagcctatttctcccagaaataccataatagtcaaacggttgttaacaactcttcgttaagttgtatgaaaagacattcttaccctccagacaaccatttgctcacacaatatcattttgtattgtttgctcacacaatattattttgcattgatccatatttatgttagcttccaaattcacggacatcattattttgctatcaatcaaattatttcataatgcccctgtgtcgttgcctgccacctcctcgcagcccgtcacgccgacgcctgggaccgtcgggcggacgcctgcggccgacgcgccactgcctgggagccccacgccgccacctgggaaccccgcgtcgcagcctcgccgtcgtcgcccatcaagagagttaaatcgggttaggtttaggtttttatcttttcataatttttttcctttaccggtggattgggatagaataatttggagtgagagcaatttggttattattgtaaaaaaaaattctaatagtgtggactaaacggtatgttgactgtgatggtatttctaggagaaataggtttgtacgatggtatttttaaaaagttatgtttgtcgatgctatttctagaattaaaatgcttgtcgatgatatttcatgaattttctcatctttataagttggtgccattaactcttggcaagcgaggtgctactgaagtaactgaaactgagcttttgctgctgcccggctgcttactttgctctgctgccttgctgctgttgctgcctagcaccgctgcta

SEQ ID NO: 69806 - DNA, 6939 bp, Oryza sativa
agaaggtccggggcgactacgccgccggaccggagctcggcggtgacgccgaagagagagagcgacggcgcgagctcgattccgccggagagagagagcggcgagtggcggaaacggtggaggaaggcacggggagtgtttatatagggttgggagggggagagagcggccggatgagggggaatcggccgcggaagatccggccgccattgatgcgccggcgaggtttagggggaaacgtttccgaacgaatccgagggagagagagagagaaaagtggggggaaagagggagggaatcacggggagtgtttcccccctcttgattgcgcgcggggcggacgggagcggcgggattcgcggcggcggcggcgctagggcacgggcgaggcggcgggagcggcgggaggaaggggatgacgggtgggccccacccgtcagcgagggtggcgggcgggcccgcccgtcagcggcacgcgcgcgaggaggaggccgaatgggccgcgggggagaggagagagaggaagggaggtgggccgagccggcccaagagggggagaggggggggaaaaagacttttagggtttttctttttacaaaaccattttaactttgtttttttcttcttaattaatatttgtgctctgaaaattccactaaaatttatttacgcattttaggcttttatgaaatatacaaaaatcctccaagccttatttgacttttaacttagcacattttaattgttggaggctttcacatggattttacttattctatgcataatttcgaggatgtattttagagtcgttttgggacgcgacagatgctcggtctgtccatctgtctgcgggtgatacgcggtgctgaaatttaatcgggtacccaactcttcttggagcttcttccagaagtgagacgtgaattggcttcccctatcagatataattttcttaggaacgccatggagactcacgatcctagcgaagtagagttcggctagtttgttccctccataggtggtcttcacaggaataaaccgagctaccttggttagtcgatccacgactacccatatagaatcatacccgccctggatttttggaagtccggtgatgaaatcgatcccaatttcatcccatttccattctggtacttgtagaggttggagaagtccgaccggtcgttggtgctcttccttgacacgctggcacacatcacaaagggccacgaactctgcaatttcccacttcatactaacccaccagtatttctctttcaagtccaagtacatcttcgtgctgccaggatggatggaatagggactttcgtgagcttcctgaagtatcaactgtttaagttccctgtcgtctggaacgcatacccgattttcgttccgtagggttccgtgttcatcctctgtgaaacaagcggctttaccctgtttcatattcttgaggatcccatgcatatctggatcattcttctgagcctcgcggatttgatcgagcaaggtaggcttggcttctagagtagccaagaatccatggctaacgatgcttaggttcagggcttccatctgttgattaagttccggtggaatgccacggacgccaagagtgttgcaacagctttttcgactcagcacgtctgcgaccacgttggccttaccagggtgatagtggattcccacatcataatccttgatgagctctaaccatcttctctgccgaagattcagatccgactgagtgaagatgtatttcaaactcttatgatcagtatatatttcacagcgattctcaatgagatagtgccgccagatctttagagcatgaaccacagcggctaactccaaatcatgggtagggtagttgccttcatgaggccgaagctggcgggaggcataggctaccacgtggccttcctgcgtgagcacgcaccccaatccttggcgcgaagcgtcacagtacactaggaagtccttgcgagtatccggtaagattaacactggcgaggaaaccagcttttctttgagagtttggaatgtcttctcgcattgcggtgtccacacaaatttttcctccttcttcagcaactgtgtcatgggttgagcgattttggagaagttctcgatgaatcttcggtagtatcctgccaaacccaaaaatctgcggacttgagtgactgtcttgggttgcttccagtcagtgacggcggtcactatttcagggtccacagcaactcctttagcggatatcacgtgccctaagaatttgacttcggacaaccagaactcacacttgctaagcttggcatacaattgatgttcccgcaactttcccaacaccagacggagatgctgctgatggtctttctctgattgtgagtataccaggatgtcgtcaatgaaaaccacaacaaacttatccaagtattccatgaacacttggctgatcccctcctcctgagatagatttcagtggttggttctggctctcccagagctccaattgaacaaggaggcatttgcttgcacacacatgcacccagttgcatcagactcgcatgaccaggaggcagaggaagccagaacaaggctcatgctcatcatgcacgcagaagccatttctctcatgctttcagctgccaagcttcacccagcacggcttgcggttcgctcctcccgtgcgtgcacagctcaagtgaaaccgcctcatcacttccatgtgatcatcctcctcctcagctcccagaatcctaggggcataaataatctagccgtggcatctccattcgatcaccctcatcgatcgatccgcccgatttggtctggccagctttcgtcttctgatagatggttgcttttatacacctgaaactaaggcaattaaagcttaagtgtaagtacaatgcccctctttgttttcctacattttagcatctgtttatgaccatgatgatgatgcattgctgcttttaaggttaaggtgcacatcgaaaagatttgctacttgcttgtagacaagaatcgcataaaatgtaacaatggtttcagaaaggaaatgctcatactaacgaaagtttcatgacacaatatttcagatctttcaaggaggaataagaatcaacctgtcaagtaaaaagttttaatatttgtatgatcagaaagggcatacaccaacctaaatttgctgtgtaagaaagtagctagctgtgccaaatcattgtcacctcagtcagatctgccacaagcacgtacacatatatgtgaaaccgactagctttcttgcagctggaaaaactccaacgtacaacagtaaatgatataatctcaatatctagatataaaatatcctttttggaaacttctacaacgataatatatatcggtttgtcctaaaaactctttttttgttccaacaggtaagacttacaagtagcagaatagtttctacaatatgtggaagctcaagattgccgagggaggaccatggctaaagagtggaaacagtcatgttggaagagaaacatgggaatttgacccaaattttggaacaagtgaagagcgggaggcggttgaggctgcacggatagagttccagaagaataggttcagaacaagacacacctccgatgttttggctcgcatgcaggtataatgaaaacttaagttcaactattgcaaagagcttgattcgtacctcaaatcagaccgcagcagcatctgtatagctctataagaaactcacgccagtccttgtaacacctgacattagccacaagcatatgcatttatagatgtgtaaacaagcatgaaactaatcctgaaaaacaaaactaaacagcaaagggaacagcacaatatgatgtttagtatccatctggaattttcatttttgcagttagctaaggcgaacaacttcagtattgatctacagaaagaaaaagatggaaaccccataaatattgacacagctacagtatcagatatactgaagaaggcactcagttatttctcagccatacaggcatatgatgggcactggccaggggatttcccaggcccactgtttaccactgcaaccatggtaagatagtaacatacacaatcaacttcatgtctcctgggattaccatcatatcatacatcaagtttccagcatcaattcaatttgacagggatccttatgtttgtttgttccaactgcagatcatagttctatatgtcacagagtcattaactattacactgtcatcggaacatcacaaggagatctgtcgatatctgtacaatcgtcaggtaacactcaatagttaacaggaagttaatggctactttttaagtaaatacacctaaaagattaattatatttcatataagatgtgaacaagacttaactcaaagtttgtgaaccagaacatcgatggaggatggggactacatgcagaaggtgaaagttccatgcttagcacagctctcaattatactgctctgagactacttggggagaatgttgatgatggaccagatatatccatgcataaagcaagaaaatggatacatgaccatggaggtgcaacaatgataccgatcttgggaaaagtgtggctctcggtaacaatactttcagctgtatcctagttctatactcaaatacgttttcagctagtaattttactaaggtggcttgggatctcaagtttccacaagttagtttaatttatcaaatataataattacctcacctgaattaaagatctttccacctacagaaatcaaatggttaatactagtcaatgagaacatcaaaatgatttggaaaagcaaggttatcaaaagtatcaagtattgttttagtagtatgttagttatgcaaatttcatttgattatgggagtggatcttccactatctacattcccctattgtaaactgtatatttaatattacaggtgcttggagtttttgactggtcaggtgtaaatcctattcccccagaattatttcttcttccatctttcgttcctatccaaccaggtaaaattttcttccttgctatatgttcaattatattagcacagatcttatcaccagactttgaaatgaaacatgctagttagaacatatagattatgctttagttcctgaggtcaagtcgtcttctgcaattactgagcaagaagtccacaataaagcccctatttagagagatatgttgacaggaaaattacaggtgatcaccatcatcaatgatgaagtgaacttcattagcataaaaagcattatcaattcactcattaaatgttgataattttgtattattcgattactttatcttacagttgttccatctgtagaaatagagtagctatgtaaaatagaacaaatcaaatatcattatgggtgcaattttgtttttgtatgcaggacgattatggagtcacttccgaatggcttttattcccatgtcttatttgtatggaaaaaagtttgtcggtcctataacaagattggttatatcattaagggaagagctacatattcatccctataaaaagattgactggaaggaggcacgcaaattatgtgcaaaggtcagttcactaaacttaacacatttctgcctcgcacgagaaatttagcgaggtactcagcaacaggtgctcgctaggccacctcaggaatatttagatataatgccaactaatattatggtctatgtatagacatctagatatgtcaggaattactaacatcatattatcagctactatgaaatagagctaagatgtgctccaatgcttgcaatattcgcatgcttgttgtagttaaatatcagattgtttatcagaagattcaaagtccgtatagcttgaatcaactgcagtaattttctttcattgtgaattcaaatgtaggaagatgcctataatccacatatgtggctacaagagtgcctatctgactgcctttatagttttggtgagccgtttcttacacgttggccaatttcctacatgagaaaaagagctctataccaaattgctgagttcttgaagtatgaagatgaaaattctcagtatatctgcattggtgctgcacagaaggtaggagttcttccttgtcaaaatgagactcatacttaccctagaaatctcagaagaaaaaaaagcagtaatagcttcttattctcagtttccttttaacagattgagaagctgaattaccaactagtatttttgtccaaaagtttctcatgagcctgcaaatcctgcatcaactgcattcatttgctttacaagcatccccatgaaacaagaagtacatagtacagagaacttggttgaaagttaaaactgcatatctttaaaaaaaaggtcgagactgaatatgcatgtgcagagcgcagacaaatgcaaaacaaaataagactttgatatttaaaattaatcaattttcatggagatgcaaaatcttacacagattgttaaatcgaatacacatttagcatatatataaggtttagctaaatgtttattctcagaaagtgcttaaaggtaaatttcaggcttccttatacatgcatagtgaaagacactatgttcagcagacttgtttttacagaatgagtgcacttctgaaaatgcgtggtaaaattctagcatcatttacttctgaaaatacatggtaaaactctagcaccaattttaccatgtattttcattaattgaacactgcacagtgcactcattccataataatgagcctgctgaacataatttctttttctatgcatttcttttgacctgaattttaagctctagcatgtgagtgaacattattttgaacaggcattattcatgttgtgctggtggattgaaaatcccaattcagatgcattcaagcgtcatttggctagagtagctgattttctatg

SEQ ID NO: 69807 - DNA, 826 bp, Oryza sativa
gggcccactcatcgagtactcaagttgccaccgcctcactcctcggcggtggcctacttgtgttccttcgtcgtggctcgagcgaaacttctagagccacacaccccactctgattaatctcgtcgacgcctcactcctcatagcagccaactcactctcctccgtcgtggcttgggcagagcaacctctagagcctacgtcctcctctgactaccctcaccatcgccaccgccactagaccttgggtcccttagctcatcatctactgcctctctttcggcgctaaggtgctgatggatgaccatgactagcacctgctagagctcctcctcaaccgacgctacggtttttatatttttctaagagcggcaaatccaagctagacacctgccccatgttgactcaatgggtcaatcacggttagtttgttacttcagcaaaaagtacttcccaatccaatcagtttgcaccagtttttgaagacagggatgtattatattcgattgtatgattgagagagaagatttaatcaacaacaaaaatgagggaaaaaaatagagctattccgagtgaaaatgtagtcatgtactttacattaaccaacgagccgattctctaaggccatttttgggtgaagctcatgaaaaaggtatgcttggacataacactggtaaagaaatcatctttggtcggtcggccagatttcacaatagtcccggttgtattaaaaaccgggactatttagtcccggtttaaaagctcaaaggtactttttggtctttagtcccggttagtattaccaaccgagactaagggctgcaggaa

SEQ ID NO: 69808 - DNA, 530 bp, Oryza sativa
aaaaaattgtggattcttgtagtgaatatattttccacaagtttattctttagaacgtgaaagtattctttagttatgcttctgcgaatttataattcatacatcagtttcttttagagcaatatatatcaagttaaggctacagagattcttataattgaacccataacctaacttctatttcactcttttcttctagacaaatatctcactcgtaagcttaatgatgtcaacacggggagaatttgcttaatatcgtgtccttttcctacaacaataaaattgatagttgacctgccaacaccccataccccaccgcccaccctacaagcaatgaggtacatgcagcagaaatgaaaaagaaatcatattgactcaatggttctccaaactatcatataacaactacacacatcaagaatctcaatggaaaaaataattctatattggtcgacaactaatctaaagtagtgaaaagattaatcttatacaacactagattgcgccacgtcatcagctcaatatgcaac

SEQ ID NO: 69809 - DNA, 4088 bp, Oryza sativa
  unsure (1)..(4088): unsure at all n locations
ccactacttcgaacctgatgctacggtatttttagtggcttctcattcatatcgttcatatacaggctagttagggatagctggtgctggcgtgcggcgctccatattgcatacatcaagagacaagattagattgcactaattttcgttcagactagctacagatttccataacctggcaagtacactgtattgttgttactgcatattaaggtaggtaactccaacataattgttcactcaaggaaattaaaggtttaatctcagttgtttgctatctgtttttttttttgcagatggaggcaataaatagattggatgtgcgagataactcagatatttattcaaatgatgatataacttctccagtaatagaggatgacaacaccagtacaccaaaaaaaatatcaagaattccactcaatgtaagtacactggcaatttaaaaattatgactgaggtgctttaaaatgcttattgcaatgtatatgtgattttgcagtgctccgtttttacaccagagtgtgatgataagataaggcctgcggtagggatgacatttgaagatattgcctctgttgaaaaattttacaagtcatatgcacaccaagttgggttctcagtgcgtattgggcagcaaaagaagttggatggcgtggttcagtgcaagcactttgtgtgctcaaggcaaggatggaaacatgtgaatgataaggagattgttgatccatcgaagaaaaaaaagattaaattgaaagaaactagatgtggatgtgatgcacacatttacgtgaagctatgttctgataacaagtacacgatagcttccttggttgagcaccatagtcatggacttgtatcgccagataagctgcatttgataagatcaaatcgtgaagttagtgagagggcaaaaactacactcttcacatgcagcagagcaagcataggaacctcccaggcatataggctccttcacgtgagtgatgggggatttcagaatgttggatgcactaagagagacttgcagaattactatcgggacctaagaaagaaaattaagaatgcggatgctcaaatgtttgtggcccagctatgtagaaaaaatgaggtcaattcatcctttttttatgattttgatgtggatgaacatggcagattgaagtatgtgttttgggcagatgctacaagcaggaagaactatagtcactttggcgatatcgtatcatttgattctacgtacaccactaaccagtatgacatgatttttgcaccatttactggggtaaatcatcacttgcaaagtgtgttttatggtgctgcattcttagcaaatgagaagattccagcatatgtttggttgtttaagaccttcctaagagcaatgggagggaaagccctacactcatcataactgacgaagatgccagcatgaaagcagctattgaaaaagtttttccaaccacggtgcataggttgtgtatgtggcatatcatggaaaaatgtcagacaagatcggaccactatggagagaagactgcgatttaagggaaatgatgaagtcatgtgtttggagatcagaaactgctactgagttcgaatcacagtggaaatctatcattttggactttcacttggaggacaatgagtggctgtcaaataggtttgacattcgtaaatcatggattccagcatatttcatggacatatctttggctggcattctcaaaacaacttcaaggtcagagagtgcaaattcgtttttcaaccgtttcattcatcgcaagcttgctcttgttgagttttggctcaggtttgtcacatctttagaatgccaacgccaagaggagttgaaggcagataacacaagcatccatacaacatacaaacctgtaactccttgggcaatggagacacaaggtagcattatgttcacgcatgaggtttttgacaaacttcgagaagagattatagccgccagagatctttgttgtgttaaagacattgcacaatgtgatgggttgaaaattgttaccattagtgatggatctcacaagctcagggtagtccgttgcaatacaacgacaatgatagcgaactgttcgtgcaagctatttgagtccgatgggatcccgtgtcatcatattattctagttttgagaggtgaaaatcaaaatgagttaccaactgcatacatcatgaagagatgggagaaaagagtgaaaaggtaatgtgtgcatatactctttgcttgaatcttttagttttagtcagttcatgaaaaaaattgtacagtgcatacactcactatttttttttgaaactggtttcctaaccacatcgttatcgtagggagaannnnnnnnnnnnnnnnnnnnnnnnnnnagaagagaagccaattgactcctcggaggcggcaatgagaaagaaaatatcaattgcacgcaacaaatttgaagatctcatacaaaaggctaagcactcagatgaaggcattgacttcttaacatctagtgtgttcaacctgaggcacccttggaccaaatggtgtctaatgtcaagcatactagacatgaggagtgagtcttttcttggttgcacaattcctactgaaattgatatacaccgaccaactgatattcattcgagggggagaagcaaaagaattagaagaagcaaggatgccaatactggtaagaagcagggtggcaaggaacggacaccacggatctgcaagatttgcaaacaaatggtgtttcaagatttgcacaggatatgctgcctttgtttgcaaatcatgaaacttgtcctagtgccatatatatccaaacgggttttactcgttctatatgctgatgtgacatgtcatggagatgcctacgtatcggtgagatcccaatttcagtgacatattgatagttttttttagaaaattcttttatccccctctttttaattttttaaaaaacaacttcccccatcacttttctttaattttattttttctatatggctaacatgtagtcactaccatggtatgtcacgtcagcacacggattgagtcagaactcgtttggacctatgagaccccaggataagtttggggggctgaaaaatatattttgtgattctaaaatgataaatatggttgtatgcaaaataactctggacaaaattgcacttctttttttttcataacacttggtttatggggaatttcggaagtacaaattgtgtttgtgccttcaagtaaagtattatctatttgatcacagtggattgatggttgcgcatcctatatacttatatagttcatccccactaagtgcacttaatgctatttctctcttctctcataaagccacatcattctaattatttttagcctttggatggtatatatatggtacaaatagtctcttctttcttctatcataaaaccatacaatttcaatcgtttttttcttcaaaattcatatgtatcaattatataaaatatgttcaccttgcattatatttgcaatcatgtgtaaattatataaaacataggaagtcattttattttcttttacaaaatataatatagcttatttgtacatactatacaacttaatttcccgcagcaacacggcggggtaatcatctattatttggagaaatttgggtcttaataaagaaatccttggtggaataattaatcctgacatattggtccattgagccacctgataaaaaacaaagtttattactcaagttcatttacatatgtttggtttgtgggtggggtgggttggatcaaattcatcactgtttttagggtggggtgataccgtctatccgtaaggcacgagagagttgatgatcctatgttttatattgcagctcatatgccagcaaggaagaaaagtgagttggattggtatgtcaactttttagggataaggccaatccgaatcttagatgggtacaattccatcttacttatttttaaaccaaataccctgataaataaataggttcgacccaacccaatcccgtcccttaaccaaaagcatgctttgattgacccatccaacatcaaattcttt

SEQ ID NO: 69810 - DNA, 576 bp, Oryza sativa
tccagaatacaagagactagttgtggaaatcaaggagaaaatgaaagcgagcgtattggctatcatgaacgaatcaaaagcatacctcccaacaagtgttggtgtgccaccgtttgagtggtcatctgctctgtaacctccgggcaatgcgaaagttgcaccgaacgtcacagttgctattagaactgagccaatggccattgtttccgttgcgtcctttagcttttctaattctttgctttcactatctgattttaggttgtgagtgtctttgtgtttttctctaaagtgatcgtggcggcaactgtcattcatagcaccagcttgtgtcaatacaaagcgtaccatttcttcggtgctctgaaaaataaggaaactaatcaattttgttaggaagtgaaatcagtattcaattatcgtttatctcgaaagtagtacttctaaaagaagaatttaaattacctgattattatgtagccctggaggaatttgatcatgtgatatatctctaggagtttggccttttacatttactacatttagttgcacttgccgattgccaaatagcgaacaaaa

SEQ ID NO: 69811 - DNA, 27640 bp, Oryza sativa
ccttccttctcgccggattcgagctcgcgacgtcgctctctctctccgccgtcgccgccgagctctggtccgccgccgtcgtcgccccggaccgcctcccacctcggcgccgcctcctttggcttcaccgcatcctcgccgacctcgtccacctctccgtttcggtcgccaaccgccggagcgccgtcgtccccgtcgacccgatccgcgccaccgcctccctccgctccggccgcctcccccgtcgccgccgtcgccccgggatgagctgtggaccgtcgcctcctttccccttcccttccctctctcggccgccgctccgccgcgccggtggtcgccggctccgaccatcggagcgtgggcgcgccgcctcccgccgaccgcgcaagcatggccgccctcgggcgtgccgagtggctaccgcgtggggcctggctgtcagccgcccgcgcccttgggtgcggctgacgtgtggggcccacagcgccgaccggtgtgagcccgggtccttaagaagtcaagaacccatttttgtgctttgttcctgcttgttatatggagtttattagagtaaaagcctttttcttgtttccattggtcgtgtagacgctgcagcttcggaagatccgctcttcgtggaggttgaagccgacgtttgggaaagcgagcaaggacatattgaacatattgaatcccattttataaaattattttgatttaaattattgcattatcgctttatttaaattcccgcgttatcactgttttattcagccatgcctatttacctttgttatgaccttattattatggctattgttattattattaccttgttcaccctagactaaacaaaaccccaactagtgggcactccactcatggtgctactagtatgaatttaggtagatgcttcgctggttaattaggcaacattaggtggttttacaactttagactttgggaatattcatatcacctggacattatggaatggttggattattgcggaattggattcacacctccccctctattcaaaaccctcaaaatggttttaggctgggctcggggtgcatggttttgatggtagcacctcggccatatatggaccggtcttcgggcctctgttgcaaagcactaccgtacttccacatgtctagtgggtaaggcttagtttctggctcagtctggttataaacaaaagtacacggatggggatggacgaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttctgtctgtataccgtggtggtatgtggcacgtggttacacgtgaggaagatgtgtcttgtgggtaaagatgtacacctctgatcagagtataatttattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtgtgggttcacggccttgataaataatattgtttagttctagaatcgtgtttaccaaatagctttgagcaactaaagatctttaaatgctgtttactgtaaccctaatcctttatagtgtaactcctttgtgggtgtgtcttgttgagtacggtggttgtactcagtcttgctcaatttttcccaaacctagaagaggagcccctagaagatgaaggctttggtgtctagctcgtgcctgccgtcaagcgcctgtggtcgtcgccctagtcttccgctgtttctcggttgtctttgtgtgtgctgggccttcgctgcccatgtaataaattaactatttacgcttccgcttgttaaactctgaattgtatcaacttctggtgtaccttgcctcctgggacaaggaataatacacgcacgtaaggaacgcccgttgggttatttccggtcgtgacaagttggtatcagagccacccttaaccctaggacgagccgtaggtcccaagccttagcaatattttcgaaataaaaatcctttgtatttgtgaaaatcctctagtctctctctgtcttgctgcttcgtttatcgccaaaatctgacctttaaaatgttgcttttctttttgtttttgtttgtagatggccggcagcgtcagccgtcgtggtctggacatgactggtttcgtcttggagctgcggggcatgtgcgttgtcctggggtatccgcatggagtggactaccagggcaggccgcttccggagcaggagggtgacgatgcagagccccacgctgcttgggaggttactgcagtgatcctcactggctctcccgagcggacttcgctggcagtcaccgcgggtggagattctttctccgccgcttgccagagcgccgctctcctcgccatctgcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaatctgaagatcctggagctgcgtcaagagaacctgcagctcaagaaagacctagacgcagtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcatggacttgcttcgtcgagaaccctcgtgccgagcccgcgtgtcacgcccggaaattcactagtaatttccgaactaatttgtgcataaaatcctcgtccaggaatcagccgaggtacacaaactgacaatttaatatacaaatccatcttaataataacgttacatacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagtatatgacatactcaacaagccacacagcaaatatgcaagtgcacaaggattccaaaggaatggcataatataggctcatttgcaaaagcagcatttagcaaagagttaagataagtaaaacagtagagtaattaatcatcaattttaatcaacactgaacaacacacccatgctgtacaggcccaaccatcctgaacaaccatacccggctgtacagatctaactccaaaccaggagctaagcaaattattaccaattataacatccataattattgtgaaaggtgtgagactaatcacgaaaaacattgctcaacccgcccataaccgcgggcacggctattcgaatagttttactctggccagaggtgtaccactgtacccacaagacacaaccccacatcatgtcaccatgtgcctcagtaccaccacggtacctcggaaaggagttgtgacaataccccttgcacaacataacccattatagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtctcacaacagtagctcgcgaaccggtccttaattgccatgagcacgaccttcaaaaccatgtgctcacaacccaccactaatcatattttaattaccaattaattatcataacacgattaaccatcgtgagctaccattaaatataaccataaataataatgtagtataaatgattcatcccattagtgagctaatgtctctaagcattgctaagcaattatatatataacattcagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttagaatctgtgtgacttgccttgcaacaatcgatcttcaattaatcttcttgatcacttccgacgcactcacgaaccttcgcaacgacggaaacgacaagctaacacgcaaaacgaagaaaaagactaataaaaaccaaataaacaatacatataaaataaacaaacatgtagatcataattttagatgaattatgagacttgaacagccttattctgacttcaaaagaatttattatgaattttacaagattaaatctaattaaagcccatttaaaaagaattaaataaatttaattcaatttatggacaattttaatatgtagatctttattttagaaaaatttagcaacttgaaccacctgaaacggatctacggttatttagatatgattttccgaagatttaatctattaaaagaaattggaaaaggagaagatgatgacgtcagcatgacgtcacccacggaggccggctagggttggcgacctcgccggagctaggatggtcggccgcggctttggaggacatgtacacgtagaggacgacgagacgaacccaacggtactcaccctcgaaccaaacgacgaacgacgacggccggcgacgagatgaacggcggcggcggctcagacctcgccggagatggagctccggtggccggcgacgaaaggggacgggtggccgagcttcctcactcctcggcgcacctcttggcggcggcggcaacggcagcgacggcaggggcggcggcgcgacctcgccgaagctcggccggcggcggcggcgagttggacgacgcggcgacgaggctacggggcactagagagctcgggaaaaggggcaaacgaaagaggagtactagagggtcctatttatagccttggattgaagagatcggactcctcccgcaagaaatcgatccgagaaatcaaaaactcggttttggagataaactcgaaaacgagtttgattcggataaaatacccaacgatttgctccgattcttgaggggaaagatagaggagaacgagaggataaaatcccctcaaacaatcggaagaaaagaggccggattgggtgcggatttgagaggagaaaggagcggctcgggctcggcatctcggccggcttgggcgaggccggaggttgaagaaacctctgacatgtgggccccacatgtcggcggctagagggagagggggcgggcggcgtcggctgggccggcttgggccggttcggccgcgcgcggggagaaagaatgttgggccgaattcagcccaacgacttaagggagggtttttaaaactttttcaattaaaataattcatgaaatgatgtttcatttattaaaaatacttcccttgctcaaacaattcccagaaaattctagaaaatagaggaacaagcaaagtatttaataaaattttatctagctcaattttatattgagatttagcaaattaaaattagatcttctcttttaagcttttaaaatcatttctaataattccttttaaacaacaatttataacttaaggattttaaacaagaaaagcacttaacaattataattagatcattattgatcaaataattactgaactgttctttgtatcatttaggaattgagctccgaaaaatccgagaaaattccagagagtataattaaccatggagaattaaaaaaaattaaatccatccatgctttatatttaggagattttatttcccacaattaacttcacttgtaaattaatgaacatttaatataaattctattattaatttattaaataatttataaatcctgaaacgaaaatcaggatgtgacaccgcgcccgtggttccccaggagggggaagcctccggcgttggcagcacggaagatgcgctgttgctcaccttccgtcctggcccgtcgcagcggtagacgagcagttagtaggcttgcgcgtgtgttctttctcgtttgtcttcttgttggagttgtgtggggcatggttatgccggtgtgtggcataactgtgtcggagcctgcctttattttatttgcctaagcaacttgaactttaatgaaccaatttaatagcagtaataaattcaagaattatggtagtcgtgggtggttagctttaattgtcagctctctctgtttgttggttctgtgtggggttttcagatggtgatgaccaggagaagtgctagtaccggtgatggcaaccaacctgaaggcagcaaccacaaccaccagggcagcccacctccacctcctcctccgcctccaccaccaccaccagataccaacgccattctcacccaaatcctcgcccagcaggccaacatgatgattgctttcctccaccacctccaaaatccgccacaacataatgctccaccaccacccccacaacactctaaactcgccgagttcctccgcatccgtccacccaccttctttagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggctcgcttcactgccgctttccggagaacccatgtgcccgccggagtcgtggcccttaagaaaagggaattccgagagttgaagcaaggcaaccgctccgtgatggagtatttgcatgagttcaacaacctggcccgttacgccccggaggatgtgcggagatgaggagaagcaagagaagttcttggcaggaatggaccctgagctgtccgtccgtctagtttccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcgtcctcgcagcagcaacctcgctccgcgccccgacctcaattcgtggtgcgcgtcccacagccgcagcaacagcagagtcagcaagggactcgtgcgccccgtcctcctacaccaactgtgcagcctggtcaaggccgcagggacgctcaaggtccgcagcgtctgtgcttcaactgcttcgagcctgggcactttgcggataaatgcccgaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcatcccactcgttcatatctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattcttctagacaccaagaacttggatgtgatccttgggatgaattggttggctcaattccaaggagtagtggattgcgcgagacgcactgttactctgtaccgagggccggaacaaccggttgttttctttgcacccccaacctctgtcagaagttcagaacttcatcagatagtactgtcagaaatccccatcgtcagggagttcggagatgtgtttccggaagaactacccggtatgccgcccaagcgagagattgagttccggatagatcttgctccaggaaccactcctctgtacaagcgaccctaccgtatggcagcaaatgaactggccgaatttaagaaacagttggaagagttaaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgattagcttaaaagtgccacggtattctccaagatcgatcttcgttccggaaatcaccagttgcgcattagggaagaagatattccgaagaccgcattcaccacgcgatacggactgtatgaattcacggtgatgtcattcggtctaaccaatgctcctgccttcttcatgaacttaatgaacaaagtgttcatggaatacttggataagtttgttgtggtgttcattgatgacattctgatatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctatggaccccgaaacagtgaccgccgtcactgattggaagcaacccaagacagtcactcaagtccgcagtttcttaggtttggcgggatactaccggaggttcatcgagaacttctccaaaatcgctcgacccatgacacagttgttgaagaaagaagagaaatttgtgtggagcccgcaatgcgagaaggcgtttcaaactctcaaagaaaagctggtttcctcgctagtgttagtcttgccagatactcgcaaggatttcatggtgtattgtgacgcttcgcgccaaggattggggtgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcaaaggagatggttagaactcatcaaggattatgatgtgggaattcactatcatcctggtaaggccaacgtggtcgccgacgctctaagtcgaaagagccattgcaacactcttaacgtccgtggcattccacccgaacttaaccaacagatggaagccctgaatctgagcatagtgggtcgtggattcttggctacgctggaagccaagcccaccttgctcgatcaaatccgcgaggctcagaagaacgacccggacatgcgtggactcctcaaaaatatgaaacagggtaaagccgcgggtttcacagaggatgaacacggagccctatggaacggaaatcgggtatgcgttccggatgtcagagaactcaaacagctgatacttcaggaagctcacgaaagtccttattccatccaccctggcagtacgaagatgtacttagacttgaaggagaaatactggtgggttagtatgaagcgggaaattgcagagttcgtggtcctttgtgatgtgtgccagcgtgtcaaggcagagcaccaacgaccggccggacttctccaacctctccaagtaccagaatggaaatgggatgaaattgggatggacttcatcaccggacttccaaaaacccaaggtggatatgattctatatgggtagttgtggaccggttaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccttatgaagcgttgtatgggcgcaaatgccggacaccgctcttgtgggaccaagttggggaaagtcaagtgttcgggactgatatcctgagagaagctgaagcgaaggtcagaaccattcgggataatttaaaggtggcacagccacggcagaaaagttatgcagataaccgtcgccgtaacctggaattcgcggtggacgattttgtgtaccttcgaatcacgccattgcggggtgtacacaggtttcggacaaaagggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgtctccgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcccgatctcttcgccagttcttccgaatctcggggtcgagattccgtttaaggggggtaggtttgtcgcgtcccaaaacgactctaaaatacatcctcgaaattatgcatataataagtaaaatccatgtgaaagcctccaacaattaaaatgtgctaagttaaaagtcaaataaggcttggaggatttttgtatatttcctaaaagcctaaaatgcgtaaataaattttagtggaattttcagagcacaaatattaattaagaagaaaaaaacaaagttaaaatggttttgtaaaaagaaaaaccctaaaagtcttttccccccctctccccctcttgggccggctcggcctcctccccgcgcgcgtgccgctgacggacgggcccgcccgccaccctcgctgacgggtggggcccacccgtcatccccttcctcccgccgctcctgccgcctcgcccgtgccctagcgccgccgccgccgcgaatcccgccgctcccgtccgccccgcgcgcaatcaagaggggggaaacactccccgtgattccctccctctttccccccacttttctctctctctccctcggatttgttcggaaacgtttccccctaaacctcgccggcgcatcaatggcggccggatcttccgcggccgattccccctcatccggccgctctctccccctcccaaccctatataaacactccccgtgcctccctccaccgtttccgccactcgccgctctctctctccgccggaatcgagctcgcgccgtcgctctctctctccgccgtcaccgccgagctccggtccgccgccgtagtcgccccggaccttctcccgcttcggcgtcgccttctccgggttcgccgcaacctcgccgacctcgtccacccctccgtttcgcccgccaaccgccggaacgccgccgtccccgtcgacccgagccgcgccgccgccttcctccgctccggtcgccgttcccgtcgtcgctgtcgacccggggtgagccgtggaccgccgtttcgcttcccccttccctcatctctctcgggcgccgctccgccgcgctggtggtcgccggcggcgaccatcggggcgcgggtgcgccacctcccgtcggctgtgccggcgtggccgccttcgggcgcgccccgcggctgccatgtggggcccggtcgtcagccgcccgcgccctcgggtgcggctgacgcgtgggacccacggcgccggccggtgtgagccgggtgcacccggtccaccgtggaccgtgaggctgccgcgtaggccccactcccgtggacccggtccgcgcgctcctcccctcggctgacgcaataaatccgattttaaattaaaatttaaataaagaaattcgcaaatatccatttaaagagcatataaacttcaaatggccataacttgaccatttgaactcggaattggaccgttcaagtctctaatttctccttaagaagtcaagaacccatttttgtgctttgtttctgcttgttatatggagtttattagagtataagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgtattgttattattaccttgttcaccctagaataaacaaaaccccaactagtggacactctactcatggtatcactagtatgattttagttagatgcttcgctttttaattaggtaacattaggtggtttttcaactctagactttgggaatatttatatcacccggatactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctccagggcaaatgaaggctacacgagctgcggcccagtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttctgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtgtgggttcacggccttgataaataatattgtttagttctagaatcgtgtttaccaaatagctttgagcaactaaagatctttaaatgctgtttactgcaaccctaaccctttatagtgtaactcctttgtactcccttgcatttattctgcacttgtgggtgtgtcttgttgagtacggtggttgtactcagtcttgctcaatttttcccaaacccagaagaggagcccctagaagatgaaggctttggtgtctagctcgtgcctgccgtcaagcgcctgtggtcgtcgccctagtcttccgctgtttctcgattgtctttgtgtgtgctgggccttcgctgcccatgtaataaattaactatttacgctaccgcttgttaaactctgaattgtatcaacttctggtgtaccttgcctcctgggacaaggaataatacacgcacgtaaggaacgcccgttgggttatttccggtcgtgacagcatctaaatcagatcctagaagatatgctccgtgcctgtgttctagatttcgggaagacctgggataagagtctcccctatgccgagttctcctacaataacagctaccaagccagcctacaaatggcaccctatgaagcgttgtatggccgcaaatgccggacaccgctattgtgggaccaagttggggaaagccaagtgttcgggactgatatcctgagagaagctgaagctaaagtcaaaaccattcgggataatctaaaggtggcacagtctcggcagaaaagttatgcagacaaccgacgccgtaacctagaatttgcagtggatgattttgtgtaccttcgggtcacgccattgcggggcgtacacaggtttcagacgaaagggaagctcgcacctcggtttgtgggtcctttccgtatcgttgctcgacgcggagaagtcgcttaccagttggagctgcccgcatccttgggcaacgtgcatgatgtgttccatgtgtcgcaactcaagaaatgtcttcgagtgccatccgagcaggccgattcagagcaaattgacgttcgcgaagacttgacctatgtagagagaccagtaaaaatcctggacaccatggagcgcaggaccaagaaccgggtaatccgtttttgcaaggtctaatggagcaaccacgctgaggaagaaggtacttgggaacgtgaagacgagctgaaggcagcccatcccgatctcttcgccagttcttccgaatcctggggtcaagattccgtttaaggggggtaggtttgtcacgtcccaaaatgaccctaaaatatatcctttaaattatgcctagaataattaaaatccatgtgaaagcctccaaaaattaaaatgtgcaaagtaaaagtcaaacaaggcttagaggatttttgtatatttcctaaaagcctaaaatgtgtaaataaattttagtggaattttcagagcacaaataataattaagaagaaataaacaaagttaaaatgattttataaaaagaaaaaccttaaaatttcccccctccccctcttgggccggctcggcccatctccccccctctctctctcctctcccccgcggcccattcggcccctccccgcgctcacgccgctgacgggcgggcccgcccaccaccctcgctgacgggtggggcccacccgtcatccccgacctcccgccgctcccgccgtctcgcccgcgcctagccccgccgccgccgcgaatcccgccgcctcccgtcgtccccgcgtgcaataaagtggggggaatcattccccgtgatcccctctccctttccccccatttttccctctctctctcgcgttcaaacgggcggatttgcccccgcaaatctcgccggcaccattgatggcggccggacctcccgtgccggtttccttcccctctggccgctctctcccccttccaaccctatttaaaccctccccgcacttcatccgaccgttttcgcctctcgccgcccttccttctcgccggattcgagctcgcgacgtcgctctctctctccgccgtcgccgccgagctctggtccgccgccgtcgtcgccccggaccgcctcccacctcggcgccgcctcctttggcttcaccgcatcctcgccgacctcgtccacctctccgtttcggtcgccaaccgccggagcgccgtcgtccccgtcgacccgatccgcgccaccgcctccctccgctccggccgcctcccccgtcgccgccgtcgccccgggatgagctgtggaccgtcgcctcctttccccttcccttccctctctcggccgccgctccgccgcgccggtggtcgccggctccgaccatcggagcgtgggcgcgccgcctcccgccgaccgcgcaagcatggccgccctcgggcgtgccgagtggctaccgcgtggggcctggctgtcagccgcccgcgcccttgggtgcggctgacgtgtggggcccacagcgccgaccggtgtgagcccgggtccttaagaagtcaagaacccatttttgtgctttgttcctgcttgttatatggagtttattagagtaaaagcctttttcttgtttccattggtcgtgtagacgctgcagcttcggaagatccgctcttcgtggaggttgaagccgacgtttgggaaagcgagcaaggacatattgaacatattgaatcccattttataaaattattttgatttaaattattgcattatcgctttatttaaattcccgcgttatcactgttttattcagccatgcctatttacctttgttatgaccttattattatggctattgttattattattaccttgttcaccctagactaaacaaaaccccaactagtgggcactccactcatggtgctactagtatgaatttaggtagatgcttcgctggttaattaggcaacattaggtggttttacaactttagactttgggaatattcatatcacctggacattatggaatggttggattattgcggaattggattcacacctccccctctattcaaaaccctcaaaatggttttaggctgggctcggggtgcatggttttgatggtagcacctcggccatatatggaccggtcttcgggcctctgttgcaaagcactaccgtacttccacatgtctagtgggtaaggcttagtttctggctcagtctggttataaacaaaagtacacggatggggatggacgaagtcgggagtcgatggacatctctagggcaaatgaaggctacacgagctgcggcccggtagtcgagatgtcatggcacagggctggtgtcctgctgctaggggctcagtcctgcccacctgtcccgaaggttccggccgtaggtggggttgggtcggtactcttgtctatggctaggatgggttggaaactatgtcacgtctttcgtccgtatgccgtggtggtatgtggcacgtggttacacgtgaggaagatgtgtcttgtgggtaaagatgtacacctttgatcagagtataatctattcgaatagccgcgccctcggttatgggcaagccgagcaatgtacccaagttaatattttaatccttataacctgcttaacaactaaaatgtggaatggttggcctgggttggcttgggacgagctgggacccagggtcgggttgccagtttggtttgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccccttatatgataacccgcttgtactcccttacatttattctgcacttgtgggtgtgtcttgttgagtacggtggttgtactcagtcttgctcaatttttcccaaacccagaagaggagttcctagaagatgaaggctttagtgtttagcttgtgcctgccgtcaagcgcctgtggtcgtcgccctagtcttccgctgtttcacatttgtctttgtgtgtgctgggccttcgacgcccatgtaataaattaattatttacgcttctgcttgttaaactctgaattgtatcgacttttggtgtgccttgcctcctgggacaaggaataatgcacgcacgtaaggaacgcccgttgggttatttctggtcgtgacactgctgatcggcaagagcagaagcctctacaacaagcatgcaatgcaaactcaattccaccgtgcaacagatcaactcctatctaccggtgtcttttctttctaatattaaatttttccggcgagattcagttatcagtttgaagcggccggggtcgacgtggactcggactccaaaccaaaaccattaagcaactgctcgtcatcaagcgatcaaggaggaatagatggaataatttactgtagtcatgtatgctcttgatggtgcataacttggcctacagctgtatattacatgtttccagtcacgaagctatctaccggccaaacagttttttatttttctacaaagcgcaagcattcatcaaggcacacagcttggtgtcgaggttatcaagattgcgatctggctattccaagtcgatttatatttttcgccaaaattccggctattagacctttgaaacaagagcttctggatcacaaaccactaccaggtttatcgttttaaattttcttgcataaattagattaattcgcagatcactaattgtaatttgatctattattttatgcatgtgctgccggccgccttcgtataccgccgactggtgttctcgcctgcacggctggcgtattatgccgtcgttgttgggcatctacgtcttcaccaccggccgcctcgattgccgccgactggtgtttctgcctacacggttggatgatcacaccaccgttgttgggcgtctacaacttcaccaaccggccgcctccttcgctgccgactggtgttttcgcctgcacggctggcctattatgccgccgttgttgggtgtctacgtcttcaccgaccggccgcctcgtcgatccgccgccgattggtgtctccgcctacacggttcgatggtcacaccaccgttgttgggcgtctacgtcttcaccgaccggctgcctcgtttgctgccgactagtgtttttgcctgtacggctggcctattatgccgccgttgttaggcgtctacgtcttcaccaaccgaccgcctcgtcgatccgccgccgattggtgtctccgcctacacggttggatggtcacaccaccgttgtggggcgtctacgtcttcaccgaccgaacgcctcgtcgatccgccgccgactggtgtttccgccttccggctgcctcgtccgccgccgactggcgtttttgcctgcacggctggcctattatgccgttgttgttgggcgtctacgtcttcaccgaccggccgcctcgtccgccgccaactggtgtttttgcctgcacagctggcctattatgccgccgttgttgggcgtctacgtcttcaccgaccggccgcctcgtctgctgccgactggtgtttttgcctgcacggctagcctattatgccgccgttgttgggtgtctacgtcttcaccgaccgatcgcctcattgatctgccgccgactagtgtctccgcctacacggttggatggtcacaccaccgttgttgggcgtctacgtcttcatcgaccggctttccttcgccaccaccgattggtgtttccacctatacggttagttggtcacaccactattcatgggcgtccatgtcttcaccgaccggcttgccttcgccgccgccgactggtgtccccgccttcatggctgacctattatgccgtcgtcgttgggcgtctacgacttcaccgaccggcttgccttcgccgccgccgactggtgtccccaccttcatggctgacctaatatgccgccatcgttgggcgtctacgacttcaccgccggcctgccttcgccgccgccgactggtgtccccgccttcacggctgacctattatgccgccgtcgttgggcgtctacgacttcaccgccggcctgcctccgtcgccgctgactggtgtcctcgcctatgcggttggcgggctcctccaccgttgatgggcctcgttatctacatcaccggcttgcttccactgtcaccgactggtgtcttccttgttattgatggacgactttgttcctacattggttacctctgccattaccaaggggaatattacaaagctaaatcatcattaattttcttctttatatgatatttttctttttctctaagtcactacatcaattggttcgccattgactagtgagtcgggggctatagatgttatgtcatattttttgaacaattttcataatatttatattgattgctcacgacataatctgagtataaaagtgcctatcgagttatggagttctatcttcctatgcttcccgtttgatttgtcgatggacagttgcctttgggccgattcctaccacccgggggctcactggatggaccgagtaacgcaagatgctaagtgttattcggaataaatcaaaagcatagagataagataaatttattttctgctctttacaattgcaaaagtacccgagtagtaaattctgattcgtgaaactttgttccattaatgacgaactcatatcactcatatgcatgtttgggaagtgcctaggccgactcccgatgtttgggggctatgactagtcggacagagtgtttaaacgtacggagtcatctgctcggggaaatcaaaattgacaagaggagaaatacatatttataaatattttaaaatacttgaatttttctcgagtattatatttacatcagatactactcatcctatatgtttgttctgtaggatccatatccagatatgcataaaagggattcatggctttaagcttatctcctacgcttcaggaatggatcagtcagaacatcaccaccggcttgccttcgccgccgccgactggtgtctccgcctgcacggctggtctattatgccgctgttgtcgggcgtctacgtcttcaccgtcggcttgccttcgccgcagccgattggtgtctccgcttgcacggctggtctattatgccgctgttgtcgggcgtctacgtcttcaccgatcggcttgccttcgccactgccgactggtgtcttcgcctacacggctggcttattatgccgccgttgttgggcgtctacgtcttctccgaccggccacctcgtatgacaccaactggtgctatcgtcttcacggctggccacgtcgccgccaccgcaaataggcgtcattaccttcaacgcaagctgtctacgtctgctgccgactggtttcttcacttcgatggctgcatgattctgccagtgttaattggtcttatcgtctttaccgccggtcatctcgtctgctgttgactagtgccctcgcctctacggctggtttatactgctaccactactgatggacatcatcgttttcattgctggccgccttgtctgacgccgactggcttgttcacctccacggctgcgcgccttcgtcatcattgactggcgtcatcgtcatcatcagtttgccttcgccgccgcccatggtgtcttcgttttcatggttagtctattttgccgccgttcaaggacgtcttcattttcgtcatcattctacttcttccgtcgccgactggttatgccgccgtcgactgggtggagcaacttcatcttaattatcttcggaacaggcaagctctattgcctcaacttcgcaagttttgctacttcaccaaccacaacgtccacaagatcttcgacatctcagcatgcacttccagattcgacaccgcgctattccactacaacaagtggttcttcaattttcaagaattctagtcggacattttcaacatgtatcttcactcaagcaatgactactcgacgacaagaagctataattctcgactctatgttcagatgtttcccaactaaccaaagagtcgggggctacacaaatacaggactctcaaaattcgacaagctgaagcaatcaattaatcagccaacgagtcaactccaggagtcatcagttttgtcttcgcttcagagctggcgttctacttgagcaactccaattatttcactggaaattttggcttctccacgctgccacaatttactccaaaattttcaagtatcaagtttgagattttatctatatgtctgggcgtttggagttatcaaccaattaacacagattcaacgagttggacaacatcatctactttccttcaagtgaagcatctacaacagctacaattccaagttctactgccatctttacagatcaaggggtgttgcatcaatcttcgttatgcacacatcaaaaaaattacttgagcttcgatatcttctcaacagtttgatggattattgtcattgacttcatcaccagcacctctacttcatcggccctgacatctctgccgttgctaatggatgactatgtcttcgcctccggttgcttccgtcattgccgacttgttatttcgccttcacggttgacctactatgaaaacgctgatgagcgtcttcgtcattatcatcggttgctacactgctattgactggatcaccgacatcgtcatcttcatcaatatcctgtcaagcctcttcaacatagcatattctactgctgtttgatgggtaacttcgtcatcataatcgatcatctatgattgctgcttatcatcattactgtcggttgcgtttgtcgtcgccgactatttttttcatcttcatgattggtggatttcgtcatcgcctttgatgcgtgtctacatcttcaccgtcggcttgctttcgtcaccaccgactggtatcctcaccttcacggatggctaattatgtcgccgctaatgggcattttcatcttcttcaccagctgcctcgtctgtcatcgactgattatttcgctaccatggctacacaactttatcgctgggcaccttcatcttcattgctggttgacctgactgctgccgactggattcttcgcctccacggttgtgcaacttcatcacttttgattggtatcactatcttcactaccaccaatatttttgccacctctggtgagcaatattatctctatattggtcgccttgtttctatgccaactgcatcagctaccatcaatggaccattgcgactacggcagaaggacaagctatatgatcaggggcttactagctcaaacacaagtatcataccttcaatttggacttgttccggatacatgcaacatgaattcatgatcatgagtctattttctatgctcaaagactggactatttattattccccgtaagggttatcaatcgaatacttgcgcaagtcaggattcaattattatatctattttggagtatcccataagggataatcactctgatcagaagctattcatataagctacacttggtctatatcacccggaagatttattactcgggagcatgttacatgcgtcatcctttaaagggtgtcgaaggcatattttttagcctaggcctaatatgtctgcagcctatattttcaggtgtagcctgtcacgttcttttagggacttagatactttttgcttaggccaaagtgcacgtgatcaagtgcccaataccttaaaatccttttataccgcagttactcaactttttaggagttggtacaatgcatcttaaaaggtgtcaaacagtaaagctttatatagctgccccgctgacttttttatataagtgaaggtgctgtttgggtttttaagcaattgattgaatacaatattgttgctttttgccacgtaagtgtgcatttttatttgaccaatattatggcttaggctgattatatatcttggtcattttccaagcggttggtaaatcctttatgagtttatttactcggattttgcaccatatatgccgtatatttccgggtgtggtgaaaccatgtgtcttttagagagttaagtacatctgttaaagcagtgtgcgcatggcgtatgcccaatactttcaaaatttctttattcacagcattcaagttttttttatagctgttttgctatgtgaattttcaatgatgtagtcaactttaggttgctcacatcaatttttaccaagcagtcggtatatcacttggatcatgttatttgggggattcacaccgcatatgctatatattgatatcaagtcacttggttgattacaattatcaaaaccactcggttggttggattatttattcgttgactatatgcttagtttgttcagctaaccacgtagtcgggggtacacctattaggtgcatctagtcgatgcacctgactttatttttcagccctccacagtcttcatatttggtaaaagtactcgggagaccatggcaaaaatgattgaagaacttggctttggagtaatctggttcgagagaagattatctttttgactgtgaaggtctcaggggctactgtgcagattatgggtaccccatacccacacggcatggttatccgactagttataggggataacttatatctatggaatatgtaacagatcatgacttgggtattacgtttccttgtatattacggaatggcctaaagtcctggtttggtaatattgtaaagtagatttaggaaaccgataccgtattggttaaggtttctatcttgtaatcctgccccacgtcttatataaggtgggcaggaggccctctagggggcatgagcacatatgatcatcagatccgcctcagggaagccaccgacgccgccgttgggagggtgtagtcgccgagagggagggacaactgtcaaggtcgacggggagtggaagaagaagaggcggagggacggtcgtcactgccgttgggagggcgctgtcgccgagaaagagggatagccgtcaaggccgacggggagagatagatggagagggagagggggagggacggccgttgccgcgtcgtgccggcgagacggaagggagagggggagatggagagggagcagtgccactggaggggagagggtagaggaggggaagcgatgccgctggaggggagaggggataggaggggaagcggcgccgctagaggggagaggggagagacggcgcctgtggagggaggaggacggggagaggcggtgtcgggcagggggagggggctggtggtgggagaggggaggaggggtgaattaatctagggttagggttttgattgatttggaactaattcgaaccatccataaaatcaaaacgaatggctcagattgatagagcgtcgagctggcctgcatcaccgaaccgcaccacttaatctcacacgggccggcgacccaacacattttcggttacggcccacacgataagtaagatgaggagcatggggatgttaattaaactttggtcgcttacggcgtgagaaaagtgggccggctcagttgtaggctaaagaagaaaatgggctaaaaaatagcccatatagaaatgaggatttttatttaaataaatactgaaatgatgtttgtattatcaaaattagcaattaagcactataaattccagaaaattttgaagagtataattaatatggagaatttaatacaaattaaattcaaccatatcattttatttctcacacttactttactagtaaattaatttaattatatacctacctacttagaaaatacccaaatatttcaaaaaattcgtatttcacttaattagaatttaacatgttttaattcaattttctcgttttttctttgcaactttccgttgcaatgcacggagtctagaaaatacccaaatatttcaaaaaattcgtatttcacttaattagaatttaacatgttttaattcaattttctcgttttttctttccgttgcaatgcacggactattttgctagtaatgaaataatccactagcaaataaccacattttaaaaatgtctttcctcaaaaattcacttcaatggtgtccaccaactataatcacaaaatttgtcgccctagagttatcagtaatgtttgtacaatgtttgatacgtcataagcgaacatgtcataagtgaaactagtcatagccatttctacttggctgacagatgttgaatcctagccacccaaattccaaatcatccacgaggctccatcagaaaaaacggtgcatacgcatttcaggctttcaacagtgtcatatttaccctaacatccagaaacgaatctcactatacacgatagacagcgtacctataattatttctgaggccgagaacgaaaacaccgcacatccctatactgaacaagcaaaacaaaaggtaaagaaacaatggagaattaattgggtagcgaccaacagaaactgctacgctttgtgcctccctcagattcagagggaaagatgcacctctcgagctcaactgcctcctcacctttacaaatgactagtcaccagcaaaaaagattaaaaaaaaaaaagaatgtgcaatgaattaacttgtctcaagtcagtcaatcgtcaatatcctgcacccattgcagacctgcaacaggacaaattaaaggtgtcaagcactcataaaataaagttcaacaatatgggtgccataatctcgctaaagtatgcgagaaaaaaaatgccagattgaaaaatgacgagaacaatttttcaaagtaaagaaaaatacgtgggtaaaccttcagcccagtataagaatattgaatttctcatagtataaggttctaaaagatactaacaatttctacagagatggtgctgttttccagtgttgttcgcgcacagacacaagacagttcacactagaaatatggaggacataataaagctgctaggagctatgtgagggtggaactgaccttctaatactgattccacagctgaatttggaatcataagtccaacaatccgctcattatcatttgtctccaagcgagcgacacgtatcctcttgtgaatttgtcgaacctgtttgatcatgtcagcaaaaaaagaaaataccaaagagagaagctcagataaaacatggacgacatgtacaagcagcgaacctgcttagctagggccttttctactatgccccagacaggaagtattagaccacccaaaatattgatttcctgtaaccttctgcctactgtacaatagcttccaagtttgcatttgggtccatgcatacactgaaacaagtcacaggacacgatttaatgaagtaactggctgaagtacagaaataggcaattaattaatcatgtatgttctcgaaacaaaattgttgtgctcagataaaagtcacaaagtaaatcatgatcctgcaactataaattacttgcacaaaataaggggatgatagttgaagagtaaacagataattcagtgttggattactaaaacatatttcatacaccttacaataacttttggaaatttgtcgttcaaagagagatccttttgataatagaggaaaacaagttcctcaaccttttgactcagtttatttttcatccctcaactccaaaatcaggtaacctatccctcaactcttaaaaccggagagaattagtctattcaactgtttggcaattgtttcacgcacataagcacattgcacacaggatctgagggggtcaaaacctatttttagcaggatgagaatggaaccatgctaagagttgagggatgagagtgagactttttgtacagataatgatacaacagctttaaaaagagcaaactcatactggc

SEQ ID NO: 69812 - DNA, 2430 bp, Oryza sativa
  unsure (1)..(2430): unsure at all n locations
ccatcatcctatttaactttcccgcgagtagccttgtagaactccagcagcccagtgtactgtaattgatcgatcgtatatggccgtgttntagttcgtgtgccaaatttttatttaagcatacggatacacatttacagtattaaacatagattaatagaaaacaaattatagattccacctgtaaactgtgaaacaaatttattaaacctaattaatctatcattagtaaatatttactgtcacccgaccaccaactcggccaccgtcaccggcggccgccggctcaacattttcgagggccctaggcgaacttcacactatatgcccttaagaagttaagagtattttttttaacttgtaatatatactctataaaccacaaatactatagtaacataaataaacatttctaacgtggtaaataataaatcaagcagtttacaagttgcaatatagtaatttgtttcgataaaataatatcgatagtatgattgacaacttaaaaaaacatagtagaaacaaagtactatgacctaaaatcagtgagggaaaaatctatataatcaagggcctaggcctaatgaaaactaatccaccatataccttaatttaattagcttatggacttatggtgcactgaatggttgtatacttatattgatcccttgaacggttgaaccagaatggtagaaccctaagtccctaatctaggtaatttaatggggaacaaaaaataaattaaaagaacagttcaattcgaatcagtgaagagaatcgatggattggatcatcacctgatctagtgagaaggatcaatggattggatcatcaattctaatcagtgagaaggatcaattctaagctattgggctaaatacctatatagggtatatacctggatcggagcctccattttggctgggccctaggccatcgcccttatggccctgctccagagccggccgtccggcggggtgccagggacggtgcaattcagcctgccgccgcagtcgccggacttggagctggcctgggcaaagaccgtgttgccactgccgctgagggagcatccggtgctcgccagatggtgacgccgggggaacacgttgacggcccacacgagccctggggtgaggtgagccattagccgccgacgattgggagggcgcccgcgcgcaccgtgaaggtgcagttgttgacgatggtaacggtagcgccgcaggccaatggctggaggatgagcggcatcgagaaggtaaccggtgaagttggagactccatgctgtgaactaccagtgcgagctcaagcgtagtgctagcgtttgttgttatggattggccgtgattgtgcaagcgtttaaacagtgtatgtgctgaccaagagctggaacatggatatggatcatatgccgtggacctgaggttgttaccgttttttttttttgacaatttggtccttttaaaaaacttattttgaaaactaaccctcgccaaaaacttcaaccaaaaatagactgtgggctcagcgccagttccgttggcgctgagttccaacgggtcagcgccagtgactttggcgctgaacccttgcccacgtggatcaccagtcgatccgattgccgacgtggcgtagggtcagcgccaatgcatttggcactgacctccgtatagctcttaagtatgtgtagtatgcattggcgctgacctccgtatagctcttaactatgtgtagtatattttcaaatcaagtagtaatgtgtagcgcagtggtgaagcccatcccttggctagttggtgacctgggttcgaaacttgagctttgcaccttttttttcgcatttatatgggcaacagagaaataccaaaaaagagtgcagacatgggggatcgaacttaaaatctggtgaaaaccaaacaagcatttcaaccactgcactatcaatagatcctggtaatgaatagcacactgtctacttattatgtaccacgtccacaatcaactctgctagcgtggcaaattttagcgtcgtactggcgctgagacgttggaccatagcaccaacgggattgacgctaagtccacggtctatttttagttgaagtttttgacgagggttagttttgaaataagttttcttaaagtaccaaattgtcaaaaaacggtggttgttaagagtgattatacgtatgaaaggtaaagttggtcgtagcatcacaaattagaataaaaaattgatactctctccattcctaaatatttgacaccgttgattttttagcacatgttcgaccgttcgtcttatttaaaaactatatatgtataaatataagtatatttaacaatgaattaaatgatagaaaaagaattaataattacttaaaatttttgaataaaacgagcagtctatttaaaaaaatcaacagcat

SEQ ID NO: 69813 - DNA, 1174 bp, Oryza sativa
attgcccccctatcggcattggctagaactactccatcggcttgttagctgatcagctatttgatctgttgtttacatatcttgtcagtttcatgatcaaacagactctctcgtccacatctcatcaatttttggacctacactggagctaagcagatctcccatgtcgttgttgttgttgacttagttcgcgccaacagttctgacataattggccgagtgcaactagtcgcgtttgccaaaatcaacctctatttgtttcatactgctgcttaggagagccgcatgcaaaaatcaattttcgcaaacagggctcttaacagactcgcatgcaaaaataagtctattttcacatatggacctcttagtggcctgtctacaagtctaaccgtgctcccctttccctctcaccatcttaaagaaataaaaatctaagtcacctcccctctcatttcctcttctactctctccctcaccttaaaaaaaactctctccctcaccttcccctcccaagcggtgggcgggagtggccggcggcagcgcgcgcgcgacgagagccagcaacgatgacggacagtgagggtggtagtgaaggtggccctgcccttgtgggcggcgatacatccagaggccggccggtcggccagtttgggggggggggcctcagcggtgttggatccgacggtggggagggctgcagcgacagagctcagatcccatggtccctccacccataacgacgatgacgacaacaaggacagcgatggaggctttgagcaatgacgacggtggtggcggctgcgagcttctagggctaggattttggtattgtcgtttccttttcgcagacggacgatttaactgtctgcctttagccgcaatgcaaaagtttgatttttctcataccttttcgtgcatacggctagagaaactgcatgcgaaaataagttttgaccatacgcaaaaatcagtttcgtagtaatggatggccgggcgcggaagggaagtggggaatgcttgatatctttttcgctggtcgtttcatggagcacgtgatgcacgtggccatgtgggagagaagagaggggcaaagagaagaaagggggaaggaagaagagggagggggcgcgaactggcaaagccagcaagccaggcgataggggcatgcaagtgg

SEQ ID NO: 69814 - DNA, 4777 bp, Oryza sativa
cctgcagcccgaagcagcacgacgccggcgccgctactcgcggtgatggagatcggcgcgacggcgtaggcggcgggcgaaggagacggaacgggtgctggaggaggggaggccaggggacagggggctgggtcgcaacgcaaggaggcaagaggcctattacgctgctgggtcagtggggtgttgttacaggtttgggctttttggtggctcggtctccatctgttccatctcctcccaaccccagcccggttgaaacaaaaaaacaactagggtgtgtttggaactttggggagaatactaccaatcgaacgtccgatatatcaaaaaaaacatcggtcggtcaaaatgttgcagctgaccaacaagtgaaacattaatttatatatggtgaaacaaaaaaacagcaactaaaacatttaaaaaatttatgaaacacagtgaagatacacgttgaaacatattgctatcacttatgaaacaataagagttaatagattgaaacatatatttttctttcatcaaaatttaatcgtgtgatattttattataaagatttaattacaacgaatacaacggtgtaatcgaatcatagattggataagtagtttagaagaaaaatcattttaaagaccgataaaatgcatgcatgcaagcattgatggagggtagtagcaattatttttgataattttatgaaacacaataaaaacaggtgctgaaacatatggatataacgtatgaaacatgaagtattaatagtttgaaacttatatttttctttaatcagaatataataatgtgatatcttgttataacgatttaattccaacaaatataatggtgtaatcggattttagatcggataaatagtttaggagaaaaaatcatttgaattttgaagacaaaccccgatacgtctctctcattctaaatgacctttccatgggtctcacaccccatgcacacttggaaacacatgcttgcatgaagcgggttcgatttttctcttttgctcggacgacacatgggaagcaatttccgaactttggataatgggatggtaaaatcttttcccaccttctaaaatggtaatttttaatcttaaccatccattcttcatatctcatctcaaccccccactcatatccctatcccaatctcacccctcttactccattatctaaggctgcaggtaaaatggttgatacctgtcgtcgggcaagcatgagaaggacagaaagttggctgccagtatggattttcagtatgttccgttgttcggtaaggcaaactcaacttgctactttgttgggcttgccttagtgaacgatttggatgattgcatgagagacgtttgctctcgaaggagagcggagttgactctcccgagcaagctatctttttcttgcccctccgggataggttgccaccggaagtgatgattttctttttatggatttgctagatttttgtcgatagaaaatagggagaaagactcttgatttttcggtcgtcggatttgcattaagattcgtgctagcgtgtggagggaaaaattcgtgtgaaaatttacttgtgcacttgcacaggatcaaactcaggacctcgtttccgcaaaccatgctagccacttgagttgccataagattttgaaagatttagacaagttacattacatacattctagttacactgtaattatatttgaaagattttagagaaattttctttcgaaagttctatagtaacttcttttatgattccaaacgactggtcttgtcacgccaggctagcatcaaccgttcaacctagccttggatgacttgaatggcagcctagccaagcccaaactctgtattgtgatggatattgtctgtatagcccagagttttcataacacaagggagagatcacactaagcttccccttttcgggtttgcagcccagctcgtgaggcaaggtcacgctgctgctgtaggatcgtaaatgatctttcccacctcaaaagctagccaatgagggatgggctcccccacttatatattaagtttcttgtccttctataaccaatgtggactattcaataatctccccccttcatatattggtgtccctcagccgttcaccaccccttcaccgtttccttatggtctctcaggtatacgttggtgtccctcggcctttcaccgtccattcactgtttctctacggtccctcaggtatacaggctccacaagcatccacggtccatcatgccttcgcacactttgccactcaggttagagatattgaactaaccagactcagatagcaattgtagaatcgtaaatggtctttcccacctcaaaaattaaccaatgaggtgagagactcccccacttatatactaggtcacttgccctttcacaaccaatataagactattcaatagttgcagcgagctgaatttgtggaaacaaaacggctgttcgtaaattgtgcacaaatttttatgacaccaaattctaccgttattaaaattatgcgtaatcttttacaagacattaccccagccctgtgtgttactagtcgcttttgcataaagtttcagaaagccctaggtcaaaggtgtagcacgaagatctgcagtggttttacctcaggtagttttactcattgtggagaacgttgtcggcgcctcggaggttcaggctgcgaggataaaattttctctttacgtacataaaattttccagttttctaattctcttaacgtacttcagttgcagtattttctcttttaccattggttatgaacatacttcagttgcagtattctgtctcaaatgactacagtatatagattaggacttaggtgtagtgatgattctctaattctctactaatcctattgacctactgcatgtaaactgcaagtctacagcatagggtcgttgaagctacttgcaagggtcgtcaggttaattaacctgtagggggagctttggaagatgcagcagtggcaggttcgtcaaatgtcaacgcgagtaacccttacgctgcccattttacaagtcccaaatgttcttgttcgcagcagtcccgggccatcagctacctctctcgagaaaagcagtacagatctttcgatctcccacacacgcctggttgcataaatctatgcgttttcaacttcacccctcctgggatatcgcaagcacgagggagatctaaccatcagatgaagtttctgaattctacgttttgttttgttgttttgattttctttaccagagcgagatcgctgtgctgcaattgccgtcgtctgtcagcttattagttcagtccaggcattatcgggagcgtgaagcggaagcaatggttagttgttgcagcaagaggatgagcgatgaattatgcatggcttctatgtcaatagaaaagtacaaaaggcaaaagcagattaaatgctgaattattgttcttcccttgccgagcagacagaccggtggttcgtggagtgaccaagcctgaaagttctgtcaaaacaagagggttggtggtttaaacatggaccgttgttgaaaaatagattcagatttcactatcaatcttttatgcatcgtggggtcatgacgggacagcgtccaaatttcgaacatgatgagcaaatatgattcacaggactggccaaatattatgcattaatagctataatcaagaatggctttggtgtatttcagagtggcacccactgcctttcaaggagataaggactaagatgtgctaatccctccaactatacatatgtaaatcattttagtcatactttgtcgtctctgttctgttcctgttatacattttctgaatgcccacgttatcatcagcaaatatctcgcaatctttctcatttccggcatacattagaagagagagtaaataaagcgtggaaatatacaaaattgcatgccaatttaaccttataacttagttcatgtgttcgagaaactaagatcagtatacttgaaaaactggtgaaaataattggtcgtagcttgttgagtaaagaccggattttgttccattataaaaaaaattgaaccagtaaatatgaaaagcattgcaagttttgtctaaatgagactgcaagaatcatgatcttacgttaaaagtttaggccggatgcaaatttacatgagattacaacaaacacgacgtcacggcaaacagctaagctcatctttttatagcccaaaaaaactttatagcttgacgaaaaataattctggagaaaacgacccgtacgtacagcggtaaagggaacagctaatcagctaccacacaacacagaatggcaaagccagctagtggataacagaacaaacaagagaagatctgtttgtttaatgtgacgaccatctggccatgtgcaaatggaatctcagcactgtggttctcgtatgctcacctcctaactaatactttccataattttccatgctcaccacaaaggcaaaagaacaaaaaaagcaggaacagattagttaatgctactagctggagtagtaagcactaagcacggacagtaaactgtcaattcttcaaaattaaccattttacatcagctgcagtggcagtaaaaacttttacagtgccacaaacaaaaaggagaagaaattcagccactcgctgaatcactctcacagtcactcaaacaccatcaggagcagttgcattgcagtccaaacaccacctcccctctcttccatccaaaattttacagtgaaaaaaaaat

SEQ ID NO: 69815 - DNA, 759 bp, Oryza sativa
tggtctctacccacaaatcaaaaacaataatacaaagcattgaagataaaaaaaccataactagtacaatcaccgtggatatcattatatcaacaagaaaaaaagaaatcgctaaagagaaactatcaatctccgtgttaaatctctaaatcccgaaaccgcatcaacaagaagctagctactcctccggctcaagatcgcccccatctacagcagatcaacatgaataaagaatgcaatccccctacaaatcgaccagagcagggtgccgtggactggcacgaggacacacacgcgcatgatcttgccgtcgtgcgacggagagaggcggacggggaggagggagaagcgtaccattttggtggccgcggaggggaaagggggagctagggtttcggaggcgctcccttgtctggtcgagacgctgcggcgagtggcggcggggaggggaaggagaaggtctgcggctttatacggctgagctcctggaggctagggcttactggtgggggagagagcgtgtgctgctttgtgggccagaatgcgcatcccatgggccatgggccgtgatgcgttgccttatagttggaataagttcacctgatgtccctcaactttacaccgagtttgtttgtcatcccttatcctcaataccacaaatcttcacccctaaatatacaaaaccgttcaatttatatcccatggcagtatagatgtcttggtttcgctggcgtgacatcttagtggacaaaataaaaa

SEQ ID NO: 69816 - DNA, 1008 bp, Oryza sativa
ctctttcttatatcaggggcagtgtgcgatgcatatccaatcgccatgtttggagggggaagtaacatggggagagagcgatggattggccgctagctagctctcgtagcagccatttctttgggtgcaaaccactgcataaacaaataagcaataattaataacacaaaccatactaaacaatgccttgaaccaattgatatcaaatgtaccatcgtacatagctttcttcacatggacaaagctagatcttgcgctgtatttcgcgtgcggttgctggccagggttggccaccccgggcccacatgccagccacagttatttaggaaaggctaattagtttataaaatgatgcttgattagtaacctaaagtacgagccatgggcagattagttggatcttaattcgtccgttgcaatgctgccaccttggaggttgcttcaaggaaggctcctgaccacaagcaaatactactactacagtactactatactacgctgttgaaatgcagagctttgctcctctgcggctgttcttgttcgcttgcggccggaatacatgcagccaagtacgtgagatgtacgcgctacggacaacgtgcatgtgaaggaggcgctgcttttcaggtcaacattttgtggaagggttttatgttgtgtttgcgtttgcgcagctctgctcggcgatcccagatttgcgtggaggaaactgctctggtactccatggtgacggctcaggcgcggctcaaccgttggatgctgatcggatggtcgatcgggttcggaaaaggcgtgctggttgcttcgggatgaagggcaatggttttacttgagaattactggagtagtagctgaactcggcgagtgagtgtacaggttgaccattttaactcgcactcaagttacttacagtactcctactcctaccttgtgaagcgaataatgtgatcaacattggatagcacaaaatggacgtacgacgcaggtaaacaaatgcagagttgaat

SEQ ID NO: 69817 - DNA, 746 bp, Oryza sativa
gcatgcttcctaaactaccaaagatgcggcttttattaaaaagatttatatatatgaatctcttagaaaatcgtttcaactttataatagttaattcattcggttgtatccttggataattgtcacgaaccaatcggtcactcagcatttagctcaaaagaatagacacttagattgtcaatatattactggcagaaacctgttaattctcaattcccttgttattaccctcatatctaactacgtaagagaagtttcttttaaaaaaatacagtctctctgtaccttctcaagagccttaaattaatcgtactccctctatttttatcaacatgacgttggttagttcaattttaaacatcaaataaaaacagaaggatttcggtaataatttccacaaaattgagggggaggatatagatgtgtttacctgcaggtagttcaggatggacatacattgtcaagctcgcagcaaactttctgaggaaaaagcatatgcctgcaccaatcgctgcgttgaaattgcaagcaaaggtaggcatgatgaattgatgatgatgaacatggcgacaccggtctctgcagcagttggtctctctctctctgttggtttggtccccggccgttgttaccgttactgacggacgtacgcacgcacgcacacgtacgcacgcaccgaatccatcattagtgcgccgcacgtcgtgagagccatataagtatatagtattccttgcaatacgctg

SEQ ID NO: 69818 - DNA, 6627 bp, Oryza sativa
gagatagttttctcgctaggcaccacgacggaacgggcgctacagaccaacccccctgacaagaatctcgcccccgagattcagcacctaagggagcagctccgggaactcggcgcggaggagatcttctcgttcccaggttgcctcgtcttcagaatgattgctccattggaccttgtagaacttgatggtcttccttcgagtctgacgttctgcctcttcaagaaccttgatcggtatttccttgtaggtcagattcttttccagttcgatattatccaggggaacttgttcttctggaacacggagacacttcttcaactgagacacgtggaacacgttgagtacatctgcgagactttcaggtaactcaagctgataagccacttcgccacgtctagcggttatgaggtaggggccgatgtagcggggtgctaacttgccggacatcccaaacctcctcataccacggagaggtgatacccgcaggtacacgtggtctcctttttcgaactcaaggtcacgcctccgattgtcagcgtaattcttctaacggttctgagctgtctttaaatgttctcgaatcagcttaacttgttcttctgctgccttgagtatgtcaggaccgaataccagtgcttcgcccacctcattccagcacaagggagtgcggcactttcttccaaacattgtctcattcggcgacatctgaatgctggcctgataactgttgttgtatgaaaactcagcatacggcaaacaacgatcccaagtgccttcgaaatctagggcacacgcacgtagcatgtcttctaggatttggtttaccctttctgtctgaccatcggtctgtggatggtaagctgtactaaaatttagattggttccgagagcttcatgcaactgcttccagaaccttgaggtgaactgagtgcctcggtctgacacaatctttttggggcagccaaatctacatacgacatgggtcatgtagagttctgctagcttctttccatcaaaggtggttttcactggcacgaaatgagctgatttcgtgagtcgatccacgattacctagatggagtcgtacccgctaggggttgttggcaagccggtgatgaaatccattccgatctcttcccatttccactcgggaatcggtaggggttgcagcagaccagctggcctctgatgctctgccttgactctctggcaaatgtcacacagggctacgtattctgcgacatctcgcttcattcccgcccaccagaagtatgccttgatatcctggtacatcttcgtacttcctggatgaatggagtaggcggactcatgagcttcctttagaatgagatttcttaactccttcttggccggtacacagatgcgtggaccgcaccaaactgtgccttgatcgtctatggagaaatcggtgtccttcttctcctgtattctttttattaattcttttatcccttcatcatctttctgagcttcccggatttgcgattctagggtaggctgcactgtcaagctggcagggacacctgactgtaccacggtcagctttaacttctccaattctctgcacaggcgatcttgggctggccatatttgagcttcattgcaataggtcttgcgacttagcgcatccgcgaccacattagctttaccgggatggtaatgaattccaaggtcgtaatccttgattagttccaaccatcttctctgcctcatatttaactcggtctgtgtgaagatatacttaagacttttgtgatcggtgtatacttcacatctattcccgattaaatagtgcctccagatcttaagagcatgaaccacggctgccaactcgagatcatgggtaggatagttgacttcatgaggcctgagctgcctggatgcataggccacaacctttcgttcttgcattaggacacatcctaagccttgtcttgatgcatcacagaagatctcgaaatcttttcggatatctggcaaggtgagaactgggacagtggtcaaccttttcttcatttcttgaaagccgtcttcacaggctgctgtccattcaaatttcttttccttctttaacagctcggtcataggtctggctagcttagagaatccttcaatgaatattcgataatatccagctaagccaaggaagttgcggatctctgacacattcttgggcgggttccaagcaagtacagcttcaaccttgctgggatctacttcgacaccgttggaggagatcacgtgtcccagaaatgctactcagtccaaccagaattcgcattttgagaacttagcgaatagttgatgatccctgagctttcccattatcagcctcaggtgttcagcatgttcttcctcattcttggagtatatcaggatgtcatcgatgaataccacgacaaactggtccaggtattccacgaagattttgttcattaagttcatgaagaatgctggagcattggtgagtccgaaggacatcactgtgaactcatatagaccataacgcgtcgagaaagcggtcttcgggatatcttcagatctgattttcaattggcggtaacctgatctcaggtcaattttagagaaaactcttgctcctttaagttgatcgaacaaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactttccaactcttcgatttgtcttttgacttctgctaactcattagctgccattcggtagggtctttttgcaattggtgcagtgcctggtgctagttctatggcgaactgaatctctcggtctggtggcatactcgttaattcttctggaaatacgtcgggatattcacagactatgggcaccgactccaaggaggtgacttgtaaacaggttaggatagaccgacttgcggtaggggcgttagaggtaaagcggacttgctttcctccaggtccttgcaaggtgatggacctttcggcacaatctatctgtcctttgtgcttagccaaccaatccatccctaggatgatgtccaagctttgcgagtctaggactatcggtttggctaggaagtcaacttcctcaattctaaggttaactcccgggcatatttgagttgcccttatattccttccaggggaatgtactatcattggtacacgtaaattttgggttttccaaccatttcttttcacaaaagcttgtgatatgaaagaatgggaagctcctgaatcaaacagaactattgcgggtacggagttgacaaagaacatacccatcacaacgtctggagcatcctgagctgtctcagcttgaatgtggttcacccggcctcgaccaaagttgttggaagcacgagaaccttgtccacttgcctgagagctaggtcgagactgagctgccgctggagtacgagttctggcagtgctgccattagcatgccctgagttggtgttggtaggattctgagggcactgtctggcatagtgacccatctggttgcaccggaaacactgaactgctgacagtcctagcggtgacttgaaagaggtaacactgtttggtgcagtattgccacttggggtatgttgctgtggctgaggtgccggacggttcatctgaggacgaggggcgtagcccggctggcggttagcctgagtgactgactggtgatattgcatgggttgaccatagcgagggtgaggtgcgcctagggaagaattcccctgatggttagacttgcgtttcttatattcttcggtagcctcttttctagcatcctcaagtagaagtgtcttgttgatcatatgttgaaaagtggggaagtcatgagcaagcaactggagtctcattccaactgcaattcccttcaagaacttcctgatcttcttcttgtctgtgtccacttcctcaggggcataccgagccaacttgttgaactgacttaggtactcattgacaccgttgttgccttgcttaagcctgttaaattcctctttcttcatatcaatggcgctttcaggcacatgagctgcgcggaaagccatagcaaactcaccccaagcaatgttagtgggttcagggtgtgcattgcagtaattctcccaccaatctgcagcaggtcctcttagctggtgagaggcgtagagcgtcttctcaacaggagtacattgcactaagttgagttttctatcaacatctttcagccaatcgtcagcctcgatgggctcgatggtctgagagaactctggcggacgagacctcagaaagtctgtcagcttggatctattgttgcccatgtgagggtggccatttccatgtgcattatgctgaaagccggctatggctgcggctaatccttgcaagatttgtgtctgtactgccatcaagtgctgcatgttgttttccacatgaggtggggaagggatgcgttcttctccagaattgtgactggcagtgcggtgagagcggtgagactgttccacttctgtattacgggaagctgtgtgatgcgagcgattgctgcggtggggttgctcaacttctgcattgcgggaagcagtacggtgcgaacggttgctctggtgagactgctcattagctgactcatgatttgcttctggctcaactctaccttcctcaaaaccgaagcaggctggtgtacgagcagcacggtgggggtggctagccatctaaactcccagaagagggcgaggtaagaattagataagcacttaggagggcaaggagcaaagtaaataacaactcagatagcacgcactaggcataaactggatttttcaaatcataaaaacacctgatacaacgggtgtggacaagtcacagagctacgccgagcttgactgtacgcacaccacctagaagaaccagactaccaaacaacacccacatcaaacacacgcacgcactacctcgccacgactccaaaagagttggcggcggaacaaaagggcctaacacacggacggctgctgaagactgcctcctctactcctcgtctgcctggctgcctcctgtagtcggctcctcagtcgaagaaacgtcgatcggctgacgcgaagggaccggcggaacctgtcgagggcccccaacagcacgggccgctagcggtgggggagctgggtagtcgaagcagaacacggtggaagaaccaacaacacgcttccgcgcagtgcggataaagcgtgggccacggcgggaggaagcaactggggtgtgtccgggggtgtaggaggggctaactgggtgtgggtagggggagtacacttgtgagtacggcgcacgcgagctgggggagcgcgggccactgggagtgcgggcagagccgcgagagctgtgggaggacaggtggctggcgtggcagaggcggcctgagtcccaagagacagtgtcaactgaggtgacaccctcctcggccagatgggcctccagagcggcgtagcggcgggcaagggagcagtaagcctcgaggagtaggttgtgctgagtggcctgagcctccgaaagctcaaccatgcgagtcagcactggctgagactcgttgtacggacaagggtacctggcgtctgcgtggctagaaggaaggtgtgggagctgccggaaggcagagcccccaagacggtggctgtagtcgtgggccaaacgacaaagcgcagtccaggagaggtcctggtacgcgatctggagagtgggcctggccatagtgaagtggtgtgggcgaaggccagctccgtgtatacctccacgagggtaaaggtacacagagagctcacagcgagggggaacacggtccacggagtaccccgtgtactcgggacatgagaagccaaggaagcgggcgaggtcacgaagctgagcgacgtggtgaccctcaccaaaaccgtgggaactgaagctggcgttcactgccatctacaattttgaaagagggagaaaagatcagtaaccattttagcaacactactgaaaataaagaaaccaaaagaagccttagcttttcgcaagtagttttgaacttagtatccttagggtcgtcctaaacgtcgggtttcgccctagggccaagcctgtgctctgataccatctcttgtcacgccccgaactagtcccgagcggaactagcccgtgacgctccaaattaacctgttaatcgataccagtcccaggaaacagtgctggtatcacaggaagacagaatatcacagcaaacagaggtatctttattatagagtaggagtacagtcatgttgggctgcggacagatcccgagctcacaactgcatttcaaaagggaagcggaagccaagacttggaccaaacatcacaggcgcgacttgggaactaggccgaaaccctaaaactcatcgtagccggcttgctcttggaagaactcctcgtcagcgggatccgcttcatcttcttcagcaactgggggggattatttatatagagcaagggtgagtacgggagtactcagcaagccatgggaatta

SEQ ID NO: 69819 - DNA, 5003 bp, Oryza sativa
tgaggctgcgcgtgggcccgccacaaccgcacccaccgcgagccgcgcgcgtgcaccgcgtccctcccccaaaccctagcacgcaccgcgtgctccctccgcacggtgaaccgtgtcaccgacaagcgggtcctactcgggaccacgcgaggtgagcctggcccaccggctccctctctcctcctctcctgcgcgtgccttgggccaccttctcgggccggccggcccattaagctcggccgagccgcccctttctctcgagccgcgccctagccgcccgaaggaagtatgtttcccctccctcttttctctttttcaaaagggtttaattaaatcatttttcctttagaccaaaaatccaataatcttagaaattcaatatcttctcaatcgtatgtccgtttgactccgttcaacttccaaaattcctcaaatctcgagatctgtttaatggcacgtttagaggtcaataatagggctttatttttgccgtttgttgagtagtcccatttcgcgtgtagtttcggagcccgaagacccgcagtgcgaggatttcgaggatcaagcaaaagatctcgagcaaggcaagtcacctttgatcatcttgcacctataatttaaatctaagtatttcttttccgcaaatattgcatgaataggatttacacaagtaattcggccgcggcttgcgagatagctgtcacgccccgaactagtcccgagcggaactagcccgtgacgctccaaattaacctgttaatcgataccagtcccaggaaacagcgctggtatcacaggaagacagaatatcacagcaacagaggtatctttattatagagtaggagtatagtcatgttaggctgcggacagatcccgagctcacaactgcatttcaaaagggaagcggaagccaagacttggaccaaacatcacaggcgtgacttgggaactaggccgaaaccctaaaactcatcgtagccggcttgctcttggaagaactcctcgtcagcgggatccgcttcatcttcttcagcaactgggggggggattatttatatagagcaagggtgagtacgggagtactcagcaagccatgggaattaagtgtttaatgcaggcttcaaggaaaggctgttgtttttgcaattgattttatttaaactcttttctgaaacaactaagtgagtgcttctcagacgacacggatgagacagtgcgtctcgtccggtcagagtatgtgcaatgtatcagtcttttgaattgatcaggattggcacccggccaacagctttcaaacggccacccgggcctggctgatcccatcagccgcagattttccaaacatcaatcccaaaccacatcagtaaattcacaaagcagtagtcaaacaaaactacgctaggaatcaccttacatccgcccatgaccgtgggcacagctgttcgaacagtttaataacctttgcagagggggtacactttacccacacgacattactaacccggatcatccagcccgtgcagaacggccacgactagagaccttaaggctttcatgacaaggcatttcgaaagccgacacaggttcaccatatgctgatgagaggggtcccagaccaacaacaggttaggtcccagaccatactgtgccaggaagcccaggggtcctccccgacaccaccccggcgaatccacttgtctctcagcatcaaggctcccctgattagctaattactcagccaggggtgtcccattccacccatgtggtcgtacttgtcttatgttcagatgaaattccaaggaaacggtccttaagtgcaagagcgggaaaccatacacccggtacgttccccggtccgcgattttggaaattcatttaggttcgcaagcaccgacccaggtgtcaggttttccaagtgttttgtaaaacccaagttttacccaagatgtttctctgattttaagtttgaaggcgaccgtcgatactcgtgccgagtgcacaattaccgaggcgcaactaggtggttacaagggaacatgatataacaattacaatggaagggtcagatgtaacaagttaggtaggtccgccaatctgccttgcagacgggacaagcagatttagtgcaatcctatcaatgcataatatttttcaagcaacataattaagttcaaatataggttcaagatgttcaaaggtggcttgcctcgctcgagatcttgagcttgatcctcggaatcctcgcattgcgggtcttcgggctccgaaactacacgcgaaacggaacaactcaacaaacggcaaaaataaagtcctattattgacctctaagcgtgccattaaatggatctcgagatttgaggaattttggaagttgaacggagtcaaacggacttacggttgggaagatattgaatttctaagattattggatttttggtctaaaggaaaaggatttatttaaatcctttttggaaaagaaaagaaaagaaaagaaggagggagggaaattaaactttcctcgggcggctagggcgcggcccgagagaaagggacggctcggccgagcttaatgggccggccggcccaagaaggcggcccaaggcgcgcgcgggcagggaggggagagagagagccggtgggccgggtccatcccgcgtggtcccgggtgggacccgcttgtcggcgactcggctcaccatgagcgaggtgtacgcggggcgtgctagggtttggggagggaggcgcggcgcatgcgcgtggttcgcggaggacacggtgcggcgggcccacgtgcagcctcacggctcgcggtggaccacgcgcgcgagggaggggaaacggagggagcggctggccgggtcagccgatccggtcgtggccgaggtggcgccaacgtggtagccacgcgggccggcgggaggttgaagaagacgtcagccggaacggacggcggacggcggtggcgagcggcggagcgaatcacggcgatacaggcgaaagcgagcacaccgggaagttgcacgggacgaggggagtcgagccaacggctcggatttgccgggggatgctcgatggcggcggattgcggcggcggcaaccggcggagggagaagggggaaacggcgacgaggtcacgagaggccgattcccggcggcgagagcatctacgcggctacgggaatccgttgctagcgtcggattgggcggagctgcgccgagcgaggccggcgacgagcgggcgctacggagcacgggcggcgagcacacagcgggcggcggcaacggtcggggcggcgcctgctagctacggggaggctactcgtgctactacccgagtctaaggggaggagatggaacgaggaaggagaacggagggaggcactaccgtgcgggggtgatggggcgcagtgacgagaggccgacggcacgggagtgatctctccggcctcgggccgggaaagaggaagaagacgagcgcccggagtcttcttccgcgtcctagcgcgcatcggctcctccggcacacgcgacggcggcggttggcgagagggacggcaatggcgcggacgagaaacggggaggattgggagggaaaagaggaagggagggcgcctgggtttaaagggcggcaatgtcggtttggaaaccgactttgggcggtcaaggcgcgagccggcgctcggcgcttgtggccaaggcggcgacaggaggtggatgacgccggcggggaggggaaaaggaaaaagaagggagaaagggagcttgccccttgccactttgggaaaaggaggagggagcgggggcgacgcggcagagggaggaggagctctgcctccgtcccttggaggctagcgcgcggaggtggcggggccgggtcgatgacgacggcgatgacggcggaccggtttggagtggagcggcgacacgggcggcagacgcggggcaggtgcggcaggcgctgacggcggcggcgactggtcggtcagccaccacggcgcgcgcgcgcgcgggcggcgcggcgatttgggcggcaggcgcgggaacggcagcgagaacggagagggaggacttggcgcggctcacggcagagcggagagagagagagagagagagagagagagccggggagggagggggagatgggccgagagggattcggcccatcgaacctgagggaggcaaaatagacttttgcggagggatttgatttgggaagaatttggattcgggattgaacttgacaatagatcggggatttgagatctgagatggcacggtcactagacaacaagcaaagaaacagatttcgcaattagggtttttaagagatagttttcccgctaggcaccacgacggaacgggcgctacaatagcctgccggcccccaatcctaattgctgcaattaccctccttgaattattgaacacttaaacctcctttgtcgactgttgtgcttcgatgcacgggccttcgggcacgcgcatcgggacacctcccctcaaatttaaaatatccaacgatgggtaaaacttggggttttacaaaagacttggaaaaacccgacacctgggtcggtgcttgcgaactaaatgaatttccaaaatcgcggatcggggaacgtaccgggagtgcggtttcccgctcttgcacttaaggaccgttttccttggaatttcatccgaacataaggcaagtgcgaccacatgggtggaataggacaccccctggctgagtaactagctaatcgggggaaccatgatgccaagagacatgtggattcaacggggtggtgccggggagaacccccgggcttcctagcactgtatggtctgggacctaacctgatgtcggtctgggacccctctcgttggcatatggtgaacctgtgtcggctttcgaaatgccttgtcatgaaagcctcaaggtctccagacgtgccgttctgcacgggctgggtgatccgggttagtaatgtcgtgtgggtaaagtgtaccccct

SEQ ID NO: 69820 - DNA, 2605 bp, Oryza sativa
cgacggccatgccggagccgctccgcgcggggctcgtggtcctctcgtccacccaccccttgtgcacccgcccgaacccgccctcgccgaggacggtgtccgccttgagttcctcgtggcggccctgagctcggcgaacgtgaagatccggaggttgggcgcctccaggatcctcccctccgcgctggcgtcgccgccggcgttcgtccggcctcaccaccagccaccgatcgcccgccgccggtgcttgtggctgtggcctggctcggcaacttaccagttggtggccgccctgggctcatcgcgacgcgtgcattgggctgcgcgatcgcgaccatgaccggtctcgccattgccgctgcaaaagagcaaaacccagcacacgaagtgcgtcagaactagagacgcagcaccaaaaccatgacaaaatggctttgttggttccagatcccgatgaacaaaataaatctcacgaatacaaagaaaacgtagtgatattgtaagcagagcatcgggatgtcgatattcatatatgtaccttgtggcagcgcatgacgggccatcaccttgacggcctccacctcgccgtcatcggagccgaagcaattccccatggcggacgcggccggcgagcagccaaacgagcagggaagcaccgggagcacttcctctctgtgagtctcttccccgagctataatggcttgtgtgcgtagatcatgtccttccagcgacgtgcttcgccatgtcttccgctcttcctctattaaaaaaggaggcggaaatgacctggacgtggtgtggaaggacgagacgaggcctggaggaaggctgctcctggctgggcgactggtcgactgtcatctgggaacccatgcatcaggggaggagcacatggcggcatggccgcatggcgcatatcgcggcaatatacatgttttgtggcacactggcacctcgtttcaaatttcatcagtgttcaaaaacattttgagtttctcaagattagaattttttttgcggggtcaagattataatattagatccattccaatgaaaaaagaatattagatccatttgcctattattgtacttatttttcaattttcttttgagaaacgcttgtttataatatgggatatttagcagaattgctaaccttcatttgacacaaatttgagttgaatatctgatgaatccttcaccattagatccttgtcactctttctccttgaaagccagcgagatagtggcgacttaagttaggatcccatattaagatcggggtaggaggagggaattcgccaaccttaaagagatggttaggtagtggaatgggctggcggcaaaattgccatagccgagtagtcggtaactagcagtgggccagtgatagcggatccaacagcaaatagacacaagagacgagaaaaaggtagggcgtgagaatatgatttggcaaattggcagcccttaggtagggcgtgagaatatgatttggcaaattggcagccctttgatttgcagtaggatcttgtggggtttatgatacccgggtattcgatagtagttctttggggctagatatgatggggcgggctgtcgacctccgattttataaatcggaaatcttatgtgtttatcagtaccaatccctgaatcagtagttggtacacacatacatagccgaatcacaacatatcacgaatgaatccaggctaagagagttaaatgcttacattagggccaggtaggccaacaactatcagagaacaacagcggaaaacaaaataatatctagcccgagacctagaatggaaccgcactccgatcagcttgttaggtacgcaagcgtactaacaagggcttctcttcaacactttgctaaaagatatatatagagcaacaatgagtacaaaagtactcagcaagccaccacacaaaatgcagtaatgtataggataatacaacgagtggctatggttactttgcgtaaagctgagttttcaaatatcatttcacaaacctaagacctagcataaactaatcatgttttaattccattgttcattaaacagcgacggttgtgtccactatccattgtgttcccaaggatagcttcctgccactggtcgtcatggttttctggggtctaccccttctcgcctctcgagaagttgatctaccagtacaaaatcatcatgcaacattccacccaatcagattaagaaattagagtctagccaagtgtaatatatgtcccggtgctcaataaccacgagcacgactattcgaatagatttggtttactcacactacagtggatgtacactttacccgtactccgcgacttgcccaacacatgagcctacgtcccaacgaatgagacttgccacggcaaagcctttcaataaccccactttggcagtacccgctccatgaactttagtcctcatgcactctaggcgtccaaggtttctagcagtgagaggagttctggctctcccgggaagggaagactcacacatgcattaagttatagttaagtttaggtttacacatggcagtcctaccgatggtgacaccactgtaggcactcgcccctcg

SEQ ID NO: 69821 - DNA, 4717 bp, Oryza sativa
tcctgcagcccctctcgcctgttaccgagcgaggcagaggcgcggctcagcgcagccggcgtggccggcccgatccgggacggcggcgggcggctcggagacggccggggtgaggcgcggaggagctccggcgatctcccgccgatggcagccggcgcgcgaggagacgggggcgtgcggcgcctcaggcgacgccatgcccgagctcggctacaaggggcttcgatgctagggacatcctccggccgaattgaagggtgagggagcatctacggggtatggggattcgatttcacgaactatatggagaggggagctcccgggatagcctacccacggagagctcgccggcgacgaaacggcggccggggcggcacggccatgggcgctaatcgccgattttagagccggcgctagcaattagatgtatggaggacgctacgggcgcgagggtgtaccgcgagacggcgagatggcgaaacgcggcgaagtggagctcgacgcggtgcaggacaggggcaaacgacggcgacgtaaggtgcttgacaacgtttcttgatgtccagcggctacccggcttcccccatggcgacggcggcagcacggctcttcctccactccctccaacctccagctccggccggggagcctcacaatggtgatctctagcggtggtgagagggtgatcgcaaggtgttcgatgaaatgcatacgagaagaaggctgagagggatgaggattttgttgagggcttcgcttaggatgcaagcaaactatggggataagatcaccagcacatgcctaggcgagctggagtactaatggtgatcggataagagcaatgaggtggatgacgcggataaggtttgatctcctcctccattaaggttatgtggctccatcatcgtacctaaagcctaaagtctgtgcgttctaactctagctgtggcaggaggctccgttttattcattgggcgcgaatgggggcgacggaacgcgcgcacatgggagctgtggcggagcggcggcttgctggggcggttttcccgtcctaaggtagttggctagggctagggatgacgcggattggcgttctggccgttatccatcggtggcgaggtgatgggtgatggcgatggcgacggcgcgacaagacgcgaggcgccatgtttcctggagggaatccggacgcgctggcggggaggcggctaggtttggcgcggttctggtgcggcacggaggggatggcgcaccggcacggacacgatgcggtgcacgggggcgacacgagatgcggagatggcgcgattgatcacgtgcgcggctcagtagtgaccgggaaggagcggactcgcagcatgtgagcggcttgggcccagatcgaacggttcatgggcgatgaacagtgccgactgaaaaagaaaaggaatgggggaaaaggaaaaagagaaagggggaagggctaatctgcaaaagtgaatgggattggatttgaaatgaaatgaaatctatacattctggttttgagaattcaaatgtttgatttgaatatttatttagttattcattagttcccaaatgagtttgctttccattagattatccaaaaattatccaattcaacttctaggctttgatatttcttaaaaactaattaaatattctattgtgacatttaataatacaatagcacattggtcgaatttatttgtatagcaatatattttacatacataggtttaatttatttaagttttattctatgaaggtattatgagatttggtgcaatattggtcttaaacattgaatcgaatactcccataagctcttttttatatatagaactcaatttatttacatgacaaattattttacatgagtgaatctatcccctgagagacttgatgaacattgtaaatattaatttaattattccagtgcaacactcctttatatatagggtcgtcatagtggcgattatttcatggttacttagatgtcatgacacctgtcacatggttccaatatttaatatttggcctataaattaaattagtaattaaccttctctttgtatggctttgttgtgttgtgcgtaaatatttatagggttcacaataaatatcttatttttataattattaatcagttgtatagctttagcttaattttcagtggtgacaatttatagtttgacaagcaataccaaccataacatccagcatgatgcaaaagttttaaaaagttcaaaattttagtgatttttattgtcggggattttcaggatgttacacgggccaagtgccctagactcatccaacttacttctattataagaaaggaattagagataaggcaatggatcttatctcatgtaaataggaggcatgtaccggattataagagatatcacgcatgtcttagctggctccctgatgactatataagggggtcggctaaccctaattcgggtgatcgctacaagctactctcaacgtcgtattgcgaaattctgcacagatccaatctcatacgactgaactagggtattacctctcttcgagtgcctgaactagcataatcactgtgtcaccatctttcctacgtctagtgcacccgataaatattattgccgatctagaaaatcgacatatctcttgttacatgttgtaatggtcttttaggcttctttggcaaatgggatcgggaaatgatatcccatccatcgaagggtaatatcgtatcctagccatctattcttctcatctatatcttcacatctcatttagtcctagccattcatccatttccctttgacaatcctgaatctcataacacatttgcaacaggttctttgatttaggcttttttctgtgttttatcggtgacataaggcccaatagcccagtgccgcgactgaccgcaatgttgggccatcccacacggcccagcccgcttcctccaacccaaaaccgatcgtaccaccgacccacgcgtcgcaggtacagcgctcagcccgtcgctgtcctttatttatttccctttcacgcactcccacgcggccacgcaccgcgcaacgctccgccccaaaaggccagacaacgcccgttgcgccgcctcccaaactccgcctcctcctcctccgctgcacccccgcaaaaaccctagcgcaccgacttcgcgatctccgcgccgcagccatgaagggcaaggccgacgcctccaagaagggcgagggcaggtaagatcctctctccggccgtctttgctgctgcgtatgggcggtggaggagggttttctggcggtggctgttgttggttcacatctgagcggttttgtgtttggtgttgttgttgttgttgttgttaggctcaaggccgccggcggcgccgggaagcggaagaaggccgccgctagcggcaagccgaagcgcccgccgtctgctttcttcgtcttcatgtgagtttctcgctccctcgcccacgttttgctctgttcagatctagtacagatctgtcttgagtttttgtttaatttttgttgattttcttgaattttaatattttttgtggtttttattttttacttttgcaggtctgagttcaggcaggagtaccaggcagcgcatcctgacaacaagagtgtcgccgccgtgagcttcctgacaccatcatctttttcgccactttttggctgatgtactttagatgtccaatttttttctcctctgttggttcattaggtgagcaaggctgcaggggagaagtggcgagctatgtctgagcaagtgagtttttctctgcagtgttcaaaaattagtacatgttcctattaagtgtgtgcatctgttatttagcatacatcatccatgagtatcactagaggactgtttaataattgttctggcctgtttgttaggaaaaagattgaattgctcctaaagtactagttgaatgaaaattgcaatttgtttttgaattctactcagtgaagcgcttaagtacacataagtaccatgggtggctattgatgtgacaatgtgccatatgtttttggcccttcgtgttaaattttattaggagaaggcaccttatgtggacaaggctggccaaaagaagcaggactacgagaagaccaaggccaacttcgataagaaggtgatgatagaataattgtgcatcctaattatagagcccttcaagcgttaggcactaattggacttcttgaattacttcttcaggagagcacaagctcaaagaaagctaagacccatgatgatggagaaggctctgacaagtccaagtctgaggtcgacgatgaccaggatggtggtagcgatgaggtaatcattaaaggaacacccggtgccctattttagcttgaatgcccaatgaatttttactactgctagttgtgttgctaatgaacatttttaatttgctctttgcaggaaaatgaggacgatgaagagtaaatagtgtatccgggggcatgaggtagcaaactgtgtcttaggtcccctattagctttactagtttgctatcttcgaccctaagatgttgggaataggcgtgcgtgggtgtgaagggggaccgtttagaattatggtactcagaatgttttcctacagtggattagcaaagaaaaagcctgaatgccgcctgctgttctgttgcttttcttttgctaaccacttgtcacagaactttgttt

SEQ ID NO: 69822 - DNA, 19552 bp, Oryza sativa
tccaaatgctagcgggtcatgtaaatagcctaaacccttagcactcagtgctgttcacactcatttactaatagtttatttgttttgctgtaggaaatgatcggaagtttcttgaaaaatggccccttgtgttatatggcttatcgcaatatattcccaatatgggctcttggagagtatcagaaattagtatttcagaactatcagacctctagcatcaagcaaacaaatatagctccatctgctggcaatgctgctctgaagaattcagcaagtacaacagcgccaacttgatttcttggcagaatcaagcaaacagtccagtgtattgtaggtcatgtgaaagagtacaaaactctaaatctagaatctgctgtattgttttggtcgattttatgagatccttatgaattttttgtacattctttagatctgtgcaagaacatgtacatcacatttcacatttaggtactttgaaaaaggataacaaactttgccccaacttcctggtccataaacctaattcataaactgttatagtgatgatactgttaacataaactttggtactaaatgtatgctaacacacctctttttgctccaacagcagaaaggcagcacagaatttaacagaaacccacaaactattctagtaataccaaaaatatgtgttcaatacaatgcatgaaagtgaattctgaaggtgaaaaaacacatataatgtgttgggcgtggcctgtggggttagaggaaagcaaagagtggtgcactccataatacatctcgcgttgctatggtgtagagggatcagggccagaccgtggcctctgacatggaaagtggagttggaggccacaaccataacagaaaccagacttctccggtgcatttaaagttttaaacagaaacaatttagggaaaattaaactcagatgcaattataacagaaactcatcatagatggcaaaataaatctctagcaggaatatagcttgacagtcacagatagacttttccttcggtgactaatcacacatttctgagaaatgaatgaaacttcattacaaggcaacaaatacaggtttaagataaatcaagaaatggacaggtaagtaaaacatttcccatctataatgaaatacgtaactaagtaattcaacttactgaagaacattctggatgtgatggagtaattttccgatatgttttcttgtcaattgttatttggggaacatgggaaatgagatggaagtcttcccctgatttaacagcacatcttctgctcaactcaggacagccattgatcacaattttcttgagagaagtgaaactttgaatgaaatctggcagtttcattaatccattgcaatttccaataccaaaatattgaagagaggtagcagcagaaataaagctccctggaaaacagactagcttcggaagcccaacaagctggagcacatcaaggcaagccaggccacccatggcttctgaaggttccaacaaatccagctcatggcaattattaatcgataatgtttgaagtgtggagagttgattcatggtcgagggtagagtagccaactttggacagttgaagatgtagagctttcggagggaagttagactaccaaatccatttgtcaatgatgataactcagcacatgaatttaagaacagaaatgtcagtgaagtcaaactacaaaatccatcatgttctgataaatacttattcttcagtgtgaggcacaagaatctaaggcttataagtctatgcacgtcctttggcatcttctctaattggtcgcaccgactaagttgcagtgtttgcaagttcaccaacttacatagggaattcggtaagaacttaattttcccattccattgtagatccaggtaccttaagtgcttaagatttccaattgaactcggtagctcatcaaaatcaacgtcagaaaaaataagaacacgcaggagtgtaaaggttgacaagaagttgtcaagaaaagctttagtcatggtcccattgttatcaatgcttgcaaatgtccttgccttgtttgcctttctcaggtgcttaggaaattcaatctctgttgagaagtccttgcgatcccacacaaggtgcctaaccttttcagataaatctttactttcacaattaacaatagcatgctccttatggcacacaaacatcgcaagattatgaacaagatcatgcattttacaactttgaattgagccattataaataacataatggtcttggaaaagagatctttgatccagttcattaaagtattgtcctccaatagtttctatttcatctccttctctggttttatgcaataaccctagtgccatccagaacataattaaaagctctctcaaaatcacgtagtcttttggaaaaacagataggcaagagaagcatgccttaagatgaggtggaagtgcatcataactcaattttaaggctggcaatatatcgcatttattttgctcaatattccacagatttgcatccttaatacgcaaccactccttaacatcctgtttaccaaacagtacagaccccaatgtcttagctgccaagggaacaccgtggcatttctccacaatacatttgccaatttctaacaagagtgtgtcctttttttcctcatctctgaatgcatagcgaataaatacctgcatacattcatcaaatgaaagctctggcacatagtatggctccaacgtcttcaccaccgacgcaacattcatattacgtgtggtaactacaacaacacttcctcttccaccactagataggaggtttttaagttgttcccagtcattaacattatcactccatatgtcatcgagaactagtaaatatttgttttcctgtaaaaacccacgaagcttgttttgtagcgtttgcaggctcagttgtttgttgctttcacctgtatctgactggattatgtcatccagtatcttctttagatcaaatacattagatacgcaagcccataagttcttctcaaacattttctttatcctcatatcattgtacactagtttggccagtgcagttttccctatgcctcctaaaccaacaataggaagcacagaaaaagcatatgcatccgcagcactcagtatgatttcaacaatcttgtttttcgcttcgtctctaccaacaatgtctaactcattgatgaaggaatgtgtttccctggtattgctactgaaaaattgcgtatctatgatctcctctgttaatgcaaactcccttctgttagctgctatctcatcaagcttttgacgaactactgttatcttatggctcaattcgaatgggtaaacaagctgccgactgaccccagcatagaaaccattatgaaccttttgctccaaatctttggtggccacatcatccagaacatcatcaatgtcgtagacgacatcctttaaatcttccagccacactttaagagcacaagaagtagactgcttgcgctctgcatctttaagaacaccacagatggacttcagagatctttccaacttcctcacttctttcttgaaattccacgctgatttaatctcgctggcagcacaaaaggccgcttttccaagaacggagattgcaaaactcgatagatgcacctcagccatattttgcttggcaactgcacgatagcaagagcatcaaaacaaacatccatgagaggaaatctgatgtcataatactattacttttttttaattaaaaagaaaagaaccccacattacaatacattaatcagtaaaacctagcatgatttaagatttaagatcctggtaaaatcagactcacggaactaatcacataaatggatgccagatgaagacggctgcaagccctacattgcaatcaatccaatccacctgtggggattggagtggatctaagctcaaaattaaccttaacaaacaagcaaagtccaggacacgcaccaaaacccaccgcttcctttgcccccctcccgttcaagacggacgcgtcagatcaccgagcaccgccgcgtggcaggaagacgacgagaggggcggcctgcagtgacgccctcgggtttttggctccgcacagcttcttcggcctcacgcggtgggtggggggtgcggtgggcggtgagcggcggcgacgtcagctaggtcaaaccgcagcggccagcggcggttttttttcctttcccctttggcttcgctggcgtagagcaccggcgtccggctggtcgccggcgaggttgccaatgccggtattcgtcttctccgagtgtgggtggtagcaaaatgggcaagattaactttgtttttcactttaaatatcttggttgagctacagttgaaagcttgaattattttaagaaaataaatagaacaaccaaaaataatttatagatgctgtaatttaaaaatccaaaattaacctaatacatttttgtttttgcaagacttagtttaaatttaatatttagactttggttgtggctaacaagccaacttatatagtaatcggagataaacctattgtacgagagggatatgagtgatggtctgagagtatgagccaagtagatttttttttctcccatcggatagcctattaagccaaagaaaaagccaaattttgaattttcaaaattaagattgattttaagatatttttttaacgtagtttctttttcagcattggcttttatatcaccgagaacacatatataaaagttttacctacaaattcatttttattttctaataaattgttttggcttattagaaaaaagccaaacaatggggccctttgtgaatggaagaaagaagagagatcgtttgacttaaatttggagttgattcttgctttaaaatttatttagttatttttttagggtgagtttagtttatttagcaccttactaatttgggcaataattttctcttgataatgtatgacctcgattagtaatgtatgaaacatcttcgtatgtccccacaaatagggcaacaaaattcatctaagtctttcaagctaaaatcttagtcatcttagacattattttttatttactaacaaggtataagaaacaaataaatacaaatgatgaaggtataaatacaaatgatgaaggtgaaaacaactgtaaaatatatatatatatatatataattttattattggagtatgtatcaaatatgttttcctttccagtaactcattgcatcaattgcttatatgtatatagccacattattgtaaaatgtacaacaactcttaaatatattatcggatgtgaactaggttttataaactcaaaaatataaaccatatagacataaaagtcttatatttgttgaatgtaaaaaaaattcctacataacgtgttaacataaaagtcgatgtagcattgtcattaaacttacatcaactagcacgtgaaaccaaacccgtcggtctcttcctcctcttattcctcagtcatcactatttgaagtcggcatttcgattctcatcctcagtctctccggtcatcatcatcggccgcacagcaaaaccaccgtatcatgaccttgcaggcgccatgtccaaccggtcagaagagagagggggttctcttccatcatagccgatatgggagacgattttgttcagattcttcaaggcatcctcgaacgcttcgcggatctcgtgttcgcttcctactcttctccgacgagctaccgattgtgctgggcttctttgccgatcatgatcgacactgctgctacaaaaattcaaaaaggtaaaattccattttctaaaaaaaatagtagatgaacacctattcttttatgagcattagctacaacttacacctatcacaaaacaactcgttgcaaaaaggggagagaccaaaacttgattgctcaatgcaagagggaaggattgcaatgctcccatttgtacgtaatcctaataaaaataagaaaacacaagaaaggaaattttcaagttctccttttctttttctttggagcaatataattctctctctctctctctctttttttggcaccgctttctacctcctctactcctcttctttttagcgaagcaaaccctcacctcttctctactctctctctctctctctctctctcaagctcggcggaggcggaggcaagcaaagccttctcccctcgcctcacctcgcaatccaccttgggcgggccgtccggcgagctgagcgcggcggcgccctccttactcctccctccccacgtgcggccccgtcggagcacggcggcgacgaagaaccaggggggtgggggggcgaggaggagggcatcattccaccggctgattcattcttcttggctcgagtcgaattggagaggtatatcggctcttctctcgtaccgccgcgccactggagatggatggatgggcgctttgcatggctcggattagggatccgttcggacatggcttcatttctttcccaaattgacccgtccagttaattccgtcccggtttccttcttttttttttctttttttctttttttgatgtgtgggtggtgggtgcagcagtggtagctgtttttgtttccaaaaggtgattttttttttgggtggggggtgttgttcagatgaacacccaaatgccccgcgtttgggcgagcgagttgtagtgcttgttggaaccaaatctgtgatctttgcggtttatgctggtactatgtttggtgtgatctcagaaaatcgaattttatttgggttgcttttatggttggtaccgatgattttggcgaagaatcgtggtgtgattgtaggaatgggaagctttgatccgttcggtttgctgtaggagcatgcatgcttatgatctctcttggggttcctcctttgcaggtaattgcttgccttctgaggaactgcgggagggagcgaggagtcgtggagcgactcttgaaggatggcggaaggtgccaaattccatgggatcgttggcgctgttggcgcgcatgatgttggcgggaacttctgtgacatggggtactaccagaagctaggggagggctccaacatgtcgatcgatagccttaacagcatgcagacaagcatatacggtggttcggttgcaatgtcagtggacaacagtagtgttgcatctagtgactctcgtaccgggatgcttaagcatcctggcctcaggggtccagtcattgtgtctagctattctgtcgggaacagcattttccgtccagggcgtgtgtcgcatgccttgagtgatgatgcattggcacaggctttgatggactctaggttccccactgagacactcaaggattacgaggagtggaccattgatttgggtaagctgcacatagggatgccatttgcacaaggtgcctttgggaagctctataggggaacctacaatggaggcgatgtcgcaattaagcttttggagaggccagaggctgaccctgagaaagctcagttgttggagcagcaatttgtgcaagaagtcatgatgctcgcaacgttgaggcactcaaatattgtcaagtttgttggtgcatgcaggaagccaatggtttggtgtattgtgactgagtatgcgaagggcggatccgttaggaattttttgaatagaaggcagaataggtctgtcccactgaagcttgcagtgaaacaggcattggatgttgcacgtggcatggcatatgttcatggccttggatttattcacagagatcttaagtcagacaacctattgatttctggagacaaatctatcaagattgctgactttggagtggctaggattgaagtgaagactgagggaatgacacctgaaacaggaacttaccgctggatggctccgtaagttggcatacatgctctttatcttgcttattttaatcagtaattatctcaaattcgtattaagacaatgctgttttatttttcttcactcggcattacccaaggccacagtatttctcaaatggtaaatgcaacacatttgcagtccttgtatgataaaatgcagtaacctattcatgtgaattagtagctaggtatgcacatgtgttctaattacatgcaatggcactgtgccagtcctgttatccataatttatccttttttttttgctaaggctggttattatcttgaatgattcatgcatcgaatacttgagttatgtgaaaatgcatggtcatttgcatgtaaaacttttctactggtgctgcccataactgtaatattttactttttttgttctctgtttttcttattctcctctgaaatctagtttggcagatcaaattttataatatgtgaaacaagcatatgctgtgacaggagatgtcttgtaaattcttgtgtgtagcttcatgggttgaaatatatgaatgctatttagacatagtccaagagatctcattctaaaattttcattacatacctatatacgcttataattggttcgtgggtgctaatatttaataaattattgctgtttaaggtattggattgcattaaccgtgccctatgaaagcatttatgcactaaaccctcattctttgctgatagatgcacaaggtgttcatcttaagagcattgaaattgcagcttgaatcttctagtttagatgcttgttcaagatatatttgttgctaattctcggctacaaagaaaagatggcagcatcggttaactcaggcctatccttggcattaggcacaccaactatttattaggtgaagatggatcaattatgaataggattatttggatagggtttctggatttaacagacaatcaatactcattcaatgttgactaaccgggtagtctggatatcagtgccacataaggataatttggacaaaaactattaaccgtacaacctagtaacgcaaaaaccctagcccttagaaataatatgtctcctggcttccgtagctaacctaaccttaggtaaggcatgctaccagctagaatgttgaagacctgttttgccgataaagggtgatttcatgggtaatgaaagcatctgcacccccaagagagccttgtgtaggtaggaaagctttagagcaagagcagcatgtcaacatgatacactccatgcgattatccacaatcatcaattcccgtccatgggatctatgagtaatcctatcaaagatcttgcccctgccagccagatgacctgcgttggtcagccattggtatgatttgactggaaaaattgaaatgtgctccatgattgtaccatcacgatctgtgctgcttggataattaactattttcagtttaaggacccctttggtttgtaggaataacatagcctaggaaagcttttgaaacaaaggattaagttctatcatcttcctatagaaattgaaccatgttgcttgattcctgtgttattagtttctgcgttccataggggggctgagtcctctgctgacccatcacagcaaagcccttggcagtttccacgttctctaggtcatgatgctgtccagtagctttgccttctttcttgttcctaatagaattgtttatgttctaagacaagattaactaaaaagttgtgtttgaagtgtttgcgcaaaacaaacttgtgctttaccctttttaagggtaagcaactgcacaaatagtttcacctctcttaactatagcttaaatgcacaagtgtgttcctagctaagctaaggtgcaaaagatcaaaatgttcatgtataatgtaatgttgcttaaacagtaaggtaattgcatgcatgtaactacctggcaaaatgtgttatttgaagcaaaaaagttcctatgatgaactttctgctgtgcatgatgcatgaatagcgagtgttttgtgttacaatattagcaaattagcacaaagtggtgggttttatttaaaactttgcagagaggaaaagtatgctatttggttcttggtgcaaaatgctgtttatatctggcagatttactaactacaattataactagcacttcaaaaaagtcaagcttgagcttttattcactagtcttggcctgttatggagcattttctctcatagaaatagagcatcaagtttattcctttcttatccattagattggaccagcatattttcttataaagtatgaattagtgtttgggattatagtgcctatcctggaacctggataggtggataaattattggatctctatgatgttcatgttcaaatatagtgcagtatgctagaattggatcaattattgctcattgtgtttttttttcattggttctagtcatgataactttttattttgacttgcagtgaggtgatccagcacagaccatatgaccaaaaagtcgatgtctacagttttggcatcgtcctgtgggagctagtaactgggaaccttccttttgcaaacatgacagcagtgcaagctgcatttgcggtggtgaacaagggtgtccgcccagccataccccatgactgcctccctgccctcgcagagatcatgaccaggtgctgggatgcaaatcctgatgcccgtcccccgttcaccgaggtggtcaggatgctggagcaagtggagatggaggtcgttaacactgtccggagggcccgcttccggtgttgcatctcccagccaatgaccctagactgagtcacagccaggatccagggtggaaaaaggcaacctggagaaaagttaagtcctgtgtacctatcatattaataggcctgttctgcagagaagatgaaagcccaagctgagtgtacttggcgtcgcgcgttctcttcgtttaccctagacaatacctagtatctatcgtcagactggaatgtattagcggtagctttttatctttgacaacaaaaaaacaccatgcagggctcttgttgcaacaaccgcatgttcctgctgtatgttatctgttgtaatcatcctgcttggaacatgtgcaaggctgcaaggcttgatgcctaatagtatatatagcatatgtataattacctggcatgtgtcatacctgtttttatagttctggcatgtgttttttaacctgcttccatagttctgaacttcttattgatgcagctttcatggttaatgttatataccatgtactattaactagcatgtgtttttccctgttcccatagttctgaatgatacacctacatgcttaatggtatatatagcatgtacagttatctggcatgtgtgtttcatagtttagaatgatgccaagtaaatctgtcatggcatcacgccaatttcctccttgtgggttcttgagcatatcatggtatatcctgtgatgtgttcactagtttgattgctataataaccgtaccaaatgctttcaggtttgttcagtggatcagctgggttttcagttctgaatgcttcccaattaggttccccttgtatcacaagttgaatatttcagtcatgaagtaccgcgtgaccaaaggagctttgctacagaattgtgctacatgagagcttaagaagctccaagttcacaagaaaagaatggcgctctgcaaatatacaaaggatggaaccagagagacatgagactggaaagctaccggcagcataattatgcagcttcttatggctaaacaccaccactcacattgaacagcattcatgacgcaacacaagtaaaagcgaaagggaacacattgagacaggaaagaagattgacagcaagaatttcggaactatgaaattggaattataacctaaagggaggtgaaacaaagcctataatgttgtacaactgaagcagcagcaacacctgacataaccaacctgctcttttaacccttctcacctccataagagcatcatatgatccaactgctgctccaaattagtaaatgatatgggggagaaaatcgactgctttactccacagggctagcgttcgtgctcgccgttccatcttcagccttggtggttgcggtggacgcttcatcagctgaagaaacaccctcaactgcaggcttgctttcgccattctcagtttcttttagctggacagtctgaccaaatgtgtctgagatgtgggccataagttctcctagggccttattctctgctggtttctgcagctctgggctggcaggctgctgctgacgtctattctcctgcaaggctttctcccgctgctcatagaagtcaaagtcttcaagaatgttcgtctccgattcatggttcttgaagatagttaacatctgcagaccatgttccagcttcacctgcatgttttgtctctcaagttagccattttcagaaaaagctacattcactagatgtttcagaaaagcagagatctctacggaaagattaggattaaatcaacagaagctggcaaaaagacagcttttttacctcctgggtgtccctgctattagttacaggtttgttgtcattgttctcaagaatgatgtgccgcagcaggttgttcgggacatccttaataatgtgccacttcacagggaactggccactccacttgtcctgctgccaataatcgacacttttgtcaaaatcgacgggtccaatcatctcagctacaccacagaactgaccactgccattaacctgcaaaaaacgaggttatggatcaatttaaataaaatctttaaaaaatcaggacatagatcaaaagtagtcttatagaaaatcagctttttgttacttgctttttcccgtagtacagagaataaaataataaaaaaagaggggcttgtcttaccgagaaaaatagaaaaatagggcaatagtcttctttttctttggccaagcgataagcagaatccagctttctattcccactagctgtactggcccaaacattgtacttaatgctcctatgtacatggtcctcagtgtaggactttattacaaaaaattttgcatccttgtattcagtgacaaaatcagggcgattatacagttcactatcaaccagaggaacatttttctcatttttgtcatctattgaagagttctctgtgtcttgtttctttggttttgtagcacgtggcccacggttttgctcattcaggaactcaagagcaccattctgaataccaaatggcatgctccctttctgttgattggcgcttaagtcaaaagtaccaaatctgcgaccagaactccaacttggagtagtgcctccaaacttaccaccttgttggcgtggcttataggatccaggggcatacattgacccatgatgctgcaaaaacatacaccgtcagtgctggacaatgaagagcacaataaacattaggactgacaattttagttcaaccagtatttgccaaagcccaattgcaagaaagcataccattccaaaagccagcggtgtgttcccttgaccaaacaaaccaggagtgctgcttggttgggtggatgctgcaaaagaaattcatgatatgttaagcattggcctaatcaattattacaacagaaataacttgcaatcatcaaaagttcgacttgaagaacagcaaagattgaaaaggagaaatattacctctgtcaaaagacccgaatggttgatgataacctggtgttggcgagtagagaaggccgtcaggaaggaagtactcctgctgcagcataggatctccttgagacattccagtggcggaattagagtatcccatgctaggagaggctggtggctggtagtaaggacttgagaagggaaagtgcaatgggaggtatggctggccatctccaacgccaggagaataagctccatacatcatttgagggttgtttgcatatccaggagataacatgattgactggttgtcgttgtaaattcccttcagcaaaacaagattaagaaaactaaactatgaaaaatggaaaataacttcagtagtcatagtacttacaggtgatacagaatggagtccttccatattgacataatgggggtattcttcccattggcccaaatggttcaggtatcctacaggggaaaaaaaagcaaagaatattaaataataacacttccaaaggagttaccttgttaaagaacaagatacgcagattgaataatatgttcgcctctctctctcaagatttcaatagaggcagttaaacaatagtgagatcaaaatagtaaggactgatgaacacttaaaactgatagcaacaatcaatcatgttagtacagagaaaaccaaatttagagttaaatatctgaaactttatcttctaataccatggttgtgtacatttggggattaaattgtccaacagagttcaatcgtcaataataacacataaaaatgaatgtaacctaacctccagaatagattgtttgtggctgaggtgcgtacacattgggttggtagaaaggttgttctccacctttacccaaaaaactagccttctcctgtgcaccctttggtgattttgaggagctagcaccctggggaacactagtagtcattttctcatttgtactagaaagaatctgatgcagagaaaatcaaccattagtaaatagcgcgacacctattgtagggaaaaaaaactgataagacaattacctgctctttagcagcactcttggatgcgttgttctcacctacaatttctgattgtggtggaatcatgcaatctacataacaagcagagttacaaagattgtaacatcctcatagcggttatcaaaacttaaaaaatgagcgaagtaactccacagatatataaatatatatagaaagtaactatatcctacaaaccataaatgcatattatggtttttactccaccaaaactatcaactcgttctacatgagcaagcatttaataaacgctttacaattgcacatgtcctttcatcaacactgcaaatcagccttttgcatacacagcgcataaccaacatgctcaaatcaacactgcagcagcagcagcagcgacctattcaaatacctcctccgattacccagagtcgagaggacgctttagtcctttttaaccgcactagaattagtgaattaccacctacccgctcgtactcctaccggcgtaaatttccaaactacggaattattacttaattctcccaacttttcccccctcgatagcaaactgtcctgtacgcgttagctcccaggggcggggaggggaggatcaaacatgtgacaatattagtaccaaatttaacgcaaactaagagagaaaaaaaaaccttcccagatctagaacagaagctagggttcacgcgaattcgaggggagaaaaacagaaagagcgcgtgggtagagagagagatgaggaagaggacgatggaagcttaccggcggaagcagccgggcggacggcggcgcctcgccggatggagatcggcgcaggcggcgggcgaactcgcgcgaggagacggagtttgggggggagtcgacgccgaggggaacgggaagactttggtttttgacaatctagccccttttagaaaacttattttgtaaatagaccctcctaaaagctcgttttcgtggataaggcctttcagcggtctatctatacattaagctttttctaaaagggccagattgtcaaaaatccaggaacagctatagaccatgtgggccgcccggcacggcacggcccaggcccggccgtgcctgggccgaggcttgtcgggccggcacggcccgaccgacgcaccgggccgtccgtgccagcccacgtgccgcactcacggcccaggcacggcccaacacgcctcgggccgtgccgggccggcccgaaggcacgatgggccgtcgtgcttttcctcagaataagtctaaatttactccctcctattgggctgtgacatatgtacagctacaaaaagtctattttttctccctcttctttgggctggggtatataaatagctaaaataagtctatttaaggtccctattctttagacagttacatttatatgtctatttttagtcccccatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactataggaacagcggaacgtggacgggagatacttgaccagtttgaccaggctaaacaatgattttggatacaattatgcttattactccgttcggttttttaattttctaacgtttgaggatgatcttactcctacttttctattttatctatactagcaaaagacccgtgcgttacaacgggaagtgtaaagatcagaaaatcaaggaaaagttaaaaaagacttatattatgtaattagttgaagtacaaatttccttaaaaatttggatattatttaagttggtaggtgtataattaaattaatttacaagtaaaataagtgtgaaaaaagttatatggttggatttaatttttcaaaattcttcataattaattacactctttgaaattttattgaaattttcaaaacttaattgctaattttgataatataaacataatttcagcatttattcttcaacccgcgaattgaaatttcccgttcgttctcttctgggtaaccgaaggtggagtgttatttgatgcggactctggatgatttgttgtgtgttggacttgggatattgcaggacaaaaattggttgaggacggacggaaatttcactggaaacctacattagattagagatagagaatatataaacgatgaaatcggatagaaattggaccttttttccggacttttttctgccctttttatatacaatcggacttttttcactctttttttcattttagacgaacaacggaaacattttcaaattttttaagtagtagagataaagattagccattttcgttttcttagggagtgctgtcacgaaaaacgtgttttttaaaacaacttttgtatagatattttttgcgaaaaaatgcatcgtttagtagtattagaaggaaagaactcaaccttaagggacctaaactgaacttattccatgcccatgaggcggcctgggaaccgcggcctgatgtgggagaagccgcagccgtccgatctgatcgacggtctagattgatccggatctatataaaagttcagcatcccaaccctaaccctgaaatcttttcccctccccctcactctctctctaaatgacggcgccaacggtgcctctccccctccgccatggcggcggcgccattccccctccccttcccccaccgccacgacgctgctcccctccccctcccaaggtggcgggcaggggcagcgccctcccctctatcggatccagcgggaggggaggaagcggcagcccgatgtccctgcgacgatggcaccctccccttccggcgtcggtgtttttgtgcttgtgatgttcttgtgttgtcgttgttgttgatgaaatatgttcttgtgttcttgtaacagtgttttctctaggatttggccaaatttgattcggactcgcattaagtgtcaaatcgaattggactttctttttttttatgttattttcgcccttttttttgttattacggacgatggaagcaaattgaatcggatttttttttaaaaaattttttttcaccctttttggttattaaggatgatgacacctcttattttttttaagtagtagagattagaaaaaatgcccgtgtgttgtaacgggtgaagtctatttttaatcttattattgttatatggtttagttaagatgaagttcactctggaagtttgcttggatatatatatatatatatatatatatatatatatatagaaaatcatgagctgcagttagcaatctgatcatctcaagttagcatgtaagtttttttaaacatatttcttatatggtttcttctatatcaccaaaagtgaacgatcttaaaaactgactcaaatatggatatgtatttccaaaagcaaacgaacttaaaaaccaatttatacacggatgacgtatcaaaatatcgacaaaaacatctttaatttttataatagtagagattaaatataatcttatcgtattttcaatcggtacttgtatgcagcttgtgtggttatagccatttatctcaaagcttgatatagccggttcaactcttggcacctcaatttatgcttcttttttttttattttttttggtgtgttgcgcgagctgcttggtgacgcctgtcatcacgtcgtcttctagcgcatggctcgacgtttatctcaccatgttgcacgagctgtttggtgatgctttgttttcacgtcatattctagcacaacctgacccggcccatggttatgacgctggcattctggcaatcacatcgtcctcctacgtgacgccatcacacaacttcttgggctccatgacgtcagcgagcggctagaggcaagccaaggtgagcatgcagccgcacttgcaattaaaatgcacacaggagtttatgcgttgttggctggttgtctaggaactcgttggagttgatgcactgttggagacgaaagcattcgagtgtatgcaagggtatagaagtccaaagtaatcattcaaatgccaaaacatcaagaattctcatgcaaaggacccaagcgtcaaacatcaagaaatatagtacctagggagtagatttttttgacagtatggtggtgtttgaaaatcctgaagataaagattaagtgtttcacgcaaaacgagatggtagtagcgtgtgattaattgagttttaattattagaaacttgaaaaatggattaatctggtattttagagcaactttcatatagaaagtttttacgggaaacacactgtttagcagtttgaaatgcgtgtcacgagaatctaaaatttcattcaacaattgttggacattcgaacgcagcctatggcttttcataacacgttgattatttgatcaagctgaaataagaacactcaattacatagtcactttcattttgcggtcaagcacggattggaataagcgccggtttgacatgaagttcttgaaaacacagggcatcgagataaaataaaaatttatatgcttgttattcatacatctggttaggttagagggtcaacctagattttcacgagcataagcagatcctagattgcacatcaagggtgctagccacatcctcgcgcgagagagagagagatcgaggtgctagcgcatagtgtaaccatcaccatgcgcaccttgcatctcagcacaatgaaatgtgtaacctatcttttatccaaaatcaatcatttcatttcgtttaattcgtagcacaccagagataaccatttctcaaattcctctttcttatatcgattaatgtgtatagctgttcttttca

SEQ ID NO: 69823 - DNA, 610 bp, Oryza sativa
tagtggaagtttaacgtacagaaacttggacctttttaatatggcaaaacctttgctatgcttgtacttaaaaagtattaatacttattttccttttgctaagttcttggttatcagtttttatggttaatatggcttgaaataagacctttttttttcttcccatgtatttggacaaacattttcagattagtgatgcctttctcatatccccccaaaatgtttcaggttgctaatgcaatggctgctaaagcaaaacttgtgctccgtgaactaaaaacagtaaaagctgatctagcttttgcgaagcagcgatgtgctcagctagaagaggagaacaagttcttgcgagaagcaaagcagaaagggagcaaaactgaagaggatgatgacctggtatgttaatgttttccaagcaagcaaccctggaattattttattctcatgataaagttatcagaactacattcttcttgatggtgaatttgtgatgactcatcccaaaactctggctatgaccattgaaaagtgtgaaatttcttctttcccttgcatttctggacaattttgaaaaagatatgcaaattttgcagtacgttgcacaatgtgg

SEQ ID NO: 69824 - DNA, 22708 bp, Oryza sativa
atgaccaaaaatgaaaaaaaaaaggttctagtgtgaaactttcatacttctatttattgcggttgaaaagcaagttaaatgataaaaagtgaaaaagaaaacgcaaactagttcaaagttttaatctgggatttatatttaaaatcagggcagctcatcagccaatattgctatttgcgacggcttggatacccgacactgtacggcacaaactataaattgtgacaaaaatcgtgtaatttgctgttattccattcacatcaggtcgcgttcgagagcgacacgaaacattacaaacggatacccacgtgctgcacacgagacactgcgagttagcagcgtcttagcgaataaataaagcaatgatgggactgtaacgttccgattttcgttcgggattaaaaatcaattaataatgcatttcaagaaattatattaaaagttaaatcaatttattcaagtgaattaatgggagaattaaaattttcccttaaaaatcattggccgggaatattttgcaatattctttgtgccctaaaatactctctgaaatttcccgtgaattttcggagctcaagaaataattttaatagcacaaatttcatttaaatcaattaaaataaaaagaaaacaaataaaatttcccctctttgtctttgggccgctttcggcccaagatcttttccccctccttggcccgctcgcccctctctccttcccttctccctctcgggccgacccctcccttctcggcccgatcaatttcccctcgcgcaaagtctaaataaccccctggctctcctccctcactccctccccgacaggtgggcccgacgaccccacctgtcaggtccttcctctaccttcggcctccagagccgaaaccgccattgccacccacgtcgccgccgattccgactcctcccgctcgcgccctcgcgcccaaaccgcataaaatcggttcccctccacctcctccaccaaatcccccacttttccccaatttttggcgccaaatcgagccccacttcgcccacgatgtcgcccacgtcgccggccgttgccgcttcaaattcgccacgtccggccacgatttctcctccccgagcctataaaaagcaccctcgtgctctcctcttccgtttccctctcctccccaagctcctcgttacctctcccgtgtttcccgcgcgagcccgcgctccgccgctttccgacgagctccggctgcacgccgccgtcgccgtagccaccgccgcgctgcgccgcttacaccgccggcttcaccatgcctcgccgcacactggccaccgctccatttgcacaaacctccgccgaaactccccttccaccatgcagccgagtcgccaccaccctaaaccgcctccagccgcatgtcgtcgccgcctgagccgctcccgcgccctgccaccaccgcagccggcttcgccgccgcgcgggcaagcccggccaccgatccgtttatcccctccaccaccaaaaaaccacccccaccgctaacctgaggccgacgctgcatttgccgcctccggccgcctcctgctgccgtcccagaccaccttaatatgcgttgtcgcctccatcggcttctccgtctggtgccgccccttcgccctcgccattcaccgccggagtcctctccttcccgtcgaggtcatcccggcctccgtccgccgtttcccgcccgtggagtcaccgcgggagcgccatcccgcagtcgtcccgaggagctcgccgccgcgctcatcgcccctcgccgcccggcgcacggtgaggcctccttcctctcttttcccttctgcctcccttgtccggcgccgcgtcgtgctgccatcgccggcggccgtccgcgcgtgtgccgccgccttgtcgggctggccggcgagcccgccccttgccgctctgttcgccgcccgtggaccactcccgtggtccgggtccacggtgccgccaggccgcggtggaccgagtccaccgtgcgcccgcccccttgtgccgctgacgtgcggggcctgcgtgtcggcgccggcgccccttgctgacgtcagcgaatgccttttcctttgagaaaataattgataattgcgcaataaatcattaataattatagaaatccatttaaatggctcaaaacttctaaaattcatatctaattcattcgaactccgaattgggccattcaaattgcaaaattcatctaaaattgagttctacatgtttgtttacttttttatgtactgtttgcttggtttttattagggtttttcctcgttttgcgtgccagcgtgtagaatccgtcgtttcggaagatcgcggttgcgaggaaaagagttcagaaaatccaagtgaagaagcaaggcaagtcacacattccccttgagcatgttgttcccaatttataaatgttttaccgtttgcaaataaatatgcatgttttgctaattacatgggatcagggtttacctatctgctcgcttgtgccatgtttacttgatatctgtcctttgtcaaccatgggtgataaatcgcttagcttgtgttactttgatgacctagctagaactatatgcttagccatgcttaattaccactagctcagtcgatgggataattacagtattagacattctagtatcttgttgagctgcgtgctcgagacatctggccatgtttcatagtcgtaattatccaactaaaatgcgactgaatggtgggctgtgggtgcatggttttgtgagtcgcacctatggcaattaaggaccggttcacgagaaaccctggaagacttacagcgcttgccacaagcgggagtgggtaactgcttgatctgaagtatagctcgaccctttcctaggcatcggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtcttgtcacaatcactcgacatggtgacgtgtgcatcatgggcacatgatgacgcggtgacatgtcggtgggttgtgtcttgtgggtacagttgtgcacctctggccagagtaaaactattcgaatagccatgcccgcggttatgggcgatcgaccagattcaccgtgattagtctcacccttaataaatcgactcaatgcactgtagtacaggtgggttggttgggcctgttcaacgtggtgtagcgttgatcagtggagatctaatttttcttaattattcaacagttttactgtttgctaaataaaatgttttacaaccgtctttatgcaaatagccacaaaccgtccttgtatccctttgcacgtctgcatcattggtgtggcttgctgagtacggtggttgtactcagccttgctattattcccccttttcagaagtgtagtgcttctgagctgaagacgaagttggaagaccaaggctcagaccccagttgagttttgcctgtggagtggagctgaagccccgctaggatcgcctttttccgctgctgtcgttctgtttcggtgtgaggactaagtgcctcttccgtaagtattttacgctttatttacgtttggaactgtatattacttgtcgttttgtgtaccctagctggtcctggacagggatttaatacgtaaaatagtctggaaatttgggttaaatttctgggcgtgacaaggaccccccaaattgaaacgaaaattcgcgatgacacgcatccaattccagactccaatacaaatcttgatcgaactcctcttttgcaggtgaaatattttactctggtgactaataccaacaatttttccacacactaaaccagtaaatcaatggaaagaatcaattcataagctttgtgaaagaaacatttgattccatcatggctaccaagttagaaacaaacagtacaagtgtttagccctgggatcatcaagggatcacgaggtgtactcaaatggctggggtggcaggggctcctcgtcgacggccatggcggcggcgcctgagccttgctggccagcggtggcggctgcggcgttcgtcgcctgagttgccggggcgtcggtgaggactagttcctccgtctcggtgggcttgaggtcccgtaggaggacaaatccggagggcgccagcttcacaggctcgtacctgccgccctccaggaattttatgaacttctcctgggccgggacaacccgggccgggttagtcaggatctggaaggtcggttcgggctcaggggctttcttctccgccacaccatcgacctgaattcatggattgagaccagcatgagtaatttggagactataacatgtcattgtgtagcaaagacatgaacaaggtggcaaaaaaggaacaaggtaggtagttagcactgtagctcttacctgcattgaagtagaagcatcttcacttggtggtgcttctgctttctcctgagctttgctttcggcttccttctttgccctagattttgccttggcatatgttgataggatggccgtaggcagcttaactgaagcagtcgtggtttgttgggttgtcggctttgggtaatcaaagagcgatggtttagtgtttgacaggaactcaaacttcggcactttcaagtcagagttgaggccaataaaagccgtcggagagaaggccaggctgatgaaatatgtcagcgggtaccaataccagaactgggtgaagacggcaaggccaacaacagcagtcagcttgtcatgctttgacctggactgaagcctgatggtaacgttcctaccaccagcatcaaggataccagtagccattatggcacccattttgctcatggtgtcctcatgcttgtcgagaatgatcttttccaactgacgcctgaatgttccaacacgagagtcatatgattcattagtttggatcatgaccattgccattgcaatgagagcaccttgccgcacgaagtcaacaacatcagatgtaagaggctccaacaaggagatggcatcacttaatcctgttcctgcacaggatattccaacagctaaagcggcaccataacggacatgcggattatatgattcagagagcagagacacaattcttggagtctgcattgaaaataattctaggcaagtcaggctcaaattaagtgactcaaatcaaacaagaatcttgacaataaaaagaatcaataaggtaaagctaacctgctcaggctcattgtacaggacaaaaccaagagccaatactgcagtcctccggacatcgtcgctcacatctgacaccgcaaaatgaagaagctggtggatagctttgttatttgcagttcccctgtacgctagagccaatgcgtacataccaccataacggagtatgggatcttgatctctagtcatttgttcaatcaaggtgtcagcttcctcttccctgccataaactgtcaatgcaattccaagtgacaagcccctggagaaaagaggagtcagtgtatcagaacatgaacatatttaccgtcttgagaaacaaattcctagtactagattacagtgggaacttgcttgccaagagtttaaaaaatagttaccgaataattttctcatgctgtgtatcatgtgcataggcaagcatctctccagccttctcactggctgttccagccataagcaagcccatgccaatgccagcagcctcaccagccacagcactgtcagtgtaaagaatattctttacatcctcaaatatttcctcgtcggctgtgcctaaagctgcaagtccaagtcccagacaagcaccatgctgaacgacctgtacaataatatttgaaagtttagaatattttttcatgacagtgatagggactgtctaaacaaaataagagaccatgaccctgaaaaaatacctcagaactagtgttgcgaaggctctcacgaagaaattgtttgattccttcaccatggtttgcatggatcagacccagagcataaagggcaccaccttcagaatatggactaccaccacttgcagcaccactctgaggaaggtatggggccattaaagctctgccttgtgtgagatggcctctatgaatgacacctaatccagcagttgcactgaacttagcccagttggttgccctacttagccattcctgtaacagatggttatatgcaaatgaagatcagaaagggagaaaaatgcatgagcatagaactgcattaacaaataggtaaactatgaaatgtaccaagttttctcttaggaaggtatcaactgttgttcctgcatgcatgattgcattggaacatatagttgcactatgacaaacactattcctcatttccagagcttgttttatagtcttcaaaatcagaagatcagacctgtcaaatcaattaccaaaatcaacataagattcaaaacttaaatgcatgaccagctgcaataattttgtcagatattatcacattacttcctccgtgccaaagtgtaaagcatttttgaggttggcacggatattaagaaagtaggtgggaatgatggagaaaatgtgtgattggttgagaggaggtagttggagaaataactttattttgagacaaggtactattctagaaatggctatattttgggacagaggtagtacctattatgactgtataaaaactgcaatgtcaactgaatagacgtctcccctgacagtatccccttaattttggtcagcctatcagcgtgcgctacttcatttggatctacagtgtgcgcatttccatttggtgtgatagcatcatccgtcatttgggcatctccagatggttctgtagcagcagtttgatcgctaggtaaagtctgggcagaagtctgcaaactcagcgtgtcaaggtgatttttcacattcaggaggaaggcctggttttcattttcaacaagatcaaaagcaatttggaatgcaaggagagcatcatcctgtagagcaaaagcacatgttaggacaaataaacacactaagcagcagttaaacaactaaaaaaaaacacaagatatttccagcataccttgcttccagaaagcagcttgcccaagatgtttccaacagtttcaggctcacccaagaacataagacactggcaaatgcttaagtaatccggatttggcagtgtctggtatatttttacaagacatcggagaatctgaatagatcaaacataagttcttggtcattttatggcattccaaaatttatgaagaatgctgtatataccaataagaaatctaagagacagactttacaattgaaatctgccatgatgtaatcttacctcacagcgatattcacggtgactaacatattgatgagatagaatgatggaataagaaagagatccattaagattatcggatcgagatatcgcttcctctagcttatcaagtctcttgcattcaagagacatacccatggcctgttgatattttccatcaagtatacacctgaaacagtttccgcatcaatgagatgagaactgcatttaattacagatgagctactagaagatataagaggattctatcatacttatccagcattctctctacaattgcctccaatcttgggtccattttttcatccccttcacctgctgctttcaaggacttcgatcggatgctggcatattcatctaaagcttttgctgaagaaaggaacaaacaaattttaaaactatgtcaatattgtttctttggaacatgaaaataagaagattgcaatgaatttagtcaattcctcacctaaaagtgtttgagcatagtctgaaccctcggagggatcaaatagtggtccagcaccgagtgcgtaagacagagaatcatctaattcaccaaggtagtaaaacaccttggaaacaaccaatgctgccaactgcctctggtcgaattcctcatcttcatataagctctcactgtaacaagtatataacattataaaataagtaaccagaaacacttcatgcttaatagagaagtccttgaaaatattaagttctaccaagttattaagtgacaatgaataaagaacataatttccagaaactataataccaaattgcaactgccaaaacatttaatggacatgcctcttccaatgtatctagctcccattaaatcccatgaacaaatcataaacaagaaacgagacgacacatgtcttagctcaatgtttttacttgacaggacaagcgctaaagatcaaacaaaatgttcctgcgtatagtcttgcaattcagacacttcaaagtcaaggattatgcatattcctcaaaccaaccataataaacagaaaaaaagaagtctcaacctaggctccacctgctcgttttcagattaaaattatgcttcattagaacccttcaaacaaaagccttggcaatccgagcctaaacgcaaattatttttaaaaaattaatattttttctcgaccacagcaactcctcgaagaataatacatgaatgaaccacaacagttagggaagtttgagttatctataatccatacacaaagcctaggttttctagtaccagtgaaactaaccgcccattataatcccctcccgaaatctccagcctaacagatcaaaccaacctagggttcatccaaaaaaatcgccagatcgaatctaaccaggccaaacgacactaatcgcatgaatcctccctccacacggcaccttcctagccgaaccccacctctcatccaaatcatcatcatcacatacatagagcaccaaaccccaaccccccactccacgaatcgaaccgaatcgcgcgaaacgccgcatcgggcgcagcgggccggcggggagggaaaactacagctgaaggtgggtgggggtggagcaactcacatggcggggacgctggtggagatctcgggccagaagacgtggacgagggagttgaggttggcgagcgcgtgcagcttgagctccgccgccggctcctgcagcatcgccagcagcccgctcgccgagctcaccatcaccgccgccgccgccatctcccgcctccgccgccgctggattcgacgatttggatgctcgtctcgtcggcgctgcttcggctttttttgccttttgcttggaggaggggaagaagaagagctctcgccttcgatgggaggggcggagatgtaaatatagcaggttttggaggggctcaatggtgaaatccgagtagggcgtatttctccgatttttttttggatcgggaaaaccaatgattgaattggcacccggatacgtatacggatacgatgcactccgtatttggtggagtactgttcgtactcaggcctcggcccattgtccagagcaaaaccaaaggcccaatgccctaccgttttcacccgtgcatttaggcgcagaataagttcactttgactccctcaaaagtgacccgaatctaattcatggccctgaaccccaaaaccagatatcttaaccccctaaactgttaaaaccggtgcaatttgactccctcaacggttttggaggacgattttgctgctgtggcgcctaagtggcgacattgaccgagtattcgtttcacgtggtgttgacgtggcattagaattaaaaaatatgcgtgggacccattagtcattcacacaaagaaatgtgggcccactgacatgcgggcccacatgtcagtcctccgtgtctccttccttcctcctccttctctcccttctctctctccccttccaagccggacatgcgcaagggcgtggcggctcaccaggatccttgccgccgcgaccacatcgttctgccggcgccgccctgatgtcgcccaccctgctcctcgcagtgagccgcgccgaccacctcctcccccgctcgctacttgatgccgacgtcggcctgctcctgcccgccgccatccccattgacgcatcagtcgggaccaaatgcgtgagacaggagacaaagaaaggcagtggcgcagtgccctgatggttcggagaactcaatggtatcgtgagctaccgctactgcctttggctgagaagaggatgaggaatcagcaatcatagacgatgcctccagcagattttgtgcagatgttgcttgccccttctctacacacctgaagtggaagaagcaagctcaatgagtagaagaacaatttatatgaggagatgcacaatccatattaccaccgtgaggtgtaagttagctcacgaatgtgattaagcgttacatgatatagcggtataatttgcaaaagagatggatatcacagccgaacaagtaacatacagattaacaaacaagtaaaactagtacaggccaaaaatttatctgtaacttgcaacatgaatccaactgaaatacatagggaactatacttgaggcttctgttcccaaccacccaaaaatcatagatagccccatcgacaatcacttggaacatagcgagcgtagcatggagatggcggagagtaagaagcgcgggattagggattggattggtgactcccagcggaagcggaaccgcaagccaggccgactgttcttcctcctcccgctctcctcccgccctccgcggcttcgccttcgcggccgtgaaaccgacggaggcttcgggatgcggccgcggcggcgagaaatgaactccggcgaggggaaaaactcgaagcacttatcggtcagatccccgcaatgcgcgcaaggttgttgcggttcgccaggatccccccgccacaaccacatcgctctgccggcaccaccctgatgtcgcccaccctgctcctcgcggtgagccgcgccacccacctccttccccactcgctgcttgatgccgccgcttcctctaccaccgccgccaccggccgaagagaaagaagaaggggaaagagagagagagaagggagacatggaggaagaaggaatgagacagggaggactaacatgtgagccccacatggcagtgggcccacatttctttttgtgtgaatgactaatggatcccacgcataatttttaattctaatgccacgtaagtgccacgtcaacgccacatggaacgaagactcggtcaatatcgccacgtaggcgccacgtcagcaaaaccgttgagggagtcaaattgcaccggttttaacagtttaggggtcaagatatctggttttgcagttcagggtcatgaattagatttgggtcacttttaagggagtcaaagtgaacttattcctttaggcgctctttgtttagacttataagccaatttataagtcgaaaagtctaaagccaacgtggaggattactaggacgggattcagggctatcaccacctgccgcctacatttgacaaatctatgggatacacaacaaacaaatgtagtctctaacctaggcaccacgtctaagttattaattattactctaatacttgcgcaggaacttccttctttattcagagtcctagtcctatagcacttagtacgaaatactaaataatgaacccacaaagatggaaatctatcttactcagactaagtaattaaataatggatatcatgttttatttcattatatgcaggtattgacggtcaaatattatgatttaaggaccgtcaagagtactccgttttcagccccggttggacgaccataacaggttgttgtaaagaactcggcaacccggagtggtctttcgaagtaccaggaggacactattagggggtattggccacacgattgtatactagtatatgtaaattaggaattgagtgcatactagaagtatatgaattaattgctttctatttcttctcccacttagttataaaattaattatcatgaatgatttgaatgggaaaaacgataacctatcatgataattagaggaaagggcagagccaatttcatttgtcatgataatggcattttaattaaaaatcctcatttcgttatttgtgcgtgcaacatgcgtgggaggcgcgcacggagtccaggcatgagatggcaacgtgtggttcatcggacgaccagaaaatttggctgagataatttttttttcagccggctgttatctagtcccttgttgataaatttaccttcggaaatttaacaaatataattataatacaatcataatataattattttataacttgcacgtaactacaacttgttgtaacttttcaaaaatctcaatgcaacatgctattttcataaaaagagatcatgggactccaggtaaaaaaaaaagtcataggaccgaatcctctctcatgtacatgtgctgtgattttttttcttcctcacttgtaaaaattttaaaacaaatctaactactgtgattggtacgcggggagcacgtccgataatatttgaatgcaggatgcgaggcgataaacaagataaacaaaaacaactatttttcgtgtttaaattaaattaaacaagagataaatacatgatgattaagaggataagctaaggatgttggagccattcagaacacgggcaccaccaagtgtatgaacacggcgaggatggcagccatgacgccggcgaccctaactgttgccgccatggcgacgccgttggcggtgggcgcaatctcgatgatgaagcggcatgacccggcagaggggtcgacagtggtggtggtggcgatgcccttgaagtcgcaggcacggtcgtcctggtcgttcacctggtagtagctgttgaacgcgtacgacacgttccccttggcgtcgaggccgccgcacgacgtcttgtacccgaggcttgtgcagtcggcgagcccgcacgcgtagctcacgccgtcgccgaccttctggtcgacgaggctcgccgacggcttcatcacgcaccaccgccgctgcaggtaggtcacacccttcgccggcatcagcgtgctgccattgccattgccgttgccgccgccgcgaaggctgagagggtacttgggctggccgtcgtagtagaagacgccccagtggcgctcgaagttgcccggctcgatgctcttctggtcctcgtcgatgaggctgaagaggtaggcgtcgacggggccaggccggagtggcgtgccctggccggaggcgatgtgggtgaggaacccctggttgaactgtcgtgcgtactgcgggttcgcgttggcgtcgccgtcggtcggccacccgacctcgccgacgatgatggacacgttcgggtacccgttccgccgcagcgccgccaccagcgtgtcgtggttggcgtcgaacgtgttctggtacgtcacgccaccatccaccaccggcgccgacgagccctgaatcaaagtagggatgaaaacggttcagaaatggtcggaaacggtaccatttttctattagttcttaaaagaactatatcaaatttctattagttttttcttgaaaatgataagaataattactatatttatgaatttaactatttagtgtatcaacgtcaaatcgatactgaaaaaactatattttaagaatgctaacgttagtacgatcgaaaaattttcatactattttcacccctacctgaaagaaggcgtagtcgagcgggaagttggggtccttgtagaggctgatgaacgggtacacgttggcgacgaacggcgcgccggtgtcggcgaggaactggacgatggtgagcatcaggccgtggatgtcggcgcggaagtcgccgtcggagggcttccccgtcggcgactggtacacgtcggcgttgagcggcaccgtcaccttcaccttgtcggcgagcccggccttcttcagcgctgcctgcacgctctgcatcgccgggaacgtcgtgttcaggtacgtcccgttgaacgtctccaggaacggctcgttcccgacggctacgtacctgccaaccacaatccgtcaggaaaattaaaaaaaaagcatcattttttcatcgagtaaattctctctatatatggccctattcttttctccaacaaaacttagattaaattttggatactcgtgaaacgcttttcaaactgctaaacggtgcgttttgtgcaaaaactacatgaaagttgttctaaaatatcatattaatccatttttcaaatttgtaataattaaaactcaattaatcacacgttattacaacctcgttttgcgtgaaacacttaatctttattttcatcttcatctttaggacatccaaacactaccgtaagtacttaaaattctactcttacgaacaagatctcaagcgttgaatttaattagctggtagctataaaagttcaatttttttaaagattctagtaaagctttttactagtatcgtattcattttcatcaaacaaaaaaaacattattacagcagaatattttcagagaattttttttgaaggtaattgatagaaatccggtttctatatctattcatggatatacacagttaaattttcagagaactaaaagagattttaagatgaagaggtggaagattatttgaggcaaggatcacttcagcacggttagacatctgcatcagacagggaagcatgaccatgctgcgaagaactgaaaatctccatataccatatgaatgcctctgtgccaggcattttccactgaaattcatgacgctagaacgagaaaaattgtggcatggtcccaagttcttgtgaccatcacaattaattatagccccacaataattttgttaaatcttcaaacaaattggctctagtaataaagttgaatgattgaaacatatcaggttttaataacctatgaaattcttttgttggaattggtcagaatttagaggcttctaggttccaagcaacccaaaatttcagggctataaaatatatttttttaaagataaggtgaaaagagattactttcagtaataagaaacagtgtggatgaaatttcaagacaagattaatgcagatgtggctactggcagcagctgcatgatctttctggatggctggacaagatggtctagaaaggcacaagagagattgtgatttgtgagagactattcctaaaccaaaacgtgtcaaaacctctcaaaatagttgctgtgtccttcggtttcttgagctttagcctttttcccctgaatctgatttcatcactgcccatacatgtcccaatcacagaagtggcaaatcatgaacaccagagataatggttttctcaaagctatgtgtgatgtgtgtgtgcagtagcactgagcaaaagagaaagagcaaaaaggaaaaaaaaaacaaaaaaaggcatgcatccctgactttgattttgatatgccatgcaggattattgcaattgaactgttggaacaacagaaagaattttcagttgcttgtggctatggtcttgccaataaagagaagggaaccttaactttttgtgactgctagatgtcctgtgaagcttctacaccagtgatgtcaaagaagacatgctcattttggttttggtttcaggaactctacagtgtgacagtaacactttgctagttgctattgcaggcttgcagtgtcttgagagtgaagtaaagtactaatgccttagcctaaatgtgatgttaaagtttttatttgtagtgttcagtttctcaaattagttaacctttgtttttttaacttctacaacaaacaccaagattccaccaaaaatatgtttgcaccacaatatatatgatactcttagaaaatatgttgtctaaaaaaatgataatctctccttccaaaaaaatacaaagatttatgtagttctacttgggtattaaaaaaataggttaaactaaataaaagttcgttatgattggttaaaatgagaaaatatgtatggtgttattggttcagataagtgagtttatagggaaattgttatatttcgagatagattttgaacgctataggttgctatattttcggatacaaactaggccgagttatttcccccactttcccaactcacatcgcacgtttttcaagctgctaaatggtccgtttttttgcaaaaattttctatacaaaagttgcttaaaaattaaattaatctattttttaaaaaaaatattaatacttaattaatcacacgctaatgaactgctccgtttttcgtgaggaggagttgggttcccaacccgaaggaacacagcctaagagcctatctttactgttcgtagaagccatctggagcgtccgtttccaatccaacggccaagcgtttcatcgaaacaccttgcaattggcatcacgaaaacgagatatatatatatatatatttttttggcgagctggggtactgatcgagtgtctgacctgatgtcgacgccgttgttgacgtggttggagacgttcgtggcgacccagtcgtcggcggccttggcgccggcggcgaggtcggcgagcatgtcgttggggatgccgaccatcacctgtatgcccgaccccttgagcgccgccaggatgccgtcctcggcgtcgaacagcttcaccctgtcgaacccgttgtccttgagcagctgcaccaccgtgctcgccggcagcgggtggctcagctgcgtgccccagttcacgccgatcccctccgaccaccgcgccatgcacgccgccgccaccaccaccaccagcaccagcctgccgccggcgagcggcgccggcgccattttgcttctgcagagtgtagttctgatcaagaaatgaggtgtttcttgggatacttttggggattttgtggattgtgtgtggtgttaatcttggatcaggaatcggtcagaaaaggctgggagagtgggtatgtttgattcttggagatgatcatcaacagcctcaaaccttgtgacacaccaaaaggttagaggaaagattgatcgatcaagaaagaacttatatatatgtggaatctgatttgttcttggtacacagccaagtgccaagtgtaccaagaacagctgaaatggaacaagagaagtgaggaaaatacacagcaatcagcaggcaaattcagagacctcaaactaactgaaattcagagaaaatttccttgtgccaaaaaaaaacaggaatcaaacaccagcaatcaggaaacaaaaagggagctcagaaatgagaccacaaaatggtggccgatctcttctttgaggaagcttgtggggggtagcagaagaagctgtctgcactgatcacagcctcacaggaacaagagcatgacatgacagggacaggaggaggaggaggcattaataggtcaccacaagtggaggttgtgctgcaagcaagaatcctcaaaaaagggggaaaccaggtgactactagtattaaaaattgcagagatgaacagcaggggtgtacttacatgccctaggttgagatcaggtgagtgccaggttagtaggtagtagtaacctacaggaagatcacagcaataagtaatggacagttgactcatcaccagcatttccaggaggagaggcttgccaggtgtaggagaaacaaaacaaaaaaaaaaggctatggaagtatggatagcttaagagcaaggctaataatacaaccgacctgttggtaaggttattagtagccttctcttagagcacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagctttgctctctctcttcatttaatacattccaagtaggaaaatatgctgacatggatctcttgtagagagcctatagataaccattgtgggtgcccttaggctacccatataatagttagctctttacaattaatacatggtccacttgtctctctcacagagcttcttggttcttgtgtccaagccgactgtaagtttacagccggcttctcctctctctcctttcttctctcctccacctcagtatttagccggcttatagcctactattatacttgctctaagaggagatgaagttgtatccacagtggagcaacgtgtggcagagccgcagagatcacacaatcatacaaaggagtttggcatgatatctctactatggtaaaagctcagtcgcctccttccatctcctcctcccatcgcgtgatgatccaatgctttatcttcaatcaccctctagctcatccctaattgtaatgtgggtctgttactagtataaaactatatatatgaaaaggaaaaagaaaggatgaagccttaggctgtgtttgcaagagcaagttcccaacactcccctctcgtttttcgcgcgcacgttttttaaactgttaaacgatgcttttttttacaaaaagtttctatatgaaagttgcttaaaaaaattatattgatccatttttgaaaaaaaattaactaatccttaattaatcacgcactaatggactgttccgttttccacacgcactaacgcgcactgttccggatggtaaccaccagcaaccaacacagctttagtgctgcatatgtgcaacctcctcagattttcagctgtgtttcatgtaagcccttttgaaagggaaaaacaattgctcaaaataggggtaaggttgtagggttttttttgggggtgactgaagggtatggcaataatttcagtgtcaaaacaccatagaacatttgatcatataaattagcaaggtgtgtattgattattgaagggcagatttttactttggagttatttgactggggatgttaaatcatgagttcaatttgaatggccatcgatcagttaacatcagaaaacgaggcagcccttctgaaattcttgaatttgtgtagtgatgatgagcatataaagcatatgagcaggaaaaggcagccagcaatatcaaataaatatagtatgaacaaaagtgaagtttgttgtgcctttttttttccttatctgtttcttacctttctctcatcaggtaaaataaaatagaaaaacaaaaagagaagagggcaggagatatgagcagagcaaccggctttgcttcttccacttctactttatcctgttttcttagcattagtgcattgttcaccttcatcgccatttgacaacagcgcttagttttttttttaaaaaaaaagaaactgacaataactctccagtacattacttaactcatcgacaataggaaaaaaaaagaaatgtatatggtgattaatcaaacactcaaaatcacaattatattttcttctagctaggagaagctcagatatatttgtttcataacaaaggtgaggttgtcaagatgataggtgacaacagggagtgatttgtatgaggaaaagggatctggttctggagtggcaagggagcttagtatctgtctaacttttttcaaaactatatatatactaaacaaattagaaagcaaagagagcatctccaatctgtccatgaaattcttgccttgaacaagggagaggagcatcaaggtgtttggggcagtgcggggagtaggatctaatggctcgactagcagctgtcttaaatctggaaagtgtgtggttatatattgtgtttaaaagcactactactatgtactacctccgtcctaaaatataaaaatctaaaatttgatatgttaagatacgttgtactaggaaatgtctcatccaattctaggtttttatattttaggacggagggagcagtagtattagtaactattcgcatgtgaaatcttctgtactcctcttttccaaattacctgttgttccagttttgtcctaagtcagtatttgtatctttgatcattagttttccgagaagagttcgtataatttaacatcataaggtttgtaattttaaatttaccatgagaaatacttataagtttatatgttgttaaaatatatgaatttatagaaattaatggataaagatattatttgacttacaagaaagctaaaaataaaaggtatgatgaaaaaaataattttgtttttgggcatttgcaggtaatgcctcttaagctgtgtttgatatagctgttgttcttagctaattagtggcacgaaaaacgagacgatccattagttcaagattaattaagtactaaatattataaactttaaaaatatatttgttgatttataaagaaatttcaatatagtaagtttttctataagatgtaccatctaatagtttattaagtatgctcatcccagcactaccttagtgcagtctcaatcctctacctcagttagtttccatagtattaaaatactaccatataagaaaaaaaaaagccaaggtagtaagagagttaacgaggagagaggggaaaaaaatatgaagaaacagctctacgcaaaaattaaaaatgaaaatgaggagatatgtggatgaaagaagagagaagacatgtgatagaagataatttattgtgaaaaaaatcatccattgaatatatagtttctatatataatgtctatatgacatggtgaatatgaaaactattttatagcttctatattgcgattgcccttggaatgcatacttagttatatactgtgcatatcttacggaaaatataaagtaaatcaattttacctgaggtaaaatatcgtagatgtagagcatgctatatcaagtgtgcatgcaaaaacgtatttatgcaccgtgaaaaacttgttcctttaaaataaaagagagtgaattgcactttgggccggctattattgcatgagttatattttagactaggttatttctaatgttatcactttggtccaggatttcttaccctctattgtacattgaaccactttttttgtctgccactccttgatttcattagcaatcttatcagcaacacaataaaccaatcaatatttcatctaaccttgatttctttactccttgatttagctgcttgacttctagtttttcccttaaaaaatcatgtgagcttagaacaaatcactctattgagcttgcattcggcagctacaacagccagcgatcatgaggcttggtttttgttggctcctcaagctcgggaagacgggaacagagcagagagagaagggatcccagtgctatgcttgatcatctattcatccttcagatccatggcgcaggtgcttaatagaaaaaaaaggaggaaagagaagagatggagaagaagggtggtccaatttaaaactattgtaaatttatatagtccaaaatgataagataactttaccccttgtccaaagtaaaattttggtaaaattttatagcctaaagtgcaattaactcaaaaaaaatatatagatcaggtatgacgatcacaattcatgttgaagaataaacaaaaagtaaacaagaagataaatatgaaatcaacagtaaaggcttatctttgttatcaaactagatgatgccccgcgctttgctgcgggatgtatgttacatattggagaaatgatgaaatgatttggattgaaatattatgaaaataatttgagaatgatgatttagcatgtgtatgcatgtttagttttagaatgaaataaattgcagatataattactatatacttgtatgttgagttttgtgtgtttaatgggttggtgtggcatgcttgcatgtaggttttagacatgctaataaatactatgcttgcatgttgagctttaggtatttagtgggcagtagctttatagaaaaaagggattaaatcattcactctagctacaaatcatatgattctccatggagggagtaatttcacataacattgtttcttttgttttgcactcacctttagctagtgaaaatgatagtatttaagaaagggagaaatattttttccaggaagaggaatcacattttttttttgacgagaggaatcactgatttagtccctcaagttccttgcagcaaaatttttccacctgggaccctaaattttttgttttgcttccatattgttgattctttcttttacatagttccatattgtcaattcacattaaagaaaaggaggaaaaaggagaaagggtgcacattgagtttcatatgtaggggacccactgctacctaagagcatctccagcaataggctttattttaaagcccctaaaagttaaatgagggctacccccatcttccaaggatccaaaaaatacctctaactctagcaatagcccctatttcttagtccctactcatgtttctcttttattttaacatgcaatccttgtttacacaatgtttaacaccacaataattaaacataaatatttctaacgcgtataattgaaccatagttaaatttacaatttcaaacgccacaattcaaatccaaaatcaaaattttcaaacatgtaaatatggtgtgggcagaatgccatatacaacaacatgcaaccaaaatttatagttcaccaatgaaaacgaaaattgctcaccaacatgtcattgtctgtctccatatcaccacaataggctatgtgaacccagtgatgcattatttttttttgcggagatgcactatataatttaaaaataacacaccctacaagaatgaat

SEQ ID NO: 69825 - DNA, 1443 bp, Oryza sativa
gttcgaagtagtggaatgattcgtctcttgatggtgtagaatgattcgaagtagtcacaaggttcggatgaacagaagacatctgagagcaaaacaacgatccccttcgcctcgatgaaatattttgccggcggcgcgccgcgcatggaaccacaagaggagctgaagaggcgtagcatatcagcgccgtgattaacgagatcagctgaagaggcggtaccagatgggctgttctgcaaaacagaagtggaggaggcgggcgtgtattcgtaaaattgccacgctaggagacttggccgtaggatgtcgatcgaacggatccggacgcacgtgtacacgagtgcagctgtactcccgtgtgcacaggatacccttcctacttataattggcttgctatttgtagagttatgcatactattgccaaatatagtcttagtcaatgaacaactaacattaacaactcctagtacctcgaggggcaagaggattggagcactgtaaaaacactaataatagtcatgggtcgtgctaatagaaattctcattttacaagaagggcaacaatcatgtttcttccgccttacacacttaattaacattggtcacacgacagcggaacagctagctcatggcattcggtccaagccaagtgcacctcatatgtacgcgtgacaaagagggtagcatatatgtctggctcaaacctcactagcaacgcccgagatacgaactcttttgcttgccctgttagaactcctattctattgcatatcaacatacttttgtttgccggttcattctatttatcctcgtcgacatcacatatttacatccttcagaaatgggttaaaggacggtgatatgaatcaatgaccaggtcgtcatagagctaggttagttggcatggagctcgagaagaacggcaggctgtttggttgatagtcgaattttaccatgtcaaatcttaggtgtagcgtaatttcttatacagtgtttgattgtgtgttacacttggagttaagtcacactttattagtatgttagctcacacattatatatactcttattttcaagacaaagtttatcacaattgtgactaaccgatagtgataaagttaacctccatccaaacagtctcagctagttaaatgaggaaatgaacatagatagatagatagatagaggatgaaggaggaggagaatagttatacacggaagtattatgaacaagataaaaattaagttttagttcctccatcccacaatggggttgatcgtttgtgctactttccagctgcaggcatctggagcaacaatagtagcaatcgaaaaattaattgtggctgcagcagctgctacggctgtgctgccacagctagcacaaacaaacaacccaaatataaataactttggatggatatgacacatactaaggctatgt

SEQ ID NO: 69826 - DNA, 3872 bp, Oryza sativa
atctccctctctataatctctctctcttccttccttagggcaccccgaaacccgtccgccggttgctgtcgtcctaccgtggcttgccgtcgacgttcgccgtagtcttcctctgcgccggccaccctcggtgaggtttcctctcccatccattcccttccctctccttcctagccgccgcttggcgccgccgccttcgcgtcgcctttgcgccgtagcgtccgccgccggttgccgtcgccggcaacgcgttcgcgcgtgcgcgctgtcgtcttcgccgcggccggtaggccgagcttgagccaagccgagccgggtcgccgccgcccgtccgatcgaccccaagggcgatctgggccgtcggtcctgtggaccggcggtggaccacccgcgtggtcccggtccgcggtgaaccgccctcccccttgagtcgctgaccggtgggtcccgcgtgccggcgcccctttcctccctctcccgagccgctgaccggtgggccccgcatgtcggcgccgcgcccccttgatgacgtcagccctgggatttattgcgcaataaatgatttaaggtttttcttttatagtaataaacacagtgaatcttctaaaattcataactaattcatccgagctccgtttaagcccattcaaagtctcagtaaatcaagaaaaatgtgtagaatccattaaaaatggttttgttccctgtttcagtagtcttatagcctgtttgcaatgtttgccttgtatgtcgcgagattccggttccttcgacgctccagtgtacctcgaaatagtcgccgaggttcctccagcagcagagcaaggcaagtcatgcttgtcacttgaacatgttgatcctatattgcaaatgctctattgttttctttcaaatattgcattgttttataatgtgtctatggggtgtctacctattgtcatagccatgctattgttgtaccatgtctctttgtcagcttggggttataacatgactagagattggactagggattgcttagccatgcttagttcaactagtgcacaatggggagaatcctattaatgtttagactgttggttctaatggtattgttggattagtgccaccagtttggtgttggttaattaaaataaatcacatggtgggctgtgggtgcatggttttgctggtcgcacccatggcagttaaggaccggttcgtgggatgccctggaagaacttatcgtacttaccacaagccagcgtgggcaacggctggggttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtatggtgtgcttggttagagggggttgtgcgaagggtcctgtcacggcctctttccggtatgtcgtggtggcatgtcggcgcacggaaacgtgtcgtggggctgtgtcttgtgggtacagttgtacacctctgatcggagtaaaactattcgaatagccgtgcccgcggttatgggcggtcaaccagattcaccgtgattagtctcaccctagtgtaatcttttgaatttggatagtttaggtggatggttgggcctgttgcaacgtgggataacgttggacagtggatagttaatattaattaattattacaactgtttaattctttcaacttctgtttataagtgctcgctttatgcaaatgaaccactttagctctcctttgataattccctgcatcatacccctattccggtatgacttgctgagtacagtgggtagtactcagtcttgctctatttttttcccccaaccccagagtacgagtatgtgtcagatggaggtttctccgaggagtaggcttcgtccgtgccgtcgaggatgcctgtggagtggtgttcccactgcagttctagtcaaggcttagctcctgttgtctttcttttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacatcatggtaccactagtatgattttaggtagatgcttcgctggttaattaggcaacattaggtggttttacaactctagactttgggaatattcatatcacctggacactatggaatggatggattattgtggaattggattcacccctccccctctattcaaaaccctcaaaatggttttaggctgggcttggggtgcatggttttgatagtagcacctcggccatataaggatcggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccagtgtcctgctgctaggggctcagtcctgcctacctgtccccggggttccggccgtaggtggggttgggtcggtactcttgtctatggctaggatgggttggaaactatgtcacgtcttccgtccgtataccgtggtggtatgtggcacgtggttacacgtgagaaagatgtgtcttgtgggtaaagatgtacacctctgatcagagtataatctattcgaatagctgcaccctcggttatgggcaagccgagcaatgtacccaagttagtgtttttaattcttaaaacctgcttaacaactaaaatgtggaatggtaggcctgagttggcttgggacgagctgggacccagggtcgggttgccagttcggtttgaatcatcgtaggccttgggttaaggcaggttcgtgtgggttcacggccttggttaataatattgtatagctctaggaccgtgtttacaaaatagctttgagcaactaagtgtcttttaatgctgtttactgcaaaccctaaccccttatattataacccccttgtactcccttgcatttattctgcacttatgcgtgtgtcttgttgagtacggtggttgtactcagtcttgctcaatttttctcaaacccagaagaggagcccctggatgatgaaggctttggtgtctagctcgtgcctgccgtcaagcacctgtggtcgtcgccctagtcttcgccgcccatgtaataaagtaactatttacgcttccgcttgataaactctgaaatgtatcaacttttggtgtaccttgcctcctgggacaaggaataatacacgcacgtaaggaacccccgttgggttatttccggtcgtgacattaatccaccttccagcaaggggcatagatttatattggttgcaactgattatttgaccaagtgggtagaggctattcctttgaaaaaggttgatttaggatatgctatacaattcgtcaaggagcacataatctaccgatttggtatttcccagactattacaactgaccagggatcaatctttgtgtccaatgagtttgttcagtttgctgatagtatgggtatcaagttgttgaattcttcttcatattatgcacaagccaatggacaagccgaagcatctaataaaagtttgatcaaattgattaagagaaaaacatctgattatccttggcagtggcatacacgactgaccgaagcattatggtcttatcggatggcttgtcatggatcaattcaagttcctccttat

SEQ ID NO: 69827 - DNA, 4903 bp, Oryza sativa
cttattatcaagcctattaaaaccttttattttggaccctatagcaactaaaagatgtacatatgcacccctaaacaccaccggacccactgtcagcctcttccctctcttttttattccctctgcctcccccctctctctctcccccgagccctctcaccgtcgtcgccctttcttttctcccagtcaacccgccgttgtcgccctctcttttccctctaccttcggtggcagatcagtgtcactcgagctctggcggtggcggatctggcgaaggcggggagcagcggtggcggtggatctggcggcggcaaggagcagcggtggtggtggcggggagcaacggtgagggcggatggcttgacgccgctgtcctcctcacgaccacggcgagatggctcgacgccgccatcctcctccccccacgacggcgcagacgagctcgccgacggcgtggcgagcttggcggcggcgggctcaccggatccgggtgcggggtcgccggatctggcgaggcgacgacgaccacggcgaagcgacgcgagtccggcctccgcaccggcggcggcggatctggcggcgatggggagcagcgacgacgaccacggcgacggcagcggatctggcgaggcgacgtagcggcgacgacgaccacagcgagatggggatttggggtaggtgcacgggagaccggacgaggcgacgctgttaacgaccaaatttggtaatctaagtatcggagataaaaattagattgaagcggaatccaagatcaagattgggaccagatgaggcgacgctattaacgaccaaatttggtaatctaagtatcggagataaagattagattgaagcggaatccaagatcaagattgtttcagaaacagagcaagaatcggctggaatccaaatcggctacgactaggatcggcagagttcgagtcagacagggttagccgattgagccgatcccgacaatacaactcagtgtacgtcatcggattgaattaatgtgcttcgcatggatcaccacacttggattgagtcctgaataggcaattgtatctattaattaggatattttatgtaatttccttagagataagtgtgggcaaatgtctgccgcaaagatttatggtatgttagagtttgttagagataagagtcgtgtccgacaaggacatattgtgtaatctcgggtataaatagaccccgagccccatgtaatacaacaacagacgttcaacaacaatctcggcgcatcgccacccttttactttcattttgtttcgacgagttcttgctttcaggttgagctgcatcggtttcgatcttcaactagaggtaaaacttgttatggcggcttgcgttctcgggattagtgcttccatctttatgatactctaatcttgtttatgtaagttgtcgagttatcatgtatcttatataatctccgacaatatcgttatctaacctccaatcggctaatatctatcgttaggaagcagccgattaggttaaatatcgacgttggcttagattatataggatatctaccactctatgaagcttccaatagcttgattgtctagatattgtctttctttttatacttatggctgcattagttgagtttgatctcataagtcgtgtttagaactatagtctcaagcctgcttcttggttgctgattagagtagcatcgagctttcagccgatcttacctgatttacctttatgtcttatatgctcaattgttatgctaaatatgccctttatgttaagatcctattgcatttaggtttattaagctctatgtttggtatattttacttgctttaatatcttaatatagagtagtatcagagtattagccgatacacgctagatctatctgatgggctatgctatgagcatctataatctcattgttaatatttatttcgatctaagtgatttatactgcctcggtatggtgatcgatctatcccaatcacttgatttaagcatatatcaacataaaaattatgtactgttaacatctacagctgatcgaatagatttagttttaacttactcattcacaactgccgatcgactcacatatgacattggctcaagaataaatgatatgtcatcggtgactggccgatcggctatcatttatggatttaactgcggtttctttgtctttatttcttgttgattgcaggatcaaatcaactggcacgctcacgaacctaaaaggcatgattttgtacctgcactggagttaagcagatctcccagacctcatgtttttcgcatcaacacgtttttggcacgcctggtgggacaatagtttcaacgacttcttcccgatggccgaaaaaccaccaccgtcaccagggacaggagtcaaacctcccgttaccaaaacgggagctgcgaaatccatcaactgaagtgaaccccagcaacatagttccagttacattggataacctgacggctgaacaaaggggtgaacttgaacaaatgatgagcaatgtaaaggatcagcttatgaattcttttcaagaaacccgcagaggcacaatcgtccagaagtacaagctgaaggtagttgcagccgatgaggttggctcaagctcttctccaggcaatgcaggtactgcagctggctcaggcgacaaaggtaatgtctctcaagatggtgcagttgaagatcttggtgaaaatggcaaccaagagcaattacagtttaataactttcaagatcggatcgactacgccgtccaacatgctctgatcaaccaatccggtgtgctagttaacactttgacaaacatggtgaagactgtggtcgatggtacgatagctgagcatcaaactacagggccagtttatttaccaggaggtgtttttccgaacttttggccttcagtcacaggaaatcaacagggtgttactagtgtaccaccaatccagccgatggcatcagtttcaactactgcaccaactgcatcatcatcggcaccaagacagatggtcaatgctgaaagtgcattaatcctcctagtgagttttggtgattaatgataaatgtggttaagggactaatgagctcattgagtagctttcaggtgcattagtccaaggtgtggaagatggatgcttgaagaccccccaaaaagtacaaaatcaaagcggaccggaactcaagaagtgcataggatagtttatcttttgaaatcgagtttttaagaaaaaccgtactattaagaggggttccaggtgatgctctgagatatatcaagtgctcttagtgtgaaccaagtgtcaagtttcccttggagtccttttttgcaaatactccatctgtccaagttccgggcctgggaggctggaagttctggagttccttaccaggaagttcctggtctgtttgaactttaccgcggtgatttgtttttaagtttttagggacaacctattcaccccccctctagtcttcatcaacgcgttcaattggtatcagagcaaggtgctcttgattcaagcttcaccgctttgagtaatccacgatgtcggatttagggggaaagaacggggaaaatggaaatgaagatggagcgagcagcaagggaacttcattatccaagggagctactataccttttgattacagcaaacttaccattccccctcacaactttgtctccgtgccttccgggcgtgctcctcaatttgatgggacacattacgccgcttggaagcacaagatgaagttgcatctaatctctttgcatccaagtatttggaaaattgtttgtacaggtgttgatgtaccccatgatgacatggagctcacttcggagcaagagcaactcatccaccgcaatgctcaagcttccaatgcaattctctccgccttgagtccggaggagttcaacaagtttgatggtcttgaggaggccaaggagatatgggatactttgcaattggctcatgagggatcacccgccgttcgtgaggccaagattgaattattgtaaggaaggcttggaagatttgtaatggatgacaaggagacaccacaagagatgtatgataggatgatgatccttgtcaacaagattaaaggacttgggagtgaggacatgacaaatcactttgtggtcaagagatttctccgtgcttttggtccaagaaatcccactcttgtatcaatgatacgggaaaggaaagatttcaagaggctcaccccaagtgacattcttggaagaattgtgtctcatgagatgcaagaagtggaagctcgtgaagtgaggcaaatggtgaagaatgccgccatgatcaaaaatcaagaagtagctttgaaggcaaaataagaagaagagtcaagttgtgaagaaagtgaagatgaagaaatggcttttattgtcaagagattcaagcactttcttcgcaagagtggctatggcaaagggaggaaggatgatgacaagggaaagaggcaatcaaagagagcttgcttcaattgtggcgaatacggccacttcattgccgattgtcccaagtcaaatgaagcaaaggctaagggaggcaagaagaagccggagcgtgctcatgtggcggaggcacacatggcggaggtgtggtactccggagatgaagaagatcccgaggtcaagcccaagcccaagccgaaagacaaggttgaaggagaaggtggtgttgctaccgtcaccttcaagtcatcttcttcaagcaaggaacgtctcttcaacaacttgagtgatgacgacgacgactcctaccactactcttgtttcatggcccaaggccgcaaggtgatgactcaaaagccctcttacatctctcttgatgttgattctagtgatgaggaaagtgataatga

SEQ ID NO: 69828 - DNA, 3461 bp, Oryza sativa
aaatgcagaggagttgattgaacgaggaacgccaaaggcaagattcatctgtatctttgttaaacctagtaatggagccaatgacattgttgagtacggacgtacaactaatagcatttttcggtggttggccacttttttatagcatacataccataggcagcactcggcagtgcaactgttagtggcagagctcaagttacagcctgatctgctcaggagttggttaaaccccataattcaaacaaataaaaatttacgtcagccgaactagctagcatagcatatgttagttgtcactactataagaaataaatatatcgtctttaacattcagatatgctattttttcataaacttttctacaatacaattgtatgcaaatcaagttgcattttggaaaccatatcaatgtaaaagcgtcacttgtgatttaagggagtgattttaagcttttctactcctataaaaaaaaggaaccagtagttacctcatgattaaacatgtgggcatccatctttcaagccgatcagacagattgccagcgattattgtagataaatcatccctagatggatgcatagctagttagctacatgtcgacatagctaattaaccagtctgatagatccacgccaaaaaaactcttcgctggaggcttttaggccctccaattttgtgagttatgaggtgcatgcttagccacaacacaagctaaagctgacctgcattttattttatttttgttcagttcagttgtgcatgcatgcaaagagggatcctttgatggcctgatcaactgtaaaattgtttataaacatggttagtaatatagaaatgacagagatagattccatgagttggtacactagtggagcttgacattgtagggatcaaggtggagcgtaaattcaaaggtgaaaaagggaagagcaaaccaagcgaacatgtgaggtacagccttatagcggctgatagcatatcaaagttaattatagtcgccgcaatcggcattggtcttgggttaagatttcgggaagaggcattatgcaccactgtcgtcgactggtgtataagcggcttttctattgcgtcactcaccaattttctggttgtgggcgtgaagattcgccaccaccgcctggaagagcagtactccaatgcaagggtgaaatagagcggtgctatcgcggacaagatttttccaatgtccgccaactctatcatcttgaaattggtgaaaataaaagatgaaatgtgtattaaatatatacttacgagtcgatagtatatatagcgaacaccgatatgcgtcgtcatcgagtgatctaattatgccgttagttatttaagcatgcgagccacatgtggtgagcatatgatggcaaccatagggtgtgtttggttgcctgcatgtgttttggctcgcacccgcccatgcaacttcgggttgtttggttgcctgttcgaagatcttagccaagccctaaggatgcaggattccctccacagccaggctctagaggaacgcggggaatgagcttcgctcctcaacctggatgagcggatgcaggggcgggtgcctcgcgcgatgcaacgcctgcagtccgctcacctccactgtctcatttgctccttccccatcctctttcctctccttctcattgtttcccatcttcctcctcttctcgtcgaagccaccgtcatcttccagagcactgtcgactctcctcgtttctgagtcgccggactgaccagatctggcggccatgagctcctagcaccatatccggcggccttgacctaatggcaactcacaagccattctctgtgtccttgatgtccatctttggtgagcaccttgactgcaacaggtagtgacttcagaccaaccctgacattctcatctatgtagcccttgtaaacagtcccaaaccctccttcaccaagaacgtagtcagcacggaagttctttgtgatggtctcgagttcaaacaatgtgaagtcaatcacataacgtgtatatggagatgttcttggcatcttcaattttcctaggtgttaaggatcactcatatctgatgagatgcgggtgtgcttcctctctgcaacagcattcttgacagagagaaccgctatacatacgacattttgtttacgattgctttacgatcaaacgttctctactactctctgttgacgattgcaagtttcggtcccacgcgaaaaaacatacacagatgacacggcgttagatcgtacttggatcgtaacaaaagatcgtacgtatagtattttccttcttgacaggatgttgtagcaagtggagctgctgaactgagaagatgacatttcaacaacaagaaagaaaaaatagtcaaggtaaaaacgaattaaggttaccataaattcttatacatataagataaaaggcaagcttttttttcatattgaattttgagcattcacagagatggttggatgaaagagagctaatcctgctgaaatacgtttaggaaagctataatcacaaactaacaagagaactactggaaacgagcgttggcgattcctagcaattataaaatggtattctacttaaaaatactgtaaaaaaagtacatacatgggcaagttgattacagcaagaggtaaacaggaccaggagaccagatctactgcacagttgcatgcaataaaaaaaagggctccaaattgcttaaacaatgcagcaaactgcaagaagtgattatgtttttccaacttgcaggatcataagtctattttctgttaaactgaaagtcaacagtgcctcagtgaagcagatagcacagaaattgcagcactattgggggaagtgcctgtaaattgtccctatgaacacaatgaagtagaatttctgatacagcaaccaagaagataaggatatgcagcagagaagaaatcacagagcaaccacaccagaaagcttaaggagatgaggcttccccgcaaaaaaaaaaaggaaaaaagaatggatgttgatcaaatgtagactgtaaatcaaaatcccagaatccccatgtgcaactaacagaaaaacaatgttgaacatttggagcaaatgttgatatcggattttaatcaaagctaaacccgagagtaccaaaatgccgatttggagacctaacaagaatcaacatttgcaaccagaacacccatccaaaggtcccaataagccataggtcatcatatatagcaaaaaggaaagacagtgcttttgtcaattccccactgaacccaccaacctagagtcctagagatcaggggaacccagaaataaccaccaagatcaattttttttgatgaaattcagatcatccaacccgagatcccatcccaacaaccagcatcccaagaaacaatccctgggaaatcccctaaagaaatcaatccgaggaaaaggagaaagtgaagaatac

SEQ ID NO: 69829 - DNA, 768 bp, Oryza sativa
gtcaaatacacttttgccatagagtacccaaaaaaaaaagcaattctagacgtacacatgactgtttgtgatgctttaacttgattaacttaaatgtgcataaatcatttttgttatgaaaatgtgtcaatttctacagagatcaatttagtgcactggtacataattaccttcagaattaaggcagttactttctgatagacatactacacatgtggactgacattacaaaataaaaaaaataatgggtaaagacaaagctaaatcagactatttgaataaatgtcagagggaaagaatagagtgtacccttggattaaggtattaacttgtggccataactcctcgtcccttactctgtttatctttttcgacaccttagcaataactcgcacagctatccgtatttttgttgatagcttcctaaccaaattacgagttgcatcaatcttgggagcttcagcgcctttttgatccaagaatttcagcctcttagagttcttggcaagcaggagccgcattttctcttcagcctggaagaggaaaacagcaccaaaacattcaatacggaatagagactaccaagggtgagctcaagcaaacaacatgatttccccaatgtagagcagtaattcttcattgatgggttcctcataggattattagtttacacgtagggtgataatgatatgaaaacaaaatataatattgtcctgttatgctacaagggaacctaaaaaggcatggcagcaacagggctgcaggaat

SEQ ID NO: 69830 - DNA, 9738 bp, Oryza sativa
gaggaagggggctcgccggtgccgttgaccccttctggccagccggcgagtccgggcagtggcacgtggggcggcggcggaggcagcccgcatgtgagagagatgcggcagcagcctggaatgacgaggggagggagaggggttagggttagaactgcagcacgaatcttaaagcgatccaacggtctagaattcgcatgatttgtgaggtgtttttctgtcaaatgccatctagacagcccccataacataatcatctacttcctccgtcctaaaatataagggattttaaatggatgtgatatatcctatctagattcatgatcatatatcacatcatctaaaatctcttatattttaatacggagggggtattagcttaaaaaattaacccatgtcatctatagaatatttacctatagatacatattacaccactaatgcatacctcacatttttatcccacataggttattggaactcatggtgcagctggctataaatttgtagtctgttttttctctctcctccacgtaagtataaatatgatgtggcaatatgtagagctcgcttacatcatcttattgtactcgctttgataaacactctcatggtaatatttgtgttttgcaaaatgaaaaatacattattcccaacttctaatatatttttactctaacggtctgtttagttcccaaataaaattttcacgctatcacctcgaatgtttaaacacatgcatggagtattaaatgtaaaaaaaactaattacacagttcgccaggaaattgtgagataaatcttttaagcctaattgcgccatgatttgataatatgttgctatagtaaacatttgctaatgttagattaattaggcttaataaatttgtctcgcagtttcctagtggaatatgtaatttgtttgttattagactacgtttaatacttcaaatgtgtgtccatatatccgatgtgatatgtaggggtaattttttttcccaactaaacaggccctaactttgatttatttgaaattcctctgttcctagataaagtctcactccacgtagcataaatcatagaacaacctacctacgtaataattgagttgatggatttatttggaaaccagtaccatatatgtactacaaaagtacgaaccatgagcaatgggatccaccacctcccaaagattcctcttgttgggataatttccattcacaagtgaagtaacataacttatggatttgatgaaaccaaattaaagggaaattgtgtttattttttctgcaaaaaaagagagagagaatcattggagctggcgctgttttttttagtaaatttcacaaaactacaggtgctttgtttaaattattccaaaactacagatttaaggtgatgtatcacagaactacagatttaacaataaatttatcacaaaactataggtttaagactaagtatcgcaaaactacatatttaataataaaattatcacaaaactacagattttagggcttaaatccttagtactaatgttatgttggacatataattgttcaagtaatgtgattaaattatcaataaacctgtagttttgtgataactttgttactaaatatgtagttttgtgatattacatcttaaatctatagttttgtgataaatttagcattaaacctgtagttttgtgataaattgatcaaaatacctgtagttttatgaaatttactctctttttttttgcctgtggaaacttttattattctagaagattagttgcactgttgttattgtcacatttcttgatatgcaagctctgtagggatgaacaccaaaagctttattgttatcaccatcacaatttttttcaattctttttggtacaacaaaatcggatcatgacttgggaggatgtttcttttccatgtttccccttttagtgatacaatactgtttggccatgatataagccatgcatgcatgatagtacagccacttatttcttgtctcagcagaaataggaaatatggtaagctcaaaatgaaatcttattaaaatgttatactagatttctaagatagagagagacaattgtagtaaatccatttaaactaagaggaactgtatatcaacaagcttttcttgttctcatttatcccttgaacaaaactacaaacttttctgcttctactaccaacaaagtacattgtctaatcttacacaaataagagaatataaaataaggctccttggatcaaaagatttttgaaggaattttattggaaaagaatcctatgaaaaacttgccaacaaaaggaatgccttagaaatagccaaaatcaggattagtaacatgaggttcaacctcatgaaaatatttgtgtctatctgtatccctctcttgtgctccatccaaatgactactcgtgtaacttttccgtgctttatcattcataagatgtgaagtgctaagacattctactcctgtattttttttattccctgttttgagaatcctatgttctaaaatgtgccataagagcatgctgcctatctttgcacacacaaaaatcttatcaaaataacaataaaaaaagaacaagttggcatgaaaatgggagattgaggaaatgtgcttcatgctagcttgtagaaggagcattataagaggaaggaccacagacagaaaaagataagatggtgggcatcggctaatatctgtccatgcaaatatgcaatgcatgtccagcagcatgtgcacacaaccatatcacacgggtgtgtagctgcaggccgagcctaccaccaaacaccagcagcaggcagcagcaactggggactgatcaagctaaggtggtgtttggatccagggacttaactttagtccttgtctttagacactaatttagagtattaaatatagactacttacaaaactaattacataaatgaaagctaattcacgagacaatttttttaagcctaattaatccataattggagaatgtttactgtagcatcacataggctaatcatggattagttaggctcaatagattcgtctcgcgaattagtccaagattatagatgggttttattaatagtctacgtttaatatttataattaatattcaaacatccgatgtgatagggactcaaaagttttagtcccatctaaacagggcctaagccaagtggttgcaggctgcaatatatatcatcttcattttcttctctttcttttggccatcaactgcactccacaaccacaagtggctgcaggctgcaatatcatcttatttttcttctctttcttttggccatcaactgcactccacgatcacaagagggggagaggagcaaaggcaacaagacgagcatgcagtgcagcagagagagctgcatggatgcatgtgagagcatgtacaatagcaggctataagccagctataaacatattttaaagagataaaagaagagagaagagaagtaggctacaaatttgtagccagctgtagcacggactctaagacgtaatttatgtatgacaagtaagatcaagtattaatagtataataagcaactattatatgaattagctattacattggttatagatgatttggagctagtagttgactatactattaaacttgctctaagaaggaaaggagatactatcaggcaggagatcttctaccttggaattagcaaaagctacccaacaccacctgcattcttatcacaagttaaagctgctatactgcatatgcaattgcagggacactccctctccgatgaaatgaacaaatcaacttgtgtagttaaacattgctgtcatgtgcctgagcctttaaagtagttaagcttgtaaatggcactcgtgtagatcagatcatcagggccagggtctgtctgaaactagagattctttaattgcacacaggaatcttagaaaaatttcgaaggaatccggcaaattcttgcgttttaaaggagtccaattgaactcttatgaagtggatctccttatgtactaactgggttcttatgtttcgtttttgctcagcatttagtcatggcacaagatcacaccatgaataaactttagcaccaaaactgtcactacgttttagttcatggcctttacctgtcaggcttaaaatacagtagtaatctagagcaaaaggttaagctggccatacgagacaaaagaaataaaaaagatggccgagtagagcatctccaactgtctctccaaatccaactctccaaatatttatttggctaactctccatctaatttggcaagtcaaactcgttgtttactccaacagcctctccattcaccctctctattctaactctatgacagtgggacccacgtgtcagcctctacaacccttctttttcttcctcatacttctccattttctctccattttcctcacgatcctctttatcctctctggtggacaacgcggggcgatggcgacgacggatcctcgccggcctcatcctcctcgacagttgctggaggaggagacggcgagcttccagtcgtcggagtagcgggatccggaggaggcgcgcagcggcagcgggcggcagtggccacgcgcggcgaggcaccgccccgttcgctccgctcgctgcgctgaccagtcgaggtggccgctgccggtctccgctctgctcgccaaggtaccatctcgctggcggcaatgaagccgaggcgctccttcttgacctctataaaatctccaagcgaatcagatcaccgaccagccattcccatatcctcctccgattcgaaaccctcgtctctctctctgtgtgtgtgtgtgccggattccatggtgacagcagggagcagccgaggaggaagggcgggaggggccggaatgcactaacggcggtgctggacaacgacgccaacatctccgccgggaaggccgacggcgacggtgagctcaggcagaagatgcaagatagcgacggcgcgcctccttccccatggtggcggcatgcacaagcagagggaggaagggcggccgcggcgtcggcgatatgcaaagggagggaggggcggcagggcagggatggtgcggctagtggggagagaggagaaaaagttggtggggcccacggatggccagtggctaatggtggccaaaggctggctaagtttggctagctcgagcccatgcttggccatggctatcttttgtcaagtgggatagccattctactggagtgtggctatctactggagtgtatttttgctcaaagtagctaaaatttagtttggagagtggaatggagaggctgttggagttgctctaaagaaatggctggagcacagtgacagttgaggagaacatgcgagggctccgagcaatgatcatttgcttacacatcatccataatttttctttcctaagatagagatcattttttcttaccctaggatagtgatctatttttctcagtagctatatgtgcttggaaatgcagaggagttgattgaacgaggaacgccaaaggcaagattcatctgtatctttgttaaacctagtaatggagccaatgacattgttgagtatggatgtacaacggatagcatttttcggtggttggccacttttttacagcatacataccataggcagcactcgggcagtgcaaccgtcagtggcagagctcaagttacagcccgatctgctcaggagttggctctgcagttggttaaaccccataattcaaactaataaaaatttactactgtcagccgaactagctagcatagcatattttagttgtcactactataagaaacaaatatatcctctttaacattcagacattcagatttgctattttttcataaacttttctacaatacaattgtatacaaatcgagttgcattttagaaaccgtatcaatgtaaaagcgtcacttgtgattgaagggagtgattttaggcttttctactcctataaaaagggaaccagtagttacctcatgattaagcatgtgggaatccatctctcaagccgatcagacagattgtcagcgattattgtagatgaatcatccctagatgcatgcatagctacatgtcaacatgtaatgagaagggtcatgatacgtgtgaagtgattggacggtagcggctacgtgtacctccttgtgatggattagtagcgacaagtacgtgattaggcctgcaagtgcgtgtctgcacatggttgtaagttttgagagttcttgggatatgttaattagtgaagtaattaactgatgtgatatcataattaactagtctgatcgatccacgccaaaaagctcttcgctggaggcttttaggccctccaatgttgtgagtcatgaggtgcatgcttagaccattcccaacccaaacacactatatatagtttccataaattttacatcataaaaaaactgtactagacactactcttccaatgcaaacaccactattttatatttaaatttaatgctacttatttcacatgatgtcttggatattgtgtagaaaccatgtctcatgcaagacatgattttcttttctttcctcatttattcacttaccatatcatttttcatcctaggtggcagcttatttgatgttatggacatcatcatagttattgggttggaaatggccttagccatagaacaaactaaagctgacatgcattttattttattttttttcagtcgtcagatgcggtctcattggattatgcagcagctcgatctcttcaccttgccccacaggatcgcattcgcatggcgacaccatcaaaacacttgcacatttcttcattttctcttttcatgtcacgctctacctcaagttcaagtttcaactccactccatatacagttcagtattccaaaattccaattcatcacaggggcaagctacattctcagctaatcagcttggaacatagtagaaaaattcatatgaaaacagactggatctcatctctagcagtaaccgcaaaggataaaacctcaactttgtacatctggggctagaaagtgcatgcctccaccaagaaaaaaaaatgaaatggtgtaccaaacagaaacagacactcgagtccatcaagtcacgcgtgttcataacacgtagtactgttctatttaccatagctctgcaggtccattcacatgtgagcaagatggagtgataaacacacaaaagctactagacaggtgtcacagtccaaaatcaaagccaagccaacatatattggcaggcaaatcaagtgatcagcggccagaagaaacagtgtaagttgcttagagcgggtacagtaataggctataagccagctataaatatattttaaagagataaaatagaagagaaaagaacagcgggctacagatttgtagccagctgcagcacggactccaagacacagtgtgtgtatgacaggtgggaccatgtattaatagtatagtaagcaattattgtataaatcaactattagattggttatagatgaattagagctagtagtggactatactataccattgaacttagctcttacaggagagcaggcacaggctggcccggagcctcgtgccccggctgctcatcagtgtgctactgtttggagatcacaggtagcgcatccctttccatggcgatttgcgtgtcccacactgaaccagcagactgcgaccatttggcagcctgctactgcttgcaaccattttgtcaatgtccagtgattcacacatcaatgtgtatcataataaagatcccaactgtcaccaacccagccttgaaaaaacatccagattctagacaaagttgctgtcaccgacccacacaaatatcagtttgataatgttcagtaccagatcataacagaagtgtaccaatatatatgagaaaaggactcataagatcaagatgatgccacatataattggcaactccgaaataaagcatcaggaatagttaatcaagcttaacattcaaactctacaacaatcctgaacaaaaaatctacccatctcaaaataacacagcttgtattggcagccacaaagccccatatacagggaaatagggtctccagtatcacccaagtcagcaccatcatcaaggttgcatctgaagtttcctaagctatatcagcaacaggagatagtaaccacaagactgtaaaattgtggatcatctacccgctgcatttgtgccagaaggttgtgatataaacttctgggcaatagcattaatgcaagacctgttcctaagttactctccattgacaaagcttttactgtcgtagtactcgttccgtttctgcaaaagcaacgccacagactaaggtggtgtttagatccagggacttaacttccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaatttttaaacatccgatgtgatagggacttaaaagttttagtcccatctaaacagggcctaagggaaagtctaataagagagtaagcagccatctattagatacttactccctcggtcccataaaaaagacaaaccctggtttccgtgtccaacgtttgaccgtccgtcttatttaaaaaaattatgaaaaaaaattaaaaagacaagtcacgcataaaatattaatcatgttttatcatctaacaacaatgaaaatacgaattataaaaagatttcatataagacggacagttaaagttggacacggaaacccagggtttgtctttttttggccggagggagtacatgttatttccatatcattaaagataatataaaaattaaccgagtcattaatttttttcttaatgtgggtcaagccttggttctctctcctagactatctaccaatcacagatgctctttccatgtgggcccaccttaattatctctcacctaatcttttcaccaattacagcatccatcgccagcatgctgtgtctaggcgcccgtgcggagccgtcgtcaatttagtcgaccgcttctctctctccactccctctttcttccagcaatgcaaaaggagctgacataagtggctaatagtaggcatattttccctattacacttgccctaaaactgaacaaaaccatagcacatcaatggaccagaataaataaatgcaaactacccaccaccacccgcattcttatcacaagttaaagctgctactgcatatgcaattgcagccttgcagggaccctccctctccgatgaaatgaacaaatcaacttaaggtagttaacattgttgtcaagtgcctttaaggtagttaaggttgtaaatggaactcgtgtagatcagatcatcagggccagggtctgtctaaaactagagattctttaattgcacacaggaatcttagacaaatttcgaaggaatccggtaaattcttgcgttttaaaggagttcaattatactcttatgaagtggatttccttatgtactaactgggttccaatttatggttcacttttg

SEQ ID NO: 69831 - DNA, 32354 bp, Oryza sativa
  unsure (1)..(32354): unsure at all n locations
ttgggtgatcatacttgcatgcaactccatatctgcaatacccattttgggcatagtatgcacaaggctgagccccctgcaagttgagataacacaagcagcttagcaagaaaccaaggagcattttctctacaaaaaagcaaagacaaaaacataggtctatgtgcaatcaccaatcaacttcttccaaacatactatgcaagcctgacactatagatgattaatgcacgaatgtgctgtctcctagcataaattttaagaactgtgtaaaccttttgggcagtgcaaactaattcaggatatcacactgaaaaacaattagtatgagtttgcaactaaagaaggggatcttacaagacctccaaactaattatagaaaagaaagtaatatcaccaatggatatttttaacaatataggacatatttccctacaaagcaagttaaatcagacactagcatttgaaattatgcgtattaggctatttaaagtccatgtatctgttgaagtttgcgcttcactcagatagtgatctctgatttatgggaatatttgggagcccctgtttctataacttgctgagttacactgacgtgtgggccaaacatggctcatcctcacattcaatgttattttcaatttatacatgctcagtgttattgagtaagttttccctctgaaatattataaatgcttattaagtcaaaaaaaaacattatgaatgcttcatccaataacaatttaagctgcaaatagcttcaaaactcaggagctaagtttgaacaatgtatcttacttgatacattcaagtttcaaccaatctttggcccataaaagttatatactagtagatgacaatataacacagttaatatttatcagctaaccaaaattattaagtaatcaactatgttccatgatctcataatccctaaatactcagcataagaaagcttacaatgcctaattgcccaataatctgcttcttctttttgtgatacaaagaaagatgcacatgtgcacacacacagaaacatgagcacatgcataagtgcgcctccttttaacacatactcaaacacacaggccaaggatanatccatgaacctcaataaatttcctagtgaaagtgcacatagagaacattatcgttaggaggcttcaacgagtagtggacataatcatatgactagttcctacaacctgtttttcaaaacaaaaatatatgtgcagcttttttttttaaaaaaaaaagaaaaaacatggacattaggactatggaagttcaaccccactcccaaggacattgatgctacggtacgtattagaggtttcagggtactcaccggacgaagtggaagacaaagggagttgaccatatagcctgatttaggtgcactcaactctcgggggtgatgatatttacatgtagctccaaatttgcaatctcctgttctcatataatattgacaatcaggctgccctggccgctcagggaatccatgttcttgttgattgttgcttgattgtccagttgaggaagcatatggaacgtaaggaccaccataagcaattgtagaggaagatccatggtgccccatgccgtacacaggtccagcttgaacattttgttgagctccacctgacactacagggtttaccgaagcctgtataaaatagaagagttaaaaccacaatgagaagactccatcatggcatgtgtcaattattttgtcccatctgattgtttgcttaacacttaaacactggctggttattcaggcagcacatcagtgagtgccttccagctcttgcctaaaagacaataagcacattctacatctttcgtctagattacaaagaacctgcttcacaaatcatgacacaagtatgctgtcgtgcctcatttgttgattcactttgcatttcatagtataagttggctgtcatgtccaatttgtttatcagttttgcatttataggtatgctgtttatttttccacaatagaacatgtaattcaaatcaattaccggataagggctccatccttgcaatgggatcattccagatgagagcatcattggggtgtatgagcctggtatatatgatccaggaactacaggtggtctccccatttgccaatttgcaagagaagcatatggatgaggggaagctatagatggagactgtaatggtgggtatattccaggggtcatcggaacaccaccgaattccggatgatggaatttacatgtagttccaaatttacattgcccagttttcatgtagtaggagcactccttctcaccctgcattttatttgtaccaacatctctttttcaaaacaggaaaaacaagtgtatgaataagcaatattttacgagagatttcacaccaggcgtatagggaatccactgttgtttaacataacaggtagcacagctccatcttgcttaggatggtgatatttgcaattggtaccaaatttgcaagtcccagtcttcatgtaatactgtaaaacaaggaaaaagaattaggaccaacatttacatgtcatatgacatgacattaaaattgttatgtgcttaacaatctcagccaattattatttgagtattatgttgcatgccctgcctgcctgccagttagcaagcaaagaacacatggtgttaatgcaagcttaagtgatggcgggtgcctttttcgttgcataaaagataattgaattcaagcaccaagctgtttagtttgagtacctcgcatataggttgacccgccctttctggataatccaatgctgctgcattccttgcacctccaccaaactacattttgaaaaaatagcaactacttaattttgatgttccaaaatcaagcgaagctttactacctatagactagcataggcaaatatggcatcccatgcgcacagacaaactaatcaatttcttaacgaaaacagaaacatggaaagtagataggctatcaatagacatgagtttcataaatcatttagaaagatcacagttgcaacagaagaatgtaaacttataacaagaactactgaatagttgctatatcttttgcaaacccaacaagtgagaaattcacaaaatcaggatagagggtaaactatcagccaaaagccaaatatgctaaacaaaggactttgctaaccaacggtaagaaaacaggcaagaaagattttcatgtcaataatcattgatcctagatgtctttgttgacacatttgatttaatcaaccaaattaatgacaacggaatgggaaaagaaggatattttttattatgttatcagaatcaacaactgatcttacttaaagaaagattgagcacagaagtttgccatctgcagatgcatgtagtctgacccagtacaatacaatccaattaagcaaaattagcaaacacaaaacacccaaaaaagcagaataagtaaacatgaagcggccaataaagcaggcaacctacagctttctgctttcaaagggatatccaagtgctttaacttgcagaggtgcacctccaccgcgaacccaaactctaatgctgctacccgatgagtgctaccgatgcgccggacaagatctaggcagtggcatgcccaattttcaagctacagaagaactacatttacattggccgaatcaatgttccccatggcacgatcctcacttgggcactaagctgatcacatggttaatccatccaccctagagctgcctcatccacgcacgcgcgcgcgcgcaagccgcaacgaaccagatcgggaagggaagcgcgaattaggagactcacctcagtgccgccgcgatcgcgcgggtggttgtagcggcagcggtcaccgaagccgcacgcgccggtgcggaggtagtagacacagtcctcctccccgggccgctccggcagcctccccgccgcgtccccatcccctcctcctccacctccacctcccccgcctcctcctcccagccccatcctccacatcggccctgcaaccacaaccaacaaaaccaaaaccaaaacgcagctgctcatccaccacccccgccacacagatcccgcgccacccccgtacggacgccgagatctacatcctcgagctccaaacacaaaaaagcacacaacgagcacgcacgcacgcaccttccaggccggtgtcggggctagccccgccctccccctcccctccaccagctgcggcggcggcggcgtgcggctgctccatgccttcgtcggcgtcagcggcggcgatcggggcggggagcgatcggagtgggaggaggaggagatcgggggtgaggttttgtttcctcttattctctctcctctctctctctctctttctcgcgtttcctttccttccaccaccactctggtgtggtgtggctactgctcttttctctctctctcctcgttttttttcctccctttccttgcctttttttccgctggttttttgcagcacctgtccgggtttcacacggggttggtttcttctgtttttctctttttctttctaaaaaaaagaattcactttttattagtatatatactactctctccttttaaggttaaaaaacgttttaactttggtcaaagttaaactattttaagtttaactaattttatatacaaatataataatatttataataccttaaattaataattgaatatattttcataataaatttatcttagattgaaaatgttattgtttttattttttaaactgagttaaacttaaaatagttcaaaacgtcttataacctgaaatggtgagtatctttttttgtttttcttttaaatttaatgggagttgggatgggggtgcaaaggaccacgcctgatcaaggggtggatctatcactcacttcacatgtggggattgatggtgattttttttttcctctttcttcgttgcataaatgtggggggatggaggcggtaacggttggagttatattaagcttcatttgctttttgctaggatgttttatggtaattgagtgtggggtgtggaggaggtgagttatgtgataattacttcgaggtatccataatccatgtcatgtgtttgggactatcctattcgcgtgaccgaaagagtgatatatgtgtgatgcatgtcgctggcgtcatggaaatagtggacacgagcaagcgggctgtgtgtttgtgtgtagtagaggccatgtgttgtttttatgtgcattgttttttgcttattcgtgtgaccaaaaaggtgatatatgtgtaatgtgtgtcgctgacgtcacgaaatggtgtaaatgggcgtgctttatgtatttgggtgtacgagcgatgtgttgttttttttgtcatgtcatctattgtttcgcgtgttatctctgggtcttgattgtgtcctaattaaattttctttttttattgttatgtattttcttcgtaaccataaaaggttaatttgcacgtcataaatagatatatgttatgttgagttttggttatctcgttgccgcatggaccccgcattcctatggtaacctttaatagccgtcatcggaactacgacacggttgatcacatccttgtgctagtcatgacgttactagcctacacgtggacaaaaggatatattaacagggacgacacgactaccgtgtactccatacatctctaattcgatttatatagtttatactacataactacccgcgtgttgttgtgagagtttagtataatagcaataaatacaaataatatgtgagaactagatgacataagtttatataagtcgatgtaatttacaataatttaaaaagtatatagaatggtgttcaaatgtaaaagtaaagtgacgtggctttacgagaaaaaaaaaagagaacggtagtttggactatagattaatcatctaagagctaaaaataattgtgatgatatggttttatgagatgagaaaatgatgaagataatttagaccacagattaattatttaagggctaaaacaattgagatgatatgtcttaataagagaagaaaaaagagagataatttggaccatagattaatcatctaagggctaaaaataattaatatgatatggtttaatgggagaagagagaaatatcattaactaagtgataatgaaaagatatattgacatattgtgtgaattatgtgtgatgatgatttaacatgcttgtattttaaagctctgaaatttaacaaattatagaattataaataatatatcatgcttgtataatgtttaaaatataataattgttaatgaattatgatgtggtattttgagttttagaatttagtggcttataactttattgtaaaatatgatactcaataaaaaaattcgcaatcctgcggtaggtgttgtttttacatatgcgtagaatgagatgtaatttagcgctaaaattagtttaaaaattaataattattaagcacatggtacggcatgactctttactgtagtacatggcccaaccaaccccaagtctcttattcgcttgtgatcaaatcaactatactcacatgtggaaagcacgcttgttttctagcacaacgaactaaggaataattatttccctacgtctcaacggcaaatctaccacgatcgattctcttccaagaaaaattaactagtctaatccactagtttagccataaactttggtcctgttattttctcataaagattaagattttacctcggtttccattactactaaacggtatatttcgtgcgaaaactttctataaaaaaagttattttaaaatatcaaatatatctatttataataattaaaacttaattaataataagttcataactttttctcgttttaactttatctttatcgtcatgagtttcgaacccaaccaaaatatcaccggcctggggaagttgtatactcgtataggccaccttcggcaaccgattttcatttcccttagaggatatttttttccaaactatgccatctgtgtcgatttattaatcaaaaagaaaaaaaatcaccggccaagattactacagctaaaatgccaataggtagcttgcactttctgtatgtcaatcaaaagcatcattctgctgcattgccctgaaagcatcacacacaaacacatatatactcctactgttcttgatactggcaaaaagtcaactaatctcatcatgccaccacaaatccaccatccatacatgcactcgctcactaggccccgttcagatctcacctcaaatttttcaccatatcacatcgaacgtataaacacctacataaaatatttaatataggctaaaaaataactaattacacagattacaagtaatttacgagacgaatcttttaagcctaattgctccataatttgataatgtgatgctaccgtaaacatgtgctaataacagattaattaggcttgataaattcgtcttgctatttactaacggaatatgtaactagttttttttttattaatggccgaacaccccatacagcatcctatataatacctgatgtgacacgctaaaattttacaccgttgcatctaaacccctcactaacccccggccagcatcacctactctactctacctcaacgcaccaaccaaccgccgaaaagaaagaaagaaaagaatccgtcaagaaaaggagcgtgacgtgagaagcaaggaagcaaacggggtatgtaccgttacgatagtttgtgtgtgtgtgtgtgtgagagagagagagagagggggggggagagggagagtgagatgtggcgcacgtgcacggggggcgtgggggcattttatttatttgtttattttgttgatgattgacacgtatagtaccccaagtactcctacgggggcccgtgggcggccgcatcctatgcccgaattttcatcgagccaggcgtgcgggtttgtcctcgttaactaattcattaattaattactccctcagtccccttaaaagggatacttgtactgattgatcattcgtcttatttaaaaaaaattagaattatttttttttatttgtgacttactttattatctaatgtactttaagcttaacttttcgggttttatacttacacaaatttttaaaataagataagtgatcaaacagtgcaaacaaaatgtcaaaatcccttatattaagggatagagggagtagcttattatcttatttggtttcatgggctgatccaaacaggtgggctaattcattagcccatacaagaggtactaatgggctaattttctatagggacttaaaaaaagcagttatctctctcctatctctctaatctctcgccacattttagtcctgaattagcctatggttccaaacatgtcactctaagctaatgtttagcctaccgattcaagactaaacattagctctcaaaattagtcctgggctaatcttccaaatagggccaatttggatgttgtatagaggagcgcatgtgcatgccgttggttagtcgatacgttgttgaggtggtggtagtactttctcctccgtgaagacttagagcctgtttatgagagtttcgggtagtttgcagcttctctcggaattaaaaatttctcaaacagtataactttttttttatactatgagaagttctatttgtaaaatttagaaaaataaactagaaacctgaagctgtttcttcatattctcaaaagctgagtaccaaccagctgcttctcaaaatcttaagctaataaatccttaacagtgtttgagagaaggagaaagaaaaatgttgatataatacgtaaaacgagatgggtcattagcatatcattatttaagtattagttatttaaaacttaaaaatggattaatattattttttaaaacaactttcctataatttattttggaaaagtacaaattacctcccgaactattgcggtcgaccgaattaccccctaaaacccgaaaatcagacaacgttcaccccctcgacccaatctagaacagttttgtcctacgtggcgtacccgtggcagtccagttagaattctatttgtataaaagcaggactcacctgtcatactcctcttccactcttcctctctctctcgtgggtcggcggcaggtgggggacacggagcggcggcggcaggggacacggagcggcggcggcgggggacgaggaggcggcggcggcggctgcggccacgatgagcagctgtcgccttggcgcggggacggacggaggcaggggcgggcggggggcgggcgaggacggaggacacggaggcaacatgctcagtgcgcggagaccctcctgcgccagagggagttcgccgctccctcctctgtgtcccgcgtcaactgccgccgcctcctcgtaccccgcctgccgccgacccgtgagagagagaaggaagagtgagagagagaggaagagtggaagaggagtatgacaggtgggtcccacattttttaaaaaataaaatactgactgaactgccacacgtacaccatgtaggacaaaactgttctggattggatcgaggggggtaatttgcccggtattaaaagttcagggtgaacgatgtctggttttcgggtttaggagggtaattcggtcgaccgtgatagttcgggggtaatttgtactttttctttttttagaaaaaaaggcacaccgtttaacaattcggaaacgtatgcacggagaacagcagaaatctaatatgtttagccccgtttgaacctaaataagatacgtattttactgattttttgttagaatattttttaaactactaaatgctaatcttgcttgcactactagaaaaaaacattttttaggcggccaaaagcaatttttccagacggaggagaggaccggctgcagaccaacgacacgattttcgcagccagggcaatggcccgcctgcgaaaatccaatgaaaaaacaaaaaaaatggcctcgtcgccgccgccctcccctggcctccctccggccggatctgggaggggaggagaggggagccgctgacgtcgccgtccacgcgcgcgcctcgtcgcagccgccctcccccggcctccctctggccggatctgggaggagaggggaggggagctgccaacgtcgtcgtccacgccgccgccgccctcccccggcctccctccggccggatctgggaggggaggggaggggagccgtcgccgctgcaacaggagccgccgacgtcgccgccgcaacgggagccgccgacgtcgccgccgcaacgggagccgccgacgtcgccgtccacgccgccaccgtgtctgcgccaccggtggagggatggaggggaggggaggggagggggagagagctgagaagccggtggagggagagagagagagagttgagaagattagtgttgagggaaatgagtggtggggagggggttggagtagataagtatcaaagtttttttttggtaggtaccatttttgcaggcggaccacataaggttcgcctgcgaaaataggtggtccgtttgcgaaaatgattttcgcaggtgccgcttaagtggtccgtctgcgaaaatctattttcgcaggtggatagcgaacttcaccccgatttatatttttataggcgattatttggttccaagggtcatgttcgcctgtgaaaaaaaagacccccatatcaggaaaaatgttttttctaagtgtgttggcttcgatttgatctaaagaggcatgcattggagtgttatttaggccggtgagtgatatttgtttcttttgttacggtcattgatctccggggtttcttcggacttcttttttgttcgatttagaaaaatcgaatgaatgctataacaaattatatattgggatagaactatagattgtgggaggactgtttcgagggggagagggctacatagatggaacggtcgcgtggccaacagtgaacagttaatgagacaacgggttagtggtagcaccatctaagggcaagtacaaaggtagagaccggtatggtctctacgttaattagaggctattacgttacaataattaagacaatactgtctctaacattaatgcactaaaatactttcttactagtgatctttcctttattagactcaatgcaacgaaaaatttcctaataaatactaagagtcgactctatgctgttgtcatgcgtagcaaccatctttctttttccttctccctctctcttccacgtcaccaaatatgcttgcatgataataaagagagaccgctaataaagaccattgtacatgccctaagcctgcatggaagagtatagagagtaagtttgtcttctttcgaacatttccctagctaacttctatcttccgtttttacacgtacgtttcctaaattatatttgatccatttccaaagttttttaagctaatatttaattaattatacgctaatttattgttccgttttacgtgctgaagtgagggttccaaatccgtagtagcgaatgcagcttaattaaatgggggtgtgcgattggagtgagcccttttgaattggaggaaaaatataggaattttggaggattttaatcatataggaaaattttctatgaagccctttgaaacaaaggattaagtcatatctaattctttgaaattcttatggaatggacaatcctatagaggttttagaggaaatttagcaagagcttcaacctcttggtaactttcctttgagtctatctctctcatccaattcctgtgtttttcctgcggttcaatcaaacagtcatttctgtgtttttcctgcgttttgcaattctttgttttacacttacattcctatcaaaatcctatgtttttttcaatcccgcgattcaaaggggccctaagtaagaagtggaagaattacctctccctccattttatattataagattctctttaatttatctatcataagtttaatttatccacgtttgtccaagtttttatgaaaatgtagcagcatttcaacataaaatgaatatattaaaaaatatatttagtgaaatcaattcggtgttctacgtattgcaatttttttatataaagttagttaaattcaaacaagcttgactttaaactgaaaattttttcaatgtctaagtatctggacaacataatttttttctcataatatacaggcaaaccttctagaagcgtggtagtcttcacaagttcacattggggaaaaaacgaaatatggatatatatatggtatcttttgaaatattaaactaacaaccgttattatctcgcagagtacggctaaatatggagtaccgggcgtgatggaaaacggaaaaaacatactgtattttgtcttaaagacacgacaggagtataggaccatagtttcactgaatgcttatcggttttgtaatattgatgtcaatttttgatgtgacatttatctattcatcttattaaaaatataaaatattatttacttattgttaacttattttatcatcaaagaaactataaccttaacctatatttttcatatttatactgaagttttaataagacgagtaagacgaatatttaaacaattatatgaaaaattaacggtgtcgtatataagaaaaactgcggtagtatcatttataaatgtaaatccatttctttttcccttgattgcacgctagatccggttcagacagaattgattgggcaggtggcgagaggccgtactacgccacattgtcctccccctggaaaaaaaaggcaaaaggacaagaggaccaacagaaaagggtgagagagagagagcagggcactgcacggtgcacagccacagcctgcactgcagtagtgcagtttgcagcaaaggcagcaaagggcatgtttagatccatttgaaatggcaaatggtaaatggtaaaagttttattattgtaaaagtattagttggtgtttagatgtattttaaatttttgccattctagcactaaagtgagagagagaaagagatagggagtggtcccaaagcatttttttggcacaatttgctactatggactagcaaatgccaaatgtcaaattgccaagttttaatactagtgtttagatccaaaatgacaaaatgtacttcaaaatggcaaaatttttgctattttggaggatctaaacagggctaaaggctagggtagtaccaggtactggagcactgtagtgtacttcctgtagtagcccaaaggcaaaatttgctacaggacacgcaaaaaacgtgtaattagctgggagacaccgcgaaaacgtgacacggctgatggacactacaaaatttgtgtaattggctataggacactggtcgcattattttattatttccgagtcaaaacaagtgatatatttttctgaatgtctagattgccctttctctttccttccttttctcctacgccgggaacctgcgtgatgggacgaggtcggcgaggtcaccgggaacccgcgcgatgggacgaggtcggcgcaggcgcgagcttgatggcggcagcggggcggcagacggagaggcccgcctcggcgatgcgcagcgcaacggcgaggccggcggggccgctgacgacgacggcgaggtcgacgggcctagagcaggcacccggggggaggggtcgccgaccgctgccgcgcgggtggggggaggcgtcggcgagctcggcgcgagtgggcgggcatgagctcggcggcagcggggcggcagggcgagaaggcgctcggtgttctcggcgaaggcgctgagtgtccgcggcgaagacgacgactacggcgagggcgagagcagcggcgcatcgccgccaactccctctccggtagcagctcacggcgcccacctccatctcgccggacaagaggaagaccggccagctagcagctagcagcagccaagcatgcgccggcgagctcgctccaccagcaagaagatggctagctagctccttcaattcagacttgagagcttgagcaggcagcaatggcgagctccttcagacttcaggcttgagagcttgagcaggcagccaggaggcagctgcagccggtcaggggctcgatctggtctctgatttgcaagtcggagcatgcacaggcgtcctcttgtgccgacctcgccaacctcaccccactgcgcgcgatcccggcgaaggagaaaaccaaggaaagagaaggggcaatctgggcatttagaaaaatatctcacctcttttgatccgaaaataataaaataatacgacaagtgtcctatagctaattacacaatttttgtagtgtccgttagccgtatcacgttttcgcggtgtcttccagctaattacacgttttttgcgtgtcctgtagcaaattttgcctagcccaaatgccacagttttgggcctaattggaatataatcaagctgagctgccatgggccacggccactgcacgctgaacagctcagcgctttaacgtgccaggccatctgtttacagggttgttttcttaattaagtgccacatttttttctaaacaaaggcaagagatacacatgacccaagaaaaagttctcactttaaacaccataatattacaaacactaaaaacacctcaaaatcattccccaaagctacattaaacacctaaaagaaaaccaaaaaatgccacattttacccaaacatagtcaattggtttttagtcacagactacgctcatcacatttgaccctgtttagatgggactaaaacttttaagtccctatcacatcggatgtttagacactaattataaatattaaacgtagactattaataaaaactcatacataatcttagactaattcgcgagataaatctattgagcctaattaatccatgattagcctatgtgatgctacagtaaacattctctaattatggattaattaggcttaaaaaatttgtcttgcaaattagctttcatttatgtaattagttttgtaagtagtctatatttaatactttaaattagtgtctaaatatagagactaaaattaagtccctgtatccaaacaccaccttatattttttcttcttacctagccacagactccactcgccatatttaatttttccccttaccttgcctaaggtgtgaacaatagatcttggccacaccttagcaaagggttgactaggtggtgttgcattttttttaaaacaacagatgctcatataaatgtgcacgcaatcactctatccctttgagcacctttgaagattgtataagtatatcttgagattcacgaagtcacctatccctataaaaacccgggtggatagattgcaccacgaagaaactaaccaattaagttatactcacttcacgccaatatgtgttatatctttctcttgagcaaatactgttacctttttttgtttgataattcatgtgtttccatggccaaatttagggctccttggaacgcatgaatcttataagattttgacaggaaatattttagctcctcctaagtttttccaaaaaatcatatgcttcaagggaagcctcattgatcctcagtagagtcttaaaaatcaacacaacgctatatatcggggtatttaactttttgccactttgaaatgtggcaattaaagatttaccactcgcaatctatgacatgtgtgcctagtggcaaatccttaattatcacttgtaagagcggcaaatagttaattattccctatatatataaagtttgtttggtttagtagcccaccaaaataactctagagtattataaatgaatttgttcgaattgatattaattggaagccaaaatttatataatagcaaagaaagttctagaattgtttcaaactgagcatgtgcattacccatcatttggcatcaaaccaaaccatcgtatttactgctcaaactaccaaaacaattggtatgacacgttttagcattgatccaaaatgacccattgttgcctagcagtttcatccataacctccataactaactggctgccaatcaaatttgatcaaaatttatcaaacaattgaatttacttcatccatcccataaccacacaagggattaaaccttttctttttccaaaattaaggaagtagcaaagtcgtgatacaaaagtgatagttataggaatataactacaaaagttagtagatagggaataaatagtagaaaagttagaaattgaggaataaaatatcttatattttaggataaaatagaagagtaaaatattttatctcgtagaacagagagagtatgagcttaattaattttatcaagtggtttccaggtggtcgatttataaggccgataatgttcctcgctgactatactcttcatatagccccaagctagttgcatgaatcatataatactataaagttgatatttattgactcttaaaagtttaacatgcaagtgtaccacataaacccactagcaattattatctacaatattttaaatatcatgtaaacataatatatcatttacaattttattgtatttctagaactcaatatgcaagtaatatcaaatcattatatctacatcattttcacattatttaaacatatacatatctcgcaacaaagtatactaattcgaatactttgactactaatacatactgatggcatccgtggattacaccgttggtttgtcaaggaaaatacttctaatcttctatacaacattttcactcttttactattaatcttgaagtccataaatgttgcttcgagagaaaaaaataaccctgatgtccaaattaaaacaaatcagctcaccttatatctccagactcgatcacaaaactctgatggacgacgcgacaaagagagcttgggaagcaaaggcatcgagtagtacacatggctgatcagttggcatgcttcttgtcaagccgcgagatatggagggcttggttgacctagtttttagattctaacacgcggctgtttctgaaaatatggaaaaactctgaaacccagcttctccagtttctggcttcttaatttattcttcagaatatgtaactacagattctcaaaagctatagactgtttgggacagcttctaacagaagcagcttttgagaaaagctgcagctgggacaagctcccccggaatggtcttttgtagcgagagtgatgtggagtgaagcatacagggcaaaacatccgtgaaacggacgaactagtgtactgggtacaggagagataaggttaggttaaggttgaagtttatatgcaatgcatcaattaacgtctcgttcttttctaatctaattaagacaaattttatctcagttttcgtttacatacttttttaaactgctaaatggtttataaaaaatacagaataacaacatccgctcctcaaatcttaaatagacaccaccacagatgcttggactaaatccccccatcatgtgagaaagggcctatagcctagtggttataagagtctcagtaacaccataggtcttgggttcaactccacatgggagcaaatttttcaggatttaacggctttgtgctttcaatggtaggcgatgtacccgtcgacagcgaggcgcctatgatgacttcgttaatctccaggatggatttgccgacccagtattcaaagatgctcataggggtagcgtttgcgtgcgtgcgttcataggggtgagtgcgcgtatgttgtgagtgtctgcgttgtattgtataattctcaaaaaaaaaatccccccatcatgtagttcaccgctattttactccaaccttatcaagtgtcggcctacggtgacttcatcaatctccaggatgatttgctggcccagtcttcgaagatgctcataggggtagggtttacgtgcgtacgttcataggggtgagtgcgcgtatgttgtgagtgtctacgttgtactgtgtaattctccaaaaaaaaaaatccccccatcatgtagttcaccgctaatttactcctaccttatcaagtgtcgtaccagtacgaggtagtactactatctctctgcagctgctcctcctcaagaggcgcgcgtggcaattgcaacagcggcgacaacagtcatgcatggaggaggtggtagacatagacgagcacgacgaggaggcgatcgtcgtgggcgccagcgtggcgcagctgcctggaccgtgacggttgtgtcggctcgctgtggtggcgccgcgcctacgaccgcctccgtgtccacctccccaagcagtaccgcacgggtgatggtgtccgctcccgcctccgccgcaaggtccgggaggtgcggttcgacgccgtcgaccttgccaccagtaagtaacttagagcggtatgtggcgaggtaccgccgccgccagtgagaacgatgagcaggtggtccccatgaccgggatcgatggagacgttctcggggaagacgatgcacaccgccgactacatattttggttgtgtgtatatatatatatatatatatatatatatatatatatatatatatatatatatatatagaatgtatgtaacgttcttgtggtgttcggcttggatgtaatatggggtgttcagtgttcttgtgatgttcggattaagatctgagctgagtgggcttgatctgagcgtagtggggctaaacgtgatatggacctaaactaatataggaagagaattggaaattgtggagcgatctgggaggaattggaaaaaaaaaatcgtgcgcactacacggggagggaatcagacttttttttgcgtttttttcttccctttttaccatacaatcatgcttctttttttcgctctttttttaaaaaaatttagattgacgacataaacctcggaaacctttttaattttttaagtagtagagatagagatagagatagagatagtgatgcacatattaaaaaaaagaaaaataaaccaaaaataaactagaaatgaaaaaagaccatatgcaaggaggcaacagattgagatcctctgcaatcaaatgcatggtgactttgggaccacatgttaataataaagtcacttgacttcttcaagtgtagaggattatgatccgaggcgccgccccctcccttccggagatgaccggggagacacccccggagtgagggggaacgattagctttttcgcatgaagggtgattgactgctcgtccatcatccatgcaagggataagagcaggtacaatagcaggctattagccagctataaatatattttaataagataaaagatgaaagagaagagcagcgggctacagatctgtagccagttgcagcacggactctaaaacgcagtgtgtatatgacatgtgggaccatatattaatagtatagtaagcaactattgtataaattggctattagataaattggagtttgtaatgggctaagtttaagacgccgcggccgcgcgcaaattaaaaggggttaatttcgcggaggtcggtaggattattcgcgagtttgttggggatcgagatagatttcgatgaatgattggttcgatctgagactcccgccatcaatcaaaacccttataaaatccccccttctgttcatcctcctcctcatgttggtggtttgcattggcgacggtggagagagcagaagccactccatatgccaccctcttccgcagccgcagccgcagctgcttctgctcgtcgtctgctagctccgccgccgccgccgccgccgttgattttgccggctgctagcgagctagctgctcactctcgtcgagagcaaatggatatcgttggctatcgtcgtgcctcggtgaatcgagacgtgatgatcatcagtggtatgaagtactccctccatttcaaaatgtttggctgatcattcgtcttattaaaaaaatttaagtaattatttattcttttcataaaatttgatttattgttaaatatattttcatgtgcacgtatagttttacatatttcacaaattttttttgaaagacaaacggttaaagatgtgctaaaaaattaacggtgtcgaatattttgaaacggaggtagtatgatatcgttctaagggacacagcgacttgttgttgttgttcgtgcttcatcgactcatcgtcacggatcttattgattaacggctccgttggcacggtcgtgacttgtaagaaaaaaaaatttcgattccctttctttacatcagattcgtacgataaattttaagattttataagagtttatttatatctattccatattaaaaggtggtcaaagtggaaagtaaataaaaattgcactttacgcatgataaagtgtacattgtttcactttgcactaagtttaacacatatttttactttacaccagggttcactgatttaggtttcacttaactacatcatcaaatatataggattttcatgacatttcataaattttttgaatgaatcctcatcaaacatagtctaaattaaaaagtttatttaataatttttaatcatattttacaagatttatgatacaacacctagtgtaaagtgcaaagtgagagttatttcaatatactctggtgtaaagtgagtatatattaaacctggtgcaaagtgaaataagatacactttagttggtgtaatgtgtaatttactctttattatattgtcttccaaagtgtgtaatttggataattttaccatatcaaattactttatatcttttcatatacgggagtgttaaattcgtttaatttgggaatttatcttacttgagacatattttttcgcccaacataaacctcgttaaagacagtacaatctcgtatgaccgagacaaaaacttcgatacttcaaaccgggcggccaatatattccaattttaccttggcagtagaatagagcttaactaatttcaaaatggtttaccagtgtttgtctagtaaaggaaacattccggcacaatctatactcattaaaagagaaggtattagtgaatttgtcaccccacctcttgttaatcttaaaacttagttgaactttttatcattagaaaacaagctaattacatagctacgtataaaacaagcaaattcatgttgtgcaagaggattgataacacattgcacaacatgaattttaatttattttagacagtattataatatattttctattatctctgtaacaaaattacaactatccgttcatattgtattaggcgatattagtctccagttaaatactacctccgtcccctaatacaagggacattcactattttcttataacgtttgaccacccatcttattcaaaaatttgtgcaaatataaaaaacgaaaagttgtgcttaaagtactttagataataaagtaagtcacaaataaaataaataataattttaaatttttttaataagatgaatggtcaaacagagtaagtaaaatgttaaaatctcttatattagaggacggagagagtagttagttatattagaaaaaaagtaggtcatgaactcatgatggtttgttactttgtttggtcaatcgtatattgagatggattgctcagtctcagattatcccttaatctccatcatgttactttgttatcaccttgacgtgtcagcgtcattgtagtcgtctatcggacaaatcaccctctcttttttcttcatctctgattagaaaaacaaatcatacactttgaccaaataagcttttgagaccatgcgtgatgtgaaatcgttctagaaaatggtaattacggcactgatgggaacgaccgcacatttattgtcttgcacacgagaaactcttaaattccggtttgcccctggaaagtaagttcagtgatatctgcatccttaaaatagacgaaagggtacacatccaaatgaattcagatagaccaatgatggtgaaaggggtctttagtttatatgggataaaatgacgaaattgtaaagtgagatgattctcaaattttatgaaatatacatatatttttcgatatattaacgtttatccgctcatacatagatgttggcgtgtttttgtctcgatgtattatcgtacatcttagatcggagaaacactttcctttctaccagtttgtagaagacaaacaacctatcgctagcatgcgagatttctctagcttcaccaatactttatcaattgattcaaaatgtggacgcttcattgctttttaagtgattaagccatgtggctttatttctgcctcaccctacttttttgtcatgtccataaaccacataggcacaggcccaaccaaaacaggttgttagctagtcaagtttgtaagatcaagagtggcctccaagaggttcagtcaaaattagaaatagccagtttatccagggatgtgaatgcaattctcacctgaattaaattagacccctaatttaattctcaattaaccaggtactgtcctaataattttctcccaacatccccatcgatcctgactttgtctgatccccactgttttttcttttccttttggccactctttgatttcttttttcaattctattgcgggtggagactttttggtttggccgcaatccaccaccccattcctatccatcctccttcagcttcttctttcttctcctcctcctccttgactgtcctaacaaaaaaatcgattttttgttctcctcttgatggttgctgcgaccttcgatgtccctatgcggaatgaaatctcctgctggggcggctaaaaatcggagattttctgtctttttgatccgtctttagtggagctttttgagcctgatttatgcgatgggcttcttggcgtgcttgttcccatgtcctcaagaggtgagagatgaggatgaggaaccaagaagcggccagagagtcagctcaggtggatttaattattctttttgttggaattcgttcttatgttcttgcaatcttgcttaaaaattggagtagaaatgtttggtgctgattggttagtgtcacttgtagcagttcttgtggagctaaatatgctctcaggtataagaggggcttttctttcatgcagtggaaggaaaaaagaatcgagttatttgtgatctattgatcttaatgattgtgctgttgggttcgggatgattcaggctggggttgtacattaatttaattttttatttagatactagacttattgtagtcaaccatcaggatttttcaattgtttgctcatttccccttttggtttgtggtgggagcaattatttgtgcaattcatctgaagtcacacgagaggatccaaaattagaagtttgtttgtaagtttggactttggagtgcgtaatttcaccgggagaagaggatagaaagaacatgaattagtttaagcggaattaaaattatgaagaagacgaacactgtggtagaaaaggaaacagtctgggtggactcgaagaaaatcgctaattttctactattcttgttttcgatttccaactctgtttctctttcaggatgtatcgagtctatcttcattaacagtggacgtgttcttttcttcccttgaaatttctcaataacagtggaatattcaaagtcgtcagagagttgcccactgaagactgaagggtcgatagatatggttggaattcggcgaaataaggggcatggtgaagcaacgatcttcactttgcgcgagcttgctgatgctaccaacaacttcagcacggagtgccttttgggccgaggaggattcggcagtgtgtataaagcatttctcaatgatagacaggtttgtattttctactcaagcacccaactccttatgcacttcgagtcccaagctatgccgcgagcatgaaacaagctttttcaacaacactgctttgaatactttgtgatattgataaaagaaactgttcctttggtcaaaattgatgggaatgcttagactattgatgttaacagaaagtattgttatgctatataccctttgtataaatttctaatttggttccagcatttgctgcatcgcaggttgttgcagttaaacagcttgatctaaatgggcttcagggaaacagagaattccttgtggaggttctcatgctcagtctcttgcatcatcctaatttagtcaagttgtttggttactgtgtggatggagatcagcgcctgcttatttatgaatatatgccattgggatcactagaagaccgccttcacggttagtattttattggaaattgtataatatcctctgttagctcctagaaaaacctgaaagttccctaagaatctgtagttgtgttagaaaacattttatatttttcattgttacatcatcgtgatttaaagcacatctaaccacttgaacatggtgaaaagaactgtcttctaggtgagaagaaataaaaaaaaataaagagctgataatttggcacctctttcagcattttaaagatcagtagctgatagtacataataacttcaatatagaaagagttcacaacttctgtacttttggatttccctgaattcgaagtgtgttttctgcattctatcttggcaaagaaaacaattggttttcttcaatgttccatccatcatattttctaaatttgaatttctattataatctgttgtatctgaagatggcttgaagtaattcctttaaatgataaacatcgcaaccttttaccttcaaatggctattactatgccttgctaaaacatcatttgacctttttattatgtatgatgaaggtgctattgtttttggcattgaaaattattatccagtattttggtagacctgtctaggatccagattagttttgtttccattgtcttatgcatctgatcaaaagctaaagctagcatggaatgttcaactttaggcagatctgtctagaattcagtgaggattcgagggcataacttttcataaccatccataaccacttttttttttttggtttgacgagaggaccctgcagtgtatattcaataataaagagatagattcagcatgtcgctgtttatcacccttcatgtccgtttctaccattagaccacatggttcaaaaagaattaaattgttctttacattccagtaagctacttaatttccttaagtattattactggataccctgttaaaaatttgctgccgatgctttttacagatctcagacccggccaagaaccactagattggacaacacggatgaagattgctgctgatgcagctgctggtttggagtatctgcatgatgaggccattccagcagttatttaccgggatattaaaccgtcaaacattcttcttggcgaagggtataatgcaaagttgtctgactttggacttgctaaacttggtcctgttggtgataagactcatgtgacaactcgtgtcatggggacacatggttattgtgctcctgagtacctctcgactggaaagcttacgatcaaatctgacatttatagttttggtgtggtctttcttgagctaattactggacgaagagcgcttgacagcaatcggccacctgatgaacaagacttggttgcatgggtatgtttctatcaataccagaatgttacgaaaggtcacaatgatcatattttcacaaagaaaaacaaaatgaggataaaagatgtattgtttaaagggcaacattgaaacaataatggcgtactggaattatagaaaatgctacaatacattttcttctgtgattaatttttatactacagctatcattaacaacattgtgctgtgtggataaggatcaaaaatggtatttggtcgaagttagtaacatttaattaacggtgcaagggtgggggtactggtgctatgtacaccttttcaaatatatagtgtgagctatgttctgagaacaaagtaaattatattattaattaacctccctgtatgcatcctaatgcctatggaacaggaagtaaatgtctcaatcttgtgtgtccaggagtttcctcgttctaggaaatgaatcttatctgtttcttaacataccccctcagtaccagttaaatgaccgttcatctaacttattgggtgtcctactaaattggatctgtccctttttcatcatttgatcccttgaatactattatgtttttaatgttaaatgttctatttgtctgcaggctcgtccattgttcaaagaccaaaggaaatttccaaagatggcggacccctcattacacggccacttcccgaaaaggggtctgttccaggctttggctattgcagcaatgtgtctgcaggagaaagcgaagaaccgcccttccattagggaggttgctgttgctctctcttatttagcatcacaaacacatgaaagtcagaacactgctgctcgccataccctgcctggcccttctgtaccaagagtgctggataatcagattaaccaagacacttccttgcccagtcaacatggagttcatatgccaccgcttgccgggacggatcacatggtacaagaagtcaaggagaattgccggagcagttcgcatcgaccgggaaggggcagagttaccccgaacggcgctgatagagagcgtgcgcttgcagaggcaaatgtatgggtcgaggcttggagacgtcaagagaagacgagcaaaatgcggtaatcaacgaaaagcttctcgctgctagcttcatttgatcataggaacagaattgacaaggtatgccacagattgcatacgttttgaagaaaccgcggaccgaataataactgttagaagacgatagcgaataataatgatcagtgagttcttctgtggacctacaccagagtgagcgcttgggagatttcaccggtgaagtctactaaatttacatccagacttgtttcactacatacatggattcttatttctcatcatatagataatttagcttctataggttaaagtcgcaggaggggatatgtacatgtaaataaccccctcataacagaagtggcagatgcagagcatacatatatttcttttctgtagttggatgtctcttgtgaatccatgtacatgagctggtaccataagtgctacagcttatacatttttcagatgattcttggtgttaactctcccttgcaattctctgttctcatcatgcagcacaggtaaatgtgtgatagatttgtgaaaaaaaaacaaagagatgaggagagatgctgaatggtgatgctttgcataacaggcatgcagtgtggaaggagatctgttcctctgcagtgtttgtttcagagctgttgctattcatccttgtcatgcaaaaactttctataaacaaattcctttacaaactgttttaaatcaattttttcaactttataatagtcaatgaatttgtttgtagcctccaataattatcacaaaaccatttagctattaaagtaaaggaaaaaaaaaggtaggtgtaaccagcagaggctgtgaattagtcagggaatcgctgtaaaaacactggtttttcgcatgtggattgacgacggagcagtggacgattcttaatttgcttaatctgtcattacattatactcccgccgtttctaaatactacctctatattttaatgacgccgttgactttttgtccaacgtttgaccgttcgtcttatttaaaaaatttatgtaattatcatttattttattgtgacttgattcgttattaaatattctttaagcacgacataaatattttcatatttgcacaaaaattttaaataaaacgaatggtcaaacgttggttgaaaagtcaatggcatcatacattaaaatacggagggagtatttgacgccgttgacttttttaaatatgtttaaccgtttgtcttattcaaaaaatttaagtaattattaattattttcctatcatttgatttattgttaaatatacttatatgcatacatatagttttacatattttataaaaaaatttaaataagatgagcagtcaaacatgtgttaaaaagttaatggtatcaaatatttagaaatggaggtagtgttaaactacacgaattaatcaaattttgcaaaatttatgtggcatggttcaaattttcccattaattaatttaatcaattgctcgctcgtgaaaacgatgtggaaatctgtggtcggacttagctatgaaacttctccttttcttttgaacgaaaacttgctataaattcatcaaatgacaaaacctttttcaccaaacgatcattgtagagctagcagctctatggaacacatcaaaatgcattataccgttatgcaccaagagaaaaccgctcttaaaaaataacacatgaaccgtgtattacttctaggagatcacacaaacaactgttattcaataatactccatccatcccaaattataaaagatttcggataaatgtgacatattctaatactacggatatagatataaaatttatccagattcacagtagatgtgtcacattcatttaaaattgtttatattttggtacagaaggagaagtggtttatgttggtgttgatggaaaaaatcaaattttatcgttaacagttgggtcacataaaccactattattcaaagaaatcaatacaaagtaactaacccataagcctgtaagatgcaatgaatctcaaataaatatccgttgttactatatacaatatatattgatacaaattacacaacaattctacagagagaccaccgttgccacttgccaccaacaactcaacttttttttttaccaaaaaaaaaaagttatgaactgcaaactcctccaagacatgccctgatcaaacagaaaatccttcacatatatttctacacaagaacacgttaattaattactcccgaaaacatgaagaagaagaaatcacgagctagcttcatcgcacggacaaaagaaaaagaaaaaaaaaggagaaaaaaaaaacacaaattaaaagcttagaaatcaagctcgacctgcacctgcagtgttgttcatggtttcactcgccggccggtcagtcagtacacgcagaagccgcggcggcgcggcggcggcgcgccgccgccggcgagcagcatgaacatgatgacgacgatggcgacgaggaggatgccattgaagaggttctcgtcgatgacgagaaggcacaccttccccatgaagcccaagctgataatttgctaatgatctcctccgatttgattaattacttcgatggcgaagaagcagatcgaatgctaataatgatctctctctacactaatcatcttactctatttatatcgacttatcgaggtgtgtgtgagagaatggatgctttctgtctctctttctgggtcaacttccagaaccaagtccagttagttttaactaaattggtaatctcgattagcaataaaattatgtgattagcaaaagtaaaacacgttttttgcagttaggtgatgcgtggttagtgtatttttaatattttatggtgtgtgatcacatagtggttgtggtctaaccgtgtgacgaaatggtacggcgttttggttggtttttgctcgagtttggtggtatttcaattccgggctgaattgtgggaactgttcattgacatatcaagcctagatagtgggaagatttcattggagattatatgtagttggtagtttatacttttgaaagagttttttttttttttagtgtgtgtatggacaaaatcactcttgatagaggccagttcaccgaacataacaagtacaagtatatagtcatcaagaaaaaaaagttgattggtgtttgattcgatacaaatctaaacatacttccagctgttttttttaaaaaaaaaattttggagaggaaatctttccagctgtttattaaatttagagaaatggagaaaataaatttcttgtggatctttccacttgtaacctgtcagtctcatggaccacacgtctcttttatttatttacacctgtctaaataactgttcttttgtattcatggatcatatgaaatcaccaagaaaaatcactcccctagcaatttgacaaggacgtagctaattaattatcatgtattattatggagaaaaaggttggtgtggtacgattattattatcacaaatttcatagcacataggcaagttgcaacaacggcttgaagaaattaaatccggtggcatgtgcgtatacaatcctcattatgtcacaccgttgacatcataaaaaatgtaaaaaagaaaaatcctctaaaaaaagatgacatgagatcgagttgtaatattacaaaaatatatggtgcaaagcacgcttgaacaaacatataccctgcgtttgatcttgatcgatccctaccatagctaattaatcgtgattaacaaactaatttaatggacacgcgtgatccaacacaagcttgctgatataatacaataagaatctgtggttaatggacgattagtcaagtgatcagtccaaattaaggctcaacgtttgtataccaaatacacggcctggacttcactggcttaatttatgagtcaaattgtggacgaaatttcactaggcacggttactgaactaccgtggacaaagaagctctccctagattttattcatctttctcaatggccatttgtcactccggttcaaactaaatcaactaaaaatacaaatattttctactacaagtcgctctcagttgattctattcaactcttgtaaccacaggggcaggtcattctcaaggaccagttttgtgaagaaaaaaaatcagtcgaattgtggaaacaaacaaatgtgtggaagatgcagtgcaaatgagggagaaaagacctgcctatgtcaaaaagttatattctgggacggagacgagatcaactcaactgtgcactcgtcatctttgatcttgagatacacatatataataaagacctggaagatgcattatatggtcagatttcagagtcgccgtcttctgctgctccacacaccacacaccacacgtatgcagaacggcaaaaagaggtggacagggttcaaacatgaatgccaagttcttgtctgatctttgttgtcttaactttgttattagtactaacttttacacaaacgtgataagggagatgaggggaaaaatgcattagctatgttcttagaacattattattgtcgtgttatagaaagaggaatcatgtacgtcacggtcacatagcatattgttcaattccaggtaaataatcatctgaaaaaaaatggtatgatcaaaactcagaagagaaaaggttggccagtgatgattatataatcaccgtagattttcctaaccgagaacactggaattatctagtaaaagggaccattagacagcggcagctaggttgatagcaccatgctccaatatagtcctgttggttcacagattcacagagctttacaggcattcataacaataaatttccaccccgttgcttggtaaagtaaaagggagtgtacaaatatacatgattttaagggctatgaaactctacagcattacatggtgagaaactgaaaaccgatgaaacgccaaccaaaattggcacaggggaaatacaggaagggttttggccacaagctgcctctccagatttggccagaaatggtatactgaaagaacagcagctccacgttgcatatagataaatgatcacacagccaatcggatggttcatcagtcatcacttcggatggtgagaacccatgatcatagcttggtgcaagaaacggtgaagaaatacaaggctgaggccctctcttatgatccctatgaacatcacttgcacaatgccaaccaagccagcacctgaccaaacttcggctcaaccacagcgaggtaaacgctgcagttcagcgcccaaatatgaggcggcgtcagcaaggcagccatcatgtgaacccttgaatgccgacacgagtgcttctactcgcatcaaggctgacaaagatatcgacacgatcattccttgcgctagatattgcctgcaggagaaggccaggcaatacagcaggcgagtcagccttaggcaggtgccatgcttcagcaggtccagaacaacgctcagtttaggaagattggtcagcaagcccaccgtagcctcccgaggtgctgctttgagtaacagcaccaagcagtctgatgccaaatcgcttatatgtggatctgaacttccaactaggtcgaggaaaatgcccatgttgccaccaaagtcgcatatatccatgacgcatgattgttgatcgacagca

SEQ ID NO: 69832 - DNA, 14145 bp, Oryza sativa
  unsure (1)..(14145): unsure at all n locations
tacttattcttgagaagaaaagaaaccttgccttagaggagagcctagctaaagaatgtgctaaaaatgaacaactagctaatgagcttaatttggctaatggttctctagctagccttagggatgtcaatgaaactcttaaagagaaatttgctagtttagacaaaagtcataaagatcttgaagttcaatttgacactctttggaatagcacttctcaaccaaatgtggtttctaattcttctaatccatctactagcaatggttgtgctaggtgttacaatattgatttgaactcttatgctactaatgttgatgctatgcaagctcttaagaaagagaatgaaaggttgggcacattggagaaatatggatgcatgaagacataccattcaaaagaccatcaccgctcatcctaacaaggatggacacgggctcggattttctggtggaagtcctgtgtctaagcgtgtgatggtaaatgggaaagaatgcttgatgtttgtaagagaaggaaaagctccacaagcaagtgaagtgacttgtcccctcactggtcagacacccggaagttccgggcaaaatgaccggaagttcctgccctgtaagacaggaagttccggacattttgtcaagaagttccgggcttctgataggccgaagtggctggccagaagttccgttataatgccagaaagttccggccagagggtctttactatgattcatatgtaatttccaaaaattcagagggcaaagtggttgcttattttaatgggaattacaatgatgagtaccgcacttgtgtgtgggtgccaaaggctttggtgactaatatcaagggacccaaacttagacaagtttgggttcctaaatcccaagcttgatttcttttgtaggcatactcctctggtggctcaagttgggttgtggacagtggctacaccaatcatatgatgggagagaggagtatgtttacaagtcttgatgaggagggtggaagtcgtgaaaatattgtctttggagatgatggtaaaggaaaggtaatgggtctcggtaagattgccatttccaagaatcaatctctatctaatgtcctccttgtcaattcattaagctacaatttattatccgtgtctcaattgtgtaagttaggatttaattgcttgtttaccgatgtggatgtgactgtttttaggtgagatgactcttccatagcattcaagggtgtgttaaagggtgatctctatctcgttgatttcgacgtagatagagtgaatccggaggcatgcttgattgctaaatcctctatgggttggctatggcaccgtaggctagcccatgttggaatgaggaatttggcatctcttctaaatggggaacacattcttggtctatttaatgtttcttttgagaaagatcgtgtgtgtagtgcttgccaagtcgggaagcaagttgggagtccacatcctataaaaaacatcatgactacaacaagaccactcgagcttcttcatataggtttatttgggcccgtggcctacataagcattggaggtaacaagtatggtttcgtcattgttgatgatttttcacgcttcacttgggtatactttctccatgacaaaagcaaagctcaagatgttttcaagcgcttcacaaagcaagcccaaaacctctatgatctcactatcaagagggtgcgaagcgacaatggaggagaattcaagcacactcaagtggaggaatttcttgatgaagaaggaatcaagcacgagttctccgccccctatgatcctccccaaaacggcattgttgagaggaagaaccgaaccctcattgacgccgcaagggcaatgcttgatgagtacaagacttcggatgtctttcgggagaaagccgtgagtaccgcatgtcatgccatcaaccgcttgtacctccacaagatcctaaagaaaacctcatatgagctcttgagtggtaagaagcctaatgtttcatattttcgtgtctttgggagcaaatgttttattttaagtaagaggcctcgctcattaatttctcacttaaggtggatgagggattcttacttggctatgaatcaaatgcacatgcctatcgtgtcttcaacaaaacctccggtattgttgaactcactagggatgtgacatttgatgaatctaatggctcccaaggagagcaagttgttgtacatgttgtaggggatgtggatccaaatcaagctataggtactaaggctattggagacatacgaccagtcgagacgcaggatgaccaagaagatagggtcctattgaccggaacctccggacatctctagacccggaagttccgggttctatagtccggaacctccggatcagtggcagtgaagatgtgccaacggcacaagtggatgggatcgatgttgagggcactttagagcattctgatcaggctcaggtcccccagtgcaccatccaaggatacatcacactgtcgaaagagatcatcccgtcgacaacatacttggtgacataagaaaaggggtaactactcattctcgtgtcgcaagtttttgtcaacacttctcgtttgtctcttctttggaaccaaccagggtggaagatgcgcttggtgatccggattgggtgatggctatgcaagaggagttgaataacttcacccgcaatcaagtatggactttggtggagagacccaagcaaaatgtcatcggcaccaagtggatcttttgcaacaagcaagatgaacatagggtggttgtaaggaacaaagcccggttagttgcgcaagggttcacccaagtcgagggtctcgattttggtgaaacctttgcacctgtcgctcgcattgagtcaattagaattcttttagcctatgctgctcaccatgatttcaggttattccacatggatgtcaagagtgcctttctcaatggaccaatctcggagttagtctatgtggagcaaccaccggggttcgaggatccaaagttgccaaaccatgtgtacaagctccacaaggcgctctacgggctcaaacaagcccctagagattggtatgaatgtctccgagattttcttttgaaaaatggttttgaaattggaaaggcggatactactctcttcactaaaaaatttatgagtgatttattcatatgccaaatttatgtcgatgacataatatttggttctactaatgcctctttttgtgaagaatttagtagtatcatgactaaaaggttcgagatgtctatgatgggcgagttgaccttcttcctcgggctacaagtgaagcaagcactagagggcaccttcatctctcaaaccaagtacgtgaaagacatactcaagaagtttgggatggaggatgccaaacctatcaagacgtccatgcctactaatggacacctagacctcgacgataatggtaaatgtgtggaccaaaaggtatatcgctccatgataggatctttgctttacttatgtgcatctcgtcccgacatcatgcttagtgtttgcatgtgtgcccgttttcaagcggagcctaaagagtgccatttgattgccgtcaagagaattctaagatatttagttcacactcctaatcttggcttgtggtatcctaagggttgtgactttgagcttttgggctatttcgattcggattatgctgggtgtaaggttgatagaaaaagcacaaccgggacttgtcaattccttgggcggtcccttgtatcttggtcctctaagaagcaaaattccattgccttatccaccgccgaagccaaatatgttgccgccggttcttgttgtgcccaactcctttggatgagacaaaccctaaaagactttggctacaacttcaccaagatcccactcctatgtgataatgagagtgccatcaaaatagccaacaatcctgtccaacactcaagaaccaagcacatagacatttgccaccacttcttgaaagatcatgagactaaaggagacatatgccttacccatgtgagaaccgaaagccaattagccgacatttttaccaagcctttagatgagaaaagattttgcgagcttaggagtgagctcattatcttagactctcgtaacattaggtgatgggtggttggctaattcatagccaaacatgtgtcactaaaatgtaaattaaaaaaaaattgagcttttgtgtcttgagatcacttcttgtgtagaagatgatcttgataccatgaataaagctcaaacattccctctattatccaaaaacccttttgtgaaattttgcgaaaatttttgtgtgcgtttttattgcgaaaatttggtttttatcccttcttgtgatgtatattgaccattgttatgtaatgttgattgttggctggtcatatacatcataagtctctttatgtccataggttttcatttccaaatcattgaattctcatctattccattgaacttgggcctgactgccctctgttttgtcaggccagaagttccggtcaccccagtctggaacttccgggggtcgggggtataaatacccagggggagccgagcctggtcacttcttctcctccccgattcccaaaccctagccaccgctacagtgctcctatcggtgattttctcttccaaccatggaaatttgattcctctccgtggaatcaaccacattggtggctaggaggttcatcccgtgatcgatttgcgatttcccctctcaaggtagcacttttgatcttctcttttggttcatcatgtttttgccccgatctctaaatatgtgaacctagggagaaaaccttttagatagaattgttcctgctaccttgtagattgccgatctataggattttgtcacatgcactggcctggttaaatcctctgttcttcagttttgcaggccagaagttccgatgttgttggcccggaacttccggtctctgtccagacagccagtaaccttgattctgctactgtttcttttaaccattgcactccaaccttgttgattcttgttgcagtggtcattatgcctcgtgagaagagacataagctttctcaagatgttcctgctgactcgagccccccggttcgtggtcctagggggagattgggcaaagaaaaagttggagatttttacagtgggagtcagatccgatccattccaggagggctggtagcattgtcattcgtgatgcactccgctctccctctccagctgcatctgagtcagatgatggtggcaatgaggatgagcctggttctgaaagcaatcctttgaggctgtacaagacaagggctgttgatcctgatcctaaacgcccaagagtgaactatttgaagaatctactcaagtgtggaaatgacagaatggttagtcctgatactctgccagctgactttcaggatgacagattcaggacctttgtgcaggttgattggtataactctgtgatcatgggaagatctcatccagtggtagagatgaagtggctagactggcagtacatgtcctcaaagaacaacatagtcttcaatgaggtacgcaaggtgtgtgagcgcaagcacatggcagatttgttggccttgcagtattcatggaatgagtaagtgattggacagttctactccactgctttctttggcaccaccaagaaggggcttgtttttgtgaagtggaccatcaggggtagcagtatagggtctctatggcacagtttgctgcagctttggggttagatgatgatgacctgagtcgtccacatatctttgtagaggatgctctgtcaccgaccagcactacctttatgtatgagaaggatgctcccaaggattgtttggggactactcgagggttgcgtccatattatagagtgttgtactctatcttcaggtggtctttgctccctaaagtgggagatgctacagctcttccaggtaggcatgcgctcctcctcagtcgcatgcgctacaacaagcccgatttcagcatcatgaagcttatctggagtgagatctatgagacagtgtgtgagccaaagaggggctgcatctatgctccttatatcatgaagatgattgaggccaagactgggatttgttatttcaaggacaatcaacgcaagcctttccgtgctcatgctcccactactttagctactcctaccaccagagtgactcgtgcttccacctcagctgctccttcttcctcagctgcacctcaacgttctgagtcttcttctcccataaagaaggctctcagggctatcttttgcatgtgtgccaagacagctaagaaggtaaagaagatagtgaggcatcaaaagnaagattggattgcagcaggcaaggatgtctctgacatttctgatgatgaggagtttgttgatccttttgctgcttatgagactgcccgagacattgctagtggtgagagtccctctggcacttctcatttcttcaatgaggagtcctctcactccgaggagagcagtgacgatgaggagtcagatgcccctattgagaatgttcctacagatcccgatgaggcagtggatgccgccgggcaagacatcgactctcctcactcgggcgacactgagatcattccttctgatggcgataatgatgaggcttgatcctcttcttcccttgtgattttgtctcttttcggtgccttgatgccaaagggggagaaaattgcaatcgaagcgggtcaaaattttgtttttgatgcttgctgcctgctatctgtataatccggaagttccgaacctggtagctccctcgctttattgtcatgtcagcttgtccggaagttcctggtattttatccggaagttccggacctggcaatcctttggcccctactcttaacaactcatggacatgttctaattctctatttgtgtgaatgtaatgtctgttagatgctcttagctgccctttatttattctgctcttcatttatgctatgagtgtcttatttgttgtttgtgatgtgatgttgattttatctttttgagtgctcaccgtgtcgtatcttttgtatataatatctattcttactgcttttcgcatcccatgaatgagtagggaggaaggaaactctcctcggttgctcccatatatatatgcatatgagctccactcatatctttcatatgcatacattaagggggagtttcattcacctctaaccattcaaatcaaaattcttatcaatcttttgtaacctttaaccatgttgtcatcaatcaccaaaaagggggagattgaaagtgcattaatcctcctagtgggttttggtgattaatgacaaatgtggttaagggactaatgagctcattgagtagctttcaggtgcattagtccaaggtgtggaagatggatgcttggagaccccccaaaaagtacaaaatcaaagcggaccggaactcgagaagtgcataggatagtttatcttttgaaatcaagtttttaggaaaaaccgtagtattaagaggggttccaggtgatgctctgagatatatcaagtgctcttagtgtgaaccaagtgtcaagtttcccttggagtccttttttgcaaatactccatctgtccaaaaatgcaagtccagaacttcctgtcttctaggtccggaagttccggtcttgtgaaaaagattttcctaagtgtagtccggaagttccggtcttccaggcccagaacttcctgtctagtttccagttcaaatttgtgagtaacggcaagatgacgtcacctagccgttatacatatacagctcgtttctagctcgttctttggcgattccactttcacttttcgaacgtagagctattgctagcctctcccaagtgtttcttgccttctccactcaatctagagcctaattcttgtgagagagattgagagggagaaaagaagatttggagatgtgtgaagactaggatcttgggtgagcacttggaatatctcatgggctgtcatctcggtgcttattactcttggagatgatctcctagacgattaggtgtcgcccgcgagaatccgttgaaaattgtggatgtctcgggtaagtttgtgaaggatttcctctcctccaaaagggaacgaggtaagttagtgaagttcttgtgctgagattctagaggctttcaaagtagagcaacccacacttgtggtggatttctagaagtaggttgagttgaatcttggtggtcactacattctagaaatttgcctaggggtgtttggggttgaaggctgtggatttcctctgggtttttgcacaagtgaggcaaggggttaatcgagacccagctcttggagctcctcaacggagagtaggatcacaagattcgaacttcgggaaaaaatcgctcttgtctctttctgtgatgtttctatggatgattctgtgatatatcctctgcttagaatacctgtgcaccatcttgtgaagattggcttagtctcttgtttcgaaatttaaatttcatctctgttttgttacccggaagttcctgtattagaacaccggaagttccgggcctgggaggccggaagtttcggagttccttaccaggaagttccgggtctgtttgaattttaccgttgcgatttgtttttaagttttcagggacagcctattcaccccccctctagtcttcatcagcgcgttcaaatcctagattgttgaccagagaacaaccacaacatgctgggcaaagtgtcaatcggctgactcaggagcaggttgctgcaatgtttttaccaaatccaccaacagccgacccaatccagtcaatgccgattcagcaaatgttgccaagacagccgatggttcggccgattcaacagcaaaacttgcaacatgcatcggctaggctgaggaatcggccaaggcagcatgctgcaaatcaagtagttcatgagcacttggtccataatgtgcaggccaatcagtcagtcgtacctcaagttgttcctgaacatttggtgcacaatattcagttgaatttctagaattatcaaggaggtaatttgaattatcaatatcaggctccgtcacctcatgttcagtaccggcaaacaaaattgcctcaatttgctcctcagtttaatcagttcgagccgatacaacagcaaacgcaaggaatacctcagcaaaggccatggtctgatatgattgcagatgtgatgagggagcagtttgggttaaagccaaaggacactggaaacttgtatcggcatccttaccctgagtggtttgaaagggtttcattgcctagccgatacaaggtgccagacttctcaaaattctcagggcaagacaatgtttcaacttatgaacatgtcagccgattcttggctcaatgtggtgaggcatcggctgttgacaccttgagggttagattgtttcctttgtctttgtctggatcggtgttcacatggttttcttctctgccatataattctgtcaatagttgggccgatctggaaaaacagtttcatagctatttctacagtgggattcatgaaatgaaattgttcgatttgacagcaatcaagcgaaggcatgatgagtctgtgcaagattacattcagaggttcagggagatgaggaatatgtgttacagcttgtctttgacagattcccagctagccgatttaacttttcaagggttgataacaccacttaaggaaaagttttcatctcaggactttgaaagcctatcacatcttgcacagaaggtgactttacatgagcaaagatttgctgaagttaagaagaatttcaagaagatcaatcatgtatatccttatatgtatgattctgaagaggatgatgactccgaagtagcagcagccgaatgggtcaggagcaagaaagtcataccatgccaatggctgaggagctctggaaaagaggagaggtttgactttgatattaccaaggctgacaagatcttcaatttgttgcttcgggagaaacagattcaacttcctgctggtcatgtgattccatcggctgaagagttaggcaaaaggaggtggttctcattctactaacgactgcaaagattttaggcagcaaatccaggcggccattgaagggggaaagatcaagttcgatgattcaaaaaagccgatgaaggctgatggtaatcctttccctgttaacatggtacacacttctgggaggacagccgatgggggaaaaaatcgaaatatccagatgaattcggctaaaattatcaacaaatatcagaagaggcatgacaagcagcaggaaaaatattatgaagaagatgatggtggttttgatcctcattgggaatgtgagttcttcagattttgttggaatgaaggtatgaggcttgcatcaattgaggattgtcttggatgcaacaatgattcagggagttcaagccgatccagcaatagaggtaatcggctgagtcagaagagggtagctgttcatcagaggttgggccctgtgaatcaagattatcgccatgatgaagatgaaaataggaatacacagtggtgtcctacaggcattttcaccaagaatcagaagagaaggatgcaaaggatgaggaacagggagcattttcaggaggtgcaacaggagattaatcatcggctgaggaaaacaaagaccaagcaagagtgacgtgttaagagcacggttgcaacagctgatgagatcgaaggtgacaagacaaaaaggttgcttaagggcaaagctggtacatctgcctcaataaatatggttttcatgttacctgcagaattcgaggctaggcaagccgatgttgatgatgttgaagaagcttcggctaaattggtttgtctcgagagcaagcagtttttgagaagccagaagggacagagaatcgacatctcaagccgttgtacatcaatgggtttgtcaatgggaagccgatgtccaagatgatggttgatggaggagctgttgtaaatctaatgccatatactacattcagaaaattaggtaaaaatccagatgatcttatcaaaactaacatgattctcaaggattttggtggtaatccatcagaaactaagggagttttgaatgtagagctgacagttggcagtaaaactgttcctacaacattttttgtcatcgatgggaagggttcctatagcctgttgcttggaagggattggattcatgctaattgttgtattccttcaaccatgcaccagtgcttaattcaatggcatggtgacaagattgaaattgtactagccgacaggtcagttaatgttgctaatgccaatctagctctttgggagatgtatggtattgattgcttatctggaaaagtttgggatggagattttctaaaagtgtccgattgtgatatacaactgattgaagatggagagcccaaattattattttgagggcgtcgtggagggttcaaatgtctacaccaaggacacagtagatgatctcgatgacaagcaaggacagggtttcatgtcggctgatgatttggaagaaattgacataggtccaggagatagaccaaggccgacattcattagtaagaatttgtccccagaattcagaaccaagttgatagagcttttaaaagagtacagagattgcttcgcttaggaatatcatgagatgccaggactcagccgatcgattgtcgagcatcggcttcccatcaaacctggggttagaccatatcagcaaccaccaaggagatgtaaagccgatatgcttgaggctgtcaaggctgaggttgcacgtttgtgtgacgctggttttatacggccatgccgatatgctgaatgggtttctaacgtagttccggttatcaagaaaaatggcaaagtcagggtgtgtattgattttcgggatctgaacaaagctaccccgaaggatgagtacccaatgccggtggccgatcagttggtcaatgctgcttcaggacacaagatattaagttttatggatgacaatgcaggatataatcaaatctttatggcagaagaagatattcataagacagcctctagatgtccttgtgcaatcggcttgtttgaatgggtcgtgatgactttcagtttgaagagtgctggagctacatattagtgggctatgaattacatattccatgatctgatcggctggttggttgaagtttatattgatgatgtggtagtcaagtcaaaagaactagaaaatcacatagccgatttgaggtaagtttttgagagaaccaggaaatatggcttaaagatgaacccaacaaaatgtgcctttggtgtgtcggctggccagtttctgggatttcttgttcatgagagggggattgaggtgactcaaaggagtgttaatgcaattcagaagattcaacctctagaggacaagaagaagttgcaggagttgatcagcaagataaattttgtcagaaggtttatttctaatttatcaggaaagttagaaccctttacacatttgttaagattgaaagccgatcaaaagttcacttggggggcagagcagcagaaggctttgggtaatatcaaggaatatcttagttccccaccggttctgattcctccacagaaaggggtgccgttcagattatatctatcggctggtgacaagtcgattggttcggtattgattcaagagcttgaagggaaagaaagggttgtattttacttaagtcgtaggctcttagatgcagaaacaaggtattctcatgtggaaaagttgtgtttatatttgtatttctcttgcaccaagttaaggcattatctattgtccaatgaatgcactgtggtatgtaaagccgatgtggtcaaatacatgctatcagctccaattttgaagggaagagttggcaagtggatatttgctttgacagaatttgatcttcggtatgaatcgccaaaggcaattaagggacaagctatagccgattttattgtggatcaccgtgataactcaatcggctcggttaacattatgccctggacattgttttttgacggatcagtgtgcactcatggttgtggtattggcttagttataatttctcctcggggggcgagttttgagtttgcctatactattaagccttatgcaactaataatcaagttgaatatgaagcggttctcaaaggattgcaattgcttaaggaagttgaagccgatgctgtcaaaattatgggcgattctttgttagtaatcagtgaattaacaggagaatatgaaggcaaaaacgatatattgatggtctacaatgagaagtgccgagaattgatgagtgggtttcggctggtaactttgaaacatgtttctcgagagcagaatgttgaagctaatgacttggctcaaggggcatcgggatataagccgatgttgagaaatgttgaggtagatgttgcaacgattacagccgacgattggagatatgatgtatttcaatatttgcaaaatccatcccaatcggcttcgaggagattgcgttataaggctttaaaatacaccttgttggatgatgagttatattatcgaacaatcgatagagtgttgcttaagtgtttgagtaccgatcaagcaaaggttgtaataggtgaggtacatgagggaatttgtgttactcatcaatcggctcacaagatgaagtggttactttggcgtgcagggtatttttggccgacaatgttggaagattgtttcagatattatagaggatgtcaagattgtcaaaaatttggagcaattcaaagagcaccagcatcggctatgaatcctattatcaagccgtggccattcagaggatggggtatggacatgatcggccagattaattgtcacgtcccaaaacgactctaaaatatatcccttaaatgatgcctagaataattaaaatccatgtgaaagcctccaacaattaaaatgtgcaaagttaaaagccaaataagacttagaggatttttgtaaatttcctaaaagcctaaaatgcgtaaataaattttagtggaattttcagagcacaaataataattattaagaaataaacaaagttaaaatgattttataaaaag

SEQ ID NO: 69833 - DNA, 1195 bp, Oryza sativa
ttacatctataaatcgttcgacttttctcttagtttatttctttaagtttcatcaaatttgtagaaaaatatattaacatttttaatgtaaaataaatatatttaattttaaatttaatgaaactaatttagtgttataatgttgctaattttttttataaatttgatcaaaccaatagacttctgactatgaaaaaagtcaaacaacatattcatttgccggaatacattatgaacatgtcttcgataagaaccagtaagaactagtttggtatactccgatgcttttttgtttgtttatgtataattactcacatgggagtattactatttaaagtagaaactatgatgatgaaatctagaacacttaaaaaaataatgatgaaattcagaccacttaaaaaaatgattaactgttggtggaagaggaaaacgagagattttttatgcataacatgtgccctgatcttattcaactctaagtgtgtcagcatgaaagtgaatttggattgaaatggtgtaaccttttatcccatatttgtatttctctttagactttgagctgaatgtcagtggacctaaaaccactccggatttgtatttctctttagactttgagctgaatgttagtggacccaaaaccactccggattgagtagggggagttatttgttcggtttcaatagttgagggtgcaacatgtctggttttcgagttcgggggtataattcggtcgacctcgatagtacggtggggggtagtaattcgtactttttccttgtaaagcacacatgtaaagctggcatatctgttaaaaaagatatttggttaattcaactgacttgaaaagttattttttaacaaagaaaatttgtgctcctgcttctgatggattaattcaactgacttaaaaagttatttttaaaaaaaagaaaatgtgtgctcctgcttctgatgatattctgcaatgagtatattctcacagttgcagtatactagactaaatttatagtacctaataacgtgcgttttacgtgtactgttactatactgaaaagagtgagcctgtttgattacacaaattgatgtatacatatactcgagctaacacaatcaatcaaattgtttttttcctttactttcagtcatattttctactttaacatatacctaataactaggggctgcaggaatt

SEQ ID NO: 69834 - DNA, 1695 bp, Oryza sativa
tgcacccctatttaaaccttccccgcgcctccctcgcccgtttccgccccttgccgcaccgtctccctgccggaggcgagctcgcgccgtcgccctctctctccttcgtcgccgacgacctccggctggccttctccgcttgccgggaccgtctcccgccccggcgtcgcctcctctggctgcgccgcaccgccgtcgaccccgtccaccccctcgccgagtccgccgaccgccagaacaccgtcgaccccgtcgacccgagccgcgccgctgccttcctccgctccggccgcctttttggtcgtcgccgtcgacctagggtgagccgtggaccgccgcctcttttccccctttccttcccctctatcggccgccggtccgccgtgcctatggccgccgctggcgaccataggggcgcgggcgccgcctcccgccggtcgcgccgagtggccgccttcgggcgcgccgagtggccgctgcgtggggcccggccgtcagccgcccgctccctcgggtgcggctgacgcgtggggcccacggcgccggccggtgcgagcccgggtgcgcccggtccaccgtggaccgtgaggctgccacgtgggccccactcccgtggacccggtccgcgcgctcactcccatcggctgacgcaataaaccctttttaaattaaaatttaaatgaagaaattcgcaaatattcatttaaagaggatataaacttcaaatggccataacttggtcatttgaactcggaattggaccgttcaagtctcttttttttccttaagaagtcaagaacccatttttgtgctttgttactgcttgttatatggagtttattagagtaaaagcccttttattttccgttggtcgtgtagacgttgcagcttcggaagatctgctcttcgtggaggttgaagccgacgtttgggaaagtgagcaaggcaagtcacattatccttgaacatattgaatctcagtttataaaattattttgatttaaattattgcattatccctttatttaaattcccgcgttatcactgttttatctagccatgcctatttacctttgttatgaccttattattgttattgttattactaccttgttcaccctagaataaacaaaaccccaactagtggacactctactcatgtgtcacaccctgaagttctcctcctaagcctaaaattgaattaataagagaccctaagaaaataccggtgcaaagcaagagtaaaccctattgaatcaatgcaaataataatcagaattggcatgtggaatttttcttgagttctacatgttgaaattcactaacaggatttttagtggaattttcagagctctcgaaataattttaaccatttaaaatcaagcatgcaatattttaattccacggaaaatctttttctcctttttctttttctttttcccttccctttccgaatgggccgccggcccattctctcctttttctccccctcctccccgctgggccggccgcaggccgaggcccagccaggccgctccgcctccctcctctcacggggtcgccgacaggtggggcccacctgtcgggtccttccccaacctcccgccgcccgcgccgggcaccacccccgaaaccgccgccgccgcgccccacctcccccctttccccgagcccacgccgcgtcgcccgcgccca

SEQ ID NO: 69835 - DNA, 1113 bp, Oryza sativa
ccactgcctaatcttcttctctagtgccgaccgaacgtcaccgctgccactttgatttgggaactttcacctcggggagttctagtccaattccttcccatgggagaatcaaaatttcccatgctcttcttctctagttgaggagatattagccactgcctaatcttcttctctagtgccgaccgaacgtcaccgctgccactttgatttgggaactttcacctcggggagttctagtccaattccttccatgggagaatcaaaatttcacatgctttggtttcaatctgcaacgtttggagttccgccatcagacaaattccacccgccgccaccttgccggtagcctcaaccagtgagctcctttttctggatgtgcttatcacttgttccagtgtggcaactagcacttcccacgtccttgccatgaccagcgatgttgtggttcgtctagccgcccaagcgctggtgtattttaagaaccgctggtgtattttactccagaataaacaaaccattccagagatttctcaactcccaaaacaattattccatgtttccataaattgcaatgcaataattacccaaaaatgaatttcttttggaacaaacgaaagagaccagaaataaatttatttcgggacagaaggggtattaattaaactgctgtagacggccggtcacactatctttatgctgagtcatgtgaacaggatgacccacagaaatcctcttgaataaagtgtttaataatttattatgtgtatgtgtatggctaggatacagccgtgcacgctgccaaagcatcacactagagttgctgctataactgattgtacctaacaaccatcagtaccaacaatagtgtcggtggcagtttcaataaaccatagagtcactgatataattatatgaacagatagtgtcggtggtggtttcaatcaacaatcgtcacctatataatctatatatccccaacgtttgcatcacaaaaacttttagagctccccaacctatcagccatggaacaagttcatgttgagaccaaagagaaagactcgaacttacttgcagctatttcatctgaaaccaaccacgatgacaatcccatat

SEQ ID NO: 69836 - DNA, 758 bp, Oryza sativa
  unsure (1)..(758): unsure at all n locations
agtgattgacacttgtcagtanttcatcattgtttcgtacaatataaccaatcacacgtcaacgaattcatgatttgactaaagattattttatgtacattttgagaaatatcagaaactttttaatgcaaattgctggaggaatatcagaaaaagaatgaaataataaatagtgtcgagcactcaagccttggataacatttatcaccagcaactcaattgtgattcaaatagcagaaaaattcaatcttcaaattatgtcctaaataactgtccctatttaggacaaaaaccagcagcgatgtgtagtgcaaagtttatgaatcctagctaaaatagtcctacaacacatttacctgtccaaccaaaatagtgcattcaaaagccatggtttgcagagcaatagagcatcaaaatgcacaaaatatactaaacatttgaagattagcacaacaacaactaatcacaataaatctgagttagcacatggaatttaaaacaacataaaaggaaatattttttctatggaaaggaaggtcaaaatcaactgcctcacaaactaagtgtgcacaaaggaaaagaaaaaacaataccatatgcaacaaggagttctggatcaccatatatatcaacaaggacctacatggttttgtccatgagtcacaaaggattacactaaacatctcaatcctcttgtagaacaggcaaaatatataagaaaccttgggctctacttctttgcgtgtagagtatggaaa

SEQ ID NO: 69837 - DNA, 675 bp, Oryza sativa
ccacatccttcaccacgtcacgtcaaagcagaaaaatttaccagtatggattagttcgggtcttaattttacagagttgatcatgagtgaacgagtccagctagctctagcatgaattcatgcagatgcagcaaatcgatcgatgtggacactacagttatttctcatctactacaaacagcgtggtcaagccgacatctctctctgtttgctcgccgcgacgatctctctctgttcctgccttcttagtggccggattgaccaggcgtttactaactgcaacagacacgtacgtacacaaagagaaggagagcgcaaatccatctcgtcgattgcattttatgttgcgttcttgatgttgttggaaaaatctccatagttgctggaaaaaaatattgaagatctatcctgcgaggttggtaggattttgttttggatcggaatttggaagattgatgcatcatccgtggttgaatcttcgggctcggggttcacaagtgaaaagactaggtatagcagctatggtggaatctaacattgctaaattaaattgttcagcaagtaacgcaacaactcgcattgttggagctagttaaaaaaccatgcactttcagtaataccctccatattttcacaggtaaacccatactcgaaaatgcactgggctccttattt

SEQ ID NO: 69838 - DNA, 52782 bp, Oryza sativa
tgtcaccgcccagcgcccgcaccggcccggcccccccgcgcgcgcgccgtcagccagctgccgcgggcaccgcacgcggcgcggtcgacggcgtacgaccgaccgttcgacggagcgaacaccgctttgagatgcgagtgtggtgcgcgccgagtggtggtggagggggaagggggtgagggggtgccggctatataggcggagacggccgcccgctgggccccgcggtggcaggaacccgtcgatccgcgggggagggacggacggacgcgcggtggaacattccgcgctggcagatggggcagcctggctggccggctggctagctgccttggctagctagggtttccccgccccgaccgatcgatcgatcgatcccgcgccgcgccgaggcgcgatatgatgcgatcgcgccatgtcgcgcgcgcgcccctcgcgaacgcgaacggcttctggcgcaataaagccgagccgtgcgctgcgccgcgccgcgccggaggggggttgtgggctgtggccccctcgacacgacacgaggagggggaaaagcgcgcagcggcgcaggatatttttttgccaaatattgcttctctccccttacccgactttgacagtacgagagcagagagagctgcaagtccaaactgactactgttactctgcctgaccgacctgcaggctagctacaattcgcacgcgtatgtgtacagttaattaatggacccatcacccaagccacgacccatcactccatcaggttgcttttgcgatcgagatagtcaaaagagataaagacatctctccggccggctaggagtattacctccctaaaaaaaaaagacaaaccatgagttgtcgtgcacaacgtttgaccgtccgtcttatttaaaaaaatgaaaaaaattaaaaagacaagtcacgcataaagtattaatcatattttatcatctaacaacaatgaaaaatactaattataaaaaaattcatataagacggatagttaaacgttggacacggaaatccacgatttatcttttcgttggacagagggagtataagctagtgtcatgtcagttaggtcgtcctcttggcctaaggccctgttagttctgaaaacaaaaatttcaccctatcacatcaaatagaatatttggacacatgcataaagtattaaatatagaaaaaaactaattacatagttcgccgggaaattacgagacaaatcttttaagcctaattgtgacatgatttgataatgtagtactacagtaaatatttgctaatgatggattaattaggctcaataaattcatctcgcagtttcctggcgagatctgtagacaatgttaaatacttcaaatgtgtgtccgtatatccgatgtgacacatcaaaacaaaaatttttggaaactaaaccgggcctaagctggagaaattttgttgctgctaagaacaaattttataatagatgtgactatcacctataattttatttatgttaatatatctctacaaattaacatatacacgacaagttacctacaacacacaaatctcagtaactctaatttttttatatttttattgaattttgtatagaaattgtccctcgtacgaggggtgactacttaatttactctctcttcatttctctctttcacattagtaaatgagattacatggtatagaggatcataactgcttaaatgcttatagtggcccggtttagattacaacttttttttcaaacttccaactttttagtcacatcgaactttcctacacacaaacttccaacttttccgtcacattgttccaatttcttcaaacttctaattttgacgtagaactaaacacagccagtatttgacaaacccgagaaaatgcacagccaagatcgagtggttttgagtgcagcatcgcttgctccaaaaggatcaggccaaagagcacgagagcacgcgtcgaatagtttttttttttcgcgtgattgcaggcatgttgatgcagcaccaggggctacctgcaaatctacagtccgatcttcacacttgttgtacgtagctagctagctagctaatcctttgcagggtatggctagtacaaatgtctttcttccagtttgaggcatgccaagtggtggtggaggcagaattggatgcatgccacaccgctcaacttacgaccggtcgcatgcatgatacatgtgactgctactgggagctgacaaaatttgacacctcccaacagaacggctcagctatctttaaagcatgccacatgagcttcaagacgagatagagctgccagataaaacttgtactccctccgtctcaaaaaaaaaaagataaaccttatagattttcatgtccaacgtttcaaaaaattataaaaaaattaaaaagacaagtcacgtataaagtattaatcatgttttatcatctaacataaataaaaatactaattataaaaaaaattatataagatggacagtcaaacgttggacatggacacccaaatcctctacggtaacacacaggtagaatggtgtccacaattacagatgttctttctcatgagtgatcatgtttggtatcgagttagccaaccatcagtgataggcttattggtccataacaaaatcggtgggtatgtctagtgaaatatgagcctactatgatattaggtccatcacaatattgtactattgatcggtattacaggctctaaaatccagtcagccttaatcgaaagaggattaggatggtgacgattgaactgtatactttctagattaagcctgggcaatgtacaggatgttgaggggtggatgatctggatgaacctcacagtcctcagtgctaaaggagtagcgcctgggacgagtaaaggcaaaattaaatcggttccatcttcgtatataacatatatgtatgtacaaggatgatttttgccctagctaatttgcacgctctttttttcgcatgtgatatctaatcgcatacatgacatagagagaactagaagcaaataagacaatgggttaatttttatgtagacaaatttagtggtttgggagtgtatcaaagagagggaatgtggctcgggtcttgttcgaaccagggcaagctaggttacatgttactggcttgacagacaaactcatagtttttacacaatgtcctaggagctcggggagttgtgggccccaccaggcctttcctcccaggggcttggggcgttatgggctccaccaaggcctacaaaatttgcatcttgaagttgttaagaagagtatcgagatctacaagatctacatcttcaaggtttcaagaagagcaccaagccctacaagatctacatcttcaagttgtcaaaaagagtatcaagacctactacatcttgtaggtgcaggagcggtcactagtgggtaccactgtctcgtccaaggacatgcccatcatgaactccttcatcgacatctttgaaaatttcgtccaatacaacaatgaaatttacttccggcaatgggagcactctaaagtgtccgggtgggtgccccaaggactcagcttgccaagaggacacaggttgacccgaacacagcagccagccgatgacaagcatttagtctctcgggccttgagcactaattagggtctcccgagcactccttgctggggttcatctcattaaggaaagttgttcgggtccagtaatcacatttaaaccactactttacattaattgtgaggtggttcaagattggcgtacaactcatacgctatttggggggcgtgacggtacacgcaaccccttgcatgcccacatcgcccgaagaacacaaggcatgcgacgttgcacttcctcaacaaccatcccatgggcccacctctactggctacgatggttgacggatggtcctagggacatttggaacgaagacttttaactcccctctccacttgttagtcagtaggtgtacctgccacatccggtcggcttgcttggaaggaaaaacgacaagactaagcatatcaattttagagtagtagaccctactcctgcatgcatgcaacaacattgtggactccccttcacatataaaaggaggatccatgaaaaacaaaatgtttgcgctctcatctaagctagctaggttagccaaacatccagtgagtaaggagcttttcctcctcacttagtttttcttcccacatcactttgtaattcctaagaacatgcatagtccactgcacaggagtagggtattacgtattcatgcggcaagaacctgcatatttgcttgtgttcatctctaccacgcaataaaaaactcgggctcagaacttacacccaggccgaaactcacaaatgaggagtacttagcttccctgctagaggagtttcacatactcactcactcactctctctctctctctctatggcgaaaaaataagcatcattgcaaaaattatcaaattatcggttactatttgagatgtcctcgagcctaggcacattttcgtccatgcaaattaagaccacaaatcctatagcattttttttcatgaaaacttttaacatatatactccctccgtcccaaaataagcgcagctatgagtttccgtgtccaactttaatcgtctgtcttatttaaatttttttagaaaaaactaaaaaacgtaagtctcgcataaagtactattcatattttataatctaataataattaaaatactaatcataaaaaattttaaataagacggacgatcaaagttggacacggaaacttatggctgcacttattttgggacggaggtagtagtgtttattaggagcattaatgacgccttgaatgctatatcacaagttcacaacattagggagtccattgactatctatgaccctgttggttgaggactaacgttgtcacacattttttttaagtaaggtgacttagcttagacatgtcacatttttgtggcaaacaaaatgataaaccatgcttaaacaaagttagataaaaaaagttgggtcagatgattaaaaagttagataagtcagagttgtaaccgaaaccaaacaccatctacttaaaaatataatttatctaagattagatgtggtgtggtaaattcagttaccaaccaaacacgtcctttctcttcgtcggctacccaaagccacccatgcatctactgttaatttgcatcggaaaacatcattactactactccagtagctagtacgcgctgcagttgtgtgcatccgaaaacatcatcacgatataatttcacgtgcgccgacaaaagccttccattattgttcactgtcacaaatgttttctctcccgggatctaaacatcactgaccgatcaactcgcactgtagtaactaattgtacccggctagctttacgttcacagtacaactccacaaacagtaaaacaccaacagtaaacacaccagctgctcgttccaattacgagctactcctaacttattagagcaagtttaatagtataatcaactattagctccaaattatctagagtcaatgtaatagctaattcatacaatagttgcttactatactattaatacctggtcccacctatcatacacatgctacgttttggagtccatactgtaactggttacagatatgtaacctgctgcttttttttcttttttttatctctttaaaatatatttatagctggtttataacctcttgttcctgctcttagctgtttggtaggcaaggcacgtagctccacaatttttcctttgctgtttggtaggccgaggtcgtatagctccacaaatttctcctttggcacggttctcgagtgccgagatcggaaatgtcctcttcctctaggctttcctcttttggtccgttcctaattggccacgattaagcttcacatggagctcgatcgatcgaccgatcgcgctgtcccagaagataagccgcgcccgctcgcgtcgcttcgaggaaacgaacacgccggcggcgagatcgatcgagcaggaggaggcaggaggccagagccactctttgtcgactcgtgattggccgcgcctcgctaatctattgtttaatttaatttaagagtgcttaattaatcgtcagaaagataaaagcagccctgcttttaaattttatcggttgcgagacatgcaggcagggacattattggagcagagccaataatgatagttaattaagtactatatgtactagtggattggttaatcagataatgtgttgttaattagtctgcacaatgccgaagcttttggccgggtgagcaggagctcgcatgtgcactgtgcacgatcgatcttgcgacgaagattttgtaattcttaaggtagatcatgtcgcgctaagtgctcgcgaataggatcaatatttggtggtttattttgggaaaatgtggttttggttttcttagtgtacagcgtcaggggtaagcatgcatgattggaacatcacaaattcggctcctcctcctcctcagactctaatactttatactcctcttgtactttagaacaatagtaatcactcctcttgtactttaatacgatagtaaccgctccatttgtaaattaaaacaccaaaataatcgctcctcttgtactttaaaattaacaatctgcaatggtacaattggtacgtcatatgtgtgcttttcgatcgaagtgatagcatgcatgcatgctcctagccctaggttcatagaaggtcagtcagcggcgttctggtcccctgtagtaccatattctactcggagcatgcgtgaaggactttggaatttgagtgtctcttcctgctattttaaattgccatccaatttacagtgagatttggatttttggaggcagaattaaagaatttaaataaggcatggtagcatcactactcagaattctgatattattccacctgttataaaagttagtcaatatagcggaatgacgactaaccttctcaatcgcttcagtcattgaccacccaagacatgccagatgacgacacaggaacacacgatatttgttaacgacgttcagccaaaacctacatccctggggctctgattatgggcgctcctccccaaccaatatagcttctaaccgctatgagtccggtcatggcctcgccgccatcatctctctgcgtgtctacgctctattatagtcgccatggttacattgtggtaccccctctctatttaagactaccaatttatttccctagtacgtccatgtaggcttcgatcttggaaattcagtgttaatcaaacggcttaattagattatttttattttctcgaaatggcatggaatcgctcttgaccccgcagcacaacttactattggtccaagcagcacccactctcaaccttacaatatcacctcaagatccagatgtagaaaaacaaatgaagtggtttctggttgccttttccaaagcaagaaatttgtaatagtgtatagacatgattatcaaataaccactttaatatacgaagaaaaagtcttagattcatataaaaaataaaaagtcttagattcgacaatattcgatagctggcgtgtcgttggtagactatacatgtataattattaaatagaaaagtattacaacttgcgagatgcgtgtcgtggttcccggttgctttttttcaaatttgaaaatttataatgtatagacatattattaaataacactttaatgcatgtagagaaagtcttagattcgacaatcttcggtagttgttgtgtcgttgatagattggatatgtctagttgtattaaataaaaagtacaacttgcgggatacatgtcacagttcctgctagttaaatattgaatccacatgctactataaggtaagttgtcacgagactaactttatgttcaatatatatataataaatttctaactggacggtcataaacgatctatgtgtcgagaataaactggtccgatctaacccaaaacctttaattgactatatccacaccactactctacaaaccaaattgaccgaataacatatggatacattatattttggattccaccggttgcacagcgtgtatgcatgcgtcgtgctgggtttgtgtgtgtggtcctatttcgtgctccatgcatcgatcttgtttttgtgcatgcaatgcgtggtccatgcaccaccatgccgctttttgaacggcggtctgagacatatacagtagctagataactataccagctatagctagctcagcgagatcgattcgaactcttttgaaaaccaagttgtgagatgtgcgagcctatatagcataaagtagtgcatacctatacgaatgcaaagctagagacgcaaaataattggctaacctatacgaatgcaaagctatacggtatatgcatgtactccactctctcctatagctagctactattcgatcgacaggtgtattggcacagtatcttttgccaatctttatttttggcccctgcagggttactttaattgtgcgcgtgattggtcggtccgtagctcgctgtagtgtgggcaccaccacacacacacactgtgtggccccccctgcgcgccctctgccactgcatgcgcctaagctaggaagcaagatccatctcctccatcgctagcttgagctgtcatttggccgcacgtctgcagatcgatcgatcggtttttgtggggagtagatggcatggtcgccgaccgatcgatcgacggcgagaccttaattcgtacgatcgatgcggcgccgtacgtacgtacctgcgtgcgcgccggccggcgacagttcgtcggtcgatggatggatggatgcagagcgcgagcggcgcgcgccgctcgtagctggtatagcgatcgagctagacatgcggcatgcgcgcgtggtaggaaacgatgtggagacggcaagaggagacaaagtcacaaagagagaccgatgtactatgcgtgtttgtgatgaccggcgtatgcggtaattgcgtatgccgtgccgacacgatagatcggggccgggccaagtgatgatcgtacgtaccttcctgagtcctgactcgtagtctcgtactagctccgtccgttagtcgggaaagtccaatgcatgtgacgtgcaagtgtacctgtagtccatttagcccctatttacttcacaccaaacttcccccaaactcccaacttttcattatatcacatcacatcaaaaactttcctactcacataaatttctaactttttttttccaaacttcttccccaatttcaaaaactaaacacagccttagtactgtatttgttttgaaattcaagcatacatcgcggattttaataacgtatacaatattgtattcctctgcttgtggtaacatatatactagtagatcgtagtaaagcatatttaattgcttagcctgtagatgataatatgatatgcgctagtgcttggtaaaaatcatgttctcattaattatttacaagtttataacgttgacacaatttctattgtacatattttaccattgtttttctaattatgaatttgtgaaagtagttgaaaatacaacaatatgaatgtatttttcataacaaattagtactactagtttcatttttggataacaaatattaatatatatattttcacatagtaggatttaaaatataaaacattaacatcatcattatttttttctgattctcatcgtgtgtctacttaaatagctgcctctcagattatggtctatttggtcgagctcgaacttcaaggaggtgggtctggagtggaacagcctaaacccagcttcacctctctagttcattttgtgagagcgctacacctagcttcgtttcttttttagtggagctgaaactgtttggctggcttccagctcctaacaaacccttagtctccagctcccacacactacacaaatgaccgtaatgtgacatcgacagaaggaggtgagagagataaaagatgggaaatgatgctaaactctcgagtggacaatattccctcgattttcatatcatttaaatggttatatatttattttagaaaaactagcaagatagataaatataagatgtatcacttcacaaacatataagatcgaatttaacttcctataattcataacataataaataaatttgactgtgaatgtatgttaacaagctatagtttagtttgttctttttgttgcaacttgtattggtagaatttaacttatatgttttagagtgatatatcacatattaatctatctatgttatcttttttttataactattcggatgatatgtgagaggatattttctcgagagtttaaaatctatttacaaagagggtgtactgtacgagtgcaaaaaaaacattatgcattattattttcatgtggcacgataaatactggtgtcggagaattgtcgtcgtccttcttgtcttcttatacgttcttcacctctctctattgccaacaacagtagccattaactgagcgggatatctaccccctttctctctctagatctctctgtcttaactgaagacatgcatagcactactttagtttggtcccttcaaaacatgatgtcttgtgtacaatgattaaaaggtagggccgctataaattcctatctctgtggagtgagccagatgtgtagtacccctatttggtacgccgcttatctctccacccacccaaatgtttcctgatctggcagctttcatgtggcttgcctggacgtgcgactgtctgctcactagctccaaacaacgtttaagtgtccccgatttgagaactgaccatctcccgattttagcagcacatatactccgtaatctattggtctgtacatacattaccacattcttattgtctttggtactcttaacaaattccaagtgtgtagtattaaggatgcacatgcagtatgctcctttttttttctaagaaagaaaaatataacctgacctgaaacttataagattgtgtggtatgctccgattcttcaacggaaaattgataactgttgcccttcgctttattcatatataactgtcgtcgtgggtcagatggaaaattgagcaagatgggggcctcccaaatcttctaattgggcctttcgcagcccatccaaagattgcccgcttcaggaagcccgcgatgccgcacgtcgttgcacccagcacccgtccgatgcggacgccccaaacgcacacgcgcttgccgatctagcgtagccggccgggccgttgcgcttcggcgagctaacgccgggcgcgccgagatccatccaccgaggggaagccgtgcgtacgtgccgaactgagctgcgtgcgcgagctcacgcggaggtaacgctcacctcgccagaaaacctggcgatcgcgcgcacgcaccgcatgtcgtacgggcggtggccgctcgcacgagcgcgagtcgcgtgccatccagctacccggtggtcccggtccctgccgcaacgcgggtctaggccgaggcggtaagacccaaccctgccatatctttgcggcgcctcctattccgtcaaggcaggccgcagccggcaaatccactgtgaactgatccgacgagctgtgtgcacggggaaacagggtgaggaataagttcactttaggtcccttaatttgtcaccgagtaggaaattcatccatggactgcaaaaccggatacaacgcatcccccaatttacaaaatcgtgcaaacgaaatcccttggcagtattatactccggttttggctgacgtggcaactatgtggctcctttgactaggtcttcatcccacgtggcattgacgtggcgcttacatggcaattcgatccgaaaaattgataaaacaggacctacatgtcagtttcacatacaaaataataaaaaatggtaggtccatgtagcccacatgtcatcctcactactcccctattctctctatcctctctctccttttatctctacccccctctctccgacgggaaagcagcggcgcgcaggcgctggccggcgggaggagaggagccataggcaaagcccgaggggtgagcctcctccctctccgccccccttaccgggcggtgagcttggtagagccagagccgagggggcagggatctgagagggaatggagagggagaagcggccgcttcccacgactcctttcctcccatcggtcaacgctcgcgcatcactcctctctcgccagccactgcgcgccacttctctcccaccggccactgtccgcgactcctttcctgctggccgccgctcgcgtctcctttcctacccgtggctcctctcttcctgccggccggcgcttgcatctcctctcccgccccggcgaggtcgatgaacacggcgacatccttctcatccacccgacctgctgctctacctgcggcctgccgccgctccatctcgcttggcctgcgagagagagaggatagagagaagagtggagtagtgaggatgacatgtggggacacatgggccccaacaattttattattttttgtgtgaaactgacatgtgggtcccgtgggttttattattttttcagattgaattaccacgtaagcgccgcgtcaagagagccacgtaggcgccaccgatagccaaaaccggggacaatagtgctgaaggacctcgtttgcatggttttgtaggtaggggatgtggggatgaatttcgaacttggcgacaaattgaggacctgatgtgaacttattcgaacagggtaaacccatgtcagggcaagctacgtgcgtgtgcacgatgacgaaggtttgtctgaaactctgaaggcggccacaggccacttattcaacccgcagttggttgctgtggactaccgaggcacccatttcagttgtaccatgcgttatggacttccacctgctcacggttcattgctagcacaaattttcgccggacgattactagcagaatttagtactactctgttccggattaagcttttggccaacttgcgggctttacctttactttactgaagcaatcattaggatccaattatgctttgcttccagcaaagtacaccttgaatagtatatacgaggtttagtacgtactttgatgtcataatcactgtagctagtagagtatccgaccgacaccagcccctctcgctagaatgttgcacacaccgagtactctgaacttacaaccgacgagcaacagattcacttgcttctcgttctgaattccgaaccacttctgcagattcacaggcctagttgggtagttgggtaccacacacgttactgcttagtgcttacttgcaaggttcccttcgagggtgtcctggcaattttccctctgatctgcagctctttactcttgttgtgcagttaccagatgaattgtagtagtagtagttagtctgcgtacgaaacaacaaagattgatatgtgcaaacaacttccacacaaccataaatatacatttcttgcaatctttacacactcgacacaagctcatcctgtcattcattcagtcagtagtcagtaggtacgactgaaaacgaagctatctccctgcacatcctgattcgccttaccttacgtttcaagtcaaagcatgtcgtgagaaaatttatcggatgtctgttcgtttgttcgattgtttgtttgttttctacgtaccaaactctgaagcgaaacgctcaaccaccagctgctgcaacggtgcttcaaattggacgagtggtcattgctgaaagagagagaacggcattgcgatttgcagcatattcagaatgttcatcagtggtgacagagctcgagacctcgatccgtatgtgatatgtttgctacttaatacagtagttagttagggattgcatcaaaagcagaaaacagaatgcaaatgtgaggttgttaatgtgaatctagcgcaggttcttttaggaaaaaagatggctagttcggaaaatgaggacaggccaaggagtaggcaaatatactagaaggacaaaacagagagatccgagcaagatatgttcgattcttgctctcttttctactctgctttttgtttctttcctcgattttactcgcagatatggatagcaagcaggtttgcaagtaaaaggtacaaacagacaagttaatcacggtgtgatacgattatgacatcttggggcatcataatcagtggagagcagatctttcgccctcaaatatttgcaaactgtagccctgaaacatccggcaactatctgacacaacagtttgaaaatgaaaatgattttgacagagcaccaccgaaaaattgactactgatgtatcaaggctcagcaacaacaatcgttgcttggtgatcattaacatcacaaccaattgaacaggagtgacaaaggataatgacaaagctgattcttgaaaatgacagcattccactgatatctctattctagtagtaattactaggaaaacattttagtaataattagcagtttttttccccgcacagcacatagcaaaaataagttgaattagattttaatacccttccttttgtttgtataaacttaattttatattgtacacaagcatatcgataaattacaccgttataacgactcaccgcgatcaaacagtgcacatctatctctttttctctaatttaatgtgtaatttctaaactccaattttgccatttggatgacacgtgaactttttactcctaccgataacagaagttacaacgtgttgctctgccagtttctctgtcagtagtgttcggtaatcatcattgtcactcctctcttgttacagagaccaatcccaatgatggtcaggtcagatgatcggcggcggcgacgtctcccagacgtcgacgacattctcctcgttgtgcagggcgaagaggcggtcgccgccgatcgagaagtcgcagatggcgccggcgtcgctgccccgcagcgtcgacgtcagcacgtggtcggggccactgaacaccgagatggtgtcgttggtcgacgcgaagagctggccgccgtgcgcggcgagcttcgggtagcacgtctcctcgccgcgcggcgccgccttcttcttcctggcggcgagcttgctccgcgacctccaccgcacgccgccggcgccgccgctgctccggacgtcgaggaacccgaggtcgtcgtactggttgatcacgcagagcgaccggccgtcctccatcgcgatggcgtgcagcacgtgcttgtcctccagcgacgccggcgtgccgacgtcggaccacgaccaggcgacgttcttcttgtcccggaagtccagcaggctgatgaaggaagagtccgtccgcgggaacatggtcgccgccatgagcgtgctcgtgccgtcgagccactggagcttgtcggcgtcgccgagcgcgcagcccggcggctcgtagaagaagtcggcctgctcgccggtggtgcagtcccagacgccgatgccgtactcgttgaaccggcccttgcagctcgcgaagaccttgcaccggctgtcgaaggcgagcgccccgggggtgtaggacctgacgtggcgatcgtgcgcgacgcggaagcggtggcgcaggtcgccggtgagcgcggagaaggccgccacgccgccgtcgcgcctgccggtgccgggcctctcccgcgcggcgacgaggagcgtggcctcgtcgaggtaggccgcgtcgttgaccggcgcgtggtcgaggtgcacggcccggcgctcctccatcacccagttgtacacgcgcacggcgccgccgtgcgcgacgcagcagccgccgtcgggcgcggcgcggacggccgtcccgtcgcccgcggcgctcccggccacggacgccgccagccgcagccggtccccgtcgaacggcccccaccgcgcggcgcggacgcggtcgaggagaccgtagtagagcgcctcgcggcagagcaccccgtcggcgacgtggggcggcacgtggagcccccccgtgcggagcaggtcgagcagcaccgcgaagcactccgggtcacggtcgatgaagtactcgtccgcgccaccctcgccgtcgccgtccccgccgccgccgtggttccaggaggcgtcgatcatggcgccgagcatggtgtcccggccggcgctggcgagcgtggaggccatcgtctcgaacacccggcctccgacgttgagccgcacgcggccccgcttccccttcatggcctcgcactcgcggggaggtggagagcgagtggcgcgcgcgacggtttggtttggttggggttggggttgggccacgccctcgcgtcgcgcggctgcagtggtgacgcggggcgtttttgcagtgggttcccgtataaaacgggctcgcgcgcgtgccgggccttcaggtggcgggcgggtgaaccggcggaggatttgatcgggtcgcgggagacgtcacccaaccccacgggtatcgcggccgttgctttcacgcgagacgggggggagtggcgttcggggttggggattacggtgggggcggcgcgagcggtggtggatttgggggacttttggggcgcgtggtggcgtcgtctccgcgactcgccgactcgggtggcagcgcggtgaacggcccaagtgagcgaggacggggtacgagtccttgtaatggtcacgtagtggagtagaaagttgtgtttgtgtgggtcggttggagttggactggcacgttgcacgcggtcggagagcccccacgatcccgaaccactccccgttctaccaatgcgcaccacggcactacgtagttccaagctttaaaaagaaatgaaaagctccaacattgccgagtccaactagtgctaccacccaaagaatttgtataagtataactacagggcgctaagggcaggtacaatagcatggtataagccagctataagcatattttaaagagataaaagaagagatagaagagcagcgggctacagatctgtagccagttgcagcacggactctaagacgtaatgtgtgtatgacaggtgaaaccatgtattaataatatacttcctccgttttataatgtaagtcattctagtattgcccacatttatatagatgttatgtgtgtctagattcattaacatcaatattaatatgaaaaatgctaaaatgacttacattgtgaaacgaaaggagtagtaagcaactattgtatgaattagctattacattggttatagatgatttggagctagtaattggctatactattaaacttgctctaatgggagggcggttcacagttagcccagttccggaagaccagcggatgcggaatttactggagaatcgcctctcgctcgtaatcccataaagcacggcctttttgtcatttaacttccccgcaaataaaaaatattggattgaacttttaaagagatgatatgcactaacctaggatatgttaggcacgtagctcaatcatggccttcgtttcttctggctgaattcaggcagcctcacagctctgcaaaggacggaaaagttaacaacgctacgctagctgaatcatcatcctcatcatcaaggataaaaactgggactcaaatggcacatcccgcacgcgttgttgccgatccaagcgaggcatgcgaggtgataggatcacccgggtcccggggcgacgaaaaattgtgcaaagaaaacgacgcgtcctgcaaaagggaggtgagctgatcaagcatcgcacttactaggtcctatcctggtcgactccactgtcggataacattcacaatgtttcttgtctgacgagaccgtgttcttttcgtttttgaccggcgcaaggcagtgcatgaccccgttataaaacgacggcgaccatctattgcaaactagacatggacagctgccgaatcccgctatcgcgtctcggcttgaagagagattcaattccaatttcagttgactcttatgaagatatatagagtttactagtgtcaaattgaccagtaggggactgaaacattgcaaactgaacagtttagacctaaccccttgaccgatgatgcttcccagatgaccaacgaaatcataagccgttgtttctgaaaaattaggtgacgttcatcttgtaacgtgttagttgaccactgaacatcttttctgtcgacttggagatgggatagttgggagaaataatggaatagttgacctggttagtgtctgcctccgctatggcatgagatgagaggagacgacgagacgaccgaccaagtcaatactagttgataatggtcgtgccgtcatggacttggtagcccactagcccgaagaggaacaagccgtgtggcctcatgggtatgcactatgcagtaatctgaacctcaatttccagacgtttgtttccataggccatgtttagttcattggccaatttttttttaagtatacggacacacatttaaagtattaaacatagactaataacaaaacaaattacagattccgcctataaactgcgagacgaatttattaagcttaattaatctgtcattaacaaatgtttactgtagcatcacattattaaatcatggcacaattaagcttaaaagattcgtctcacaatttacatgcaaattgtgtaattgattttttttccacatttaatgcgtcatgcatgtgtccaaacatttgatgtctatttttgtccaaaaatttttgggatctaaacacacccatagccactgaacgaatgcacaggggccaattcttacatggactgttattggcttgttgttaccactgttaagactaaaatatagctatttctagaatacaaatttgttttaaaatgcaactatttcttcgccaaatcctctcatcttaaccaatctatccctatttaatttttctattactttctcttctaaatcaatcataacctttcaccattcatttatcctatctaattccttaattcctgtgaaaaatctaaagaaatgctttacatttaaggttgaagtggcaacatgcaatctctataagttgtgataactttttacgctggcctttatcgatgatataaatgattttcatccaattccaattgtaattaggagtggccctttaggtttctccttccattaaaaatgtacctattttatattttggtttttccaaataagttagttatatttgtagtcctccatgtatctaagatttaaatgaagagatatattaaatgtttgatcaaaactcaatgaactatcttaaaactatctttattacatgtaagataagttaatttctttttagttttagtaacaaagtaacatgtgcaactttttgaatgaagggagtagagctttaaggcttagccatacctctcatggataatgctggaagtgcagagcttagccaggccgtagtcagcttcaacatggttgcaatctgcgacagggagatcgctgcttccactggcatatataaaacgttgaacagaataacataagtacagaattaagtatgccaagataaacacaatgagacaacctgacagttgtgaaacaacctgcagagatgacagaaagcagttagcaataggcatgatctcccaaaagagacaatagacgaaaaaaaaaagagaagataatgtatactctactcgcagaggaatatgagctctgaaaaacaggatttcttaatggtgccaggcagggctgacagaccggcacattagctacaaaactcatttgctcatatggcctaaataaataagacatcaacaggctagctacaacatcatccgacacaactatgatgtcattggcctcttggcaagcatggggttcaaccaaccattaaaagttgcgcacttgcgcctaacatcacaactacagcatttttatcttgtctacaacccctagttaaaaccgctacatgcccaatcagttggcattccaataggtcacccgaccgaagagttacaaccacacagggtgcaatgttttaacaccttttgagactaagcgaaccttttgagtctagagagcgaatccatgtacaagagaaattagcgggtaacttcaagccttccttctgcgcttcttttctccagtagaagcgccaccagcggatccctaacttcaagccttccttctgcgcttctttcctccagtagaagcgccaccagcagatcccccctgctccacttcagctgctgcctcgccttctgcttccttctgcttctctttctcagctgagacattggccttagattcctcaccagccaccgcagcaccggcaacctttggctttcgacctggcttggctcttccttcacttggtttgctctcacccttcaaatccttgcctccgctgctagcctcctttggtttactggcactcttgttgctaccatcctcaggcaaatcatcctttgtcttctcagttgacttagtggctttgtcttcggatccttcttcagcttccttcttaaggtcactgccaaccttaggtgtctcattttcatccttccttgcagctttcccctttgatttgcttgaagttgccgagatgttacttttgggtgtaccattgctggaacctttcggacgacccctttttttgggaagatcgcctccaccactgccattaaacagaaacataagtctcagaaaatatgtagtcaattgtctacactgcttctttgattaccaaattaccttttaggtgtttctgcatttccttccttcaattgcactgagctccctcttccttttctgcccctaccccgtggcttcggggaacttgaaacaaccagtaacacaaatttatcaaacaaaataccacttgatgcaaataagtatgacaaattagtcacaggtttcacaattggaataactagggatgtttgtgggaatcccatttacttcacacctggaccaaacggtgttcaatttagtaatttttgagttaatttgcatggaaacgaattaggatggacccatgggctggcacaacccgacccagtcatccctagagaaaactaggaattattgggtgtttgtaaggaatttgctgaattcccaacacagtcaggacagcagacatttctctacagttctttttaccatggccaaattatgacaaaaaaaaacttagcctattcagcaagccaacatagcttataacaataggaggtgccaagcataatagaactcaagaaactggagagaaataaatcattaaaaaatgcactggatgctacgattgaaaaccagtgattgaatcaataaaaaacttgaactgtatagctaccataaatgcaaagtaaaaatgtgattttgaagttgcaggtatggaagtggtgtcaagataattcacttacatctcggaagccacatcaggggttttgtcttgttcctgatataacaactgctaattagtttaaaaaaaaggaagaggagaaagcagaatcacaacattaaatgcaatctaagcagaatcacaacattatgtgcatacctcactgacgaattcccacttttcatccctaaggagaagcacctctacatctccatcatcatatgcaatctaagctccaaaagtacaaaaaatcaaccatacaagaaaaacagaataaaacctttttttaccaagagaataaaacaatattttaattggcataagctcttcatgtaggtcatatatcccatgaaagcagatgatacaatgtacagggctcataccttgtgcctttttgaagctgtatcaaatgagtcaacaatgcccttgtaaaacctgcaaatatttaaaacaaaggacctcaaaattttgaaacaggatacaaaataacccaataaattgtaccaaagcaaaggacatgcctcatcaataatgagcaaatatattattatttgattaaaacatcaaacaggactaacctaaatactaagtcaatgttaatatatatacaccatttagaaaaagctacacagcagatttggaattagaacagcggaagaatagaaaggcataaagaagtaaaaaagatgagctagcaaatatgccgtgtgatgataatgtctatatatctggttagtttatatactccagtgtcaacatgaaacatggcaacaattgtaaaagatttagcatagagactaatgatcatatcacttacttcttgtcgtcaggccaccatacttggatccttgcaccaacaaggctagcatcaaggcctttattcttcctagaacgaggagtctgcagagggcatataaacttaagaataagaccaaaacataggagatgttaacaggtgtcttgagaaccaaacatcttcaagctcaactataattacgcttctaaaacattgttatgcattaagtgattttatcctaaatcacctgaataaactgggatccctattgaagcgtatttttttatcctaaatcagctattgaaggttgttacctagggtgtgcccagaaaatataatcaaatattttttaacacagatttttctaacacagaattaccagttttgaagttgaagttgttgcaacaaacaaatattatatttgagctattgcaacatcattctctacaagtcagattattaaacagaaatttagtaagcacattatcttttggcacaaaaagaaagcaacatgctaacttaaattacacctttatgagtaagcgatcaaatgaaatatgagcagagaaaagcacagcagacaggcaacagaacacagagaatcaactaatcaagaatgcatgcataatcaagtgcatacctcttgttcatcctcttgtgaccttttcctcttggagccattattgtcctggccttggctgcccttggtcttagctgaccccttggacacggactttggagagaccatttcctttattgagatagaacaaacagtacaacaaccagtgtgctaaaaagcaactgaatagatgctattaaattctatctgttttgaattaacatcaaagataggatcaaatcacaattgaaccacactaaataactcctatatactcagtgttatagcaaagtttacaagacaataacaggatttgaatcacaagcaactgtatcagtaaacaaaagctcgtaataccttgaaacagtaaacacactcaaaacatgtttcagatacacaaacatagcatgccagagagaaatagtattaacaaagactgaataatgcagcaaatcaatgctaaagacaggcagctttactaattatacaaaaaaattactactgacaagaaaattacctttaggctcagatccttagcagtatcttccttggagtcagtttcatccttctgtttcaaactgatcttttgttgcttttttgatgaccctgctccacttgcctttcttgtagatgacttggaatcatccttagatgactgcttcgataacttccctgttgaatcagtagtctcctcaacctttttcagacctagaactttctttccagcagccttcttctccaatgactttagtccaggaggtcgacctctttttgatttgaccatagctggtgagccatcaacacgttctgatgtttcagcagaagctccattggcaacctttgctgactgcttaacaccatcctttttctctgaatcgggattggataattccttgggattagcagctgcagattctgtgccttcagtaacaagattcaacatatcagcatcttttgtatttacagaacagtaaggttgttcaaggcttcaagcttatcctttggaggtgtccttaccattatcaactggagttgcaccactgccaatagcagtagtctgagtaacatcttgctccaactttgcaggttcctgaaaatagagatggcacggtgtattatcaaaagttcatttgtttagttgataaaaacagaaatgcagagcagcatacctgaggtagctcatcagaaatagtcctttcagaaagtttgccatcatccacctgaacattattaactcaatagtaagaatagatgaatccacatcaagagcccatgtggccaatttgttttccagtttcaacgataaggtgttgaaatgagctgtatattaagttctgagactaatattcacaccatcacaaagtacacccgtacactctatagactaaagccaatcacaatttcatcttccaagtgatccattccaatataatgcagagagcattaatgaattcaaggcgtatttcaaacatactaaaaaaattatacacataatgacctattctaacacctatgattatcacatagaagtctaaggtaaaaaagaaacatctctgaatattagttgctgcatgttagtaattcaactgaccacatcttttccagaaggatcagcatccatgtcttccttgacatctgaactgtcttcacaaattgttgcgataatattgtcatattcattcaaggaagtgcctttaagtaactgcagaaagaccggtttcagtttttcagagcatgcacctatcaccttctctgcaagttcaaaagatgcagcagaagtttcctggaaataaaaaccaaatcaattagatggtatctttttgtctgggtaggaatgtagattcatattgttgatgtcaagaaagttaaaaacatatatatgtaccttcagttcggacttagcatgcttgagcagacattctgcaatgggtatctcaacttcatcatcctcttcaattaccaaaatcattattgtagtcatacagtttgtaacattttctgggtgatttggtctgaaatatgagacaagggatttcaaattatgagtgtacatacaaagcatacaatgcagacattaaagtataatatctaacaaaaatgtgttaattatcaactggccaaagtagtaacacaagcaagttatttaggtaaaaacaatgtaatcatgaaagatcttaatattggcgatttagctcagactgatgactttaaatacagagtatataagaagcctataagaaaaacattgaataagatctgtgcagaacagaacagccaattgtataaaaaactatctgatattcttgttcttgaagaaccgttacaggtaagaactatgttaaggaaataaaattgactcatttagcattcttggagaacataatttagcaaaacttacttcaaacttatcatgagaactagcaaatatagatgaaattaagaacaaacgaagaggtacttacttcacagttgtgaagaagttgtgaaacatttgcagtatcagatcttcacactcaagatccaacatcaccacgcatagccggacctttgccacagtttcaaggattgcaactatccttcgaaacaaggggttctccatatcatccaatttctcaaaagaccccaccattatggaaaacacgtcctgaaccgaaagtagatagcacaggtcagatgtcaggatataggatatcaaaacaagatcatcttcatccgataagaaaaaggtataccttcatgacatcatcgtcatatggagtgtcaggtgcagtgatcctagttatctcagaaatacaggacaccacagaaagtttcacctcatagctagaattatccaacagctctttcttgatcaaagctttcattgctggagttatagcactaatcatgctttcagaaggtgcttgttccactttcaatatatatatttcggcctcctgcatgaacaaacaatcatgccaatcaaagatcagttttctagggaaccaagaagatcatatatgctcttaataaaactgtaatgttaaaggagtatggtgcatttacaggaatcaacaccacggcaaactccgtatatcaacaatccaactccatatgtcaacaaacacgacggaaaatactctagaaaaacaaatgcttgctctttgtgccataacggaaaatcaaacggattgcagagcagcagaaaccaaaatgaatctaaagcggaattccagtccagtaaaaatcacgactcccaaccgaatcaatcctcgcggaatggtatcaagccaaagcttccgaaccatcccgaaatcaaaccaaccatcccgaaaccacgcaatcaacaggattaataaaaataaataaatccaacaaacagcagaaccctgacaggagaggcaaaaaaaaaacgtttcaaagcgaacacaaacgaattccagcacagagagggttagagagactcacgtggatgagcttgagcaaggcatcgacgtcgtcggggggagactggagcttctccccgacgtccctcagcttcccctcgagctccccgagctccgccattcccgcgcgcgcggcaccccccgcgcgtcccccccctgccaccccctggatccggccgcccccgccccgccccgccccgccgcgcgagatctacggcttgcttgctagggtttcagcggggagggaggagcaacgccgcgcaccaccccctgcccacgcgcgcgcgaggcagcggccgacgccgacgacggcaaaccaaggtgacgggaagagaggagaggagatggatttctctatagctatctctgcctctctctctctctctctcccccacacccaccggtccccttttcccctccctccccccgtgcgagacgcgatttcggtgcggtgcggtgcggcgcaacccggaggtgggtggtggagatgtttggaatcgggcggggcattttatgggcgcgacccggggaggggttggggttgggcctcggccgccaaaaaacgaacgggagcggacgcgtccgggggtgaggagggttagggcgaaaatgtgcgcgggtttgtgcgtccgaggtgcgccgccaagttttgggggtctagcggacgggagtccccaggcttgtctgaggcgatctcggccgtcgctggctcgcgatggagcggggggcagggtggatggatggctggggaacactgctgttccacggccgccgaaaatggcagtccgtaatcctcggcccaggtacatcctcggccctgtgacaataggagggagagagagaaaataaaaaaattgactcaccggagtacgcgcgacacggcagcggaggcgttagagacggaggcgagtggtggcggcgagagaatgaggtgagcgggggcagcgtgacgaggcggtaggggtgcgctatgaacgagggtggagtatcgttgttgttggtaccggcattggtggaggggtgcgggggcagataagatgggagagagtgtagcggcgcggacgggtgcgtctgaaggtagaagacgacgttccgagacgaagggtatatataaaggcgggagagaatggtgaccgtcggattagtgtgatctaacgatcattgtttgtaactgtacgacgtatgaacctgccataaataatatgcttattttgtcatgacgtatagagttacgctcgacatcagcccaccgaagtaactttttgtgaagaatgtgggacctagaaatattcaaatgctagattgggcttggaaaaaaagctaggcccaagtctgattctcttccaggaccgcatctttcacaatcaccaagcctaggtccccatcgacatgcatcatttggtttgctcgtctacacaatagattggagcgcgaaactttgaagtatatataggtcatacttgcaccattctttggtacacaacttcatcataaggccaaaaccatctgttgcttgacttactccctattgaccgatgatgctctcccacctcttggtctgcctcttgtatcacctcttccttcatgtggttagaacaatgtcctacctgactcctctattggtttacaacaccgcaagacgatagaacccttctaacctagtataaggcctctacgtacgaaccaaaaggtttgttcaaattaagaaacatttattggttcaattgctcgagtatttttgcgctcacattcacgattgccatgcaagctcaacttaaatttgcgttgtagatacaaacattgggagaaaggcactttttcgaaatggtgcaacctaatgtgcattgctaaatttgcaatggtgtacatatatcattatatttaatgagcccatgataaataatgcttctttggtttatcaatgtttgactctacataatggacgtggatgtggcacgccgtcaaatattgatgattagagtctagatgtagtattcctactctgtcgtgttgtgtatcataacacacttgaagtataggaattgatatatgtgtgttttaaattgcaaggtttcttatattccatccattcctaaatagtatacaaacttctagcatttgaatcttatttcaaaatataagattttatagcacagttcactgtactatttatctcatcaatcacctcctattcaaattttattcccattttatcccctacctaccctctcgcctccactcatctcatatttattgaggacactaaagtattttcctcttaacacagggatggaccaaaaatggaccaaggtctaggccatcccatcaaagctttggcccaatccatactatttatctcatcaaccacctccatttaaaattcattcccattttatcccttacctaccctctcagctccactaattacatatttattgagggcactaaagtcttttcctctcaacgcaggggtggaccaagaaatgggccaaggtgtgggtcgtctcattaaagctttggcccaattcacttactatttatctcatcaatcacttcctattcaaatttattcctattttatcccctacctactctctcacctccactcatcacatatttatcgagggcacaaaagtcttttcctctcaacacaggggtggatcaagaaataggccaaggtcggtgccatcccattaaagctttagcccaattcattgtactatttacctcatcaatcatctccatttaaaatttattcccatgttatcccctacctaccttcccacctccacccatcacatatttattgagggcactaaagtcttttcctctcaacacaggggtggaccagaaatgggccaaggtatgggcagtcccattaaagctttggcccaattcacttactatttatctcatcaatcacctcctattcaaatttattcctattttgtctcctacctaccctctcacctccaccatcacatatttattgagggcactaaagtcttttcctctcaacaagaggggacccgtaaatggaccaaagcccgggccaccccattaaagttttggcccaacaaagtattatatggtggaatttgaaagtgttctatggacctttcatcctgggcctcgggctgtggcatatgtgacacatgatgtatgtttgcccctatcttaatattaacctctgcttaataacctagaaatctttttattttgaaacggagcagcatgctctatctctctagcaacttacactaatctcaatgcaaagcacaatcccaaattattgataaatctctaaccggaggccgaaggctttctcttccagataggaattatgtttttcagtactgtgtgaaattgggattcggatgcttcgaagagaacgtagtactggcctagctcgacatgattgatgggcatgatgattggttagggtcattcaaggctttcatcgacaaatcatgcatgacacatcaatccatcttgtctggattgttcattaagggctggtttggtttgaggcctaaattaagcttaccaatatttatcaatttcaatagtgtttagtatctatttggtttgaagccaaattttgacatgcctaagaaaataggccatttcaatagtgaatttagactattttggcttcaatccaaacacaactttaccttaccaaaattattcatgccaaaacttgctaaaatttggcaccaacaaaatttggtaaggcctatttaggtcacaaaacaaaccaaccctaatattcccacaccttgtttagttccaaaataattcttcaaactttcaacttttccattacatcaaaattttcctatacacataaactttcaacttttctgtcacatcattctaattttaaccaacttctaattttaatatgaactaaacatagccttcatcgacaaatatttgctgctcctactgcaattggagacgagacaccgtgccttctcgaccaatgtgcttgaagttggagtcaaaagttcactttttaggccgagtttagttacaaattttttcttcaaacttccaacttttccatcacattaaaactttcctacacacacaaactttcaactttttccgtcacatcgttccaattttaaccaaacttctaattttagcgtgaacggatgagagcccgtagtttcccactcgatcggaagttcaatctcgctgcgtgtctccaaagtttgttggaacgtttaaatcggatttcctctatccgaaagattacaacttctgacagggaaaatctacagctttttttcgaattaactgaaaatccccaccttgaaagttcgttttgctcatgtgaagtaacaagcgcatagcagtaaaatacgccaaacaaaaatctaaaaatagatgatggccgagttagtgatctctaaatatttcaagaatccccaaacaaaagcttcgaaaactcaaaaaagaacaaataaaattggagcaaacagaactctctctcagtctcactgaactactgaagaacgagtaatactgcatgatctgaaaagccggcatactgacaaagttcaacctatctaattattatttattcatcattgatcagtacacattttaccaattaaaccatgaactaaaattaagcacgtgtaagagttcatttccattaattcctgtaaagcacagcattacaaacacacaatcacctcaagaacacactcacaccaaaagtccattttattctccactgctactgaaggcaaattcatactatagctatacatcgtcgtcctctgatccatccatcggccgctgagaatttctcgatcatttgccgaagagcgacttgaaccaccacgtccccttggtgtcggtgggcgcggcgtcgctctccggcggcgggtcgtcctgcggcgtcttgcgcagcttctcgacgtcgtacccttcctccttggccttctccagcagccgcccgtacacctcgtcgtccatgctcgtctgccggcacaggatccacaggtccttgcgccgcggctcgccgacgagcgcgtactggtagtcgtcgtcgacgtagagcacccagtagtcgccgacgacggggatgacggggaggaaggggggcaggtagaacttgaccttgagcttggcctcgtcgctggccgggtcggccttgtaggcggtgcccttgatgtagtcgcgcttcccgctgctggtccacgtctcgttcagcacgtccaccgtcgcgccgtcgggccgcagcgcgtacgtcgcccgcgtgtcccggccgtcccggggctggaagaagttgggcagcgacgcgatctcgtaccaccggcccatgtacctcgccacgtccagcccccgcaccaccgtcatctcgctcccgctcttcttctccaccgccgccgccgccatcgtcgtcgtggtgattgtgttgctgtgacgatcgatctagctgcgaactactgatgttatctgtttgatatgaattgccaacttgagctgagttgagctaattgcaaggatgagtgtggctatataggagagggttttggcctcttgggggggttgggtttggagaagaactgaagaagctagagaggttagtatagaggataagattactacgtggagggctctggagcgcttaaaaacgagcgctttggtttggttgcttgctccttggggccggccttgtgctatacgtggagacttgcacgtgaagctaacttgcatggacgtactccgtacatctcttttactgtgtgcttttggcggttttctggccgttttcgtcggtaacttgggactggggttcaacctgaaaatctgaacggcgagtatcactgcaggattcagagaagacagtgatctggtttcacacattcccactaggcgctttccctgctacgagtacgagtacaaaccaccggaatgctcgagagcagtccagaacgacccctatggtgatggactgatgtgtgctcggcagatagctttggccgagtctggccttatttagttctaaactttttctttaaatttttaattttttttatcacatcaaaacttttctacacatataaacttttaacttttttatcacatcgtttttaatttcaatcaaacttttaattttagtgtgaactaaacacaccctcggtgtgataagcatgttttccttgctccccaaggttaaaactctttctagcacaaaagaggtagtagaagggtacagtctacggcatggtagattgccagtgtgaagcaccgatcgtaatcgaggcttggagctttgtccgtgtcgctgtccaccaaggtaagaaggtaagggtcttattgcttgcgctatcacttataccagtttgttgccaaaatttaaattttgaaacttttgatttagatgccttttcaacataaattccttcaatattggtttttaaattattaagaacacatatttaaaagttttattcatatttttttattactagttaataagccgttatggcttatataaagtggtaagcaaccaatgaggacctaaatcctattgcatcggatatccggaaacatgaacgtccttttcgttgattttatagcttgcttacgtgtttccatggggttccaatccttggatggtttcatggcttggttacgtgtttccatggggtagttgttgacgaaaaaaatcgaacacatcggcctgagagatctgcttagctccagtgcaggtccaaatcttgatgaagtgcgggcgtgccagtcagtttgatcctgcaactgacaagatatgcaaatagtagatcaaaacagccgatcggctgacaagccgatggagtagttctagccgataatagccgatgttgataccagccgatagcgatagggtttaagcaatcggctatatgtccaaagtagataatgatataaaggcaatcagctgatgatgatgtaataaaataacaacataaaccaatcggcaaataatgatatgataaataagcatcgatccgaaggttaaagcacacatcggctggaggtccgatgtcatgaaatccacaagattagattaaacagtgaaacctttgttgtcatcggctaaatccaacttatatgtatatgcaatccttatgagccgatgcaacgttcagataactcaccgactgaaaccccgatgaaaccctgattggcaatcaagaagcaggctagagattatggttctaagcacgacttagtagatcaaacttaactgatgcagcactaagtatgaaaagaaacataatatctagacaatcaagccgttgactgatttttcagggtggtagatgcctaagctaatctaatctagcaacacaatttagccaataccggcagaaaccctaaaatgagaagcagccgatagagctaaattgatatgctaagactagattaacagagacatatgataaataggtaggcaaatataccatccaaatcagagcaatccaagaggtcgaatgtactgatgcagccttgaacgacgccgacgtagacgatacaattgcctgggccgacgaaacattggacttaccccttagccagagatcaaacaccgatgcagccccgcgtcaggtgccaagtcccgccggacgataaaataaagtagaaaaggtaaaaggtggcgatgcgccgaattgtattgattgtagcgatagattacatagaccctgggtgtacatatttatacccatgggttgatacaagtccttgtcggacaagaaagaaactttcctaaagataaaaggaaaagataaagtccttataggacactaaacacactttcctaaagataaaaggaaactaacaaactattcctaattaatagataacttgccatgccgcattctcttcgaactcagtctcttctggataagctttctttggtagattagtttccttaaccgaatatagcaagaatccgacaactgacgacttgacaactctcatcggctaatctcaggacttcgaagccgatgctgactctaaaccaatgactactccgggcttaccaaatttcactgttaacagtagtagatacgaaagaatccagaaagtcatcagagtaagcaacacctccgttttagattttagaaccgcaatccccttcatttcccacaatcatgtttgtgtacatgacacatgaattgcacaacaattaattcaacaatttagaatcgcaattcctacacctctctttcaacagtttagcaccacaattgaatgttcagtcattgatactttcttcgggcaacagtgaatgccttctttcctgcacccttctttgaccccactaggagcttaggatgaccttcaaaacattgagcctcgcaatcttggacagtggcctgcatgggcacattagcaatgcagtcataaccaacatttagcaatctactatatgcaagaaaagcttttaatgatttgaacctcgatgaaagttgtgttaacaaggtacattttgtggtatagtcaatcaagcatatgcaaatatttagataagtttggaatcgaacaccctatgaccaaatgaaaatactaattttgaagcattttttatatgataggaaatggtattaagcatagtgcactagctttcttttacctgcactgcccgatgatcacatgatctcgttccctcacacgaaagcatggggaaattaatgttcgcattgatattagggtgtctcttctcatacctatcgatggaaatggaaatcatttttacaacatcatattatgtgactacgtacccaagtgaaaaaaataataattaaaaacaatgtagacttgcttgcctctaatacttcttgacaaagtgaagatagttcctacttcctacaatgatgatagtcctgttcattttagcattgtgtcgtgttctagcttgcaataatgcaactactaattgttaaggtaccggtgaatgggcatttcttatcaatgtaggttcttagaacaagcaccaaattaaggacatgtaaaacttaattaagttcaatataaatttctactccaatactcactctatcctaaaatataacaacttttagctatgattctagacgaacactagttcagattcataactagaatttttcatattataggacgaaggcagtacattatataggtaaaacacatcaagaaaattactagcaaaacaaggaaaatagacaaaataattactataacaacaacacaaaaatgaatgaaatcaaatgagcttttagctagatttgtcaacgatgaaaataatagtcacaatttacaaatgttgaatgcaaaaataaaatcttcaaagttaatatctatgtttagaagaacaacgagagcatacatttagatgaaactttgagaaagaaacacgagcacaaatagtcctgagaacaaactagaaagctatgttgcacacaattattgggagtctaggaggcaacaccacatcaatggcgtgacaactaaacaaaagtttatataaaaaaaataacaagcagtgaagaaggatagcgcaacttcaaatgagaggccacaccaatggacagttaagaggcattaattcaaactcaaaatgaatactccatccattccattatacaaggcataactgttttttttttcaaaagttctataatatagggcggcagatgcagcagcaccactccgttagtctcgtccacgcacatgcatgcattgaaggcagttgcatcggcatctctttgaatcccgtaattctcatccgcgcatgcatgcagtaaacactattcgttagtttgctttggttgttttaaagacccctaattctgcggtaattataggagcttccttggtttttgcatccaaagaagttacgccttgtatagtcaaatggagagagtactagaacttcagatatagggtattagatatcctaggaagaactatagcatattttagttcatcaaagaaaaaaaactctcaagtgagcatcccctgcaacactaagtcactagccacttgatatagatcacacttacaaccaacaaaataacaacatcaaatttgttgaagtcacataccctatatgatgtctaagaggaccacaattgaaaaggtatcaagccaaaataacttataaaatacaagaagcgaagtactccctccttccacaaaaagttacacttattactttatcaccaatactaaggagaaattaaatcatcttgcatatatgtaacaaagatcaaggagtatatgcacacatgcaaccaatcagtattaagatgactcctcaagtttagttcaaacatttaatttatctcgccatttaagttttggatgcatagagactgcaaatacgaacaacttatttggaaaaactaaaatatgaaatatgtctaaatcttacatgtagagagagtactaaagaaattgaagaggctatcaagctcttgtggatagaaggagtattgaagaaaccgaagattttataaaaaatgcattgttttccggtttgaaaagtacacataagatatataataaaaaacaaaggggacctcaatagaaataatcgaggagttcttgttattatggtatagtacttctaacatggcatataaacccatacattcaaggcaaaattatagtagacttttaggctttagcaaaaacaaggaaaataatcccagtgcccttatccaggacgtttgtatttccagttctccacgctccaaatgaaaaaggaacaatttgtcttttgcgtgtatggttcccactttcccaggtccactacaaaaccggggcaagtccgcgtctcacgaccaatggaaacgcccattaatggcaagcttagccccccgcgctaatcgcctcctcctactaattccttgcgtctcgcttcggccaccgcccaccaccacctcctctcgcctctcgcccccgcatcgccgcttcctccctcccccacctcacgagaccgttttttttcttttttttttgtgttaccgccatggccgccgcgttgacccgctcgtcgtccgtccgttccgccatccgacggctcggatcctcccgcgccttctccgcatccgccgcggcggccccgcgccgcgacgcgaggggggcggcggccgcggcggtggcggtggctgccgggtcggggctggggatctggctgctgccgccgtcgccgcggccgctggcggactccgggcaggcggggaatgaggtggcggcgttcggcgacgtcgcggaggaggaggagcgggaggagaagcgcaggttcctgttcggaggtgagggcatttgatttttgttttttttattgttcatgcgtgttgttttgggttgtaatgcgggcgatttttggcgcgtttatggcgggggagagcgactgggtttcattcccattgttttcgtcgatactaattttgcgtgaaaagcgaatttgtccagtagtattttgctactcggttattcgcctctgaaaaattttaaatccgctattttacaaacggcacgatgattttcgtcgcaatgtttcctcgaatgtagactcgtatcgcagaagggtgttcttcaactacgagaagaggattcggacgcgcagccctcctgaaaaggtagcgaccaatgtgccatattcagagcaattttgtgtatacacaacatgacatgataattcttcttggtttgtgtagtaataattgtgtggtgtttttactgcaagatctttgaatatttcgcgtccatccggaacccagagggtgaagtttacatgttacccgccgatttgatgagggcggttgtccccgtttttcctccatctgaatcgaaaattgtcagggaagggagtctcaggggagagcgcaaccctggcgagctacactgtgccccgtctgaatttttcatgctgtttgacacgaacggagatgggctcatctcctttgccgagtaagtagcgactcactgatttgtgtccttaggcgtggtatctaatttcagaaccagacagaattgtttgcacccggcacaattattgtcatgtagtgatttacagaaaatgcaccaggttctattggcaagtagaacagtctgtttgctagccatattgggtttgaatcctcccttaaacacattgtgtggaccatacattaagttgccataagcataacgtcattgcaactaataatcaccaatgcttagatatgaacattttggttaatgagtgccactggtatggtatgacattaactttatatgctgctctattgttttattgaatgaaggcagaagtaacttgatgaatttgctgaaactgcttgccatgacaggtacatcttttttgtgacattgcttagcattcctgaatcaagtttcaacatagctttcaagatgtttgaccttgaccacagtgggtaagctatcctccagctcctcgacctggttgtaaacttataaccaaatactgtgctcttcagatctatatgcatctattccttaattgtacaagcaccttaaccattttcattaaaaaatgtatttcacttacaaattttagtttgaagtgtacttcattaatttatactaactgatgtttctttaattatgatggctgcatgtatattctatgatagcatccctacattctcttctcttgaatggacttgatcataccgtgtatagagcttacagattaccagtatgctactatgctccattgccaaacccccattcatgatagaaggaccttacagtcttacacacgagacctaaggaatagtccacccatacactaactatatatgtgcagcatcattctggtataatcagttttcccctatagcctatgccaaacctcaactctaggagtcctgcaaacaaattaatgtcattggtcactggcgaatgtatatcaaattctcagttaattactatcaacattgcatgcttgcaaggttgccgggagctaaataagaaagatttgacagccctaatctattcacttatgcatttttcatctaatttctgaactttattatttgctgaagcctttaaaggtactataagtatactatccccttttccctaggatttacacaaggataaattgaatatattgttgtttacatgtgacaattcatgtgcagttaaatttgtggtccagaaaagacctgcttttatgagcatgttcaatcatctcacttgttagttgatggtaaagaagggtatggacaatttggcaattttttttaatgctatttctttactctaatctggcatttgaatttcgcagggaaatagacaaagaagagtttaagaaagtaatggcactgatgcggtcctatcataggcaaggagctgcccatagggatggtttacgttttggtcttaaggttggtcagtcagtggaaaatggtggactggttgagtacttcttcggcaaggatggcaatgaacagttacgctatgataagttctccaattttttgaagcaattgcatgatgaggtgatttttttaaaaaaaattcatcctttgttccaataacataattatggttccgaactatcttattctgaatgcaacacatgagagacttgaactgaaagctaaatattttttttgtactttcatcctttgtttcattaacatcattatggttccgaatgatcttattgtggatgcagcatttcagagacttgaactaaaagctacttcctttcccaaaataagggattttgggtggatgtgacacattgtctgtctagattcatagcacttcgatgtgtcatatgcacccaaaatcccttatattttgggacggagggagtaaataatttttccagactatctaatcacataaggaagtaaaggagggtaggaaataacacctcgacaacccacatgtcacatccctaatataattatacaagcacaacatttgctgaatttccttgtttttatattttgtgatgtgttgccactgaagaacaacactatgcaaaggtcaaagtccaatgcctgtacattcattgatttgttttgtcctagtgtaattggagaactgtcattgtgttcttgctctaaagcagcatttcagaatccatcgaaaaccaaaagtgggatcaacaaagaaacataaagttgagattataaaccccagaactactataccacacccaatgtgttgtacattttatagaatgccccagtacaacataggggtaaaaaatttacttgctgtgtatttgtgtagcgggtatacgcgtgattaatctgttattgcctctggtccggtttgtcatcattgtatatacttgatatctcataatttttcattcaattatctgcagattgttcgcttggaattcagtcactatgatgtcaaatcatccaagacaatatctgtgaaggactttgcattatccatggttgcttctgcagatatgaatcacataaacaagctacttgacagagttgatgattttgatgattatcctgatctcaaggatttgcgcattacctttgaggtttgaaagtttgctatccagatattccaattgtagtacttgggtttaatgtctctctttatcatcataattattacctgaacttcaggagttcaaggcttttgctgatctgcggcgaaaattagaaccatttgcaatggcaatcttcagctatggcaaagtaaacggtttgctgaccaagcaggatctaaaacgtgcagcaactcatgtaagattcttcataattccgtttatttccttttgacataagatgtagtctgaatcagctaatgttaatgtaagtcttaagctattttggactatcactggcttgtttcatatttccagccctgtgctaactgaacagctaggtcctaggtcttgggagtaggaccttcccaagacacccacataattggctgcattttctgattgactttacaacattttttataggtttgtgaagtggacttgactgataaagtggtggacgtcattttccttgtgttcgatgcaaaccgggatgggagccttagcgcagatgagttcttgagggcattgcaaagacgagaaagtgatattcgccagccagcttcttcaggtttaatgggagtatttacctgtttgttgaactgtacaaagtgttctcttcagcagactgtgatctagtaagcctcttgataacccccaaagtcgtcctctgttgcccttggttacgacactccttttgatttcatatgctatacttgctaaatataaaatttcagcagcataattcagcttgcataaggttcgagtttgtgatgtttctttgccatgcgcaggtgctggggagcgaaaacgaccacccactggagttctgcaaacacgattttgctgtaaatagtcttgcttatcaaagttaccgaaacatgtagcagctgcaaataacatgtttcgcactaagcccaaggcttcgctgacagaactctactccactaatgtaaaatgaacctatgacatggaacctcgttaactgtctacgccttgattcagttactatatccttacatgtctacgtttggatatcaatcttgttggtaatgactaaatatgcaaaaatgaatcggtgataattgtgatctctatttggtagagaagctttcggtatgggctacacgacttgcaacaatatacatgatgttgagattaaggggcctaggttgttactaccacattttgtgcctaccgagtagtgactagtgagtactaaaggtctattgggaaaatataaagtgtggacatatgttgatatatttggtttttgcctttttgcaagacgttcctcccaagtaattgtccctttaccaacgaggggacctcgatatcccctcgagggatgaaaatagcttcccctttaccaagggggggcaacgagcatgctgaaaaacactttactatctatttttgaacataccgaaaattaaaaattaatgatgatatcgtcgaggaaaaacatattacacacatgttacacgcagataaataatcgacagcatcgactgatcatcagtaggggagcctgacgttgagccgcctgagccagatggagtggagcaccatgtggatcatgtcgaaccggcgcgccgggcggtggagcacgaagtggcgctgcgcctgcagcacccgggcgcgcagcacccggtacctccgctccgacacccgccgcaggatggccctcagctccggtatcctcgccgccggcacggccaccgacatcttgccccagtccagcacgtcgccgaacggcggcgggtagccctccgagatgatcaccggcacgcacccggcgaacacggactccaccaccctcgggctggccacctcgaagccgctcgggcacaggcagaaccgcgcggcggccatctgcgcgtggtagtcctcgccggcggggaggtactcgtggacgcgcatgtccccgtcgccgtcgccgtcggcggcggcgccgcccttgttcccgatcagccagtgccgtaggagcgattcgcggatgtggccgtgcctgccgccggcgaagaaggcgagcgtggtgcggttctccggcggtagccccgcggtcgggcgccggaggacgccgtcggcgaggtttacctccggcagcgtcgcgtccttccgcggcctgaacccctccgacgtgttggcgttgcacagcacccggatcgcgttgccgtacagctgccggtgcgcgctggtcaccatcggcgcctgcgcatcaccggccaacttagtttcagtgatatgatcgagacacaaattaattaattcttgcaggaacaaacttagagtgcttaaatgttgtctaaataatcataatttttttaaaaaaatattaaaaatatagattaatgtgaatatatcactttacaaacctacaagttcaaaaattcgaattcgttttctataagttctaacaaaaataaccgtttgaattcgatttctataagttctaacaaaaataacaaatataactgagaatatatgttaacatgttcaatttaatttgttgtttttattataacttgtagaatcgaaattaactttgtatatttgcagtgtgatatatctcatattatctatcttattatttttttatatttttataattatttaggtggtaatgtaagaatcaaaggatatcgagggatgaattaaaaatccatctccaagtggtccatacgtacgtacccagtcgtggcaggagacgatgacgtggtcggcgccgcgggagcggttccagtaggggtagcgctcggcgacgacgcggacgtagtcggcgacgaggccacgcagcggcgcgaggtcgccggtggcgttgaggcggtagacgtagtggacgaggttgcagacgctgatggggaggaggaaggcgtgggcgtcgtcggggcgccgcgcggcgaagcggctccgcgggtcgtccatctcgtacatgaactgcccctcgatggagtagatgtcggtgcccggcccgatgtgcgccaccggcggctccccttccctgtacgtccagatcttgaacctcctctccatctccacgtagctcctaatcgcaaatgcacatcggtttttgcaacaacggtagaggagtggatcgatggatcgacggtgtacgtacgtacctgtggaatgcacgcgcgttgcggtagatggcgccgcgcggcacgtagtcgtcgtcgcccgccgcggcgacgaccgtggaggctgagccgcggcggcggatgctctcgtcggacggcggcgtcgcgcgagccgcccggcggatggccgcccgggaccgagctaagccggcctcgatcttgcctcgcgtcacctgctatacgcaccaagccaccgatcaatgcagcgtgattttgcagtgaacattttccattcgcgtgtcacgtggcgacgtgcgcgagtaaattaccttcttgttgattggtcgagcatggacactcgtcggcggcgccttctggggttcgtccgggacgtgccgtagtgagtgctcgctgccgcggccgtcttggatgccggtgccggaggaaggagcgggcggcagcgcgacgccggcggctacgacggcgaggagtgctaaggcagtgagcggcacggcgacgcggccgctctgctccatggcaatgtttgcaatggctaagttagctgctgctccactcgtttgaattggcacgcgcatgtggccacgtttgaacggtaggccgcgatatatatatatatatacgtgttgcgtgtgcttgagttgactgatcccgtgatccgcactgtcagctcagttcgttacaatcgccggtgcctcctgagtttacaaaccttcgaaaatgtgcagcgacaacggcaacctatcgtgatctgcagctgtgccgcagccattgtgcatttgtgccggactggactggactgtacatttctgctttggtcatgttcagaatcttaggacgtgacggcctgatgggcagcgaaaacctgcttaccgtcactgctcctaacacagttgcaccgcctccatgcgttctacgagctgggaacatatactgtgcacatttcgtgcatacgaattagcaaatgtcacagtaaaaaattagacacatacttttaataatgttatgcatacatgtgaaattttatcttcaaatttattatattttaaccataacaaaaaagacaattctgacagatttttactcttaaaaccgtcaaaattttcattttttttatgattaaaatataatgaatttaaatatactccctctgttttttaatagataacgccgttgactttttctcacatgtttgaccattcatcttataatttatgtaattataatttattttgttatgagttgttttattactcatagtactttaagtgtgatttatatcttatacatttgcataatttttttaataagatgaatggttaaacatgtgagaaaaagtcaatggcgtcatctattaaaaaacggaggtagtaacactttacatatatgtgcagtactattaggagtagatgtctgtttttttttagatttgctagttgatatgtacggaaatcttgtatacataggatatgttcacctacgagttggaggtaatccatacattgtgccccatcgttcattccgtcgccattgttcccgtatccaaatgttggtctttcccctgtcaacggtctaagtgcttctgaatagcataatagtacgttgtccaatttattccttcagttccaccctgcatgctattagtctaataaacctgcagtaaaacagagcaaatgagagacagagagccaatgcggaagaaagaagaaacccaagcacaatgacatcacaaactgccacagaaaatgcggcactgtacaccacactacacataagcatcccacaatggcgaggaagcgcaatatttacaattttgttccttcccgtcacgccttggagggtacacggagtgaaggaaatacaagtaattttttcagtacttgaaaacgaaaagatcccgataaacggagcaggaaggacctagtaaatgctgttgagaatagtcccacattgaaagtttagggggagtggcaccaacttaaaaggggaggggtccctcacctcatgagctagcttttggggtgtagaaaggctttctcccggttgggccaacgtctcccggttttaggccaacaaatgctaccatagactttacttattaatctggcttcaatccaggcccttgcaaagctatctacatgaagccatccagatgattatttacaggtgatcatgtagtgtccagctactcgggtcgaacgcttatcaggttggggagcaccgtcgcctgcagcttcttcacctcacttgtcgtgaccctgcaggaatcaagcgacagcgagcgcaggttctgcagatccttcaggtggcggaggccggcattggatacacgagtgttggagacgttcagcgagactaaagcagttaagcctgcaaaccgggcaatcatgtcatattgtcatgtgataacagcacagatagacaacaatagagtgggcacatagggacgtcatatttgacacggaggaataataccagaaatcagctccagggttttgtctgtcaggttaacgttctgagaaagattgagttgcttcagagctttgagatccttgatattcttcactccagcatcagtaattaacccaccgcagacttcaagagattcaagattcttaaaaactgaaatagcatagatcatgttagctgatgtgccacgtgaacatataggattcagcagatgataatcaatctgatatttctgataatgctgctaaaatcatatgccactatgcttataagacacttatctatagatatgtctacttgacagggttcagagggagcaaaatacatttagtaccaagtgtattgcctagtaccaatttaccatggtacagatcagaccgataaatattggacgaaaaaaattgcaagctcattttgttgtagctaacattaataaatccattttgtattgacattgatgtagcattgtataatgtagttgactcttcgaggtacacaggtacaaccaagtaatcaacatagatactttctagatgattctaagctagccgaagaccaaattcagagagtcgtctcaataaaatggacgcaattatgcaatttagtataataattctaaaattgaaatagtttcagagtatgcccttacatctgaagcagcttgtgccatagtccgttatcctagcaccaaaaaggtccagatgagtcaacccagtgagacctgcattacctcccaaggatcaaaactaatataaagtgtcattgaaattaggatttgcaactactcgctgcatgttaatagatcaagttacatatgatcttgcaaaattacaccaaaacccccacgagatgcaaggtatcaaacataaataaaaaacaaggcatggaaaaattcagcaaatgccacacaaattcataatcagtgagatccaaaacaaagttgcgaagaaaaaaaaactgcagctagcagttagcgccaaccaatactgatcattattatattagtgcaattcgtacaaaagaagtatcatgcattaccaaagttgtagcatataatacatacttgtaagtgctgctaagccaacatcagtaatctgccgattgtcaagattaactgacttcagtgaattcagtgcagatatcttcttcataccggtatcagtaactaacgtaaacgagagattgatgctttccaaattccgaaggcctgtaaaagtttaatagctttccaatcaaatgcttcaaatgcccgtgcaacgacaaccaaatacagataataacaaaaataactgcagaggatttgtgatgtagcaggttgtgccagttaagcattataatcggattgagaaaactgtacaaaaatcgttgcacaacttgacaagttttctaagatgatcagacataacaaggatacgatgagagcatgtattaatcatttcacttttctgaacattcactggttgcaaacatattattcagtaactgttcacatgctagatactacaaatctacaatacatgcagtaaagagattaagaaaataaaatgataaaaacaatcacaagatgcacataaaactgtagcattaacacatttatgttttgccacttgccgaaaacacttcataaaagtaatcttgtacattattcatgccaaagatgcagaataagtcctattatccagtgttttacaacatgaatgacattgcatggcacttaactgctaaaaagggttagagctagaaatattattgttcataagtgaaaacagaccagatagatgctggagtccactgcttccaacttcggtgtcagatagctccaaacttttcaaaagcataaggcctacacataacataaggcatatatagtcacagtaaatagatcacaaatgcaccaacgagacaatgataataattaataatcagcaaaccaagtaatgctcttaaacaactgaatgtacaatacacagaaaagcagttataacaggtacaggctgacataaatactatagacacaaggaacaaagtgcggctgacaactgtatcgtactattgaaaatcacaagtaacaagaaaattaaactctaagctattggcttcaacatgttttgggagcaaaattgaaaaggtaagtttttttttttttttgaaaggtgaaaaggtaagagtgagcagataattctaacaaattatgtaagagtattgaaaaatgaaaatgattaaaaactagctcacctctcagatgtaataagccttcatctccaaccttgcatgagtccaagtttagagattccaaattgatcaactctagaagcagcaaatgttaccagttagctacccaataatagttgtgtgactttaaagtgatatttcagtttctatgtacacaacacaatgtaccacaaaataccatgctctatcttctttttctctccagtctatgataacattcttgagaaatatatataacatatcaatcagtataatgcctcttttattccaataatttggcattgaaagctcaaaccacaatcaatttgccaatttcaaaattgcatggttaatattacgaacttctaccagaaatgtcactgtttcatgataaatatcaccaagttcatttctccatccaaatatatttttaaaatccttacaggaaatattcactagtgcctactggctaacataatgaagccagatatattgcttaaacaacagagaaaaaattgactgcaccacttatatttcctgcataaacatccatattcttaaatgtaaataaagttctaacaagaacttagtcttacctttcagatgtgctaaacaatcatctgtgatattattgaaccccaagtttaaaaccttcaattttttaagacctgcaaagcagaactgttgtaatgaatagaagaacagatatgcagggcataaacttttcgagctggtgtcaaccaggtggaaacataatattaggtaattctgtcaacaattattttcactagagttcacgtcatcagttattacaactgccagtgtataacaatgacaaaaggttccatggataattatatcttgaacatacaaagctcacaaaacatccttccagcttttatgcaaacatcgttcaatgcccccatatttactactcacctgaatttacttaaaacatgtatgttggcattattccagtttgtcagcagttggcattacaattaccttgaaagttttcacagccttcaccgtatatgccacaccgactcaaattcaacaccaccagagaagccaatcctacaaaaggaaatgacacacaaggttgtgtttttatggtgttctctagatgcaatcaggtgctttgaaagaggtgaacactgccaccaattgtagtatcccaatacactattaagaaaagttgcaagacctgatatagcttccaaacaggcagcagtcactggacagccctccaaattcaactgtgttagcttggacaagcctagagaaaacaaatgacaaatagaaaacatgagaagctttagataaggtcagaggtaaacaattaaatggagatcatgagtacacccataaaacgcaaaacagaaggatgactctttcgtcttttggttgttcaaccattaaaaatgaaagatcaatgtcctaatcaagaatgattaaaattatgggcctgtttacctctaagataagaaacacccagatcagtgattctacaacaagccaattgcaattctttcaaatttgtgagatctgcgcaaaagaaaggtgcttgtcagcctggaaaggatgagataaagagtgatatatattccttatagtttaaaataacaatagctcaatttctataaaaagtggagcttaaaaagcaccttatacagttatactatgtcaagcaggaatatcaaaggaaataaatatgggatcccaataaatatatgtgctgttgttacctgataagtatttgatatctgaatctgcaatgttgttacaatatctcatattgagtgactccagattcctgaggcctgtaaaaggataaatgcagccaatataccaaactatcaatttctaggcagttgaagttgcaaccctgacaggattatgacattcaggtagggaggggaggggtgaaagccaaaaggactacaaaaattcaatttagaattctacatacccacagtagtaagcatataaaatgtgatgtttaggagctgaggtaccttttaagtgaacaaggccaccatgaatctttaggcatcgttcgagatcaagatttaccaaattaactaaattagcaaatgcttccattgcttcagcagtaataccatcgctgctcttgaaactgagagatgtcaggtttgaaagacctggatatttaaaaggcatgaatatctagttcaacaggatagttaacatgacaaacagccaaaacattcaagaactatacaaggaagaaactaatctatctaataagcgatcaagtgggttaagtttctcaaataaggagtttaattatatactaacaatctgttccaaaaccatctctgttgtaatcatataatcttaaggcactgctaaaagatttaagctcatgcttaaagctctccaagatgacccaaattagtcctataagagcatgtctcagtaagtagcatgttactgacctgacaagattcctaggccatgctctgagatcatatcacagtaattacatgccaagctttgcatgtttggacaatctctaagaagatataacccactatcagttatttcagagcaagaaatgtcaactgataacaatgaatgcctttgagaagccactacttccatccaagcatcattcactccaggatactcccccaaatcaatgtcctgattgtcaaacgtatgcagtatttgttatcccacggagaaaaactcagccttatatagacaattatcagatgaccttcccaatacaaaagctaattatcaattacgcatgctgagaaaattcgacttccaaataaaggaagtgcaattaagagcctgctcttaaataaatatatagtttgatgaaactggttccatttgttactttcttgctaaagtataccagctcttcttttcttttttttggtgaggaataccagctcattgttattgtaacatcattcttttcttgaagtcttgtaagtactcatatgttacaagaccaaattatgtgtcatgcctgtaagcatgaacaatcttacctgtagtgcacaatcccgaaaagtttcaagcaatgtctccgtgagacggttcgacgctaccaattcattaaaaatctgctggctgagatccctcggcaatacagaaaaactagaatacttgttaatatcctgcaagtaccaggacgttaaacaaaaggcaagtgaaaatggcagcatccattggtgaaatcaaacacattagacaccaaagtacctcgcaggctttggccacacaaagctccattagagatgggcaacgaccagggccctttccctggcccttgcgggagacatcggaattgctgcgtggcagtgtaagcagcagccatttcaagctgctggtctttgagaacctggaagatgtctggaaagagtcatcctcgtgcactaattggcttctcttccttgagcagacagcacccattataagtgtggaagtattgaacaaaacaaatcacttcgtctatgaactccaaagaatctctatgttcagacacaattttgaccatgaatgcaacttgtaaccatctgtggcctagtcaaaatcctgggaaatcatcgaataacttccattccattctgccacatgaagataccatagtgttactgctggtggtttttttacaattagatgaatgctcttagataaagatcaactttatttaaactattttaatcatgcatcgtactatgtgttccccattcccaatgacaaaaaaaaatgtcatactaaaatagaaacacatcgaaaccatacaggcgtccggtttttgcgcgatcctatcaacagaacaaaatacacttaaggatcatcggttccattcagaacacgaacaccagaaccctcgctaagtaaagccacaaaaaataaaatccttaaaatccaaccgaattaacagaaaaacctcactcaatcgaaacgcaactggacccgagcgccgatcagaacggcgtcgtacaacctcaccgcaaggccaaattactcccccagaaagctagcggataaagttaaccccccgaaaaaatctccaaaatcgagtgaagaagcaacagtgcccaaactaatcccgcatcacccgcacacgcaacagaaaagaaaatcccaaaacagctgcgcacggaattctcacccacaccaccccacaccggagctcgccaccgagc

SEQ ID NO: 69839 - DNA, 1810 bp, Oryza sativa
ggcgtatcctcctcccccgtcgtcgtccttccctccccgctgtcactgccggccgcctccgccgccggccagccctcccctctcccctcccccctctctctctccagggcattttgggcacaaaagtctctaaagtggcatttcatcctgtaggcaatgtattaagtggcattttatccggtgcattatattgagtggcattttatccaaaccaatcttacagagtgtcatattgtccgttttctcataaaggtagacatctcaatgcttcgctggaagcgaatgctaggtacaatcaccagcgaagcagtagtagctacgggttaagtagctagaatagctaaatgcggaggcgtcgagcgccgctaatgcggatccatgcacgcgtgacaataacagcaaccacaaagccctctcccctcagcctgcttgcagctagccttgcactgtgtcccttttcaaagcgacaaagcactcacactctcacacactcactgcactgtgcagtgcaagcgtgcgtaaatgaaatttcaccaccaacttccataccggcatagtactcatcaagtctctctcacccagttgctagtgtacctgtcaatcactgcttgcacatcatccaatgttcagtcactgcatctgcatgctgttctatctaccgagcacgaggtcacctgtaattaaaccatccaagccctacgtgtccaacaactgcgcgtcgtcggattggtcgagaacccagaacggacgccgaccaaaaaacggacgagacgggagcgacgcacgaacggacgccttgaaccgcaccagaagttaattccgtggttgtttccactttccaccagcaagtggtcgacgactcgacgggcaacgagctagcgaccgagagcgaagcgacccgctgtcccgcttgcgtcggcgacggagtccggaattccggataatatagggtaagcggctatgcgtgcttttggtctggaaacgcatgtgacggcacggcaggtaggcgacgcgaacgcgagcttccggtacgtaacggcgcgaacggtatgtacgtgaggtgggcgttttcgccggtagcttgcggaagttaggaacggtttgacgcgtgacgcatgacgaagttgggcggcggataggttggatcggaggggataagctcatatcgctgtttagatcgggaattcggtccgcttttggtccgatccaacgaattctcccctttgccgacttcactctcaccccatttcttgccgcgactctgcaagtgggttggtcgagcggctggaggggagatgccatgttttgttattccgtcctccaccagccggcaacagaggggatcaaatcaaagaaaatagagcccagtcacgctcacattcataggctcatgctaatctctgtttcacatcattttggccccgtttagttccctaaaagttttttttcaaaaacatcacatcgaatctttggatacctgcatgcatgtatcattaatatagattaaaagaaaaaccaattacacagttagggaaaaaatcgtgagacgaatcttttgagcctaattagtctataattagccataagtactatagtaacccacatgtgctaatgattagctttatcttcaacgcctactagtacgaaatccaccctcgcaagcacgcgtggctagtagtactccggagctagcaaggggcagggatcctgttctaacatgtggtacatcaatataggccctgtttggatccggaggtctattaaatagccctccggaatcttactatttaggagtattaaacttagatta

SEQ ID NO: 69840 - DNA, 752 bp, Oryza sativa
  unsure (1)..(752): unsure at all n locations
cgtgatttacaccatatggtacagtagctcatcaatggagcggcctaaagtcctgagttgataatattgtaaaatagatttaggaaaccgataccgtattggttaaggtttctatcttgtaatcttgccccccatcctgtataangtgggcaggaggccctggtgggggcatgacacaaactgatcgtcagatcaatatacacccggcggattcaaatccccaaacaggagtagggtattacctctcatcgagagggcctgaacctgtctaaatcctttgtctccgcatccatccacttttaggtctcatgcgctacccccttttcatattgccgaaaatttgttttgacagttggcgcgtcaggtaggggttgcgttgagctttccatcgagaagtgcgatggaatcaatttctggagatgtgctgagatcgatctcaatgagttcgacggtttcaaccttcatctcaatgagttcaacggttttaatctgccactcggtcggcgacctcatgtgtcctgctgatgtaattccgttcgcgctctgtaccgatctacacgccagcataggttaaccggcagtcttcacgcgagaagcattgctgattaccaggggcatataagagcagccgattacaaggagctctgagccatacattgatatatacatatgnctatatacatgcttttatgcttgataacagattaatctacntaatcgtttctttgcatgtatgtatatgctgaccaaga

SEQ ID NO: 69841 - DNA, 5681 bp, Oryza sativa
cggtaatctaagtttaatactcataaatagtaagattttaaaggactatttaatagctcggaggatccaaataaggccatagatgtgttgcgagactgctggtgccggtggtggagcagtagagtaggagtagaaacgtgctgggggcggggacacggacagcaaaggtggtcgctgtcggcgacgacgacgtgacgctgcgagcctgcgtcgacgagagacccacccaaccgttggttatccatcggtcagccgaccggatcggcctgtcgcgttctcggctcgatcgttcgcccgcagccacagccccgcaggtgcccgtacgtggcccatcgcggctcgaatcctgcgcgcgaacagcggaacaacggaagttcatgcggtgctccgatgcgatcctgggcgcgtgacgatgatcggccggggcgcgtgcatatgcatgtgcgtcgcgcgctgccatcctgcctggcgcatcagacggaccgcggtcaggcgcgcggtccccgcgcaaggaagtgaggaacaacaccgtggccggtgtttagaatcccggaacgttattttgagcttcaaaccatttgatctggtgtgtgcgttggataccataattttttcccaagccaggagtagctaggaagttctaggaacaaacatggagaaatgggggatgtgaacatattccgaaaactatattttcttatggacaaaataatctgaacatgcaaaaaatcggtggtcttgggacggactattggtgccatgatgcctaacatcgacgtctagagcacgatgctgctccttcgacttcgagtgattattcaaaatcgagaattgacatatgcccaccaagtacgattttcaggtttggcacactgtctcatttcaagatttcagtcgccacgcgttcacgttgattttatttttttgacagccatttatatttgacttagaaaccataaaccttaggccttatatttagttaataggttagttaaataatttctcgctcgtcaaaggacatctataaatcttaatcattcattattcattatgtttcttccttttgatcataaccttcactcatttttctattccagtcccactcttcttaccccataatccaaataaacccttaggatgggttcgttagtgttggttgacaaccttcccctccaacatgaaaaacagagcagctcattaacatataattaattaaatattaattaaaataacttgaaaaatagattaatatattttttaaaacaacatttctatagattttttttttacaaaatacatcatttagtagtttcaaaagcgtacacgcggaaaacgaatgagaggagatgggaacacaaactgatgtgaccatcaagtatatgcatacaatcaagcatgataaatataaaacatcgctaaagaatacatcggatgaatggatgatctacaggatattaaagtccaatgagttttggaatcaagttcacctccgaagacagcagtgacttcaaacggacctagtgcattcatgccaactctgatttgagtggtcatggacttgatggaaagcttatctcgtcacctttcaaacgcatccggtctcatattcaaatttatcccgagtcaacaggaatcatcaaaataagacagtattgttgttgaaaccgaacttgggccttgggccttgtaatagactaagcccatatcggaagtgtctccctccacctccacaaattagcaattaaccctagatttattttcgtctttaaatgtctatgtacaccctctgtaacaatagggttttgtttagttgaattttgccaggtgtcattcaccttggagagaatcccttatttgccaccggaaattggtctggtcccttgtatgccattgaaaattggctcttcccttatatgccattgttccaaatttacgcaccctctcatgccactcccgtctgttgactgcgtgttggtagttaactctcaagtaaaaaagacatgtttgcccttctgagttgttaggcatgtcctaaacttagaagggcaaatatatcttttttacttgagagttaacggtcaacaggcgagagtggcatgagagggtgcataaatttggaccagtggcatataggggaagagccatttttcagtggcatacaagagatccgaccaattttcagtggtatataagagattctctcttcatgttgtctctagtcctcattagttggcgactattgattcagagcccccaatagttggcgtgttgatttgccggttcctcactcgattagtcagcgattattaattcagagccccaatagttggtgtgttgatttgttggttcgattagatctaccacttcaatcacaactatttctctgtgcttaatcacttttccgcaatatttagattgaatcttatcttattcttgcaatgttcactcgtttgcattgcagggatcatcaaccatatgtcacggttagtatgacatcgtttgtggtgtaccgatttgcacggcgtcctcgacttgctctggttgatagctacgtcacaaacgtcacactgatcaaagtgagagttatcctctcaccagaagatcaggccatgagagagagcgtcatcataaataaacaaacacaaccttagtacagatagcttatgctaccatctactacctccgtcccaaaatataagcatttttagctaagaacctgtgcttatattttaggacggagggagtactatcaatatcagttctatctcaagatatactggtttagtttttcggacgtgtttatatgatagctgtgagtgtatgccctgttcttttctccaacaacttttggattaaattttggatactcgtggcacgcttttcaaactgttaaacgatacgtttcgtgtgaaaaggttgttctaaaatatcaaatcaatccgttttttaagtttgtaataattaaaacttaattaatcacacattattaccactccattttgtgtgaaacacttaattttaatcttcatcttcatcttcaggagattcaaacaccacctttattttcttaaaaaaacccagttctatctaaccgacattttacgcccagatagaaatgggcctatcccacactattcatccgttggcccaatacaaatgggcccagcccacagcgccgcatttgtttcgaccgcttcaagccttggatgctctgctctgcccttgcattcgggcacaagaggggtggcatctctgagcgggagccacgcgcaagggtccagagcaaacgctcctcatacgacagagagagcgtgacagcgcgagggggttcggaggcgggagcgggcgacggcggcggcggcgggcgccagcgagcggcgaagggcgcgctggagatgaaggagaaggggtcgagggcggcggtggacgagcgctacgcgcagtggaagtcgctcatcccggtgctctacgactggttcgccaaccacaacctcgtctggccgtccctctcctgccggtaaaattccccgcatctcctcccttccttcctcccttccggcggtttcccgcgcgtctcgtagccatcgtcctccgtggagatccatttcgggctagggtttttgggggactgtatctagggttttagggcgtggctctgcttcggtgactccagatctgtcgcttgcatggtgatttggcggggatggcagtggggtgaggatgtcccggccccggttgggatgttagggtttttgggacggggaggttttgtgggatgcgactgtttgtttgagtttggtggtggtggtgtgtgtgttttttgggggggggggggtgtgggtcgattcttccgtgttcatgtaatgcttgctgatgcgagtctcccttcgagattttatggctagtgggttgctgttcgtccatttctgtctatatagtcgatataatagggtcgattcttccgtgttcatgtaatgcttgctgatgcgagtctaccttcgagattttatggctactgggttgctgctcgtccatttttgtctatatagtatatagtcgataatatgattacctgttatgttttagagttagattgtcatgctttatccgtgcctgttctgtgttgagttgtgacatatcatcttgtaattcggtttaaagctgtgcatgttggattctgtcgtgcttttgaccttcaatagtggttctgcaactaacgatttgatcttctcatcattaattgttaacaggtggggaccccagtttgagaaggctacctacaagaatcgtcagcgtctttacctttcagagcaggcaagtgctcccaaaataagttgttctttttctttcttttgctgtagggatgttttgaagctcaaatttatggtgaagtttgaattcagatatgcagatgggtcttcttagctagaaaatttatgtattcttagttggatattaaactttagcatttgctaaccatgtgattgttgcagacggatgggactgtccctaatactctggttattgcaaattgtgaagttgtcaaaccaagggttgcagctgctgaacatatatctcaggtttccacttttttcagtgacccatttgagtttgtaaaatgcagaatcatgctacgtttgagatgaatggacatagctggtcctttttgcagatttaattgacccgaggtgtcagcttcccatcttaatgtaatcattaatcagagatgtggacctgtagtaccaactgatagtttactatgcctaatctgtcttattaaattaataaaaatgtcataactcgaacatctagatttgcatgacttcagtcttgtgatagcggtgtatgagactgccttacattggccttaaaaagacctgaattaggaattccttgcactaacttgaagtctgtttacaatgaaactgaccggatgtctcttattttttgttgcagttcaatgaggaagcacgatcaccttttgtaaagaagtacaagactataattcatccaggcgaggtacaagctcattcaatcgtgattgttgatttctctttccttaacttgaggatcattgcctctgtatgagatcttccatgttgtgtggtgcatatattggctataaactttagtggtttagatggcttgcttttcttttggagatagtgcttgagatgtgtcttttatttgtttaaccccgtgtccccgtcaacatttatttaacccaatcgttgatgtattgtttctgttttaccatggacacaggtgaacaggattagggagcttccgcagaacagtaagatcattgccactcataccgacagcccagatgtatgcctagaactttgtagtgctgcccgtttcttgtgatcatcaatccctaagcatttctgtgatggatttgtagactgaaggcttttttgttcatttgcaggttctcatttgggatgtcgaggcccagccaaatagacaagctcaactggcacagatggagtctcgtcctgatttggtaccacctgactctcgccctgatttggtatcttttcttattttcattctcaacctatatcattttgagaagctgaaattgcagcttcatctggtgtatctgcacacaagtcctaagaaactgtgttatggaatcatagaatatatctgaaaggttttcatctttcatagtt

SEQ ID NO: 69842 - DNA, 1412 bp, Oryza sativa
atctttttttttccatgcgtacatcatattttaagatgatttttcgtgtgatgatacatgtcatagtgctgcagatctctgattttttttcacatttttttgactttttggatgcatttgtgatgatatatgtcttagagctacacatctctgaatcgtctttcaacttttttttgactttttaggtgtattttttagctcagcagtacgggagcacggaactgttccatagcacctgatacttcctcgggtggtctgacatgtataacaacaaccttgacatgtaagccccaatattttctgtttgtttactacacgtggcatccccgtagcgtactactgtaataaaatcatggtataaacagacctaggtataaattgcacggtattaataaaaaacaaatcgaaatacgatgatagggagaaaataaaaacaaatcttcggtgaatagtaaagtgacatgtttgaacattgttgaaggacgaatttattgtttttttctccctgcgtacatcatatttttaagctgattttttgtgtgatgatacatgtcttaaagctacacatctctaaattttttttgaactttttttttgacttttttggtgcatttttaaagtttggtagtatagaaacatgaaactgttacgtagcacctgtacttcgtcgggtgatcatcacagcaccctttccatcgaagtcgttggcttctcagccctgggtggtagtttcatggccacagtcaccgcagatatcgctggcatgtcgactttcctcttgagcgtctttctgaatacggcggcctcctcgtgcaagataatggcgaaggggacaaggtaagccacgaacatgacggcagctctgacatgtatgacagaaaccctaacatgtactccctccgtcccaaaaaaaaaaaagacaaaccctggtttccgtgcccaacgtttgaccgtctgtcttatttgaaaaagttatgaaaaaattaaaaagacaagtcacccataaaatattaatcatgttttatcatctaacaacaatgaaaatacgaattataaaaaaatttcatataagacggacagttaaagttggacacggaaacccagggtttgcctttttttaggacgaagggagtaggctccaatattttctgtttctttacaagtggcatcctcagtagcatactatctatctatctattatattattaaaacagctttgaaaggagacaccacgttcactgtggggactaaaaattcccacattaatcggagaaaaggaaaaaagagtccaagtagaaatacaatctaaaaatagctgaaattcggaattaaaagtaagcaatattgaaagaaaagtccatatagcaacctaatacgaaattaatcaaaattcagaataaaaataaaataaa

SEQ ID NO: 69843 - DNA, 17124 bp, Oryza sativa
cacaccttttgtatttattcacatattgttctggtgtcaagacttttttgtgtgcgcatgtgtgttatccttaacaattacccctaaattattttccggttgatattgttgacttttcatggtcttcacctcttcagtgttcgattttgatgtgtgcaagggtccttgaagttgagaactggctttgttttgttctgttggatcttgtacatgtgagtcaagataggtccatgcctaaactagcttgcagatggaggtgacagcaccattttaacgtgcagaataacaaaaagaatagaggccaatcactaaattaggcatattgattactatgtaaaccagctgctagctagcttgggtttgggcctaacttgaatcacttgctaaagtttatagacttggaagttttgttgccaagttcaggggacacgttttttctctcgactcaatgtgctgctgtgataacttggacttcaatacgaattgtaataggaaaagacaaatctgttgtatggtggagcatccaagaccacatatctgcactgggagattcctcgaaaactgaatcttctccaggggcatcaggaagcaagggaaaaactgcaaatgataaggatagtcctaaagttgatcctcgtggtatctttcttggccacgacagtactgttgaagatgtccagttctgcccttctaggtattgcaccttccccttcatgttattaaatgttgtctctctagcatgtgtatatgttgtttggactatgagcttcagtggtttgcatggcctaaagtttttgtcttggctaatagtcgttctttatgatgataaaacaatagcagctatcattattgtgaacatctgctgggaacttggaatgcatgctatattttgatattgtatgatctatacttctatcaatttatcttcacagtttatttttttttattttttgaagtgcacaggagttttgtagtgtaggcgatgattcttgtcttattctttgggatgcccggagtggtacaggcccagctgttaaggtggtgctcttctccattttaagcagattaatgatgctttacgtgaaaatgagcagctcaattctatgcaccatgttgaaactggtttattcttcatttccaggttgagaaagctcatggtggtgatgttcattgtgttgactggaacctccatgatgttaactatatcttaactgggtatgatggcatgaaatgtttctaaattctaaataatatgtaacatgttctttagtgttcatttggtacaagaagccgtggatacacttcttgatagtgggtttagctatttacacatttgagtaagatggtttcttttcgtattcagttctgcggataattctgtccgtatgtgggaccggagaaatctgggttctggaggagctggcattccagttcacaaatttgagggtcataaagctgctgttctttgtgttcaggcatgtacagatatttattgttactatattttttatgcacatttggttactgtcgtttattttttttgtgcctttatgctataattcaaaccttgtgtgtttcagtggtcacctgacaaggcatctgtatttggaagctctgcggaagacggcttcttaaatgtgtgggatcatgagaaggtatctttctatacaattcgttaccatttcagtcatctctgtcatggccctgcagaaagtttggaattgggatgggagttcatgctccatttgtccccttcatttcatgtactttttaatagctttagattcataaaattcttttgatgcaggttggaaataagaaaaatcccaacgcacctgctgggcttttctttcaacatgctggtcataggtatgctatcgtatgatgaaatgtaaaattttccttatgtgttgtaatatgcgtaactcaataccatattccttcaaatgcttaataccacatcagttggctttttattcctgtcacatttacgagacattcgtttttacgacaactttaggttgcatcactgtgcattgcttttctgtttctgcaatgagatatttttcctaagatattttcattaattagttttgcaaaattgaagatgggacttgaatcctctttgaactggtgtttgacttatgctgagagacacttgtgcaattgcaaatttgaacttaagaagcctaagacttagagggataaatcttgattatggtgtactctgtatcttagttggtaaggccattataaagtcagcctgtgctttctccacctttggaataactgttatggttcagaacaaatggataatcagtacatttgtaagtagatcatatttcagtttttcaatagatttatgctacagcatatgcatacaatgttagctctttttagtttccacatgaactgggcactataataaattgaggggaagatgtattagatcttaaggaatgatacaactgttatcaaagtgattgctgttgattttcattgtatgtattccataaataacgtattttgtgatatttttattggcagggataagattgtagacttccactggaattcttcggatccttggactattgtgagtgtgtctgatgatggtgagagtactggtggaggtggaacattgcaggtgtgtttctttatttttatagtgccagacacaaaatgggactgtactcatatttcattggaatagtgactgctaccatgttgtcttttatctgatattatacgtcagttgttcttatgcatattttatttgtgtagatatggcgcatgagtgacctgatataccgtccagaagatgaagttcttgcagagctggagaacttcaagactcacttggccagctgtgctccaaggagctgaatcgtgtgactatctgtgtaacccagtcctgtaataactctagtaggtttctaatttcttgtccatttagaatgttcctttcaaatattggttatatcctctggtgcggaacccaggcttgtacccttcaagtgcttgtgcgactcttttaccttactgtatcgactcaaatcggtaagctagtgcaaacacagcagagcagaatctctgtgggcagattatttggatgctaaacattgttctggagtctcgtattggacctagttgtattgttagcctgacttggtgacttaatcagatggttcttcagatagatctgtccaatagtaatgtagccttgaatacgtctgcttgggctattccttgcttgtggtatatcgttgcactggataccccagtggaagcagttttcccgcctctaaatcttgtcggatttgaacatttggtccaatgccgcgttgttcttgaggtcgtgcgttgtgcatctgagttcattggtatggtcacaaatccaaaatataagtgtgcttgaaagtcatgttacaacgtcacgtgggagctttaatttggactattatcctggttactcaattgtcaatcacggccgataattgcctcatcacctcatgtctcggatggatgcatttaaattgatgggagtcctgtgcccgacatgtgcctatgaatattatgctgggagctcatatgctgcgggacttcgtctcggcagctctactgacgttaataagtgcgcggttggttgagtcaggttgacctgcttaggttccgatctggccactggatggatcagagcaggtctcgcggcacaccggcacgtgacgtgaagcaaggcgcgcagagtctcgcaccaggtgggctgatatcactagctggacggtcaatccacgtggtttgttcattgcctcggaacggatgttcatccgactgtgcagacttggtggtggctcacctgcttctcctgctcgagcgtacgtttcaacgccaactcattgccgcggttgcgtcaaaatgatgaagcgaaatgtgcttgacgcattgttcatcagctcatcgcagtagtcggcaagagaaatctcagtactccaactccccgaaatgcttgttctatagtctagagtagtaatcttgtgatttgttcatgacacaacttgacacggtttgggtttgccacaggagaagtttctgttttggcagacttgagacgatcaaccactaaaatacaacagtaaagtattggataacggagtattactaaaatactagtacgctgtacacggcattatttccctggagatggagcaccgtggccggtgcaaccgacgcacgcacgcacggtgacgcccctccctgcgtcgcaatgaattgagggctcatgggcttggggatctccaacctgtcacggtgggtgacggggtggtcggtcgcgagcgcacgaggaggccctctcatacgcacgccgtttctcccatcccccgcaactccgcaagcattcctccctcccatccaccacccgcctccgcgcgccgcgtgccctcagcctccctgtatatttaccacgcaccagtgcaccacgccgagcaggccaacgcccagctacaccacgcagtcacatccgcctcaacgcaccaagctcttcccgtgcacgtgtggtaggcagaacgtgcgcggcgatctcgacgaaatggacgtcgcggcagacgcgacagcttggccgccggggtggtcgctggtccgcggctacttctccccggcgacgctcttcctcctgctcaacgtggtcatcggcaccatcgcgctcacctcccgcgcgtcccaccgccgccgccaacaccaccacgacgagcactacaaggcacagcaccaccatgaccaccatgatgagccgcagcgctgccatgatcagtacgctccaccgccacccgcgccgctcgagcgcacgtcgtcggtcatggagcggctgcgctccttcggcctctaccgcttccgctccggcgacttccctcccgagtacaacctctccgccgccggcgccaacgccatctgcgacgagagcgagaagcagcaggcgcagtacacccggagccggtcggagcctgctgctcggcccgcgccgccgccggtggagaagagaggcaaggcggagaacgctgccgccgccggcgccgccagagcgaaggtggcggtcaagaagtcgtcgagctcggaggtgaggaagctggagcgcgccccggcgcaggcacagcggcaggtactgcaagtgcaacgcgcgcagccgccgccgccgagggcgccggccccggcaccggcacgcgccgtgaagtcggcggcgagggaggaggtggagaccgcgcaggttgggctcgccaccgcgagcagcgtggacgcgagggcggacgacttcatcaacaagttccgggagcagctgcagctgcagcggctcaactcgctgctcaactacaacgagatgctcaaccgcggcacgtagctcgatcgcgcgcgcgcgctctcaaaccgcggcgccggtgcagatgcaaaaggcggctcggcgacccatgcgtttagagtggtcactgtgtacgcgttgtttgtaaacggcaattagttttcaattttgggtgtttttgaagttcatttatctcgtgtatgttcgactcaggtagtactcgaatttgcccgactcgagagtcgtggtaacgaggcgcccagcgtctgaatctgttccgtgtataattcaaagcggaaagtctagattaaagtctcactgaaacaatcaagtatgggatgtgtttggcagaacagcccgttcccctcttttggttaaggcttcagaacgtcgtcttctatctgtttgggccctttcaccgttttcacgtacgcttgatgtacctgggttcagaactcggatgactaaaaccgaaagcaaaaataaaaggctggaccatcctccataaactttggtagtgagttagtggctgcggccaatcgctggttaggcaggacaggaaagcaggcgagactcgagaggaaactgaagaggaaggttttcgttggggtcggagtagaaaactccgaatcccttgcacccagttccctagcctatccagttcaacaaacggcccaatcgttctcatggtccaaataacggcagcccatctttcgggctgcattgcttgtcaccgaaataaccgggccgcataaatagcttggattgggataatcgttcagctacaggcagagtgcagtttctcataaatcgcgggtaaacggaagccggaggagctccggcggatgaggcggcggggaacagatgctgcgacctgctggctgctgctatctggtgacccatggaagcgatccaactcggactaatcttgatacgggtccagagcttttccatgtcccggcttggtcgacgcgagcttttgccacggaaaggagttgtacgagctgttggatgaacggtttgtgttgcgtaggacattttttttccaaacagggagctgtatcatatatcatcattcaccagcgtgagcgcgactagtaaccaaggcccgctccggctgcttgcatgcaaattcagtgtacctgttcggatttgtcctttagaaccaaattgaaacgatcattatcgtctctcggtttccacttcgaatcttcaacacgagcttgctcaattgtatggttcgtgactagtacgatcgatgaacatccagtcacgaacgcatctgacatacggttcaaattcgcatctactcgccgggccggcgaaagccggcagagttttattaagaaagggagagtatatagtgcaaggcacagattacaacttaattagttagccacatctctgtccgaaacaacacaattcgcatctctactcgatcgagtatatatggtatgggctcgtctgaataattgttgaaatctctaccaactatacagtggctgctgagtgctgacgtcctcgttctcatatttccggtaccaatctcgccgtggcgacagcaagcaaattagcaaaagaccatcgtccttgatcaactccggcggtaggtacgggcctgcggccaattcagggaggcgagactcgagaggaatcgtaggctaggcagtcagacgagagaaagctcggaaatatggttttggcggagttcggagaataaaactccgaaccccctggaaccataccaattgttgttcctaacctccattggttgtctctgatataactgcaccggcataaaaagcctataatgctatcaaggatggtaattccggcacatctcgatcgcctggattggatcagtacagacggttcaattcccagaccctagagtctcactatggtgctctctactactactactggtagtagaaaaaaactcatcggttgatctcatttgatcaaaggatttaaatctatttgtactaccacccaattagcggtagaagaaatgtggagagatattattgtaaaaagaaaatgtgaaggggtataattgttatttagtagcgatggacattttctctcttttttaagctttttcgatggaatatgaccgatgccagtggaatggatgaccacaaattgatctagatgaaatgtaaatgacaaaaattacccctaatcactctattggtaaattactaatttatccttaataacaaacggttcagatcatttctacttgcagtataatactagcataatataattttattttgtttcagtagcatgtttgcctaaactatcctggaaacggaatgcagtcactatggggctagctctatcagctagtactgatttggaccaaagacctgaaggtagtatttttaagcagattcaggaggtgtataatcagtttgattcttgttcaatctcggtctacacaagatcatgtcacaaggtagcagattgttttgctgctttatggtgttaatgtgctgccggttaacgcacgggagttctggtgcaatacacaccaaagatttgtaacggtccaagtagttaattgaagcctcatttcaaaaaagaaagaaagaaagaagtttgcctaaaagatcttagagaaagaaaaaggaactcatccgaggagaaaaacttgaccaggaggctcaatgaaatgagtgatacaatgtgggagaaattggcggctcaccgattcgttaaaaaaaatatgggagaaatatcgtaatcacggcatcaccttttctatcttgctgtctttctttgcattggatcttacaccactagaaggcaaagtagtcaagaaaggaggtcacgcattcccttctttctcataaacaaacaaacatctctttttgtgcaggagtatatttttgtttatgtttcatcttccatctggactaacataaatttgctggaccaatggtcggtaggcctcgaaggctagacatgcataattgcatatcaagatctggatcttattagcaaagtgacgaaagatcagatcagtccaagatcttcccctgtcatctgctttctgcgtcgcaacagatttcctgtattattaatcgaaccaatgcatgcttcctgcatcgtcgcagaatgtgattcgaagcaaagttatggctgtcatggattggtcaatcaagggaaaggagatggctgtcgtcgaacctttggccggcccttccccggaccaactgcagcagccgaatcaaattgctgtcattcatgcactacaagtagtactaggcactactgctggtgtagggtatctcgtactgttttgtgccatgttgatgttcctagaatttcatcttctgatcaagtatagatagcaggaatcttgcagaaaattctccgcaatttcataattaacaaacagcccaaatctttgcaggaactagtagtaatctggatagcttcttgcatccacattatttgcagcttatagattattcgatcatgagcaacactggagcctgcacagcctgaagcccgaacagatcgaacattgtgtcatcgagtatcgatctcagcctgtggaatcatgaaacttcatccaggcagaacaaatctagcgtgttaattaggtgtactcgtttgcatcttatccccttcaagagaataagactaacattatgtcactcgactaatgtttggttattacttattagtgttagtaacgtcaccgatatcgacgtgcaagaaattgtcttgttaagccataggtccggccaaaggtggttcaatcgagtactatagactactagtacgatagacagctcttggggaggacggaggatactctgtcaaatgtcaatggagggatgatccatgttactatgtcgtggtcttacaactcaccggtttgacacgtgtcagaaacagacaaaggagatgacaatgagcaagcaacgctcaatgttgccatcgtgtcttctggcgccaaatgacgccgtaatacggcgggaaatttcaaagtagacactgttttgctgaactcaccagtctccctagaccaatacggacatggattgacaatttctctcgattcccgaagaggtgaagagagaacacgttttacacatgtactagaagaacacatcacctcctcatatctcaattttatctccatacctgaagcaacatggatcgccaaaccggcaaattaagccatatccaaccacgtgaatcacaccattgtttgagatgagcaacgcaaatcgtgatcacaagggaaaaaaattgctacgtggtgtgattcgctccgccgcggtagtgttgcagcagccggttagcctcgcgcacgccgctcaggtacgcggcgtgcgtcgttgagtagtgcgtgcggtgcgtcgcctcgccggcgaacagcagccgcggcgacggcggccgctcgtcggcggcggcgtctggcccacgtggcagcggttcggccatgcgatcgaggtcgtcgccgctcgatccgacggccacgtagctgtatgacccgaggaagagcgggtccgtggcccacccgctccgcttgatcctcctcaccctccaccgtggcgccgccgggaggaaggagtccagcgtggcgtgggccccgcggatgacgtcgtcgtcggggagggactcgaggtgcgccgcctcccggccggcgaaccacgccagcgccacggtggagcccgcgtggacggggcagatcgactccgtgccgcgcatccaccacgggatcttggacacgtgtccccggaacgccatgtgcaggaacgggaagcccgccgccgccggctgcacgccggcgacgtcctccggttccgatggcgccacggcctccacctccatgaacagcttgttcacgacgccgaagccgaggcgcgcgacggcctcgcgcttgaaaggcgggagcggcgggtcgaaggcgatggcggccgcgccaacgccggcggtgtccttgttgccgaggctggccttgaggacgcccagcgagaccgtgaggatgacgtggtcggcggtgagcggcggcgcgccatccgcgaagtggaggcggacaggggttccgccccacttgagacggcggagacggagtccgaggcggacggtgccgggcgggagcgcagcggcgaggcgctcgaccacgcgggagtagccgccgggaatcgtgacgtgttcgccggggaagtcgcggtactcgccctcggcggtgaggtcgaggtcgccgaggtcgtcggcggaggtgtcggtccgctcccggttgatgtgcatggcgagcagcgcctcgtccacctcctcaagctccttgccgccgccgccgccgccgccggcagaccgcgccgcctggtacgcccgtaggccacggcgcaggtactcctccacgccgcctccaccaccagcctcgccggcgcgcgcggcctccatcatgcccctgtacagctcctcgatcgggccagccaccgtgtccgcgtcgacgacctcgccgccctctgcgacggtcagcacgcggtcggggaagccgtccatgcgctcgtacgggagaccacgaccctcctcctccccgagcgcgccggcgtcgcgcgccagagcgtacacggggctcccgacgacgccctgcacccacgtggcgcccatctcgacccggtggccggcgaactcggacgtgaggatccggccgccgactcggtcgccggcctccaccaccgccacctcgaacctgtccccgcccgcgccgcacagccggtgcgccgccgcgaggcccgatatccccgcgcccaccaccacaaccctcggcttcttcgccaccatcgcgaacgaaaccgcgcgcacgggtgtgcggctacgccttcttcgtcgtagcaaaacccaaccgcctgcgcgcgtcgatgcagccagagccaaccaacactccagctgttataaacgaggagcagacagaagagtggagcaacgcaagcaagttgacacttgacatagcttaggtgcgcaacagccaacagcgcaagcaacgtgacggtccggctgcatttgagcgcaaagtgtcgtgttagcgcgcgcgtcgcgcacgagtcgtggcgtacgttcgtgcgcgcgcgcggttgggccatggaatcggatgcggttgtgttgatttcgaatgggatcttcattcttaagctgctgcgaatctgcgagttgtggtttcctgattagtgactgctacggcggatagcaatccgcataccggccggtttctctgttaaaatgctcaatgatgcatggttacgttagacacacatgcaccggggccctgtggcggctttaatttcgtcctagttgagtcgccgtgtaccgagccgggcaccgccgctcgtgcaaccacgactccacgaatccatggttggttggcgaccgggcggccggctggatgatcctagcggactcgcggtaatcgagctacaatgtgcaggtgcatagtgaagacctgctgtttagatccagtgacacaaggaccgaaggacggacggtttgtctacttgtcttcgtcatggtcatgcatgcttactttctcatcgacgtctagacttgcgtacgccagctataaaagactcagcctccgaggctccgagccttcggtcatgtttaaacttgctaagctacggagtggagtcctccgtatatatgtagactgttcttacatcttgtacgacatgagtaaatctgctgccaattattaagaacatgtcttattcttcacatgtcaccacagaacaaattactcctacttactgtaaggactaaatctgatgccgattctgaaaagaagaggggaaaagtaggaacatgtcgcactgttcacctcatcgcgttgtcactcgctgctgaaccagtgttgcatgatacttacagttatagctaagttattgacgttgtttgcatgtacaataagtatatgccgggcacggcggctgacaaagttgctaactctcggctctcgcatcaaaagaaacgacgtcgaccttctttgtcgtttaagaagcctacaacacccatctgtgtcggatgctctactcgatttacctactcgctgcttcttaacttgcttaattaccctgcaacaaattaattactccatagtctgtgatgataagtttgtttagttatagtataatcgtacgtaaacacattttaaattaagcagcttgaaatgcacaatgctttgtcttttatccaagtggcgcttctgattttttgaagaaaaaaaaacataatcgacatttgtaagtataggagccctatccaaaatgtggaactagcgcgtactagtacaaaagtagtactactcggtacaaaaaataagtactactgcctttgtacctaaataagtacagcttaggcagagtttagtttcaaatttttttctttaaacttctaacttttctgtcacatcgtttcaatttcattcaaactttcaattttagcgtgaactaaacacatttttattaacgttgtttacatgtacagtaagttatagctaagttattattgttactgttactttacattttttattatcatataagatcaagtaaattaaactcgaaacatccctgcaaggcatgcatatgtattacattgttcatactgtaaattacaagcattatagtaagagaaattttacaatccttgagaaaagtatcttaagatacctaaattttacataaaaaaattgttacattgaggtatttagtatctagatatatcaaattttgcactaaaaaaatatgatacctctatgtattttttcaaagatggtaaaattacccttatactaatgtactaaactttgttgaatgaacagcacaacaaactaatgctgcagtgtatgcagacctaaaaaaataatgggccatgcaagtttttaacttaaagcatgtcgcgttggctggcgctggtgggttggcacatatgagtggatctaacgtacgtgcagagaacctcaggtcctcgatagtccatactccactggatccctgtgaggaagtgaagaggtggaaggggaaagaagggaaaggtaaagaagagtaggggtttgaaggggaaagaagaaaatgagccttctctaacctgatgctactcctactgtactaaggctgtgtttagttcgtgtgtcaattttttttaaagtatacagatacacatttgaagtattaaacgtagactaataactaaacagattacatattctgcctgtaaactgcgagacgaatctattaagcctaattaatctatcattagcaaatatttactgtagcaccatattgtcaaatcatggcgtaattaggctaaaagatccgtctcacgatttacatgcaaactatgcaattgatttttttccgttcacatttaatgctccatgtatgtgtccaaacatttaatgtgacggaaaaattgaaagtttgaataaaagagtttgaatctaaacatggcctgattgtcagtggctcagtgtgacagtgtgtcctggtcaccgttttcgcagaagggaaaaaaaaaggaaagatgagacctgggtactgttccttcctgaagatccgaacaaatacttgctggcacgaattaagaaaaacacacgcatgtgtggtcgacagcgctgcaaatagcatagcagtggctcgcaacaaactagatttgacttgactcggctcagttagggaaacaagctaaaacttgagttcagctcagctcgttttctggctcgcgccagtctaagctggcttgcaagcctttctggttgaaatacttcttcatatatattttataatcattaaaaaaacaaaagtaaccccgcaaaaaaaacaaaagtaaaatttaaataagtttatacattcaattcttcaaaatcttaatgataaattgtaagttggcaaataataactctataaccaaataaaataatccatataaacacataatcgcctagacacatgagccaaacaagctgctcacgagccagctcggacttggtcaattcagcaatgagctgaaaaaaaggcttgcgcttaccagcccaccgagccaaccaagctcgagccaagcctgagttgagctcacgagcccaagcttttttccacccccagcagcaaacccccataaaaatcatgcctgccgtcccccagcatctctggttcgccttcggtccagtacataacactagcctaaaaaattgtggcacgcctaaggtttggtgtggcatgttagagttcgtctatgtcgtaggcagcagctttgtaggttctgaagatgtcgctcgttggcgaacgatgaacaacagcttcagcttgatcaaggcacaccagcggtgctgtcttcaaggagattcacgccctcgccgaggtgcacgagacggacggtggctctcctccaagatacaatgatctcgtatcctcagccgtgcactcgaccaagaacaaaccagcagactttcgtgggatgtaactctctctatgcaaaacaagccgatgaatgtgggcaaaaactttgtgtaacaaatatagcagcagtacgtggcttatatagccttgtatagaaacaagaaaatcttatctctaagccggataacaaacaatcaatagattgattttcgccggactgaatatctagaatgataaagactttatcttccacgtacagctcaaaccaacaagaccaaaactgaaaaccaaaatctgaagataaggcaaaagttcagatatcttatctgaaccaaactgacgaatcactggtacaaaatgaacagaaccaaagagataaaatctgaacaaccatcaaacatcatttgtgactttcattcagatataatcagaaggaaaaccacctaaattccaacatggcatactgaggccaccagccaaacagccccttactcccgcaatttggtcaaagtcaaattgctttttgtttgtagaaaaaagtagtactctctccatttacttttgatagtcatatttcaacttggcacacagaccaaagataaataattatacttatcatctatttaaacatgctactagtcattcctcgtaaacaaacgattcattaatatttacatttctcgatacccatgtagccaatcttgtgtggaagaatggagagtcacgcattaaatccgagaaagtcattaatatgataggttgttagattgaaatatacctatcaaaaataaaattttcagatttgataatatgactatcaaaagtagatggagggagtatcatttttaacccaagacaaatatattataaaaatatatttaattttagatttaatgaaacatgtttcgtgttataaatattggtatatttgtttacaaatttaatcaaatttaaagtagttttattttgaccaaatcaaattgactaataatttgaaaccgtgaaacggagggagtagtgtctgagtatgaaatgtcacttgacataaacgtgccacacatcttactcccctacatcaaaagaatcaacacatattacaagggagaaagcagaaaccacatgaaactcacacaaaagaaccatgaagcatcatttaactaatataaacacgcaaagttgctttaatatatattataatagaatacacacctaaatctaatagtcttctaaagaagacggtaactagcagtgccctatttctaaagagggcacaattatgataaactcaaagaaaccttcttcggtatactttaaattaaaattgataccttttcctatttcaattattttgtggagttcagatcaggatttgaaatgaattcactattggtgttgggtgtgggctaaactgtcccatgtgttcactgctaaccctatctcggaatataaggttattttggctatacgtctacttagaagggtggggggggggggatgctgcaattttttttacttggacttaaaaagaaatggcaatttttgcttgagcgttgtagttaatatattttaattccactttgtcttgagtattttctactgtcactgttctaactgcacgacattgtaaccccagactcaaatcatggcttgccgatttggcttgtcagcctatcggaactaggtggttgctgcaggagtttactatgataacaacaaataaaaataatatgtaagataacctaaataatataaacttacataagttgatgtgaattaaatttatatagcatgtagaatgatgattcaaatgtaaaagtaagatgattgtggatttatgagagaatagaagaatgaagataatttagactatacatctatgggctagaaaaaaagagatgacatggtttaatgagagaagaaaaatagcatgaactaagtgaggatggactatattaaaatattatgtgaattatgtggaatgatttgacatacttacattttaattctctaaaatttaataaattattaaattgtagataatatagcatgcttgtatgatgtttaaatataataattattagtggatgatgatgtaacatctttacatgttaagctttaggattaagaatagagaagccccgatggctggatacgtctgcaaaaatgcctctacgcatgtacaaatgtgttgcacaaataaataaaaagaacgggcggttttattctccaaaatcaaaataatcaacacatattacaatggagaaagcagaaaccatgaaactcgccacaaaagaaccatgaagcatcatataactaatataaacatacaaagtcgctgttaacatacagtggcgt

SEQ ID NO: 69844 - DNA, 1898 bp, Oryza sativa
cagtctgggccaagtgtgcttctcctttcttcttctttgggtgcggacactggttggaatagtgaccatactcctcgcagttgaagcatttgatgtggctcttgtcacggccaccgccgcctgagccacttgcagagttgccgcgagcggcgccaccgcgcccacctgcgccacggcctcgcccgcgtccgcgaccgctttggccgcctttagctccctctccggaagctttccctttctggggcgacgatgactccccgccatccttcttgaaccgcgcctcccactcagcctgagtgagaagaacctgcccgtcggtggtgactccgccggccgctgccttcttcttacgcacccgttcctcgtaagccttaagccggcccacagcttcttcgaatggcatgtcatcaacattataaaactgctcaatacctgtgacaaggttgacgaatttctccggcaccgtgtcgaacaacttcttcaccatcgcggcatcactcaacgtcgagcccaacgccgagtggcgcacgctcatcgtggtgatgcggcctgcgtactgatccagggtttcccccggctccatcaccatggcgccgaattcgcccttcagcgtctacagccgcgcgtcacgcagtcgatcagcacccacgaatcttgtcttgagacaatcccatacttccttcgccaatcgtttctttgccacctgcatgaggagatcctctggcagcgactgcagcaggtgcgacttcgctttcttgtccttctgagggtcgacggccgccccggccgccggttcaatcacctcccacacaccctggtcctccatcatcgcctggacacggatcacccaactagtgtagttggtggccgtgagttgtggatacaagaaagcgctccccgagctccccctcgccggatccgacgttgccggaaccaacgccatggtgtcagaccagccctcaaacctgggtgctctgataccacttgttagcgctagaccctcgatcgaacaccttgcatgcgtactgcagcaatccggcacggcaacgaacgagattcagaggaatacagagcagaacaagaacacaggaaattgagaagtttcagagaacaatagcagataggaaatttgtggggctaaatttctgtggttttcattcactgaacagagtaacatgcaactcgaataacagtacaaaaactcctacttatactgcacacaaaagaaagaatccgaggctcaaatcgtgccatcccacgatccgcttttctctgaattcgacgactcacgcacccacgctaaactcacgcacacgaatgctaccgacgcggtcttcttctgactcgatcaccgcatcattcgcatctgctaacaaacacagatttattccttcaaccgttgcaactgcaatcaccaggaacacgttggggccacagctgtaataacaaactcaacagtcgcctctgatttttggcagctacctatgcaccatgtgcttcagctgacgctggtctgccgtcgtccgtcagtcaccatgcatgcgtcctggcatcgcatctgcatgcacaaagaaattgatgtagaattgatcatcatcggtaagcaatagaaactgatctaacaagaggaagatctgtgagagatgcgcaaagaaaatggaaagagatcaaacgtcaggcttggtggtggtgcatctgcacacaggcttgccgacgggatctatcgcagtacccacgtctgcgaaggatcaccgctgccggttcctagaaaacactatgcccatggatcgcggcgtcgccttcgacttgccgtagatcctgtgtcatcactgccgtttttggcttcacttgacaaaatctgaaatcaaatcacaacttgttggtaaaataaaataaca

SEQ ID NO: 69845 - DNA, 1129 bp, Oryza sativa
taattaagcttaaaagattcgtctcgtaatttacatgtaaactgtgtgattgtttttttatttatatttaatgctctataaatatgtttaaatatctggtgcgacgaaatttttagaagtttgaatgtaatgtctaaatctggaggctgtaatgatgaagagaagacggcgagagtttacgaaccgtcttgtgcttgtaggagtacgtcaagtcttcaactcttcaagtcacctactgctactgcatgcatgtcaaactctcacatcggcgtacaccatacaaatgtaaccctgttctaaatttttttttcgaaacttcaagctttccatcacatcaaacctctcatacatacataatttttcaatcacatcgttccaatttcaccaaaaaggttatttgggaactagttactaaactttagtccctctcacaaaaacataagcccctcctctagagacttatggttttgagtttagcccctctctcccaaataccccctttcaaacttcagtgtgaactaagagggtgtttagatggggctaaaactttttagctaatgtcacattaaatgtttatatgctaatttagaatattaaatataaactaataaaaaaactaattttataaatgagagcttatccgatgcgacacagcttgccgggaagtttacgtgctgagtttactccaagtaccacccttgcgctttgattaccactgcagttcagagaaccatgcatgagagaaaggcacctcagattagacagcgaaatgattgccgtcagctgtctacacgagggaggaaatgagtgaaggttgcacacactcctacaggcagcagtggtttcttgtagcgccaggcaaaagaaagacaggtctctctcagggagtcagagatgacagaatcatttctttctcctgataatcacagttaaaccagctagtagtagtagaaaactctgcctcggtacttccgctttttccacggagtgaaggagtatagtagaaaactccttcgaattatacgtacaaaagtactcctactatactcgttagttgttcttattagtactaaacaatttttgagattttcggatgccgtttccggtttgcgcccatagttttagccgg

SEQ ID NO: 69846 - DNA, 33819 bp, Oryza sativa
  unsure (1)..(33819): unsure at all n locations
tctctctctttttaaggtattttaggcacaaaagtctctaaagtggcatttcatccggtaggcaatgtattgagtggcattttatccgatgcattgtattgagtgacattttatccgaaccaatcttagagagtggcatattttccgttttctcctacctttatgtataccacgggtattgccatggacacctcgtgtacctaatagaggacatcagcgtccttggatgactggacagaaagctcacgttcacaaatcacaataattctgtgtccttcagttgatcgcctgatcggtgattcggtgaaatcatcaaatgtatcatgtatgtagtatacatctaggatcgttagtgaccacgttgtgtgtggcatgtcgttgtcaatttgcccatatgcatggtccatcaagaggaaaagatgatgaataatggcggtccaaactccaaaggcgtgtgtgcggtggtggatagctgctctgagatttgggtcatgttttttctccaacaaaagttgaataaagattaaaattttcgtggcacgcttttcaaactgctacacagtgcgtttcgtacgaaaactttctatatgaaagttgttctaaaatatcatattaatctattttaaagtttataataatttaaacccaatcaattatacgttaataccaccttattttacgtaaaaaacttaatcttcatctttagaagaaaaaaacaccaccttgattgtaatccggtagtgcatcgtgctactattatcatacagttaattcatctagagaactattttactgtaattaaataatcagttgaataaatattatcatcaattttcaatacagcaagttaattgtattgtatattaaaaaaataaatatggcaataactaatgcttattgaaatacttagtattatgcatcagagtgtgactgtgaagcctatacaaatgacatgttgggctagttgttgtacagtgcagctactgttctaatttgttatagcacagctatggcgcaactgatgtgcaatactattactattatataactcaacaaagcacgctaaactttatgtcggttggtgctgcgaaatttcacatgtagatattggcttcctataggtttgcacttatggtttggaccaaattttcggtatcaccaatttattgcggtttttttggtatttttggtactcttttgcacacttttttttttaaaaaataataaatattgactgaatttgttttttttttaccaaattccaaaaagtttggaaaaatctgaaatttatgggcacgatagttgcttgccggggtttcaaaatttcaaaaaatttgaaccgagatttcaatcactgagtactaattgaccatgaacaattcgggacgatggataaaccaacatcagccaaaaagaagtctgaaaagctttaccattgctggaaaatgggcatcttactttcaccgtactgattgcacgtctagcttaaagttccaaagggtctaacgtgagtgtggcttgtccggttgccatcaaagacaatgcatcagtgacacgcaaggcacttcctccctggttcgctttctctgctaggttgccctcctggaaaaggaacggaaaatatacaggaatagataatctttggttttgtgggactgcgttaccactgatccgctgttgagtcattaatcctgcttttcaaaatgctccacacatggtaccgcaatatgtgtccttttttatcaatctcccgttctgtgtggagcattacagcaaaggatgatctcacactggacgtggcgtgacatcaaaccgtgtcagtttttttttaattattattgtggattgccagctctgagcgatcgagtacgtatactggaccagtccagatcattggctgccttgtcgtttttagccgcctaataaggtgcgtcttaaaatgcacattttgtttggaaaagaaataagtgtacaaaataaggtcttttagtggtctctagccgaggaatcttatttgcgaagcaatggtcatatgctagctatacaaacatagaaaaggatgagcaattcgtccgtgcttcaacacttcctcatatatttaaccttttcttatgattcaagggtatctttataatgctctatgccagtaatactgtactatcaaacgacagtagaaatgaccagatttataaattctactgccagtaaaaacattctactaccatgatccacaaacgaaccatacattgaatcaaccaatcattttttacagtggatcccagcaaaacagttcagtgcaaattatccttggagatgcccacgtgatttaaaacagacaaataaatcacattattgctagtataaatacttcaaccgatattgctagcacataaaagtgccatgccacacttggagaaaagtacagctacgcattacactagtttagggaaaagggctaggccacaatatgcacgaggtgaaacaatacactgtagagggaagtaggctacctggccttgcttcgtggagactccatggtcttgacaagttcaaatgaaaatgttaaatgattaatcaacgttagctcatttttgacgtgtgatgacattttctaacatgggattttctaatggtgatccattctgcgagacgtatgactactgactataatgactacaaacagtaagctagaagttttagggatgccaaatcgtcctgtccaaaccataagctaatatactttttaaattcatcagggtttgtacactggtaaaacgtcggtcaattacaagcgaccattgtttctgctgttgccactcgcaaagtcgcaagcatgagatggctggaggtaatcaaagtatagccatagctaactatagctccgggggccatagtaatctcactgattgccgctgtccccaaaaaaggacaggaaaaaagcccccacgcggccaccaccaccagcggcctggcctgcctggctggccagtctctcccacctaactacagtagtatggtcgctgaggtgagaccctaccgaacaacaacaaattcaacaattctcacgcgccgctactcccccgcacaacatcaaccagaaacgtctcctcgtcaccactcgccacaagtccaccgcagcacggcgccctctcctctcctctcctccgtctcccgcctgccgcgaaaccaaacctcgaaaataaaaccaacagtttccctcgcggccgcgcgcggagacgagtagacgacagcgaatcgctgccggtttggggcgcgcgcggatcgcggcggagggaggcaagcctttcggtttggtccgccaccaccaccacggccaccgcgcctccgcctcagcgtccgcgatttttttttttatcttttggttttggatttccccttgtcaaaactggcaggattcttctgcctgcccgagcctgactactgttgggttcgtgctcgctgctcccccacgttttgttttactagtcgccgccgcaccgaatatttttcccacctcgctcgccacgccgccgacacccgccgtccgcttccgcggctgccccgcgcgccggtgctgtgtcgccgggctgcggcggaggagtgccgaccttttcctccggggtgaatgagagagatgtgatcgtggcgaatcccgagctctgccgctgggctgggaggcggggaagggaggacaggagatggggcggcgtggaggaggaggacgagcgggaggcgcgtggattggtggctgtgtacttgcgctcgccgccaccttggtcgtctgcgtgctcgtgatccgtggagctggaggtatgtgcagtggtgtgctctgtgctgtgctggtctgctctgtgggagttttgggggcctccttgttggtctagtttggccaggatcatgcagttccgatcctgaatgctagagtggtttgcttgttagatttttgggttttgagctgccagaacccgagcctgcagcggaagtttcgtactattattaagttttttcacttgggtctctgattcttcgaattggatgggtgattgatgttgaggttgaggacgttgttgtgatttgatgggtgccctgattgtaacatctgctaggatcacagaatattgcagggtctgaagaacatcgccctcttaagcatacgagaaggaataagatggcacgtgtaaattagaaatacagatgcctcaattctatgcacctaaaatttgggggcaggggcgagtgttatgtccatttcgttagctaccttttttatttcctatgacaaatagagtgtttagctgcaaaataaactactgaagcttatttttcagaaggggcataagacagacaaattcaaatggacaaacttttagaacataaatctcggacaaatgctgtaactttgcatgcactatatatgtcaactgataatattttcagttttagttgccatcttattagtttttaacccaaaaatacaatgatcatggacatcactgatcatttttgaccagtcgtattttttgttagcaattcattgttaagttattgcccttgaacaaagctcttgccacttttatattacatttaagctccaaagacaacccattcgttctattatattttggtttctggattatggcttgctatgctgacaaattgttagctattctgttcatgttttgttttcaaaggtttgaagcaatatcatgctcctgccttcgctcgaaaaattcttctttccataacaagcggacatccacaagataacttgaatattgtacttcatccgtcacagttacaaaccccaagactccaaagcttaggtctgaaagttaatggacctataccctgagatgctttcatttttgtttatcatgtcatgtattctgaactatatgcaacttaccatatttattattttctaggactaaatgtaaaaccacctgcagcaactagcagacgtgttaacgtacagcaggaactatatgcaccaagcccaacgatcagccacagaggtacattcagaattatgatttggtttgttatcctatatatatctataaagttcatcgccactaagtgtagtcaatgctatttctctcctctcattaagtcacatcacctcaattatttctagcccttgatgattgatctatggtccaaattatcttcctccttttcttctcttatataaagtcatatcaccttagttttgcctttggatgactaatctatattaccttctttcttttccttctctcatcgagccacatcaccttagttttgtttttgaatgatcaatccatatatgattaaaatttttataaaccatatcatctcaattgtttgtagcttttttattagtcgatcaaagatgaaaattatacaaaatgtagctatattacatgttatttctactaatatcacacaaaactcccgcagcaatgcatagggtttcatctagtttcttgaaattatgttgagaaaaattgttacgttggttttccctgaaagtcgtgtattctaccctagtgggttgctttgcacagatggcttatctcactgtctagtgtctaagcaaactttttttttaaataaaggaagctttatagatctcaaacaattacattgatacaattaatctaggaccactcctggcctctgtataactaattaggatgcgcacgacctataattattgcaaaaaaaaaaagcttcattcaccaccatagcaacacttggaccgtgagaaaggccctccaaaagcgatgcctccaaaagggaatggcaaactaagcaaactgtgctgcctacaatacaacctagtgctccctgtcattcttattagtctccaatcagagaaatatccccatgtatcgagagtccaggccaattgttggttagcttgatgttgaattctatctgcatcaatgttactgtcaaatctaggttgaaaatgatgaaacctttttgcttattcataggccaatctaccctaccttcacatatgatttttccaagttacagtcaaatctaggttgaaatgttttatatctctatcctctccgtaaggcatgcaaccaataagtttgttgtagaaataataataaaaaaagagacataaggtgatgggggcaaaccagcaaacccccaactccctttattattgactagcgttaataatagaatcacatagattctagccaataatcctaaggttactatgccacccataatggaatgaaagacccttgcctactgattcctgctcccctgtggtagcctcatagaccaaaagtagagccagtaggaagtcatctgttatgaatatagcttatattgaataatagccctaaggaggcaatatataggagtacaagagagcgtatatagaaacctatatatgtacaagactatattccttaacaacatgaacaaaacctgtgtaggattagacacttttttgctctagctaatgaaatttcattgcaagattgttataagcaaacaatcatatctattaatgcattccaaaaatagttcttttatgatccactgaaggtaccttctagtgttaacttttgtacttcttgatactccccaaggacataaaaagaactcttacagacacatgatgtacattacctgttgcttgttcatctacttcacaaactttttttatagcgacacatcctatttataaccggcaggctcgtctacttaactttcatcgtgccttcgtccaccaatactcaaagcatctacccccattaatttatccatatatgagaagtatatcccacccattcagaattttatgaaacattaccttagttcatgctgaaattaattccatcaatgtatgacgcaggtcttgctattcctccacttccaacaacttcacccccagttttcccacctcccatcagatcttatcctccacttcctgcaaataagccataccccaatagtatgtctctgaagcaatttttatacaagaactatatattttttatctgcttaccattttcctgtactgaaatatgcaggaccagcagtgtctccagcatcaataatccatcccaccaaccatgggaaggcccatggagttccaattgcagcacattcaaaagaaaggcatcatcattccatgcttgtaaataatacacatggaaatacccatgcaggtccagttgtggcacctccaaagggaaggcatcaccattctttgcctgtaaataatacccgtgtaaaaggtattccaccgactgcacaactaccataatgaacctattgctggtaataaaatgattcatgaagttgtatcgagcaggacctgcctattctccttcaaattctcccagtatccatagaaaacatggcattccagttgctgcacctccaaagcaacattccagcaatttaccaccttcacatcataggccccacaaaggtatgctgacagtaaaaaaaaaaaaagtactcatctcactaaggcaatgtttgctgcaggatcctttcctgtcataagccctactccacataaagctgataatgcttctgcgacgaaacatggacgttctggcttacaccatagtcctgcacctgcacctgtaggcttgcctccatctgaaggaaatgcacgaggaaatcctgcgtatgcaccacgtcatccccatgaatatcactcgccttcaaattctccaggtcagttagacattcttgaaatttctccttttcctttatgttgtctcatttgttctaacctctgcaaatgctccagtcataccccccctaagaacaggccataacatgcacggccttctatttatcatgatgttgaataggattataggacactgagattttgcacggtgatgcaagaattatctctggtatacttgataagagtacggagattgaacttacaccttttattttagtttgcaacccgtcctaccttgctatggtgattaaacacatttggatatgatactaatatttaggtccacaaatttccaccttccactaagtttatctaaatgcaaaagttttatcttctctcaacttatgtcaatcccagtagggccaatttagctcccctgttgcttttataccaatttcaccatataatttgtttttgttattttccatgtcattacgcctatgcagaacctggtctaccacctgtgaatccgcccgacagtcatgcatttaaaaagcccaagagtttggcaccagcaccccaatcatttccgccaccgcctccgagttcatgtatgctacctgaggatactatcttttgtatatgaattcatcaatatatgtgctctatccaatcatgtaagctactcagctgtgatccattcatcttttctatttgccagattgcatggcgttaaattgtcaagatcctctgaccaatagtctccctggaactacatgtctttgtgtgtggccaataaaagttgagcttcgtttaggtatagctttgtacacattctttgcattggtatcagaacttgcacaagatattgcatctggagtgctcatgaaacaaagtcaagttcgtgtaatgggagcaaatgctgcaactgaggacccagagaaaacagttgtccttattgatcttgtgccactgggagaaaaatttgacaaggcaacagcacttttagtatttgaaaggttttggcacaagcaggtcaacataaactctatgcattttggaaactatgatgtgttatatgttacctaccaaggtaagagctatttgtaatttttattgtgtcattatacatattctctttgttaattcctataaaccttattggattttccgatattcgagtaaatccttaattattttgtttattattcaggtcaatcagttcacttcctctgtgtgtgtgtgtgtgtgtgtgagtgagtgagtgagtgaaaccactggcatgatattctttttagccggatcggccaaaggaagaggctgatcaaatttcattaagattgatggagaaaaaaaatagaaattgtaaaagagtacaacaacagtagtctgtcgaaactggtggcaccccagctagctgggtaaccggaaaaagaaaaagggtagggatgggctagagactagtcgccatctcctttcaaaattcctgctgtcctccagacagagatttcatctctaatttcattgacatagtttgttttttagaaagggtcttgatatggttactttcacttattcatacaggtcttcctccgtcgccaccaacagctcccaggatgaacaatggtcttagcaatgttaatgatccaaggttgcatccacttgctgttgatgtgggaaaccacagagaaacaaaaagcaggggcataattgttataattgttctttcaagtgtctttgcttttattttatgttctggagctgcgttggtaatttgtttcaagattagaaaccgcaaccatttaactgaagagtcacctatgccaccgaagcctgcaggtaacaagacattcaatccatgcagtgttgctgtatttatctttattagtcacatattagaaaaggtgtagcaaatgcaatctggtgaaacaatcattgtcattctttccatgactatgggtgagttcgctactggaggtttccaaccgggaacagtgcgcgcggaaaacggagcggttcattagcgcgtgattaattaagtattagcttttttttcaaaaatggatcaatatgattttttaaagcaactttcgtatagaaactttttgcaaaaaacacaccgtttaacagtttaaaaagcgtgcgcgaagaaaacgagaggggaaagttgggaaccggcagtgccgaacacaccctatatccattctgaggccttgttaggattgtttgattattttgtagaaaaccaatccacataaaatgatcattcgttttctagctttcaagaactgagaagttatgtttcatatttgtatggttgaaaagtaatattaccttgaaataatcaaagaacaagagttatatttcatgcttaagtagtgaaagtacttggaacagctttgaccaaatctgaaaggattatatttttgcaaaagttaaaaactgatgctaaattattttcttccatcaatgattgcattggaaatgtaggtcctgggtctgcagttgttgggagcaggctaggaagcagacctatttcagcatctccatctttcagctcaagcatagtgacatataaagggacagcgaaaacatttagcttgattgagatggaaagagctacacaaagatttgacaactccagaattattggcgagggtggttttggacgtgtttatgaaggtattcttgaggatggagaacgggttgctgtcaaaattcttaagagggacgaccagcaagttacacgggaatttttagctgagcttgagatgcttagccgattgcatcacagaaacctggttaagttgataggtatatgcacagaagaacatatccggtgtcttgtgtatgagcttgttccaaatggtagtgtggaatctcacttgcacggtaatattttgttctctttttttttcctctgaacagtttctaaggcatcatttgttactttatcgtgtctattttgcttggagagatgcatcaaaccagtcaagcactttgttgacaagaaattcataattctgccctgtagataatacagctgttgtcgcttataacaaagtcacacatgtgaacactgtgcactaagacatgaaatgtattgtgcactaatctcctgttacattatgtttttttaagggaatcccattacataatgtttcttaagggaattcctttccatcatgttgacaaatacaaacttgcattttataaaattttgacatgtttcatggattcatagtacatccatattctattctccttaataggtgacttttttggccagacataagtattttggccggtccgtaatagctaactagaataatatggttcttttttttaaaattccaagcaggatcagataagggaactgctccacttgattgggatgctaggcttaaaattgcacttggtgctgcacgtgctcttgcttatttgcatgaagattctagtccccgtgtcatacaccgtgacttcaagtcaagtaacatcttattggaacatgacttcacccccaaggtgtcagactttggcctagcaagaacagccataggtgaggggaatgagcatatttcaactcgtgttatgggaactttcgggtaagttttgatctgaaattattatcttactacctgtagttggttaacatcctcaccttaaaaagattatgaactctttttaggtatgttgctcctgaatacgcaatgactgggcatcttctagtaaagagtgatgtctacagctatggtgtcgtcctccttgagcttcttaccggaaggaaaccggtggatattttgagacctccagggcaagaaaatttagttgcatgggcttgtccttttcttactagcagagatggcttggaaacaataattgatccatcacttggaaatagcatcctattcgatagcattgcaaaagtagcagctattgcttctatgtgcgtgcagcctgaggtggatcagcgcccatttatgggtgaagttgttcaagctttgaagttggtatgcgatgaaggcagcgagttcaatgaatcaggaagtttcagccaagatttacatattcaggattctgggattataagtagagcaagcctggatgtggacgtagaacctgttgtatctgctgagctgttcaatgcatcagcacattatgacactcttgatgcatctggttcttttcgacgatattcaagttcaggtcctcttagggtaggtagaaccgggcacaatagggagaggggtttatcaactggtagctcaagcgagcactgtggtacacaaagattcaggatagattcagagtagtcagcttgcaggcttcttttgacgatgtggggctgtgttcattggcttcttttcgcaagccacatttcatattcattgtgaatatctgtgaagagcactgagcaatatcaccagcttctgccgggacaaggaccagttttcgaagagcactgagcaagactgcaagagtaccaacatctcgtcccgtcccgtctctgtttatacagttctagagatctataaagccggttccttttttttagtggaaagtaaagccggttcatcaactgcggttcatcaactgtaaatgttcatgtaccttcccaagtgtagccattcctttcgcatggaaggtaagtgaaatatcagatgaaatgaagggtatttttgcctgtcatcctttcatccggttcaatgaaatggagtcttgcatgatttactgcattttattgatttgtggtaccaaacagatagaaacgtataccagttgtaaatctgcgaataaatagccaaacttgcataagtaggccttgtttgacacttagaaactttagcgaacaactatattcttgtaggggttaaataataaaagggaaaattgaaaccatgccattataattttacaaaatttaagatatgtcattctgaccaacatgtcattgactcatatgggtcctacatgtcattgagataccgatgatatatcttaaactttgcaaaattataatggcatggttccaaattaccataaataaaattgttgtgcgataaacagctaaggcaaccagtggataaacttaaataacattcctgaactattcacttggatgaactagcgagtcaacttggcataatcatttcctcattgacaacttatcctaccacaggaggccgggatatattagtagccttcctcaacaagtacgtgtgccccccacacctggctggagtaaggggatacactataaattgctaggattgcatcaggttacatcaggtcatgatactttgtcggccatctcccagatggggaaaaaaatcaatattcatccatccaatgctgaatacaacaccttactggaacaaaccacactaaaaaaaatagtggtggtggcaggaggcaagtatttcatcaagtagatgcattgccctacgtggttacatccaaactgtagggtttccagcactaaatcatttcacatgataaaaaaaaaactggcaatcatcagagaacatgaacaaaaaataaagattgcagtgggcaaatatgaactgcaaaagactaacaagcaaatcaaaccgattaaccgataaacaaaggtgagaaagaactacgacagctagggaatgtatacatgtcttgcgagttttaggttgctgaaggagcttccttttcctcagctacagctggagcatcttgttcttctgctgtaactacagaatcttcctttgctttgtctagacccacagctaccgagagccaatctgaagcaggtgctccagtttcaggagccacatttccgtgtatattcagaggagtgacagatatctgtaggttgtaaagagaggtatacggttagccactttacacttatacatgcatgtgcacacacagagcaagggaaggagggctcacaaatccattctccaaagctctcaaatcgatatcctcgtctaagcattcatgctgcttttcagtgaactgcattcaacataatcagagaagaaaacagcgctcagtaacatgttcatatctacaaaaacatcaacgctaaaaacatctgtaggctattcacaatctccatatgagcatattggcctaatttggtactgtcttaaagttcatatgttctatacatggtcggacaagtcaaataatctttggctataacactctggaagatatatttacctcagcacggaaaagcttcttcactacttctcgagcctctgctttccctgtagatgcaacagactcaacctcgacaatcttccgctgagcattaattctgcgtgcagccccctgtagatgaaaaccacaacaaatttgaggatgtgctaacaaggacacgtcaaatttctctgaaacaaaagcatggcttcatactgctgcagatgcatccttcccaagttgtgcgagctgaataccaaggctttggtgcatgcccatgaagtgagtagcaggtgtaggtctgcttgtggacacaccttcccaactttgggcaggacgatatatgctttgcttagtcagcttgaaaccctgatatcagatatcaggagagagatgcattaaagaaaggctattacattaaaaaaaactaaacgagcagtagatctttttatccatcagtcatcacaaagaatgcaaactaacacaagataaaacaaagtgggatggcttcgccagtttcatgatctaaatttcaaataattaactgttgctcatccaattaatagtgttgatctcctgtacagatatttgcatgggcatacaatctgcatatactatataactttcccaacaactagtacacacctgataaataaggctaatggatatttttgcatttgtgggcaagccagtaaggtaactagtaccaggacgactaagacagtaagcattctgtacagatcagaaatcatggactcacgatgcagaaaaatagcgaagaacccatgaccattttgaagccaaggaaatatgaatgacatgtttcagcatatttggaagatacgaaagcttcattgtactaattcttagcaattcaatcatcggtgaggtgcaggcagctgccatgagattcctgaacactttcaaaaccttaactccaataacaaaggaaacagcttatgttctgttttgaataatgtagaatcttgtttctttgccctcaaggctagcctctcaaggaaatatgtattgctctagtccatagtattatagcaacagcacggtcatgtgctactgtacgtttataagccaatgttggagaagacaaggagttggtttacttctatagctatggaaattttggcctatggtgctagttttggccctaaactggagttcaagattcagaattcagttattagcagaataaccttatttgtagttggtgagcttggaaccccaatgttcagtaagcagcctctgaggaaggttcctttctcaacgccttccaaggcagcgtgtatcaatggtaggcaaacctcagcagcatccttgaaatcactatctttgctttcatccttcttcctacttgcacatatccagcacaaattgttaccaaatgtgattgcataaaccaatttatctaattatgaaacatatttgaaatactaatatcacaccattaaggcacacccaccaattcaatgatattgcaattgaaggaacatcatacagtaaggcctcccttgcagcagcaatggcagaagaatgaaacctacacaattttgcagtaaattaaagaacaggatagaaatcagacaatgaattgggcatttctgaaagaatcatacatctcatatccacagttcgcccctgcattgatcccactgatcacctataaacgaaacgaaaacatcctcaatgatcacaaggttaggcgatcaagttcttacacgcagatagcaaacacaatactaaccaaagcaggcgccgaccaagagaacagcctcccagataatgccaaagagacgcaatccaccggtgtccctacaataacaataatcgcaatgagatagaaacaccaactctcactgtataccagcaacagtgcgacccaaatggatcgaggaaaggatgtagaacactcacctgatatctcgaaagctttcgcccctttgaaatccaccgatgttgctgtaatggtctcgcggatggtaatggaatagccgcaagcaggcttgtcccttcacatcatcatcaagaaaacaatacagattatttacagctgggaccaatggattagttggttggtagaattcgcaacaaatccagacaaaacaaggtattttcccgaggtcaaagagaatatcgtaaggaggaatcgaggattggggggcgcatacgattcgggcgcgcatacgtggacgtcgcatcggccgccggcgacgagggagtcgacgagggccgcgagacccggcgcccggatcccgccggcgcaggtcaggagtacggccggcttcgcgggaccttcatcggccacgggagcagcgccggaggactccgccgcctccggtgccggggcctcggcgccggcctcctccgcggccggcggcggcggccggcgcgccgcgaggacggactgcaggttggacacgagcgcggacgggagcggattgggcctcggcgcgtcgtcgccggagctcgcggccatcgggcttcccttcgcttcgcctcgccggagaggtgtttgggcgtggaggagagagagagagagagagagagatgtacggacgaatgaagggaagagagagaggaggggttggaacgcgaggggggaagagagagagagagagagagagagagagaggaaatggactgaaatgggctgggcgcgccatcgcatagttaatggatttctagaccggggcccgctttacgtgtagagggaggcaggtctctgttttgacctgcacagatacgtgggaaagcgttatctactcgacgactactcccaacttgcctcagcaaagcgtggcaagaatccgtgattctcccgttccgataccaaatccactatcatcaaccaaaataatagttttactggtattattgtgaccaacatgcgggcatgaacacggaactctgtggctagtatggggtggaatcttttcttaacatggattacaaaattttacatatttttttaccaacaatggtacagcctattttaaatgaaaaaaacaaatacaccaaaaatagtaaatctagagataaaatactccatctgttctaaaatataggaacttttagctggttgggacatatcctagtactacgaatctggacaggagtagatatgtcccatccacccaaagttgctatattttgagacggagggagtagttgtaaaatctaattttgatgcagtaactgagtgtagctataagttaggtataaaggaatgtaaatcttgatgtatgatccaatgaaaaaaaactgaaagatagaagtccaaaaaacttttgttcgtgaaatatcaaaactgcttaataatcagatgatatgaaagtgaaacgttgctgtgttgaagatgcaggccaatgtagtgggagaggtactcgttgtagtacaacgttagtacgtaactacgctcgtacggtgcaggatcagccggatcctcccttgaccacgtccatctaagcgagtgggccaacccgcgggcgtaaacgctttagggttcgcccgtccagattaattcccgttgtaccaccaagcacgaggacaaacgcaagacgagctcgctcggtcgctcccctcgcccctcgacacccaccacaccacgacgactcctcgtcgtgcgaggtgcgcacgttgcacgtacgtagccgggcgggagacgcgcgcgcgcgcggacgcacggttgctgcgacccacccaggcaacagtcgtcgtgggagcgcggcgctagctcactacccctgccacccccatgtgcctccgtctcagaactcatgtgagaagccgtagccagccagtgcggcggtcggttccaaacttccaatgcctcgccgagcgatagatcggcagatcgccccgcgggggtgggtgccgtggtggactggtggtgggggcgggccggcctatctcctcgtcggatccacccgcccgcgccgtgcggaaaggctaattttagcctgcggctggttggctggatcggtcggtgaccggggtggccgcgcccgcgcgcttgggttgggactttttgggagtcctcgtgccaaggcaaacaaacgttggtggaccatcaacgggacacgtgctgtggcgacccgatggaggcgagcgttgcgtcgttttctcttcgtaattgcgtgcgaatttatttgcggagcccccgagcctctgccacaggccacagtggaaccgtacgtatgcaccatatgttaatcattcaggatttcagatgcatgactgcatgagggctctctcattaacgagtaaggagagagatctggagatctggtgctgacaatcattcgtttctactatactgtgtagcccccgtgccgtagatggttgctggtagtttgcagatcacccaacgaataaaataactttttttttctggcaggctaggaacaaggaacactggcgatctgtttatgtgactaactttgccaaaccaaattttaggtaaactgggcacataaccacacgttaatcaagctcatgtgaaattgacagttgatatttgagattatatactaatccctctgtcccatttcaagtacaactataaatttccgtgtccaactttaatcattcatcttatttaaaaaacttttataattaatatttttattattatgagatgataaaatatgaatagtattttatatgcgacttatgtttttaattttttaaaaaaattaaataagatgaacggtcaaagttgtacacggaaaattatctctgtattttaaatgggatggaaggagtagataaaattggtatggcaactcacgattataataacgaatcaaacgacatcctagaaagttctggcatataagatttgacctggtaagttaagactatgaatcaaagtatttttgtatccggccaataacacgtattatgagcttggaagccaacctactattccctccatttcatttcaaattatgagttgttttaatcttagtgtcaaactgcttcaattttatcaaaatttatagaaaatgtagtaatattttcaacgcaagacaaatatattatgaaaatatactcaattataaattcaatgaaactaatttggtattataaatattactatatttatctataaacttagttaaatgatttataatctgaaacggagggattagctacaacttgtgaagttttaattctcctatatttttcttctaagattttttattttaaacgtacggttgctgagtcgatctccatttttcctccacttccttagttatgccacttgtttaatgaactaatttatttgactttgtaatatccttttgtctgttcaagttgacgtggctagcagcctagcacattgctgtacctactactcctatgttgttatgaaattcaatatgcattgattacatcgatgacattccaacacacaaggggcgcaatcgaattaccacatccgtacgtttgtgacgacttagtatttgtttgtcactcgatacgggcatggtgataaattatcactcgatacatatttgtttgtcatgacttaaatatacacaatcatataattctctcggccggtactcctacaagattaatcagtttgctggacgctattattaggcatttccatgattaaccaatcgttgccaccttttcaggcctacccacaaattatttaagctatatgtagcttacgcacaaaacacctgtcatccacatacgccaccttaatttagcacgcaccagagaaactaaaccgttcactaactaaacacgactagctagctagcgaacgaaacaaaacaccaggcatttatacgttacgttgcatcttgagcaagccgcacttgcatagccttgggccaaattaattaaccggcagcacgttgcccggccggttgatcgatcaccaccagcaagctagagatggcgagacgggctgcatcggtggcgctggcgtgcgcggtggtggcggccgcgatggtgctcccggaggcggaggcggggcagaactgcatctgcgagtgcgtgaagctgtgcatgcggacgcggatcccgagcatcgaggcgcagtgctcgggcaagtgcagggagacggcgtgcgtgcggagctgcgaggaggcgtgcgcgcgcaagggcttccccgccctgcccggcgagggcatcggcgcctgcgagctggagccgctcacccccgacgaggcgcacatgctgcactgatcatcgagtcaccaaccaatcgatggcaagcctcaccgccgtttccgtctctgtctctgtcgctgtgtatgtttctgtctccgcctcttctgcgctgttgtatacttgtatatgtgtactacatctaccacaccggtcaaagtgacattccatcctggctcatgtgtcgcgctacatacgatacggtgcgtaagcgtaacatacgtttgattattgtcagttttgcttgctatggtcgcggttgcgcactgacgggatcgaccacatctctgactctgaggcccagctaacatgtttcctgggcccgtcttaggaagtcgatgcaacgaggcttttagcccaaataatagtggacatcccttctgctgcctttcaggtttcagcccaaatagaaccgtgggctgccagcggcgctcgtgggtctacgcatgtcggtccgttgcgccgcagcagaggttgctgccttgcctgccactgtcatgtaagcaaattttttttgccgtttccttatcttatttcgttcatgtgtccgtttatctttttttttttgcgcaattaacgagtccgtgatcgactttgttggcttgctgctatctgaagctctgaacctgttgagctcgtggcacgccattcgcttagtccacatcaaagacatttgtacactgtagtgcacccttgtcctttacctacggaaaatactaatacatgcatcttcgctcgttagcgaaaaggatatgcttgtctttctaggaaatgatctcttcaagacaacaaatccatgttattctagaaatgagggcaatgatgaggagcaaattgcattggttgtttctgttccagtccatatatatacacgctcaattagtaagagctagccaaaactggcatatatactgacattgaataggtttttgcttaaatttttctagcagattttgttcagatgatgttcgcagttagatatcgctcgttgggtactttttaatgagatagtacgagtccccgacgggggaaaaatctaaggcctctttgattcaaaggaaatttataggaattttaaaggattttatttctatagaattttttcctatatagacctttgaatcaaaggaatgaatcctatataatcccatgaaatttctatggaatacctctttccatgtaagttttagaggaaatttagcatgaggttctacctcatgttaagaatcttttgagtctttatccctctttaaatttctgtgttttttctatggctcaatcaaacggtcattcctatatttttcctgtattttacaatcctctgttttatacttgtattcttgtcagaatcctatgtttttcctatttctctgtttttttattcctatgattcaaaggggcccttaaagctcatttggcacgcatgattctcaaaatagatgaaaaaaaacgctggattgaagcgtcttaatacatcaaaacctatggtttgaaaaaaacgtaggagaaatgagcctaggaaaataagagagtcagaactgatcagaagagatagattgacacaaggattttagaggctaaacctcacgtcaaaatcactagtttcgaactaatctaaagaaatttcatataatcttttaatagttattgatttgatccaaaagactagtgtagggtttgttcattttggagaaaaagaaaaggatttatttttttaagcattcggttttaaaaaagaagtataggaaattttcctttcctataagttgtagagagaaaacataaaagaatatcatgcatccacttaaatctcttaaaaaaattcatgtgaattgacgtgtgcatgtctttctattccttgaatttttggttgaaatttctccaaactgaacaaacatgtgattggaaagtttttattagaattaaattcctaagagcaggtacaataacagactataagacagctataaatatattttaaagagataaagaaagagagaatagcagcgggctatagatcggtagccagctgcagcacggactccaagacgtaatgtgtgtttgacaggtgggaccaggtattaatagtacagtaaacaactattgtatgaattattccctccatattttaatgtatgacgccgnngacacttttaacaaacgtttgaccattcgttttattcaaaatttttgtgcaaatataaaaatatttatatcatgcttaaagaacattgatgatgaatcaaggcacaataaaataaataataattatatatatttttgaataagatgaatggtcaaacattaaataaaaagtcaacggcgtcatacattaaaatacggagatagtagctagtacattagctatagataatttagagatagtagcgggctatactattaaacttgctgaaaggaaaaaaaacgtttgttctaaagaagcttcgaaggctcaaacttcccgagccaagctgaaacgactacgagcatccaccctcgttgtagttacgggcccgggacttccgttcttacgaggaaatacttaaaaaataacatatacttccctctgactgtaataaacttttggagcatagttttgtgttcttctttttttttttttacttcaaagagggaattttattgattacggaaaagaggattacattcttggtctatcaagtctatgacactactagaaaaaacatttttcccaacgtaggggtcttattttcgcaggcggacatgacacttagagccaaatgaccgcctacaaaaatataaatcggggtgaaatttgatgtccgcccgcgaaaatatcgcaggcggaccacttaagtggcgcctgtgaaaatgattttcgcaggcggaccacatgaggtgcgcctgcgaaaattagcatggtatatatatgtgacagatgggctgaaatttttctaagtcctttcctctcccctcactctcctctcctctcccctctcctccccttcacatctcctctcccctcactctcccaccggcagaaggggcggacagcacggggcggctagcgtagggcgggcggcgactcccctccctcccttcctcccctccagatctggccgaaggggggggagggggaaggccggtggccgggcgcgaggcgttggcggcgtgtgctcccggcggcggcggcggcgggcgcgtccctccctcccgcggcagagggcggcagcagcgaggagggtcgaggcggcgcgtctcccagcccctccctcctagatctggccggagggggcagggggagagcggtggccggtggctcctggcccctccctcccagatctggctggaggggggtggggggagcacggcggcgggctgtggcggcgaggagggtcgaggcggcgcagccacggcggcgcggggggttgaggcggcagcggcggcgcggacgacggtgcggcgcggacatgcagtggcggcgacggacaacggctgggcggcggccgtgatttttttgaatgtttttatttgctttctttgctacaattgattcggtgattttggatgaattgaatggattggatggggatgaagtggatgaattggatggggaatggattgggaacgggaagcgaccaccgtccggcagtggctgcccattttttttagcgctcaaagctattttcgcaggcggacctgttgcccgcctgcgaaaatcaactatttccgctggcgttgaggtgcaggcggacggcttgtccgcctgcgaaaatatgatttggccgcctaggaaaagcctttttctagtagtgagattcttgcgggagcacacaacttccactcctcacacgatctacctcatagccatttgagctagagcatgagcaatcctatttgcttccctcttgatcttgtaaacctgcacactttgtgttctgctaatgcttctaaggtaatattggaacagcatttcggtcgctgcacctaattaattatccctatgtgtacattcatatgttggaaatacatacttttactctatttatcaataagaatagcgctatctatgcacattaggaagcacatatacatatatagtatagtaaatcagaagttcaactgcaactgatacctcacccattatatacgtacttaattaccacttaccagtcctacacatttatatgaaaaatataaaaatgtatctacatgtaacttatgtgaaacatatataccctaagatacatgttattttataaattaagatctatatatatatttgaaacttaattaagacgagaacgagtttataaacccgtgtgttacgcaagcaccgaccagaatacccccgaacatgcatgcataattgcatattcagggaatccagtgaggttgcatggcggtgttcgccgagaagctgtcgacggatgaagcactggccgccgacgtcgtcgacgaccccaggatggcgtccatgaagtccatcaccggacccatggccggatcggccaagaaagcgccgccgccgccgcccttctgttcgacaaacgccgggaggcaactccgggccacgacgccctctggagccaagagatgatcacttggcttgcactgacccccgacgatgccagcggcgccgttctccagctggtacgcctccgctgctcggcacagcctgatgaactccccgtcgacggcggcggcgtactgaaggtcgccgccgccgcagccgtggacgccgtggccggggagaaagattggctggtgggagctgaagctggcccatgccgcggagttgtacacggaagacggcggcgattgagtgacaccgtgagctgcattctccaccgcgttcagtgacgcagctgcgatgctctgtcctgctccgtccagaatgttgtagtacaaatctagatcaatgcaacaaacatcgagtcgatcagtaattattcagtattcagtacactattacatgtttgtcgtgagtaaattatattcgtactgatccatgtgtaaactaacaagaacgaaaggtatgaaaattcatatgagaagcagcattttttcagaaagaagtgaaaaatgtagcacaggttttacctgcagaggaagggtgcagactacccacggcctgggagatgagcttcttcttgatggtggagttccagaagttcttgacctcattgtctgttctaccaggtaggtgcttggcaatctgagcccacctgcatgcaatgcagtgaatcacagtgacacagcatatgttagccagctcaaatctcgatcgattgccacatttgcgccccgtcctttgtctcagatcaagttaatgcgattgtgcattactcaaatataggccaaagcgtgcaaagataagtaactgtcacactgtcatacatgggacgttacagcctcatcacatgatgcagttagcagcaacgcagagatgatttgcaggtagagactgaccgaccaaggattacctgttgcccagcaccctgtggagctcaatgatgagggactcctcctgctgcgagaagcttcccctcttcaggtcaggcctcaggtagttgatccacctcagcctgcagctcttgccacatctctgcaaccctgcatgccatcaacaatacatggataacacgttcaccgatcgatgccataaacccaagtaaactgactgaactgaactactaagctagtctgaagaaactctgaactgaaactctgaactttgatctgcgactgaaaaaactatgtaaacgtaataaagcacttaccggctagcctggggacggagctccagcagccatggccgtgcgtggagatgtacttgacgagcttctcgtcttcctctggtgaccacaggcccctcctgaccttctgcttgttgcagcaggagtggtgccccatctcccttgacctctcactctctcgctgtactccgtgtaggctaggctcttgatatcctcttcttcacactgccggcagtagtaataccggccagaactactcgagcttttcagtagttacatggttattataaagaagagaggagaggaagagagagagcaaatgagcaaatacgccaactgcatgcatgccattccgctacatctaagggcaggcagatcaaaagcaaggagaagaaaagctgggcctgaaactgtgcatgcagttgagtcgatcgtcctagctagccaggaccctagctaacctagacgtgtgagctccatgttacgtaggttacttcaaaagtgagtggctcaagccaagtgaggggtactggagtgatgagggtgaatggaggagggcattttggtaacttaaggccccactgtgagaggaagacttgtgccatggaattgagctcctatgcctggttagttttgggaactcctgtactgtggtgtaagtgtgtgatgcctgagttgggtgtgtgtgtttgcaagcgtaaattttcaccgctctatcagtacggccataactgctatagtctgctagtagctttcttcaaactactaacatggcagcagctaccatttagactagtatcaattcgtctgtgtacatctaatggtccaaatatgttcactctgatctatcatctatatttgtacgagagcccaaattgcatgtgtatacgttttgtattagcatgcacgcaggtaaaaacaggcattacctagtgactatatagcactaaataaagcaatgcacgtagtgccattcattcacctttgacaattaaacgatcaagagctgcgattctcttgtctatacgccctgccagagagaaagacaagggatcaggatcaactgcaacagaaacagaagatctctggctctctgtacgtatgtgcatgtcttcttaggtagcttgcccgaaaagattgcagttgtaattaagccgagtaggtggcgatccgtatttgccagcgctctcgatcggcaaagtattcgttctaggtaaattaaggaccgatcctaagcatgtatagctaggtttatcgatctgaagaaacctgtaatgtgtgtgcactctgaatgattcatgtttgcagacacaattttttagctgatgcactaactacactatgggtttatttgatagagtttcaactcataaatttagctctagtagttgaatctagagtaaagttgtaaaacagcctaattaaacccagctccgctctcattttaggtagagctaaaactgtttggccggatggagttgaagctagagctgtgtcaaataaaccctatatattttgcaacgtttatttaactctcaaattagcttcacttcagtttttgccgttgcaaccagtggtcgacacaagccgatgtcaagaggctaaaggcaatattataggttgtagtactagtaccgtagtacgtacttgctggcgaaagattgacgcgaaagaggtgagcggtttcggacaagaaaaatcgagtgggccgggcggggacggcagccgtgcatatgcatatgcatgggcctcttgcagaatagaggaaacgcgacaacgcgtagtagcattcaaccccgtaccaacgtacatacgcgcgcgatcgctcacagagtcgtcgatcaccccgtcgtcgcacgaccacttccccactcctctcgatagactccggccatgatcgaagcgtgcaccatacgggtgtggtcgctcatgcgcacgtcgctcgtgccatcaatgcgccggggacccgcgctacatgtcatggcatgtacacgtgctcgtactcgtactactaatatactccatatgcatggtacataatacatgccacactcaaaggtcacagctttgctatacaatgctatatatgctacaaacaatcatgttgtatatatattgtgcgtatgtaatacgtgcgaaacgaaatgatgagaggatttgcttgtatttacagttaattatccttttaatagtaaacaaagtaactataaataacgagatatgttcgtcatgatttcgttaacatcaaaatgtgtcggttcagttcttttaaggtgcgtgtttgtgtactatgctttttttgttaaaaaaaaaatgtcgtcctagctagcagcggcatgtacacatcctaaagacgaggaagagatggaggtacgcctgtaccggccggcactttcacgtacacctgcatgataggagagcaaaacggcatgcaggttaattaataaacaagttgcatggccgcccggtacatgacacaggtgagcatgcatcaccgagctgaggttaattatatcaggttaatttcctcctcggttattggattgtttgcaaatcgttcgtacctgccgcggcgccggccatgcatttgcagcagctagtggccgatcgatcacataagtcagtcacatgtgtgcctacttggttgaatatcagtccagttcgtccgtgcgtacccaaagatgggacgatgtgattccccaaccaccgcctacttctactactacagcatgcagcatgcatgccacgcccgagatgacttggttcagtggcaagctattagcccctgcagcctccttttcgatctgtgtttctctttctgtgtttaccccctttgtgtacgtgctacgtgctctgtttcatttgacgataaattaagtattagtcgcgagctacagtagctgttttcttctctccctctttgcgttaaccataagcaaacaaatggcacagcgcttgtacgtgaggcataatttaagccgatcgatgagctttgctatgcgtacgtaactaggtatatccggtacgtattcatagtgcccatccatcggatgacaaatgtccggtcttcgggaacggcagtacgtagaaactgctccatggtgcagaaagtacaagcaaatataatgcagctcttgctgcacttgtaagcgaagctacggaatacacatcctgctggagagacaaaaaatgcaggtatatatcttcatgaaagaggcgcagtttcttttttttttctctccctctcttcgtcttttcagttatcactgtccataattagaaaattgtcagccacgtacgttacgtgcatgtacacagctgcacgtgcgattgcgcctccatggactttcggagtagaaagtcacctgacgtgaacgggttgtcaaaaaaaaaaaaaaacctgacgtgaacggtgcagaatcaatctccccgccgtacatggagcaggagaaaaggagcataaatagttcgttcagagagctgttcggtgctatactagtactgctacttggaattagtcgtccaagaacgccgagatggattggagtcggtggagtcgataccgaaagagttgcagcagagattacaaaagtcgtgttgacagcgtgcactggcatctcgtcaatgcttccatttcataacctttccagttcatggatacaattcgagcatgacacctctctagcttcaccttttcaaacgcacaatacagatgcgcttaaccggattcgcatcctcaccaaatcagcctatataattaacctgcggaaccttttttttttcaaataactactatctccattacgttttaactttgatcgaagtcaaactcatttaagtttgactaagtttttagaaaaaataataatattttcaatctaagataaatttattatgaaaatatatttaattattgatttaataaaactaatttaatattttaaatactactatatttgtctataaatttaattaaacttgaagcggtgtgacttcaatcaaagtcaaaacgttttataacttaaaacggagacgagacgtcttgcatgatccgacagtaatcaggaggcaagatgaatttactacctgccccaacgaaggccgcgaacgagtcgttttccaaacccgtcccgtccaagagaagcggcacggcgacgtcgtcggtcgcagtccgccactcgcgtcgctttcaacggagaggggacgagggatatcgccgcgcgctgtagcatccgcatgccgttagccggcaacccccggcaccggggaaggagacaagccgaatccccctcgcggatatcgccgcccacgtcgccacgcccgcacgcccgcgcccgcgcccgcgcgcgatggcgtcgtcgcgttggcttcggatcggagtccggatgggccgaaacgacttgggaatagtggaaaaggatcggcttgctctgggattgccggaaaaggatcggcttgcggcccggtgcacggcggtggcgatcacttgggcttagagacgtgaggtgccgcgttgcttgaataatcgcccgtgtgatggatggggcttgctttgtcagctcatctgtttggctgaccttcaatttctagatttagcttcagaagttaagtctgggggtatagttatagagctgtctgagagtctatttggcacagctttagctccacctctcctggagatagagctcagccaaacagctccacctgaaatgggagcggagttgggtggagcgctatcaccaaatgaactagagaagtggagctgggtttaagcagctccacagctccactccaaactcaacttctggagctaaatttaggagttgaaactctatcaaacatgccccaaacccagctctacctctttagttcattttgtgagagtgcaccacccagctccgatcctagtgtaggtggagctgaaactgtttggttgggctccagctccgggagaggtggagctgcagctgtgccaaatagacctaaaattactgcactgttgaggataaatttgtctcgattaaatcaaaacagacataacacttggtaaagtatcgaccaaacaatagacactaatattttgtgtaatatatatccgtgcattgcaacggccaataccattagaaacgggttgggttggatttagcatattattttttttttcaccagatggatttccaccaatttgagctcgacatcaaattatattcaggaggatcaatcaattaatgtaactaactgttaacaaccaaatttggtaatatcggcattggaaaagaagattagattgaagcaaagtcggaggcggagatcgagttcggaaacagagcagggatcggctggagtccagatcggctacgataagatcggctgagtctgagtcggactaggtaagccgatgtagccgatcctagcaatacaacttgatgtgtgatgtcgggttagattgaggtgcttcaaggtgattgccgcacatggatagagtcctgaggaggcaattgtatctattaattaggatgttttatgtaatttccttagagatatgattaggcaaaagtctgccgcaaagacttatagtatcttagagtttgttagaaatggtagtcgtgtccgttatggacatatcttgtaattctcgggtataaatagaccggagccctatgtaacttttaacacacgttcaatacaatctcggcgcatcgccccccttttactttagttttgttttgacgagttcttgctttcgagttgagctgcatcggtttcgatcttcaacaagaggtaaaacttgttatgacgacttgtgttttcgggattagtatttccatctttatgatactctgatctcgtttatataattcgccgagctatcatatatcttacataatcttcggcaataccgctatctaatctacaatcggctaacatctgtcggtagaaggcagccgaccaggttaaatagcgacgttgacctaaattatataagatatttaccactttatgaaactttcagtggtttgattgtctagatattgttcttcttttcatacttaatactgcatcagttaagtttgatctattaaatcgtgcttagaatatcaacctctagcctgccttctggttaccgattagggtagcatcggagtttcagccgatcttatctgatttaactatatttgctctatatgctttattgacatgttaaatctgccctttatgccaagatattgatgtatttgaatatattaggcttttgcttgatattctatacctgttttaatatcctgatataaagtagtatcggagtattagccgatacatgctagatctatctgatcggctatgctgtaaacatatatagtcctgttattaatatatatttcggtctaagtgatttatactgtctcggcatggcgaccgatctatcccaatcacttgatttaattatatatcgatataaggagtatatatcgttaacatctacagccgatcaagtagatttagttctttcttacttattcaagattgccgatcaaatacacatatgacatcggctcaaagataaatgatatatcatcggcacttagccgatcaactatcatttatagatttaaccgcgatttctttgcttctacttcttgttgattacaggatcaaatcaactggcacactagcacacccgaaggcgagctttggacctgcactggagttaaacagatctcccaggcctcatgttttctgtcaacactaacacagctaggacctacgaggctacgagtaccaattaaaaatcctccaaacagcttatagtttggatggtaaacaatattaatagttttacacatgctaatatacattcgtattaatccaaatccttggcgaggaagaactaaaaccctatgcataaaataacaatagcaataaacagctctggaggagtaggtcaagatttatgggaaaacccgtatggaattttgaaaccttttgtagcatcctaaaagttgtggtagcaccctacaaatttacaacgttccacatctggtggatgtaatgaatgaaaataatgaatcggaagaatatgtaagcttgttagttaacacaattactacttgacaagattgaacctcagaggctttatacaattgtgacttcacaaaaggcacttgataaaatcttgaaagagaaccttgccctgctccatgtttcttacggatggatagaaacttcaattagaaccatgacctgacattttcttctctctgggaggtatcttcagtaaactcttcatcgtgtcatatgcggtaaaaccaatagccacagagggtaccacctataaaaagaaacaatatttttataagggtcaatctggctaactcaacacatttatgtaagttgcaactaaataatctcttgtgaatacacatcattcaacaagtaaggttttcggctgaaactgagctggacaaatagctaaaacaagaatattgaagacaatcatgcaattcaatgttgtataaatgaaaggaaccaaggaaaattaagttcaagagggaaaaaaaatgatctgcagaattttatacatgccactggaaagattcatacagttctgacatgtacaactggaatccatatcctcttgtcagttgagtggcaaatgcaaaaagtgatgcttttcagtggaatataaacgcaaatgactaacaagaatcgcctcgctccaggttagggtgcagaacattgctcagaattaccatgtaaccacaaaagtttcaaagccaaagcaagcacaggaatgctattttttcttggggcgtaaaggttcagaatttgaggttctaggaactattacgagagcgagtattattacttgggtctaaccagtaaatagttggttatcacttggttctagcgattctagctagcaaaatagttaatgtacttaaatgttccagatgattgacctgccatcagtcctagcattcttgattatctgactagtaccatttccaggatattttgaaatgc

SEQ ID NO: 69847 - DNA, 2043 bp, Oryza sativa
tgcaaaatgatatatcacttggcatttattataaactttaaaaagtacatgactggtgttcctacgaatatatgccattgcatcataaaatctatttttttccaattgtaattaacatagtaatgtaatataagccaatacatcataatatctaagtttatgagtatatatactttttccaattgtaattaacatggtaatgtaatctgaccaagttgaccacggtaaaaagctaattttgagatttgataatagcacttgacatatgaaatcgaatagatctattgcaaatttgataatagctctagagcaactaactagcaatatttgctcacttaaatatacaaataaatttgtaaaattaattttccagagtgaatatgtcagatcctttgtccgagctatcttccgaaaggctttcaaaattatgaacgcaattttgtgcagcagaggtgagtagtattgatatgtttctcatcatgctttatttatattattttcttttggatcgctacggacatgtatattaaaaactttactcacaaattaaattatttttttagttattgttaataagctacgaaacataaagaaactgatataagtaaaacaatgaagtcactcatgcatgaagaggcaaaactcccgggcacggtctgtccataaaaaaaaagttgtgtccatgtgacatgacaagtcacagccaacttctaaagagtgttaattaatacggcagaaattgaagcgtcaaaaggagcccacgcgtcccgtcagccatactagactacaggctgctacagcaatcaacaaaactagtactactcaatcgtgctataagcatatgcacttggcacgcatcttggaaccaacgagcagctgagatttatggtgcatatgaacttcggttcacatctgagtttccatatatatatatatatatatatatatatatgtatatatatgtatatgtatatatgtatatgtatatatatgtatatgtatatatgtatatgtatatatatgtatatgtatatatatatgtatatatacatatgtatatatacatatacatatatacatatgtatatatgtagagatacatgtacatatatgtatatatatacatatacatatacatatatacatatacatatatacatatatacacatatatatatatcgggtataattgatggatatatgttatacaccccactaatgttattgtaagtgcatttcaacgaattagttactgcaaataagttgatattgaaaacaaacgaggcgttaaacaaagtttttgtcaaaatttaaacaatgatatggtgctatgaagatttccagggtggtatggtacatttgtttcgctatagtttctttaggtagtgtcgaataatcgacctagctcattttcaatttcaaaagagaatgccatatcaatacaatgagaatttgagtactattgattaactccaaatgatgtctactctatacgataaattgacaaaaaaaactatttttcatcaccttcattttctctgtccttccctggaggatgcaagtatatataacagagcttgctacactgctctaagtatggtaagaccatacataatagtaaacaagaaattaaaattgtgatctgcacggatctttaggggcatgaccatgtctatgtggccaccttgtttaaaggttactgagaagaaagtcttggtagctatggtcggctactcagtttcatccattagataggtattcgtgtttaattttaacggtattgtcctatcaatgggcagaatcagtatatttaaaatatttatatatagtgttggaaataagtagacatgatcacttaggtaagtagtgggataaattttttagtgtattaatgatgtattgagcttatttttgtggtacagatataatttcatctattaaatagggagcttttaaaacaatgataatgagtagtggtgatgatatgcgaatttacatataaatggtacaaagtgatttttttttaatgggctgcaggaattc

SEQ ID NO: 69848 - DNA, 1725 bp, Oryza sativa
tacgatgatataagacttattttagtattctttttctgaataataaataagatgcccacgtatctgcacgggttttcttcctacttaggttaataatgaacggtgtttccaaaaatgaaataaagagacgtactagcgtggaactaatataaaattttttgacaaattgacctttgtacaaaacttattttaagattagactgtgctaaaacttatattctataaatgaaccgtcggctcagcgccatcaagattggcgttggggtatcacatctcagctccaacggctttggcattaagatcctagttgagggtggggagttccatagtgataattaaggtggtgccttgtttctagccggaagtgagctagtggtgcaatggtttggtagcttacttggtttatgtaatgttgtactatactttctctgccccataaaaaataaatctagtatgagatgtgacacatcctagtaacatgactgttactatggtgtgttacatcatgtgcttgcccctgtccagatttatagtattatgatgtgtcacatactggaatcggtttgttttttatgagacggatggagtaggttcaaatccctttggccgccaggtaagtcattttcattttttctctctttaaatctcaatgctacacatatatacactgctaagaaaaatctttttctcaggtagccaaaaatagtttttcaggcggggaaaggaccgcttttccccaaaggcctgtgaaaatagatattttcgcatgcgacatctctatcaatattttcagcgaacaaagaaaaaaatcgctgccaccaccgttcttgtcgccgccgttggcggcctccccctccgactgacgtctctcctccgtccgccgcccttatgtgtcttaccggccagcacgatgcgccttgagtaaagcaacgacctcatcatgtgtatcctgatcccaccggtgggcacgtaggcaacgaggaaccccgttaccaccaacggccccatcatcttcgcctgcgccgccgcttccacctgcagcgcgtcgggctcgtacttgggcagctcctcctcctcggcgtggtgcatcacctagcgcggtagcgcgcgacatctcgatgagacccgggtcgagccacactcgcccggcctcacagattgaactgcgcagcgtctcgctgtggtggtaccggaactgggagatctaggaagggaggggtcgacgctgcctgcggtgccggctccgttggctcctcctccgccaccgcttcctcctcagccgatggacaaatctgggagggagggaggattggagcgccgccgccgcttcccaacctcgtcgccaagccacttatggatagatgggccaaaaactcagaaatgacatgaccaactgggccaaaatttaaaagtctgaagtgagcaacagaagaggaggctgccgaccaaattgtgggccggttgagccagcctagggttcggctgaaccctgggttcggccgaaccaaccgtggcgcagtttgacccaggttttggctagatggctcagatagactccctatgatggttggagggtattaccgacctttccaaccgtcatacttaagctataaaaggccctcgctctctccatttcaagatacgcctcaagcaagaagcttcagtggaatagaaatagaatagaaatagaatagaatcttcagtcctcggagtcttcggaagagt

SEQ ID NO: 69849 - DNA, 1149 bp, Oryza sativa
ttcctgcagccccattggtgtgggtataatgttcatttatatgattactctaagtcacgacggtgattgtagagtagtatttggtagcataagagaggtgcttaggctactgaatatcattatttggggttatatggtgtggatatgtcgaggtgggccgcttatggtgacagctcagtacgggtattccttcgcgcgtgtatataatcctaagttactttcctgggcagggtactcctccgtatttagccccgattggatggccatgacgggttgtcgtaaggaactcgacaactaggggcggtctctcgaaacaccaagagggcattgtaagaggggtcttggctatataattatatagtagataatattgactaaagtgtatgtatgtatattagaagtataggaaatgattcttttttaattctttccacttaacctagaattagtatgtacgagaatagtgaatgcttcagctttgtgtcatttgaattgaactaacccctgcttagactttgattattacaagtaagatacaaatattagcttggttctctctattataatcttcccacgggattaaaaaaatacaatattgttggaatactcccaggtgaaatgctacaatggtatatctgtgcgcttgcggatgaaatctgtagccataatataccacgagtgtttctgtgccattgctgggaattacatttctagtaatatcgttaagaaataccaacagccgggacgggagagggaggagccgagccaccgcctcacctcctcgtcgctgagccgccgccgttgccgggagagggaggagccgagccgctgtctcccctcccctccccgagaccggctggcggtggatctgcgcacctgggcctagccggcggtggatctaggcggcgtcgtcgttgcagcaggcggcgggacccaggtgtcggcgccgttgtcatcgcggcagtcgttgtcgtcgtcggcatcggctagatgagagagagagaggagagggagggaaatgagtggtggcgatggtggaggaatttttgcaggcaaaccacgtaaagttcggtttgcgaacatcatatttttctaggcggatcccttaagaggtctgcttgttaaaataaaggggttccgcctagaaaa

SEQ ID NO: 69850 - DNA, 6454 bp, Oryza sativa
agatcaacatttcaattccgtttcaaaaaaaatataaaaatgaaaatagtagagggttttccgaccgttttcatccctagttcctactcacgctgatgtgaatatacagtagtaggagtgttatagtgagctgtgtttagtttgtgtgccaattttttttaaaagtatatggacacacatttgaagtattaaacttagactagtaacaaaacaaattatatatttcacctgtaaactgcgagacgagtttattaagcctaaataatccgttgttagcaaatgtttactctagcaccagattgtcaaatcatggcgtaattagactcaaaagattcgtctcgcgatttacatagaaactatgcaattagttttttttgtccacatttaatactccatggatgtgtccaaacatttgatgtgacggaaaagttgtaagtttgaagaaaaaattttaaatctaaacacagcctgagttacgcaatgtaggtttgtgaagtggtactactggtcagttgcgcagcgcgagaaaacgttgctcatatagctgttgatatcgaccacgtaaggaactgaccaaatgaaaaacaagtactaatattatgtagtgagattacccatactataaatttgaacatcgtaatattatatagtattacatacctttaaaattttttatattttgaaacgggaagtatagactagggttgagagaaatagtagttagtagtaaggtactaggagtactactctttttatcctaaaaataatccaattctaaagattgcagcttctgtcgcctgttaagcgagctcgtccgcgctcaatctgaatatggtttatgttcaaattaaattgtagaattaaagatttttatgggaggaagaaggcccggtttagatgctgaaaattttcgggtctgagcgaaaagttttggcatggtccagttttcgcgttttgggaactaaacggtgaaagatttcggggtactgtttatgggtggacgagtagtacccctcaccctgcatgcaagcaacaacaacacctaggagagcattaaataggggcaaatcaggcagcattaaataggtccccaaaattttatgccaaaactttggctgtttagttcccagaatgccaaaaccccaaaattttttcctccgcccaaaaattttggccaacttttatgatgcctgagctcactgagtcacgttcaccggctcactgcctcccagtcttccagcgatgcatcggcgaccatcaatggcctcatcgtcctccttgcgccgcatgccgacgccacgaacgtacgccgcgcgcatgcatgcggggtttctcgtgacacgcaggccccacaggcagacacggcaaggacaaagccccatgggcttgcatgcacagtggccgtccctgtgcgagacctcgccccttgggggtcgtgtcatgcgatcgacgggaaactcgggcgcctctgcactctctctctctctctctctctctctctcaatgatcttggtcgagtcgaagcaaaagatcgcgtgtctgtcgagtgtcgacaagccaagctatccaaaggagtccgaacgtgtgggggtggccgtggccagtctcccgtgcatggcagtgtctctgccccctgactgctcgccactaccaggccgggccattctctctctctccctccgctagaagagattttaaatgggtgtgacacattttaatactataaatttaaatatattgtggctgtgtttagatccagttgtaaaattttagcgtatcacattaaatatacggacacgtatttaaagtattaaatatagtttaataacaaaataaattacagaatccgcttataaaccacgagatgaatttattaagcctaattaatccgtcattaacaaatgtctactatagcaccacattatcaaatcatggtgcaattacgcttaaaaaaatttgtctcgcaatttacacgcaatctgtgtaattagttattttttcgtctatatttaatactacatagatgtgtccaaacattcgatgtgaatggtgtaaaatttatcaagggatctaaacaggtcctgatctatgtccagatttattgtattagaatgtgtcacatatatttaaaatcagttatattatgcgatgcagggtgtatctccttgccgcgcgagatgacgggtttctgccaggtgggcaagaaaacaaagcaagaccgggcgggcgctacgtgtgctagcttagccccccggctacactacagtcactcacccccgccggcccgcccccggccgggcgtccttgttgtgatcgatcagcggcacacggtggcgcccacggtgcgtttcccccggcccgtgaccggtcgcaggggcgggcacactggcgcggtcaccgcagcaaatgcagcggtaggacgcgtagtttatgtgcgcaaaactgatcggaaccgacggacgtaagcaaaatataaagagaacattgcaaccacaacaacgtcaaacgtgaaagttttttcagacaaggcataaaaatactaattcctttcgtttcagattataagagtttataatattatccatattcatatgagactgcctatacatcatgtgataggcacacatatatatctagatgttaatgaatatagacacatatatgtataaattcattaatatatatatgaatatgaataatgctataaagtcttataatataaaacggaggaagtatcgaactataaaaattttctacagaataagaatctacaatactatatttgtctcacttattacctcctatttaaattttctgcaaataccaattttattcaggggcaaagtcaagacccggtcactatggacaagtgcccaggctccgcccgctgcaaaagtacgtaccagctgcttgattaatcgatctaacatgttatgttagatttagtctactatattacatctgggttatgtcatttttcttctataaatcgaaatactccctccgtattataataaattcatttttaagcctttccatttatctcaatataagtttatttttttaagtaatcattgtatcaggagtttatgaaagtatatacaaatgtattgggatttgataaaatagaggtattatagttatttgggttttgattggtatgtttgggataagtaaaaaaataaacatattttaggactgatggagtatataattttatgaattttacatatgcttagggcatgtacaaaggtaaaatttaatatgagctctttatattaattaatatcactagatattgtactcctataatagataagatctctaaacctttaatgcactaaataattttttttatacttcttttcttttctccaccctcatgcaataatttttccattaataaatgctaatagtcgactatgagtcgtcgtcatgcatagcaacgatgtttctcttttcttccttttctttcttcaacgtcaccaaatttatctgcattacaatgaagagaccccgttattagacaatgaagagaccccgttattagacaccctgcatatgccctatctcgtttgttcaggctcaaaatacgtcattgttcttaccgtcaatcactgtcaccattttgccatgtttatcctcacttattaaaggcataatagatgtcttccttttggacggcgttgtaaccattaacggatttgctatcggagcttttggtttgtgggccatcatacgagtgtcaagatatgtgctaggtatggaaaaaaattcattgcacatgcaaaatgctagctattattatattctgtaacggaggaaatagtcacctgttttttcttgtttatgttatgacaagttacatataaatatatttcagttatactataattatacttatactatatttaccttccaaagttttggactaaaagaaaaactgtcgaaagtctttagatagtctcaacaattaattaagcacttcaatgtaatgtaccgctacttgcgaacgtccgaattgtgacggatcggatcggtttatgcttttgacagtttttcacccgtgctagctgctgcgcgcggtgtcgtgtagtcgtggcggagacctggagtaaatggtcggcgttctacgtgcgtcagccatagcttgaccgggctgcgcaggcagtacctccttgacgccatcgacgattatccaacagtgccgcctcagtgcacctgccaggtggggcccacctgtccacgtgatacggcactgttgccttgttgtacacacactgttgctcagtgctgctttgagtagctgggtaggcatagctgtacaggacgcttagcaatgaagtgggctaggagtagggtagagtacatcggtgctacagaaaaggctacagttgcagcaaaagcccacccacggaggactagttcattcacccagtccagtccagtgccactagtactaaaacacctcctctccgtatctccggttctgtctgcaaagcttctaattgctgtagtttcttttaaaatcaaagttctcctagatagtttagcttttgattcagattaaaaaaaactgtaattataaaattcaagtagtaataaatttaaagccagaagtcagaaaacctagtatttctagattatcggaaatagctacaacgtgttatttttcagaattttaaactctccaaacgtgcctctctctctcgggtgacgggtggatgcgacgttaaatggcaacagcggccacgtcacctccgacgcctacaccgccgtagtactcccaaacctgattttcgtgtccttgaccgtccgtcttatttaaaaaaatacaaaaaaaattaaaaagataagtcacgcataaagtattaatcatattttatcatctaataaaaataaaaatactaattataaaaaatttttatataagacggacagtcaaatattgccacgaaaatctagggtttgcctttttttggacggagggattagacctcaaggtatctctcatgatcccctttcccaatactactgcgtactcctaccgtattttgcgtactccctccgttttcaaaataaaataaacgtagctataaatttctctgtgtccaattttaatcgttcattttatttaatttttttttaaaaaataaaaaaacataaagcacgtataaaatattatttatattttataatctaataataataaaatactaatcataaaaacttaaaataaaacaaacaattaaaattgaatacgaaaatttatatttgtgtttattttagaaacgagggaggtctggactactactagcggcgtagcctagccctgggctggtgatgatgatgcaacggcgccggggatttgacaccccggagacgtgacgaccgtagtgcaatcccggggaatctgcgtaacaatccccctgctgctgctgtcctgctagcctaaccgggggtggagtagactagtagtagtactaccagtagcagtgtaccacacgtagatcgggccccgtgtgacagggagagcgacgccggaggggggagatgggccgtgcaaccgctgcttatgtggtgtcgagtcgatggtgggggctaccggtcgggaggggtctcgctctcgcccaccccaccggcccgtcgtggtgtacagtgtactcctacgcggtggccaatggagagtgtgttttagggcagcgttaatggccaccgtacgtgtggtttgccgatcaaatcaaaaaccttgcgctggaattttgtggactaaaatctgtgttggcgactgcgaggggtggaagatgacgacgaacgaacgaacgaacgctacgggctcactcggtcaagtcaagggcatgccgtgctcgttttggaagttttcgatgttcatttcagggactccggagggacactcgtattgggtttacgaataggagatggcctaccgttccgggcttaaatgaaatgatggttttcacgaaatccggtagaaaatcagtagattcaataaattttataaaccaaaatttgaatacaaattccctgagtttatcgataagctcgtgaaaaccggtcggcttgatgaaattctgagcgaaatcatcgaaatttcaatcggtaactagtaaaggaggtaaactgatttttttcctttttaaattcgttattcttttctttactactgtaaatttcagtaaatacacggaatatattaatttttttgaaaatttatattccaataggttctataaatatcgttaacttctcccgtcccaaaatatagctacctagtacaggatgtgatattacctagtactactctcggtgacatggggccgggggtatcgtgactagaggcttgggtagccgcggtcacccacgtggcctgacccccttgggggggtcgggcccgagggtgacgtggccacccctccctctgtctccccgaggg

SEQ ID NO: 69851 - DNA, 74753 bp, Oryza sativa
agggacccagatgaaaaaagtacggccccaagctttttatgggtggccaaaattgcaattagccccttgccgccctctgtatgggcggcaagggcctaatcgcaattttggccgatggcggcagacggcgcggtcgacccatcgtctgccacgtcagcttgccgcccaccattgaggcggtaggggctatttctacaatttttttggtcgatagattatttctgtaaatattaaaaaaaatctaaaaacgaaaaaaattctcgaatttgactacagctttgggataaaaaggtcctgatgggctggctgcttgtggatgaagagatgattctagatgggccgaatgggggataagtcatcgtacgccggcccagcacgaccataaaacctgccatcctctgctgctgcttgcaacacaaagaccgaacacacgtttcttgctgaattcgatggtggttaattaggttgctgaatgctgattagtctcatacaatcatcagcgttttgtttctcaaatactgtccgtcataaaaaagataaacttctggttatcaatttaaatagatctacatagttagaagttgattttttttttctaaggaggaagagagtgtaacattataagatgaacccggattcatttagtgcagaaagcactttaacacaacagatcgattttctgtacttgtgcagcatatactccctccgtcccaaaaaaatcaatataggattagaggggatataacctgtactctcaactctagattgatttttcgtgagataaagggagtagattgctatccttctggacctctttcggatgataatgagatatgtgcgaatatgtgcttgaaattgcaaaaacccaatcctaatgtcttggttttttctcgagagattgtccatcatacgggcctggtcatgatcgacaatggatgttgggccacacctgggctagacaggtcaatagctgacggacgggtacagcaacgagcaattattttttttttcgagaaatagggaatatattatttcctccgttttatattataagattttatagtattgttcatattcatatatatgttgatgaatagacatatatatgtgtgtctagatttattaattataacctgaaacgaaggtagtactcaagagaagcttcctcacaaaccatacgtgagataaagttataagtattttctagccagagcccaaacacatattcgcatcgagccttattcgctaaaatatggctaatacagttttagctcctctggcccttgatgaatttagggcctgttcacattggtgtcattttcaaccttaccaaattttggtaaagttgctaaaaaaagtgactatatttagtttcctgccaaattttggtaattatataagaaatcatgttaaaattttggcaagttaccaaaattttagcatttgataatgccaaaatttgataaggtttttttacagcaagatgaacatgcccttaatctccctatttcctaatagcaggtccttgaccttcacggatcagaaaggctatgtccgaatatatcctctcctcatactgaatcatattgattgcagccagacagtccgactcaatgatgatcggcaccagggtccactgcaaggcccgagcaattccttctttacaggcgagcatctctgactctgcctccagtgcactatatggcaatgagcaaggtgatcataagatgcaaacataatcttcccagcactatctcttaagtcttaacacagcacctatgccccccttaagcttaaggggagtgacgtacgggaatttctgtgaaaacattacatatatttttaacatatatatcattttaagtatgttagattagattaaatagatgtatataaagatatatgcatgtaccaatacatatatttgtacgtattctgtacgagtacatatgcgcaggcatgattcatgatgtaatgtgattcactactagaaaaatcatttttttaggcggccaaaagtagttttttcaggcgggggaaggaccgcctatagaccaacgactgcgaaaatcgatagcccgcctacgaaaatcctctagacgaacaaaccggccccgcgccttgccgctctcccccggcctccctccggccgtatctgggaggggagccgcgccggagccgccgcccccgccccgcgcgttgtcgtcgccaccccgcgccgtggctggccccacgcctcgcctcaccaccgccgccctcccctgacctccctccagccggatctgggaggggagccgcaccgccgcagtcgccgtccgcgctgccgccgtcgctccccctccggcggggagggagggagggaggggagggggacgggcccggtggggagaggagaagaagtgttgagggagagagagagagttgagagggaaatgagtggtagggagggggtgggaggagaagataaggagttaagattttttttttttgtggtaggtacgatttttgcaggtggagtacataaggttcgcctgcaggcatcgcttaagtagtccgcaggcgaacagcgaacttcaccccgatttatattttttaggcggtcatttggttccaagggttatgtcagcctgcgaaaaaaagaccccaatgtcgggaaaaatgctttttctagttgtgattaataatccttttaactagatgatgtccgatgctttgctgcgggatatgtgttagacaatgtagaaatgataaaataatttggattgaaatattatgaaaataatttgagaatgatgatttagcatgtgtatgtttagtttttaaatgaaataaattgtagatataattattatatgtttgtatgttgagctttttgtgtttaatgggttgatgtggcatgcttgcatgtagcttttaggagtgctaataaatattatgcttgcatgttagtttcaggtgtttaatgcacattaactttattaactttatagaaagaagggattcctgcatgagaccatcgagttgcagaagtaaaggaagcaatgggtcgtatccgtatgcgagcctgtttggtagagctacaactcctaaatttagctccaggagttgagtctggagtggagttgtggagctgtctaaaaccagctccacctctctagttcattttgtgagagcgctccacccagctctgcgtggagctaaaactgtttggctgggctccaacttcatgagaggtggagctagagctagagctgtgccaaacagacccgcacgtttgctcatgggctgactgcttctatgtctgtttgtgagctgaaggaatgttgaatggacaaaactgatcggacagttatatatgagatataatctccgttgttataatttatagagtaaaatgcaccgatggtatcacaacttacgaggtgggtgcaatttagtcactcatcttgtaaattgctcaaacaagtcactcatcttgcttcgatagtgcaaatgttatcaaatacattttcacatcgattgtttgttttcaaattggagtccatattaacctagcatcatgcattttttaccaatgtagacaggataagcattaaaattacaaattaacacttatatttttatgtatatactactacccctactttcaatgaacacggtcatattgtgcttggcaatcaataacaaaattcatcattaattgaattttactaccggtagtattgcacgttggattatttatgaatcgtgtgaccatgtttgcaaaataaattaatatagcatataacttcattgcgaacactccatacgacacatgttttatatgatttacacccccaaaacaagatgagtgatttgtttgagcattttacaatatgggtgactaaattacacccaccttgcaagttatggtaataacggcgcatttcactctaatttaaacctaccgcgacctggcagtatagttatttattttttttctcttcaattaacgtgtatggtgatttcgttttagctatatttagatagatttttttttccaaaaagcataacccatgttgtgacaatggccatatcatgtacgttgctttcttatggtctggcaaaaattctgaagcaattaggagtcagattctcgtctcgagttagcatgcataaaaagcgtggttgaatttcaaaaccaaaattcagtttggttttgaagtttcttattgcctaagagcaagttcaatagtatagcctactactagctccaatttatttatagccgatctaatagccaattcatacaatagttgcgtactatattattaacatatggtcctacctgtcatacacacattacgtcttgaagtccgtactgcagctggctacatatttgtagcccgctgcttttctctctcatcttttatctcatgaaaatatgtttatagctggctaatagcccgctattgtacatgctctaaagactcctttaaaacacataaattgaaaaaacacacgacttagtaacaaggattgttaattcttatagaaagacaaaaggaaattttaaaataggtgttgttgtatcgcaagaaaaattgtaagaaaaaaattgaaaacatgagctatgacaattcgttattttcatataaaatcactttaggattgtttattccatagaaatttcaaacaaaacagtagaattcaatatttttcctttaataaagggttgtatgataggagatttttctctatgattacaatccttaaaatttctcgtaccaatcctcccattcaagagggcctaaaatttaacggaattaccccaaacttagagtaaatctcgtgaaatcggagaaaattattcatctccttcctccgactttcaactcacatcgctcctcccgtcctcccctacctggaggctgcagctcctggcctcccgggcaactagggttcggcaaatcccccgcaaggagggtgaaacccttccccaaaactccccaatccccacccgaccttcttcgaaatcggaggcaaaaccctaatcgcaaacagctcgtcctcgcgcggccgccgctccgcagcaatggcgtccctcttcaaggtacggattccccccccccccctccgaaaccctagctacccgagctcgtcgattccccctcctctcgcccttcctctgaggcggctcgcccgattcgcttttccaggacccgaccaagctgtccgcgtaccgggacaggcggttcaccgggacgcaggaggagtacgaggcggcgctgcaggcgtcggtgacggtgtacgtcgggaacatgtccttctacaccacggaggagcaggcctatgagctcttctcccgcgccggcgagatcaggaagatcatcatgggactcgacaagaactccaagaccccctgcggcttctgcttcatactgtaccctctcctttccttcctcaatccgttttttttttaatacaagagatgtagtttggtgctatgttcaaattaaaggtgctgcttctgttttattctagtataagcgggtgtccaaatgtagtttggtgccttttaagatgtttttctagttctagttatgcattgatttaacagtgaagtatcaatggtggttgtgacttgtgacagagaagctaagggagttttaggagtctgatgttgtgttggtactggcaggaatgtgtgattttccctagaatacgggcagcaaagaattctatctcagtgcgaatatttggcttgagcagttagatattgctattggttaagtgagtaattttgtagtagtgagctcatatgtggctccttggagagctggttttggtccgctagtatgggccaatatagtgcaccaagtttcttgttttttaccctttgtttggttacttttaatctgatgtagtgttgattagtccgcaatatggtccagatgtgtcttggttgtcgagggggcatggtttaagttatatttggccaactggtgatttttgagagtctattgggatcttttttatgtattcaggctcttgttttggtgttttgtgttcgaatttggggttttgtatgctggtagttagccatactttgtacctctaattcgaaatgtggcatcatcttgatctctgatctgttaaggttagagtatgtcttttttgttcattcaaaaaatatataccacagttcctttaactggtgtgcgtgtcttggattcctggcagcaaggcaccccttgaattatcaatcttctattaaccttacagttatggaagggattattctctgataggcatatattgctttattgtcttgtgcatcgggcatgttgttagtttatattggattttggaagatgtaaaaatgacatttatctagtttgagccaacggtgtatgtgctgttagcctacatatcgttataataccttccttcctttcaggtactactccagggaggatgctgaagatgcggtcaaatatattagtggaacaatgcttgatgatcgcccaattcgtgttgattttgattggggctttgaagaaggcagacaatggggtcgtggacggagtggtggacaagtattaccatgatcttattctgcatgaataacaaatgtatgacatttgaccatatttttgatgatagttcatgtttcttttttcataggtaagggatgagtaccgcacggactacgatcctgatatcctttggtactattgaattaccatttattacatttagagcggggttatgctggtaactcagaaacccatccgtgttagttcatactgatgaaaatgttacctgtagatccatcctaaatatggcaattcaactatctgctgattgtttcttaatagcgctcctttaaattttgtatgcctttacatgctgctatgttttttctgttgagttggctacttccttaatgaatcttacgaagaggtggctatggtaagatggttcagaaagagctagaagcacaacgtgagttagttgactatggaggtgcttttcaacctaatgcaccacctcaatgtaagtgctgaaagttttgaggactgtaccttaagcctttaactacatccttgtataattttcatttgtgttaaccttattaactgcagtaattgctttgttagagatttgcatgtgtggcctcttgatatatttttcaattggaagtattttatggtgaaacaatttgctttataactggtccgatcatatttacatgaagttagcattcatgcataatgtagcctttttttattctagtaaagcataattagacattacctttttctctggtgaccatgtgtgcctttccactattgactctgatctcacttgttaactttagctgcattttaccttgtcgtttgccaccaaaaagcgttggttgagagtttggttcactgctttatttgattcaatccttggcagcataccgtccaatcaatttactgtttatcttctgtccaaacatgttcctgattatatttcatcattttcacaaatcttggcattttttgaaatatgcagatgacagaggtgacaggaagagagggtatggagattcttaccggaacgacagaggtcgcacatctcgcatattcttgttcttttctttcccctgaactaatagctaacacaatctggtgtgctgccaccagattaccaacggaaacgttaccggaacgatgagcgatcgtcgcaaagagcacctgactctgagttcaagagagatgcgattgattcggtattagagcctgcatacgtgtcatctggcttttcctgtactaccccttcggaaaaacaatatgtttacaaaatatctcgtggttatgtttgcaggagaagaatcctaggtttcgtgagaaaggtgattctgatgaagaagacgatgattatgataagagacgccggcgctgaactgaaagaaacaattgctgataaatgcaaatgggcagttgcagtgactacactagtaaagcccgtcgagcttatgttttttaccctgttgtgtaccatatgacttatatatctgtcgtcagctcatttctatgttgcggttcatcaccacatgcttgcataggtctcgcatgcgactgggaatggattttgtgtttattgacacttcagcttatgtattgacctgttatttaggttggcaactaattgattttggtcggtaacaattaccttgcgaactatctgaaaaactgccgccttaaacttgcaaatactcgcttgttcctggtgttaagtgaaaatgttggtttagcacttgttaattgtgaaacttcggtcaaaatatatggtctaatgtgaaaattactcattatcgaacgaacaaccgcgaaccttcctgcggctttctgatacaatactacgatgttgatttcgctgacattgtgcatcgacgtttacagatagcaaagtcgatagcaaattaatatgtgaatgatcacttctctgaggccggccggcagtcatcgagatcatgaagatcgtggaggagctcctccttccggcgctggccgccgacttgaccagccggctcgtctccctgctgatccgctcctaccgcagccgcgcaaccaccggcgtggtggaggacgacgacctggagaagctccagctgctgctccttgagctgcacgctgccgtcgacgagggacagggccggcacgtcacgagccagaggctgctcctgtggctccgggagctcacgcagagcatgtaccggggctactacgtgctggacaccttccgctaccgctccgtctccatccaggcgcagcagcaagacgacgctcgcggcgctgccgccaagcggctgcgcaccagcgccggcgccgcggtgcgcctcgtgctcggcagtagcagcagggacgacgacgactcgtcccgtgccctcgcccgcgccctcgcccatctgcaagccgtcctccagaacgtgaccccgttcctccagatgctgggcacctaccggcgggtgccccggagggtcagcgtggacacggagaggtgcgtgccgatcgggcgtcacgtcgagaagcagcggatcgtcgcgttcctgctcaaggaggacgaggcggctgcgcacgtcgtcggcgtccttccgatcgtcggccctaggggcacggggaagagcaccctcatacacgatgcctcccacgacgcgagagtgcgcgcgcacttcgcggtgatcgagcgcttcggcctcgacgaagtgctgctgcccctacacgccgctggagcgggcgcagccgccgccacggacgacacgtcaagccggagcttggaagatcaccggatttacctcgacgcggtgcacaacatcgtccggcaagagcgctttgcccggaacaggtccctgctcatactagaggacgcaccggccgtcatcgaattcgccgagacagcgtgggtcctaccaatggctcacgggagcaaggtcgtcgtcacgagcgaatacgaccaaaccaaggcgggtctcggcgcgacggaggaggcaatcagaaccaagaagatgtccaaggaggagtactggtaccacttcaaggcgctcgcctttcgcggagcggcgaatgatccagcagggccggcgcacccagcgctggcggctacagctaaagagatcgcatccgtcctgaacgggtcattcctagggatgcatatattgatcgccctgatgcgatccgacccaagggagtgcttttggcgcgccgtactccagagcctcgtggatctctgccgctcctcgaactccaagaggatcaaggccgacatgggctacgtgcaggagttcgcgctgatcgggcggatcgctctcaagcttgtgcttccgatgcgtctcacgcttcgtagctgctccatcaccaagcaggggggcgatcctcaattaggacctgagcttaatcgtgtggcaggagggatagcttacagttgtcgcagtgatgactctgggtgcgtggatgtcatcctatgcagatcacgcatccctccctacgagatctacaagctctcctgcgtcatggaggaagaggtccatctagaacgtgcgtcctagaaaaatgaatttggtaccctgtataaaaccatgttaatttgcttgcttctaggtagtatatgatcttgatgaaatttacgtcttgcttgcgtatgtacggacccattctgttccattgatgtacagtgactgtgaactaaacggaaatttattttttgtatcactgatcatgcttcctagacatttgactaccgcttcagtgaatttgaaacccagttaattaaaagttatgtacaaaatccagtgaatgtcaacctgctgcaacggtctccatgttaacactagtcagagtaaccgtcgtccccgtcgtgctcctggtagtaacgccggtccagaacgagtgcttggcaatggcagcggcgcggcggcaaaagtcctccacaacggccgcgcgctccgccgggaagccggcggcagcgacggccatctcctcggcctccagcctcttgctcacttgctgaccaggaagaagtcgccgctctcgtacgtgaactggccggcgaattctgcaatatagctgtgaaacagtatagcacatatacctagctctgaaatatgatgcgccaaaacggctgtaatcacttggcagcaaaaatatggcacacactttttattgaaccaaccgatcaagttcagactttcactcattgtcagagaggcatccaagaagaacagctaagggacagcctgctacagattcaacagcagctaagtgatcaggagagcagcttggcacgagtggcaggatcttccttgctttccacccacatcatgaaaacgtagccgaggcaccagagaagaacatattggaatggaacccaacaaagcagtgccacaaggctgagcatgctgccaacatattgagggtctttgatataaccaaatggaaattctgtcacccatgggattttctttccaaatcgaacaccgtagtaggtgcctggctcaccgagcagctggtacaccctgaagagaaatcacatatatcagccacaagctaactaactgaatgatgattaccccttccgtctttgtgataaatacagaatttagtctactataaactgttgtgtactatactcatattaccaaatgctcaaataatatgtgttgccgaagtggccgtttcaagattataggaaagtgtttttattctgttaaagagacgttaaaatcagaataaaaacaaattttggagcttgagtgcctcctcgactacctcagactatttcctactggtgtaaagagttgctagaagtccaacatagaatgcataggaattagcataaaaataagttagcagtgactaatccccagggtagtggcttcacaggtatcaaactcaatgagtcatggattagcactgttaagtctatgacacttaacttacttttgcatcactaagtgtctaaatcgctaacaattgtaaacaattctaaatgtttataactaatattgaaggccctatcttatttcaaggtatggcaatcatttaaggaagatagggctttaggacaaaaactatagcaaaaatgatattgttaaaatgcaaaacaaatactgaacgagaacgggacaactacaatagatgcatcagtccattatagagcattatgagtacacatcaacttaagatgaaatttggccccttttttttcatattagatgagagcattgcttgtgcttttaaaattatactccagctataagtttttttttttttgtgtgtgtgtgtgtattgtagatgccattctggcaaatcatggagaaaattcataaatcagtaataattggtaaatagaagcagatgatcgttgttcctgcttgaaaatcgtcccatcccttactcatcccttgtccctacagcaaactgttgattctgcagcactaaatcgacaaacgaccaacacagatttatacaatcgcaaatttttggtgctgaactgcaattagtggattattgatcatggaaagatcacagatgggaacagataaattacaccgaaaacctagcacaacacacatagaaactagaaagtcgcagacgatccgaacgcgaggggatagcatcgcgtccgactgtcggaagaggggtttaggggatatatctcgcttacttgaaattgaggtactggccgacggcgaggagggcgacggagtagagcggcggcggccaggagaaggaggcgacggaggcgagggcgaggagctgcagcgccttgaggacgtgggacacctgcgccatccggcggcacgggtccacgccgccgccgcctccgccgcacaggtcgacccaccgctgcgggtggttccagagcgcccagtagaacgggaacggcagcagcacgccgacggccgccgccgccatttccatctcgttgtcgaaggcagagcggtcacgaggggctcgtggaattttcgtgtcgtcgcgacggcacactacttgggtcacctggggcgactcacactagacatcctggggtcacgagcctcgtgacatactgacatgtgtaaagtctactagtagtaatgccatgtattcttcaccgtcacttggttgctaactactatatactcagcaaatgatgcctttgtttcaagagatttctcaacagatttaaaacttaaacgctgcggcaagcatgtcacttgctacaactctgctaatgatgcctttgtttcaagacagggcgccatcgttttgcagacgctgttgcttttcagcagtacctgatgcttataaacatcagcaattccattgttttgcttatagctgattaatggatcttctgtaaactgatgcattgcctctgcttgtctgcctgtgtgtgttgtgtgctcgtcagcactgactccagatgcgtggccgtagatagattccgacatgtatagggcccactaccaataacggttcgcatttaggctgtaacagcgaaccgatacgcttctactgcaaaacagcagccgcaaaagcgaacagatgcatcctatatttctcgacagatttaaaacttaaaaaagctgcggcaagcatgtgagatagtagtaccatcctaggacagctcaaaagtactacgtcaccgttaggatacaagtctactatgtaaggacagcatgtgagttagtgagtatatatgtttaatgtttttgttgaggtttctcaagaaatccagtgcatagcctgcttcttgatggcaaattgcaagactggagatcatctgtttttgtttaaggtttcccatgaaatcaagtgcatagcctgattcttgatggcaggttacaagactggactgggaaatttctagatggtgatcgagtgaccggtagtccacaagaccacaagcacacaaggcaccaggcacgctttaggggttaaccagaagatagacaaggaaacgtattttgcatcgagtgactggtagtccacaagcacacaaggcaccaggcacgctctagtggttaaccagaagataagacaaggaaacgtaaggcgtgtttactttgggctggtttggtttgaggcataaattggtattatcaatatttgataattttaatagtgtttactgtttatttggtttgaagccaaattttggcatgtctaagaaaatatgtcatttcaatagttaacttagtctattttggtttcaatccaaacacaactttgccttgccaaaattagtcatgccaaaacttgtcaaaatttagcattgacaaatattggtaagaccaatttaggtcacaaaccaaaccagccctttgatgctattttcaaccataccatcttttttaagttattaaaaaaatgtctacgttcagtttgttgctagatttgctaaatacataagaaatcctaccaaaattttgataatattgtcatcctgccaaaattttaacaatattaccatcctgccaaaattttggcattgccaaaatatcataaggtttattttggttaaaatccgtacaggcccgtattttgcagcgaaatgttggaaacaagaaaaaacaaaagagcaaatattggaaacaagaaaaaacaaaagagctgatcgaattctctactactgttgttttacatgatctccaatactcccaaccgatcaaaaaccaatttacctctgcttatcattgcaactgctcgatgaacggagaaaatttcctaaccataacaattgaccacacgcggaggaaacagaaattttgaggcaatatcaacactcagcgtcaacagcaggaagggggaaattttgagtcaaatttctaactctatcctattacctgcttgacacattccagaaaaacatcaaaatttctggacttttcctgtgaaataaaaaataaagccccatcactcagcattatcatcatcaaaaccatcatcttcagcctccttgaccttttgaggtgctacactatcttcaaccatcgcaggatcgtcatacacgggtttttcagggcctggtcctgcagacaccttgaccatagcagggcgcaataatctctccccaagtttaaaacccttacgaaattcctgaaggatgaccccttcttcatactccactgattcttctctcataatagcctcatgaagctgaaacagaaggtgcacaaacaattcttattaagaaaagtaacaccctttgaaaacccaagaaattttggaaaataaaatagattcctacacatatccagccctttatagtagacttatcacccaaaaccatggaaggcacaaaatttaaaagagacatggaaatttcaatatttgagtaaataagtgtttgattcaaaagttaactggattagtatgtcatgtgctgctaacaatgcttaccataggatcaaatggtttgccaacagtctccacatcttcaactcctagtgagttcagaatatcaataaattgcttataaatgctctgatagctgtcgtttatttttgtttcttgctcagtttccacctttatttgtgtttttgctctttcaaagttgtcgaggacaggcagcaagctctctataacttccccttgcacatttgtcatcaacgaaagcttctctctttctacccttttcctgtagttatcaaagtcagcacttatcctcaagatacggtctcgctcagttgtcaattctgcacctaaggtactgattttgctcaaaagagaatttttctcctcctcaatagagaataaaaagtcctctatctcagcgacttttgtttcatcatcattaatcaaagcttccttgtatgattgcaatgctgtgacaataacagagggagtttcttctgtggctgcagcggcatcatctgcaccagtttctccagtttcagaatcctcctgtgacatcaaaaaagatgtctaaatgagaagccaagtgtttctattgacaagggtcaacttcttttgcttttatattagcagtggaagtgaaataacatactgctactgtgctacatgccacctcaacaactgtcagtattacatttatacgactcttcagcagaatgcagtttcttacctcaaatattgacaaagagatgcactacactcttgtgctataaacctataatataatctgcacaggccctcgcgttaaaaactggaaaatgaaatggtcgcattactgacctactatataatctagccttgctcttacagaatctaaggaaatagaacaggatagctaaatgtgactagtaaagagtcagagaaaagatttttgcaacaatgcaataactccatgttatcaagtaactcgattgcaaaatacacatgggccaaagataggaaacattgagaaaataaaatagcatcttcacacgtgtaagcacagggaagtgtggaaggcacagctaaaatgcattcataatactgaagttacacaacaactatggcaaacacttacaagtactgatgtacaagttcctaaaagaggacctatgccaaatgtgattccccaatagatcaatgacatgcaaaatagattggaaataatcccatatcagcaaaactttgctatttccagccttagtcatgaaaaagaacagatccttccaactttcatactccctccatccacaaaagttacacatattacttttgtcaccaaaaccaaggagaaattaaatcatcttggatgttacaaaatcaagtagtgaatgcaagcatgcaaccaatgagtatttaaatgactccttgggttctaatcaaacatttaatttatctcttcatttatgtattgaatgcatgaagactacaaataggaacaacttatttggaaaaactcaaatgtgaaatatgtctaacttttgtggatggagggagtactgcacaatggctaagctaaataaaacatttatttatcttgaccagcttgaggtccacatggttatgctgaatgcaaattaagaaaagcaacttactttagaatgtgaaccattagaagtcaggaaaaagtactttagttggcattccattagaattttaccaaactaattaaatcaggtgaaacaaaaatcctacattgagtattaaatttcctgaagctaccaatgaaggtcaaattcaatcattttatcatccatcatgataagccaagctttcacataggtagtgcagaacttttgcatcacccaaataaagcacagaatgggatttctttgttaattgacataatagcatatagaaaaagctgatcaactaaacataaaaccacccacaagattcctgcatctaaagccagttcgcattaattcgatggatacataagcttaaatgagatatggtacaaacaaggtagatactactcgtaaacaattcgtgcagaaaatgctagtatgaagcgatcaaataccacaccatgacctaaaagagttactaatacacaaaacttgtgtatcctacggatgagcaatttgtggttctgaaccaagcactgctatctagcttttatctgatacgctacaaaattacaaatctgataggccctcttcaaaactaactgcttatcgatcggataacaaagtaacagcatgatttacagaagctacagcaaaaaaatcaccccccgatgggggatggggaagcaagcccctctcacctcagtcgctgtctgcgcggcctcgtcagcctcggtggctcctacccgcggccgccgcgcagcagcgggcccgcgacgaagccagggactcgccgagccgcgggcggcaggagcggctgcgcccggagcggccgcgccgccgcgcgcctggcgaaggcgagcgacgaggcggcggaggacggccggcgcggatcccgggcgggagacggcggcggcgcgagcgcggcggccgtgcggaggagagcagccatgggtgaggggggattggagggaggggggcggagtttggctttggccgctgcacgctgtcgctcgctggctatcgtcgagtcgagcagcgcgcacggcacggggataactcgcgcggcgccggctcggacggacgaacggacggacgggatggatgggtcgagaatagagatgggcgcttctggaaggaggcaggggttggccggttcggttgttagcctgcttgatgggtccggtctatggagaagtggatgggccctgttctggaggcttagccggtgaggagaaaaaggacaatatgccacttcatacggtggatttcgataaaatgccacctaatatattggaaaggataaaatgtcactcaatcagtgtgtttggataatggaaaatgggggtgagattgagattgagaaatgaatgaagggttagcattaaatgaaagagggagaatgaatggctaggatttaaagatgcattttaatggatgggaaatcatttccctataccattagccaaatagggctaataggttatctttgggatattttgccactttgaagaggtttaagacaaatatacccctactatggagagagagaggaagggagagagagccagagaggggagtcgaacgacggcggccgtggtcgccggtagcgggcggcgacgagggaagaacgagtgccgtctgtgctcccgctagcggcgacaaggagaggaataagatgccggtaagcgcgcgaggtggcaccggaggggatgagcgcacgtgcgggcagcgctggagagccctccacgtcatcgccgttgcctcctccctcctcccgtcggcattgccctcctcacccatcaccgccgccgtcttcctcccccatcgcagtcgtcatcttcctcccttgtcgcagccgttgtcttcctccctcttcgtcggcgtcttcctcccccatcgctgttgtcttcttcccccatcgtcgtcgtcgtccttcccgataagcgtcgttgtcttcctcccccattgcagttctcgtcttcctccctcttcgccgccatcttcctccccctgtctgcatgtcacagcccgccccccgtgtgctcgccacccgctgccggcgagcatgagcatcgtccgggtcaaccttccgctcctccctcttcctctctatccacagctagaggtattttggtcttaaaatccctcaaagtggcaaaatatcctgaaagtaacctactgagtggcattttatcctttgcaatgtattgggtggcattttatctaaacccaccaaatggagtggcatattatcctttttctcgccgggggtgacaggacaggaagccaagagaagcaacaggtaaacagggtcatatgttttgtttcagtgccgcaaacgcgaaaaccagtctatggcacactttttcttttaagataatgaaatagaatattccgacccttgctcaacgagctacaactgattattacaatgtaacacacaaaaaaagaagctcacatgaataaaaaagaagtccatggcacacatgtgtgttaaacatcgctcacgcatccaagcaagctaaagcacaccatgcccatctgacaattaactaaatgatatgttacctacttgacatcacaagaccacgccacctcaagtcaacactaagtagagatggcaattgccctgttggggttaagtccccaccaggtacccgctcgtacggggataaggcaaattttcacctgtaggtctgtcgagaaggggcttaacttcttgcggaccagggtggatttttgttttcacccacgagtctctaaaacggtaaggtacattggatcattctacaagtccattgcaaaagacaataatcctactaataacccaaagaaaagccctactcatcccaaccttatccccacatcccttcccgcaacacctgcacgttgccagttgctttgactttgttgccctaacaagttgagttgcaaagacgcaaagtggcggatgttcccctcagtcccatagtcatgtcatcatctgctagttttctctttgctctcacacaaccatgttgcgccactatttgtcctcctctggaccatgctccctcgttgcccgcagatgagggtttcggctagctgtgagtgttgcttctgcatggtcatgccatgccgccagcctgccatcctcctcccttagtgttgcttgtccaactatcccctcacccacacaggagcatgtccatcatggatggtccacaccgctcactaggagaagctcaagatactatgctcaacagtcagcgtggcgaacgacactcaaagacgcgaaggtgcaaattgtgggaccctggcgggggtggggatcatttcctccagttgtgggttctgggatggggtcattccggtccaattcggcctcgacccattctgttgccgcctctaacaccaaggcatgatgaattaatggtatcaaacactgccccaggaccggatggactgccagttagtttcctgaaagagttttggggacaacttaagatgcaatttaaagaaatgcttgatgctctttttgaagggaacttagatctttggaggctcaactattggggtcataagtttgattccgaagattaagaatgccaatacaatcaaacaattcaggtcaatttgtttgctcaatgttgcttttaagctgattactaaggtgttagcggtcagactgtcaagagttgcagggaaaatcattagagaatgccagacaacatttattcctggtcgatacattttagatggtgtggtcattctacacgaagtgattcatgaattgagtgttagaaaactagaagggatcattttaaagctagatttcgagaaggcttatgataaagtacaatggtcttttttgtttgatgtgataaggaaaaaaagctttgatgagatatggattcaatgggtgggcaaagctactctgaacgggagagtggccataaacataaatggagaggtggatgggtatttcaagactcagaaaggtcttagacagggggatcctatatccccattgttatttaacttggttgccgacgccctttctgaaatgttgaccctggccaaggaagctggtcacttagagggagtggttccaaaccttgtgcctggagggctcactcacttgcaatatgccgacgacacgatcctttttttgcagaacacagaagaaaacattctaacagtgaagttcttgctgtattgcttcgaggcgatgtcaggcatgaaaattaattaccaaaagagtgaggttttcgtgataggagtagatgatgctgaagcccaaagaatagcagaaaaatttaattgtgagagagggaagtttccaatgaaatatctggggatccccataagctcagtgagattgacagtggcagattttgcagcctccccagataaactagagaagagactggcgacatggaaatgtgggcacctttcttatggggggaaagcaatcttggtgaattcctcctgacttctattcctatgtatacaatgggtgtctacttgctaccagaaactactcaccagatgatggactcaattagagttcgttttttctgggaaggtcttgagaataagaggaagtatcatatggtgaaatgggaagctttatgcagacccaaagagtttggagggttaggttttattaacactagagtgatgaatgcagctttgcggtgtaaatggattgttagaattgaatctggccaagatgatctttgttgcatgctacttcacaggaagtattgcagcaatgagggggagggaggtttctttcaatctagacaagagggtggttctcagttttggaaaggtttacatgctgtgaaacattggttgaggctagggagctggtatgaaattggtgaggggaattcaactagtttttggaacgatgtctggtctggagaggcgcctttgaaagttactttccctgcaatttataaagcgtgctccaaccataatgaaacagttaagcaagtgcacaactcaggtgaatgggtgataaatcttaggagatccttgacagagttggagttagaagagtgaacagagttgcaggagttgttataggagttccaaatgaatggggggagagataagatgagatggaagctaactaaatctggtgtattttctgctaaatcactatacagagagatgacctttggaggcgtgagagatagcagaatgatggaattttggaaggctccgattcctcttaatattaagattttcatgtggctcatactgaaagggagaatccaggcagcacaacaactgaaaaagatgaaatggcctggaaatcagcagtgcaagctttgtggagaagttgagtcagtggatcacttgttttttgcgtgcacaccagctagattcctttggtgttgtctgagagatatcttaggttggagttatgtgccccgaacaagaaatgagctaattgagaaacttaaagatcctggcataagagcaatttgttctacatttgcattttctctgctgtttgttgggttatttggcttgtgaggaatgattttgtttttaacaataaatgtctttcgggcattactttgatggctcacaaggtggtaatgttgctgcaacagtggagtcccttggtggcacagaaattttctggagaggtggagcccttcaaggactcgctgcgtgctcgaatcaaggagctggaagagggaagaccaggctgatctcagggtcctgctcgaggaagaagatagtgtagggagatagcgaagtcagcaacatggttttggctccaggcgatgcatcgtgtgcctttatgttagtttcctgggctgtgtgaggggctagtcactttcagctatctgtacttctgtttcaagttggcaaccccaattgtgtcatgtttccttttctgttctttatcttttccttttcgctttctgtatcgaaccttgttatgctttgttagtaaagctgggcgtggagcctttgatctaaaaataattaatggtacggtggcaatgatgaaggcaacaatggagccaatgagttgcaacacacttttgtccaattatcctcccttacacatggagccaagagttgccctcttgttgttttcatttatctaatgatgagcaacaaaaagataaagcgaagtgagcgcagcttaactgattaggtttcttgtggtggaaccaatcaatttggattcatgtactagatttgacatgagtgcttatggtaacttcgttaatctcaagatatgtcagcataatctttttaagatgtcaatagggatagagtgcgcgtgtgtctgtattgtgagggttttcgtttgtattgcgttctaaaaacacaaagatcatcggttattcccgctaaaatcggttgattccacttggaccacattggcacgtgtactgccacaaatatacccacgtactactgtttgtctgctgtactgcatccgggtttagcatgatgtttggtcgactattgagatggtcaagagagcagggcaataactgttattctgataaggacgcatcttctttaataagacaagtgagatgcacgttgtctgaaaacagttctaccttactgctcaccctgtaccttgcggtacaaatcctacaccaaattggctctaccatttggtgccattttgaccgacgatgagcacgagttctacgtgccaagactcttgagctagaccgacacttttgatctcattctcaccagcccaagtgattagtgcttcccttgtccctttttatccagctgaagtcttttggttgcttccacacttgcacacacctgccagataatccgtgagatacgacggctacgaaatcgcaatgaatcgggtccatactccaatcctcacctactgaccaccaccaaacaccaactccttccctcagagttgcttcacgtcttctcaacctactccctcaagcctccagtttttccacgccctgataggtgacttgagcgctggccgctggaattcagcctaactccggtcccatatcgccacgttggccgcgcacgtggccacgtatgacgtatgcatgtggttcatttgggcctcgcttggaatgctgtagttgggtacgaagaccatttctgtttgtaagatacatgggtcctttgcggtattatatctgtagtagcagtgaattacaggtaaactcggttccacaagttagcggcagctgttgcagatgcggtatcgcagacaatcctgcatattgcgatttctgtacttgagaaactgataggcgaagtaaaccaccgtgattaaccttattaaccctctgtgtttcgtaatgtttacggattaattaactgttcacaatacaaatacagttggcacaaaatgtgtcctgcccaaaagcgggaaggcaggaagggaaaaatttgcaggaactaacgtgtggaatcaaagaatcgttgctgcatcctaccgatgataggctgtgttaagaaccaccccgcctcctctccatgcatgtgcgcgttcgtgcgtgcgtacgtacgtgttgtttgatttcagaggatcagaagtcgaagatcatcttgcggaacttctccatgtgctcggcctgcagcgagatggccaccgacaggctgccgtcgccgctggcgctggggagcacgaaggcgagcccctcgtacgcgatgccgccggggcccatgaacaccggccgcccccagccgaagtcggcgtcgtggatcggcagtcggacccagctggtgaggccgaggttggggcaccggaacgtgtgcgcgccgcggaccagcgccgacaggtcgggctgcagctccaggtagtccagcgccgaccggcagtagccgctgtccatcctgtccagcgccgactggatcgtcgccgcgccgtccgccagcgacccggtcaccctcccggcctcggcgagcggcgtcgccgtgaagatcacgttgccgaagtagccgtcgggcagcgacggctgcagccgctggcgtccgtccgtggcgcagtacagcttggtgggctgctccgcggggagcccccgcgccagcgacgcgcaccgccacacgtgcgccgcgagcaccgcgtacgtgctgtaccgcggcgcgccctcgccgcggggcagctgggaccggaggcggccgaggtcggagcgggacagcttgaagatgtccacggcggtgggcggcggcgccggcttggcggtcagcgcctgcggcggctcgggggccagcatggcgggcgccggctggtactcgacgtgcgggtgcgacggcgccggcgggtcgcgggcgcggacgagggtgcggtcgatgaacggcatgacggcgatcgggacgccgcggcagaggtccgcccacgagttgatgaagtgcaggccggagaagccgtcggcgacgtggtgctgcatgcccacgccgagggcgacgcctccgcacttgaagtgggtcacctggagcaaaatggcgccaaagtttaactaaccgctctgttctttcacaaagattacaaaattctttttacagagttatacgtgaccgagacttctttaatctcctgagcattattagagtggaaaaaaaaaaggacgagatcacacagcaccatgtgcttaagggaaaacacaacttctttattgcacctaccgtttcactaagatacctctagttcaactaacgttaccatattaaattccaatcgtctagaagcaattcatttgacctcttgtatctcaacgtacttcctctgtcccactaaacgtgtactccgtatgagcgaatgattgcttagaataatactcaaggtctcggtcatggcaagccaacttggatgttgcagaccaccttacctgcctgaactcaattatgggatcatagatggagcctagacagaaaatatacagctggagaacctgattaagggcagactaagggcttgtttagtaaacagggacttacctgtcacatcggatatttggatattaatttagagtattaaacatatactaattacaaaacccattccataatcttggactaattcgcgagacgaatattttgagtctaattacgccatgatttgacaatgtgatgctacagtaaacttttcataattatggattaattaggcttaaaaatttcgtctcgcagattagctctcatttatgaaattagtttttttattagtctatgtttaatacttcaaattaacgtccaaacattcgatgtgacacgtactaaaaagttttagccccatctaaacaccccctatatggaacgatcaatcaaattaaggtttgcttgctagcacaaagcaaagacaaagaaacatttattttttacattctagctggtacatcattgtctttcaaccaacatgtgtcgtgcatccgaagaataagatgtccagcaaataactaacattttgttgtttggttaggccgtgtttagtttccccctattcccaaatttccatcacatcatatcacataaaaaaatttcctacacacataaacttccaacttttttttcaaactcctaactttcttcaaacttccaacttttttcaggaactataacacacccttaagctcactctatctcaaccgggtcagggggtcacccatgtggatgctgatgatgtaccaactggagcagttgtgacaattgtgaggctgtgcacaaatatgatctggcaatcttatcaaacaattggttcgctacttcgctttcatgtttgacaaaagaaacgatgatagctcgcaagtcacaacaacagcgagaagtcggactcaagtaggtagaacaccttccccaattctcagggtagttttcgacttgtctagctgtcagaatatatggttctaaccaaacaattacacggctaggttgttttcatgctgtacaatttcttttaaatttcccgcaaaagatcttttaaattcatatgttccaaattgatgggatctaatgacagggttcaactgtgcgcaggccaatcattagtcattaccgtactcagataatcgttgacatgagacatgtattaatagaaggcctataaaaacagagagctgatgtggccattccaggaaatttctaaggaataaagctaatcatttccatagaaaattccagtactaacaaatgttttctgcaacaggtatgattttttttcttttcgattcataccaggaataaattaatgaaaaatccctatattaaaaaaagcctacaaatgctaaaaattcatacgtgtttcgataattcacataggtaggttggtcggcaatttggcaccatgaatggaggcttcactcggtctaagctagagcttgatagggtccaaaaaagaaaagaaaattgttggcatgacgcagccagccactaatcacctagcaattgaattgcatgagcgctgaccgggtcgtcgcccgcaggcaagcgatcgagttggtggcggtagaaatagaatagtagattcctactacgcgtgaggagaaaaaatggaggagaattggatacctggagcacgaggatggggaaggaggagatgccgtcggtgtagtcgacggtggggatgaggcgcttgaggtccatggtgggcgcgaagtcgccgaagtcgtcgacggtggcgcccggcgcgtcggcctcgacgaacagcacgccttccccgttgcagtcgatctccacgcggccgtcctcgtcgtgcgccagccgccccgccatcgggtagaacggaaccagcgcctccgccagcgcccgccgcatcctctccccgtcgaagtagctcccgccctccgccgccgccgcctcgccgcgccggaagaagtagacgctcggcgtgtggaaccgcggcaccaccaggtccaggctagagttccacagcctcacccgcggcgtctcctccgccggccgcaccatcgtcgacccccgcacgttgatcttcatctgctcgcatcgcacgcaacacgatcaaccaatcaatcggtcgaacacctcgccggcaaaccagcaaacggggagaaacatccaagcaagcaaacgagatgaaaacagagagcattccaaccaaccttcgccgacgcggggcagatctgggaggcgagatcgaaggcctttggcaatggacaatggtggagttgtaaaagtatgttaggtaagcagctcttgggggagagctggtgagctaacgaggggtggagcgccttttatagctgtcgctgggatgccaaattgccaatatcgcatatatttcttttttcctttttctttaagtaaaagaaaaagaaaaagagtagcggtgttactccatcaattttcataattcttgacttttataaagaaaaagaaaaggagtagcagtgttactcatcaattttcataattattgacttttttaaaagctaaacttttataactttaactattaataacttcaaaaatatttagtttaaagacactaaaacaatctatatagatttgtcttacaaaatgttataataaaaataaaaatatgtttatttattggatatatcataataagagtatagtaaaccgtgtcattatttaaaagataaggaattatgaatatgcaacctgaataagtattttatttggaatttatgccagtaattgaccggtggtggattgcttcggaggaggaagaggtgaggagttggtgggatggatgacctgcgtgaaagcggaggaggtcgggggtggatcggattttcctggcttggcttggggaaggtttgattccatctgcgctcgacggctcgaggcctccgtctccgtggacgcggtccaccccaccggacaatggacgcggcggtgatgatgatctcttcgccgcatcagcgatgacagcttccttcctagtactatctatcattcacgcgggcctaccctaatgacaaacaggagcagcggcagcttcccaccggcgttggaaaatggtgtgatccactgatcgatctcccgtgtttttttgttggcgaattgacgtaacgacttgtcttttcgtttatgcttatacttattagttaaaatataaatttttaaccttaaatttaagttgattttgggaggttttcatcaaagtttattttcagtattgtttttaaatcgctaagaacacatgtataaaagttttatttgtaaattatttttcgtttgcaaataaataaacgaaacgatcggactgataatctctttgagactatgcaataatacatcagtctccggtgacactgtcacatcttctgtatcgtttccacgaacaattttgcttggatttgcatgtgcggttaatcttacagcagcaatctgagatttttccccagcttaaatgcagcgagttcaaggcgagatcgggctgggtacgatctgctcggcacatggtctgacaacgcaaacccgagttaaccgtttcccaaatattcgggcacccaggttatgtatggaactatggatcgggtcaccgccgcgtccagctttatctggtgcgaaatccttgtccaactcgtgctctactgctctgttcagctgcaccgatggggcagttggagtttagatgacgcgaattagatggtgaattacgtgtggcactacgtacggcgggtactactagctcgatcgctgctgctgtcaaatactaccaggcgcgcttttggttaaacagtaacgatcaacgtttgaccattcgttttatttaaaaattttgtgcaaatatgaaaatatttatgttatgtttaaagaacatttgatgatgaatcaagtcacaataaaataaatgataattatataaattttttttgaataagacgaatggtcaaacgttaaataaaaagttaaaggcgtcatgtattaaaatatagatgtagtaaattttagttgtctcgttgaaccagctgatacatagtactgatgcggtgatgacccagcagcaaggctcgtgtgtgcacgcacagaccagctcttacggctgaacgtttcatagtataagattattggttagtggtataattgtacgaaggctgtgtttagttcacgtcaaaattgaaagttggattaaaattgaaacaatgtgatggaaaaaatgaaaatttatgtgtgtaagaaagttttgatgtgatgaaaaagttaatagtttgaagaaaaactttgaacctaaacacttctgcgtagaaagaaaagtcgctcccgggcgagggcgatgcgacgtcgactggtgcgaaatccttatccaagctgctatcttctgacgaatgtttaggttaggtgctacagtaattaatactgtagccaattactcactagctctgaccaagccagcgatcgatcagcttcagatgacgaggtatgcgaatgcgacgccgcgacaccggcagagagccggaacgtacaacgtgtgctcagtgccatactgctgccatatgccgtgttcctttcatcctgcaaacctgtactctgacccagtctaacaagtaacaaagctgtctgatttgaaaatgaacggatatccgttcgacgtctttgcgttgcaggtgttcgattagtgctactggtacctcattcgtgcataatgtttagagcctgctaataatgtttagaatgatggttgctccagagaaacatggactcaagtactgcatgtctgcatacaacaatcctaaaagggaactttcacatgatgtcagcatcccggaccggtacaccgacagccacaggcccatagccaacagaaacgtacactgtcacggcgccacgaaatcgtaataaccgatgatgtgcttcgcacggccttgcagttgcagtggacagggagtccgggaccaaaggcgcacggagaaagtgtcaatcaaagaccccatccagagaccgcaaaatccaacgtgaatcatgcggagattttcacacgatcgcacggctgattcgaagatcgagcaaactactctggggcctggcggctttacacctacctatgcaaggacgtgcatctgcatcgatcatatggctgcgtttggtcgcaactcgcatgggggaaaagtagatgcaaaaacatagtagtggttcgccgttcgagcagccgcaagaggggtagtagtgggtcggtgtagttagcgcagctgcctccattgcttttgctcctcgggaggtttgtgtcgtgtctttgtgtccacgggaaggcttgacggaacaagagcaaagagcaggtacaatagtagcctattagccagctataaatatattttaatgaaataaaagatgagagagaagagcagcgggctacagatctgtagccagctgcggcacggactctaagacgcaatgtgtgtatgacaggtgggatcatatgttaatagtatagtaagcagctgttgtataaattaactattagatcggctatagatgaattggagctggtagtgggctatactattaaacttgctctaagtaaaatcatcgtcttacgtaggatccgagtcaggatgagatatggcgcgttgccggcttgccgcggcctgccgccgcactgcaccggtcgcggccggcacgtgttgagccttttgacgaggccttccggctgggggccttaaaccgaaccctactgcctttagtgccttgtaattgggctctgaggcaacgaggccatgattaaattaaacagaaccaggcagcgttgctatttagaataagttccggccagtttggtttgaggtctaaattaggcttaccaatttttttttggcaacctcaacaataattgtgtatgtttggattgaagccaaattttgacatgcctatgtaacataggccatttcaatagccaaattagtttaatttggcttcaatccaaacacatgttggccttaccaaaaattgacataccaaaacttgccatgccaaattttggtaaggccaacattggtcacaaaccaaactagcccttcattttggatcccttcttcgttgctgagttcgaatttcgtcctcgaaactgcaatacaagatataatgagtttctcaacttacaaaactggtatactcgagatcctaaccagtatagagtctgttcttagccgacgtggcgagtgggccccacatgcgaagtatatttcttgtttcagcaatctccctctctccccttcgttacccatcgccggctgggggaagggcgaggcaaaggcagcgatggtgaacgatgaagcttcgatttgcggaggcggccgatgacgatgacggcggagatggcggtgctggcgactatcagggttgggggtctcgcatgggcgtttctcctctcctctcatcgcttctccatccctctcgttctttctctttctcgtctcacctttttttttcttgttgcatgcaccgccacgtagaggggttctgtgcgctcaagcgatgcggggtggtgatggccttggttccgatgagtccatagcggttgaaaccgaagtagtaatcaattcacatgatagtgcagtggcaagggtatgtggttttaacccccgaggtctagtgtttaatcccaacacgctcacaatttatattaaaaaatgtttggaggggtgtatgggcacaaataaaacgaacaccgaatcgaaccgaattactagttttcgcgtttttggatttggtgcatttatttttatgtatatcggtgtccatgtatagatcggtttttgtccgctgtgaactgacttcaccgaagataccgaacatctcgtgcgcatgagagcaggtacaatagcaggctataagccaactgcaaacatattttaaggagataaaaaaaggagagagaagagcagcgggctacagatttatagccagctgtagcacggactccaagacgtagtgtgtgtatgacatgtgggaccaggtattaatagtgtagtatataactgttgtatgaatgagctattagattggctatagatgaattggagctagtagttagctatactattgaacttgctctgagagaggcaagctgcgggtgcctcgtctcccgcgatctgggcctatatgtgtggttcttgctcttgctctatgggcccactagcttttgttggttctgcgtgatgcctgcatgtagggttgtaaaaaaaaaagctcgagactcgtgagcgtctcaagcgctcagctcgagctcttaacgagtcaaacccgagtctagctacaagctcgcgagctttgtcgagccaagctcgagcttctcacgagcctaattgtgtgtaactttagaataaattagtatctattcaaatgaataattagtgtattttggcatcatatattaatcttgagttctcataatatttttcttcaatattgttaattaaaattattgtttttactaaattttatcatcaaaatatacattattgtatactcggtcgagctcgtgggcctagccgagctcgagcttgtgtcgagctcgagccaaggcaggcaagctcgttcgagctcagctcgatgatagccctacatgcggctccacgtctgggtaagtggatgaatgcatagataagagcaattggatgatgggcagctggaaaacttcttcgatataaagccgaagtccacaaaactgaacggtttactctctaccgttgggaatctctctaccgtttactctctatattaaaaaaaacaaaaacaaaatctaatacgagatacgacatattttaatattattaatctatacaatttactgtacaggtttgtattatcatgatatattaacctcgtcataaatttatttatttaaagataaaaaagagtaaaccctacttttagatgtgcacgcactgcttaacaaattctaatcaatttcgtatttactccgtctactactacaaaaaaaatctgtcccgggtgtatattcacagtgaaattccccgcactcccggagaccccgacccaataccgtcatttccagcaccgaaacggcattttcgtcctcgatgttcgtcctcccgacacgtcgccctccgagaaggcgagcagcgcagtgacacaacctacagaaaaagaccgttctacccctccaccaacatagcaaaacagaccacacgacgccgcaccgccgcaacgcaaaagccctaaaacgcctctgcctctgggggatacaaccctaccccgcccccaatccgcgcctccgtctctccgcctctcttcttcgataggcggatcatgacgcaggcggatcaggcggtgatcagcctgcgcccgggcggcggcggcggcatcggtggcccgcgcgccggccgcctcttccccttcggcgcctccacaggctccctcgacttcctccgcccgcgcggcggcgcatcctccggcttcgctgccaaggtgagaccgctccatttggggatggtgggggtgatggtcctagggttcgatcctcgcggaaggggacatatggggggggggggggtctgcggggtgcattgcgagtgctggctgatgggtgtgacatttcactggttttttggtttgatactcccctttgatttgcttgaaggatatacttgatttagaatctgtatttctgatagcatttgtgaacaataatgattgacattatcaaaagagtgtgttttactattcttagtgcagtgcttctactctttatcaacaactagctgtgcaaatcaaaaagcaatgtagatgaatggaggagcaaatcggcccctctatttgccccaacaattgcacttctcccttcgctttattcacagggaaagtccctcaatgttctaacagcaaactaaaagaggcttcgagccttcgatattgtagtttgtactaactgcaataaacccagtgttagagaacttttacccaaagaaaacaattagctagaatacaatccatcctagatcgttacatgctccgctgggccaatcaaatggcgagattcttgagttgcaacttgttggcttgtttcaaatgcattttgtctagactgtgtttctggtctggttcatttaatatgagccaccagatatgaatatatagtttattaacctctgcttggttggcatttgccgaatctgttacagcttggagacttgcggtttgaacctctcgagcgggttcgttacactagggatcaacttgttgaactgcatgaggtatttatctgttgctacttatttacttactgtatttcacatgatgaaattaatcattatggaacatttagtatagctgtcttctataatgatggagctgctcatattttgaaatattgataaaccaatagtgcggtttcactgaatctatttgcttggtttatgaaacacactgctcagttgctcacctttgttttgcacatattctgcgttttacatattatatttaatatatgtgcattgagaactgaagatttggaagtgagataacaatctagctatccaaaattcacttcaagctttaggggtgattcagttgcttgcacttgtctatgttgaatatgacaaaatgattagagaaattgactttggtactcagaaaatctgtctccttttattttttctgttgatcttttctgctatctgatgtatgaaacttgtataacaaaattagttttcctctggtgttctatggctcttcatttccctgtaaagggaagttgagcatgccatcatgttgtgccttcagttccacatatatatcatttttgtgttatggacaatgactaagttgtacatgaaatggcctttgtgccttgaataattcccaatcatgctaaatcttttcccctacatacataatggactctcctgcagtaattctgttctaaaaccactcgaattttaattgtaacattgataggagtgaagcaaagttgtggaacaacctatgtttcagagaagtttaaatggataaaacaacatatatttgcaacagttaccactggttcttgtattcataaccaaatattcttgtcttctgctttatttccctcgacatctttccaattacatgctttgattctatggttttgcagattatcgacatacctgagaacatcttgaagcttaagcaagatattgacatagaactccatggtgaagatgaaccctggattaacaatgactcaagtgtgagaactcttcctttacctttcaactgttcctatgtgttgcaaactgtatctgctcagtaagactggtgcagtttcacgtttactgattactacctgtttgatgttttatcatatctggcaggtgcaaactcagtcatataaccgctacgctgagacagacaaccgtgattggcgttcacggattgaacaacctgtgcaaactcctgctattggtggtgaagagaaatcttgggacaaatttcgtgaagcaaaagaatcatacatttcaagtggaaagcaagatcaatttaataatcaagacaaattgagctcccagttcagtgcaaaagctcaggtatcttgaggataaaagagtatcaatgggctgtcttctaagctctcttgttctgcatatgtgccaatatattttttttttacaattattgtgctgaactttttctcacctgctcctaactcctaagcttgttgttgtgccatatatattgttggtagaaaattgttccatcgagggggcaatatacgcttgtgatgggtgcacattatcatatacctggttgcaagtagtgattgatattgtggcaattcttgcatttatgaattacatcatagcaacgcaatgatgtatggactttatggctttatctaattctagtcctttggaggcaattagacatctgtcaatgcaccaagtgaaatgattgcttcaaattcatactataattttggcatgtataattacgaattactagaatgtttgctttggtggctgtatgctgatgctgcataagtaaagctacatgcaaaagtaatctgatcattttgatttgatacacgacaattatctaacattctcattcgtggtaaacatcaggttggtccggctcctgctcttgtcaaggctgaagtcccttggtcaatccagagaggcaatctctccaacaaagaaagagttctgaaaacagtgaaagggtattgtttgatttgtatcatccttcctcatcatttttatattttcatatttaggaaatataatttatttactctttttcgtctagtccctaatgtgctgttttagacatacctgcagccaaaccttttgaatgttgagcactaatgcttctttaaatattttgatttgacacatgaaacttgtggagaactcactatatcgagctttattgatgtcctttaatagaaattagttgtcatagttttgcttttgggactgtactgatgtccaaagcggtatttatttgtggctggagagagtaaccaaacattatgttttttcttgcatatatttatttgttatttgtttcacagtatactgaacaaattgactccagaaaagtttgatcttcttaagggccagttaattgaagcagggatcactacagctgatattttgaaggtatgttcttgttgttcattcaactggctttgcctttcgacagttccttgtgatttacatctggtctgtttttgtttcaggatgttattagtctcatatttgagaaggctgttcttgagcctaccttctgtccaatgtatgctcagctttgctttgatctcaatgagaagttaccctcattcccttctgaagaacctggtggtaaagagatcacgttcaaacgtgtgctgttgaacaattgccaagaagcatttgaaggtgctgacaatctgcggtctgaggtcaataaattgactggtctagaccaagagatggagagacgtgataaagaaaggctagtgaagcttcggacacttggaaacattcgtcttgttggtgagctacttaagcaaaaaatggtccctgagaagatagtacatcacattgttcaggtgcgcatgcaatctttcgcgtttagttgaatataccatcaaatgaaaatcattaagtcaagaatacgcatgtgccagaagtgcacctaatcgggatgttaagactgactttttatcagtttgtttgaacacccttcatttgatgacacaagacatccttgtttgcactttacagacctattgatttacctatcaactaaatattttcttacccattttctgtaaacaggagctattaggttctgaaagcaacagatgccctgctgaggaaaatgtggaggccatctgtcagttcttcaacacaattggtaaacagttggatgagaatccaaagtctcgacgatttaatgacgtatacttcaaccggctgaaggatctaacaactaattctcagttggcatcacgattgaggttcatggcacgcgatgtccttgatcttcgttcaaaccaatgggtgcctcgacgtgaagaggtacaggtcctcaacttctctttatatttgtattactctccagaatttttatctgcccagtactctctactagttgctaatagctatgcagtggttattaataacagaaatgaaaccaaattagattactaagaaccttcatatatatggtgagatactatgttgagtcttttgaatgcattgttttttggaaattgcccaagtattgccctggtaatatatacatggttacaccacaagagttagtcatgatggtctgtttcacacgcttacaatacttctacctgacattagttcacttcaagtcctatgtaccttttgcaatacaccgagtggcactcattctagtagtcactgagcatgataaacatttagatcttggattctgttttactgtttctatcaaagcaatatgatattattttgctatatgaattgctctgagattctgttaattctttctcagatgaaagctaagaaaatcagtgaaattcatagagaggcagaaaacaatcttggattgcgtccagggtcgactgcaagcataagaactggccgtactggtactggaggtggaggacccctttcaccaggagctttttctatgaaccaacctggtatagttggcatgttgcctggtatgcctggagcgagaaagatgcctggaatgccagggctaggtagtgatgactgggaagttccgcattctagatcaaagcccagagctgatccagttcggaacctcaccccatcattggccaataagccatcacctaataattccagactgcttcctcaaggcagtgcagcattaattagtggcaagacgagtgcacttgtgggcagtggtggcccactatcccatggtctggttgtcacaccatctcaaactacaggaccaccaaaatcactcatcccagctccatctgtagatcctatagttgagcaaccagctgctgcccccaagccaagctctacagagcttcagaagaagaccatatctcttcttaaggagtatttccacatacttcttctacatgaagcacaacagtgcattgaggagctgaagagtcctgattactacccagaagttgttaaagaagccatcaatcttgctcttgataaaggcaccaattccatcgatcctcttttgaggctgttggagcatctctacaacaagaatgttttcaaagcgactgacttggaaactggatgcttgctttacagttctcttcttgatgagcttgctattgaccttccaaaagctccagtacattttggtgaagttattgggcggctggtcttgtcacattgcctgagcatagaagtcgttgaggatactctaaagaaaattgaggacagtttctttcgtgctgcagtgtttgaagctatgatgaaaatcatgaaagcaaatccatcaggtcaggctatcttgggctcacatgttgctaagatcgacgcgtgcagcaaacttctatcctcggaataaatatttgtcgcaagtttgactaggccaacttctaccttattactgatgtcctaactgggaatgttacattggttatttgttactcggtagttggcaggttttgccctttcagttcgagaaactacaacactgaagttgaggaacagctttttgtgagctgtatttttttgcaaggtcagatgactgataatgaagtaaagaaaagctatagatttagctctgataacaccgtaacaatacctcgatggtggtttacgcggctactcctcttgtaacaggtactgctgcgtgttggcaagcatacttgttagcgttgggtacaactgagttcataatttagtcgaaagttgagatctgatgtaattcttccagccaatctcatgacaatttattcgagatttgtttggttcaatttaacctgtcaatgcagtcttatcttctcatctgaggctgtgaggtaggatatgggaattcgtactgtttgcatttcgcgctcttgcgtgtcatgaatctgatggcctcattgtttcgcttatttatgaaataagccaaacgatatatttgtaaacgaaagtagtttatgaataaagcaaatgttgaaaaatagacttcaatgaaaaaaaatctcaaaattagctctaaatttaaggttgaaaatttaaattttgactgataagtataaatgaaaagatgaggtcacgagtgactagaggcaaatgttgttacggcgtaatgcagacggtagcagttttttttttcttttaagaaaaaaccggcctctacatctggaacagatgcatacggctaatctttgtttgaaatgtgcattgtctcaatttccttagtagaatcatatagtttctgtcaattcccttagtagaatcatatagtttctgtctagtggattaatgtagtttcagcctagtagatccatatagtttcaggctttatggcaaacaagacttttaatttcttattatacacatatgaacgtacattttttttcgagactaccaagttttagatcttagatcgtctcgacacgtgcagacctttaggtaaaactacgtttggctataactctggattttttacaaagtgaaaattttacttcacaaatcacaagagtacttatgttctataaaaaacaaatctaaaataaaatgtgtcacattctatattagattcttttttttattgaacgaagggagtactcatctaacgttacaaaaccacataatactgttgcacaaccactagcaggcggcaggtttggcattgggcgacaaaagaccattgcaagaactttagagcatgatgtatgtccatatcgaatgtagagatcatgttttaatctattgcaacaaactttacacgtcatacatagatatatagatatatattgataattcctaatataatatactcccttcgtcccagaatatacaacctagaaccggattagaagcatcctagtactataaatctggatagggggcatgttcagattcatagtactaagatacgtcacatccgatcttaaattgctatattttgggacggagggagacagggagcattatctttatgattgtagtattatgttgcctatcagtatgttaaaaagaatggcaccattctcttttctctttcccaatcttttacgccattaaaaatcatgttggtattttctttaagatgataacgtcacaccattacttatgccttacagcaagtataatagtgagctactccctccatctacttttgatagtcatatttcatcttggcacacagaccaatatttcatcttgccttagagcaagtataatagtaattctacttatcatccatttaaacatgctactagtcattcctcgtaaacaagcgattcattaatatttacatttcacgatgctcaattagccaatcttgtgtgaaagaatggagagtcatacattaaatccgagaaagtcattaagataataggttgttgaattgaaatatgcctatcaaaaatagaattttccgatttggaaatatgactatcaaaagtagatggagggagtataagcctactataagcttatgtggagacgagataacaaaaaaatcaaggatgttggctctcatgcaagagctagcttaacacatgctcctaggtaaatacattaaatgcatatgtgagagatagagagagaagaagaaagttgtagccaaacttatagctaatcattatatatgttggttttaaaatgggctaatagtagaaagtgagctatactattatccttgctcttaatgctggcaacagggcgaaaggaaatctaggaggaaggaaatcctagagccacaagaattgattcgatggtttaacagggcaacacttattagtaagtttgatgcttcaagattcgtgctgcgaacgtgtcacaactcacacgcgaggattgggtctcctacctggtctccttttccatccaccgacccggaccgctcgacgctctcccccctcccccctcccccgcgactcgtgaaatcccccagccgacacgccgccgccgccgccggctactccgacgaactcgacgccgctcagagctgcctccggcgagcctccgccccgtacctagctcttctcgcccccccaccccccaaagctcgcctcctccgtctccggagcggtcctctcttaccgcttttgactccacctcctctgacctgcgcgccgactcctcctgagtccggtgtgccgtcgggaaggtccctacctgtgcgccgccttctccaagtccgtcgcaagtgacccgcccgcgctctcgatggtaagccacccgttctccccccccaatcttcacccttcctcccacagggttctagggtttgggcattcgtgtgttttttttggcttaatggcaggtgcatgttgtactgatcgagatgtttgtgcatatgatatgttaaagctttgtattgttcagaagttaccggtggtgtagcaatagtctatatagaaaaccataatatgtagtgccgtatggaccattgctatctttttgatagaagcaaagatatgtggtttgcttaaatacagtggcccgggggcctatggactactgcgagcacaaaacaagaataaaagaaaaaaaaaatctcaacgcatgatattgtacgacacaacattatctcaacaagtctacattaagcatggcaacaagcactaatcacaagttcataattcatcatccatttgcaaacaagtgtaaatagaagagtatgtactaaaacatatctcaactccttaagattcaggctttgtacttgggtttctactactagagccccggttgaagtaactcttcaaatctgcaaaacaaattacacaaatgcaatttcagaaacaaatttgtacactttgaatttgcaaattgtaatattcttaaattgtcaacaatatgtacctctttgtgatgccaatgccttccctttcctctttctatccattttctgctgatgacttggcttgcttgctatgcttggtgttggtgctgcactgctgctggctggctagttggcagaggttagtggctggctggctgctgtgcgcctgtgctggcgatggcgccctctgccctgcctgcgatacatggctgcacccctggctggctggtcacttcctgatagctcgcagtcgccgcctgccgcagtgccatgctgtgctggcgcctggtgcggatgccgccgctctgcgcccgccgctcgggagcctggcggcctcgcccctcctcgcctccaccttccctctcgtgcgccgactccgctccagcaggcagcagccgcaccgccgatggggattagggtcgggatgaggattgccggattggagaatcgatggaggtgaaggagatgggggaatttgggtctagggtttaatagtcaaaagaaacatttacatgaaacaagcccagcttggcctgctacctgttggtgagcgtacgtgcggatgcacccacgcagcgcctcgcgccctttcatgttgctcatccaaagcggcgttgccgcgctctttgcggctcggcgccctgctgtccggagaaagtgtggggggtggggggtttatcgggtggcgtgaggtatagcgagcgccacacctcgccctaccgagccctccgccactgcttaaatactataatctttaagcaaagatatgtggtttgtgctactgatggtatttattttttatttataagcagtacattggatagggttgttgtattatcagggaatcactgtctttagataataaagctttctggttgacataattgtgatgctgaccatgctatcatattactatttagtataacgactcctcgcttttgtagtactagcctgatatatttcaggtaatggatactctggaaatatttaccttttcaggaatttgttgaacactctgtagttatggcatgtttgcagtatcatcaaattgcaccattctttcttgttacttgaagcatgcattgaatctttttttttcttttggtatttgtgcaggctgggaggcacaccattattctgatgcaaccatcccaaaacagggcttctagaacatttatggattataattcaattaaccatgcattggatggtacgtacggttttgaaagcttaactaatgatgcaatgcttagataatagcttagatattttttttatatggtcctagtgagtacgatatgatcttgcaattttatgaattcacttttctcatgtgatcgatttgtttagaaaaattaacttgaaagttcaataccatataaactgcaaacgtccaaatttgcatatagtgcattagagacattatcaggatttatggcactagactctcctcttacatattatttgttgaaggctgtttttcagaaaggagagagggatgttcttcagctgcacattatcaattttttttggtattctgtttaaaacattgttttatttatgatctgctatgtgcccgtttgatgcatgacatgtatccattctactctgttataatcggaactatttcatttcttcaaatgtgcttcttgatttattttacttttgctctttgtaaattactcaccacagctctcttctgaaatgacaggactgtgtggtctttatgaaaggaaaattagggacataaacccaatggtaccaaacataacatatgatatcactgacctctataacttcattgatggcctagctgacatcagtgcactagtgtgagtaaaataacttttaaagaattggatcagaatcgtgcaatgttaatttatgtgtatagttttcaaagtaaaaaacaatcagctactatttttttctgcatttgcagttatgatcactcaattcaggcatttctgccatatgatcgacagtggataaagcaaaagttgttccaacacttgaagaagctagctcagcggtagtgagtggtttcagttcgatatctctcaccagcgagaagagatgtggccatggttgtcagaggtgttacctgtaaaacaatgagagtttcacattgtgtgctcatattctgacaaaacttaaatttcaatgggttgcctctggtacccaatatatcagttaaacttatctgctgtgtctctttgtgaataaaagaaggatttggctgtatactccttttcaaaatataagacattttgtttcgttaggataaatatttgaccaaaaaatactttattaggatataagttttgtgacatgaatttattatattagtcttcaaaagttcgtacttatgcttatgcttcatttatcgcataaatgatgtccgagtagagcgattgttattcaaaccttaccctaacggaacaaaatacgtcatatatttttgaaatggagggagttttgcttttatctgtccgttgccttattgctcttgttcaaacatagcagtagttccttttgtgcctatcatggtttacgattgtacttcccacaatcccacgtccacacaacttgacctaatgtattatatttcaaaaatgaatgttgattcaaagtgtggtgcgcctgtctaatctctctattctacgaatcctttgctcaagatttacaccgcgtttttttacacggatttacatcgtgtttgctccaatactacctaccataagaacagaataaatatatacatagacaggctgatacgggatggaatgctcataacttagcgcattagtgcatctgcaccaatttgacagtgtgatataatttcattgttcattaaaatgtaaacatttatttggtgacaaatgcctatgacaggtaagtcataactgatatttgctaagataaatccgattgttggcacaagcacaacctagatatccaggcgttacagtgactaaaagacttattaagtgtgagcatgcaagtacaattgatgaggaaaaaaaatcccggcaataacaggacaagcggccatctacttgtatgaatccatagttcatggaggcatcttcaaaatgaagacatctgatatcagatcaaacaaaaccaattgaagccggaaattttttttgccgcttcagttgacagaattggctatggcgtcgtcagtgctacttcaagattttcaaaccagaatcagtgcctgaatggcagctgatcactgccaacggacaaagccttaaccacgatgcctaccagttggatgaacaccccccctaaccccaaaactagccttgaccccaatctcaattgttggtgatggaacaaagccatgggatttcatcattttgaaatatttattggcttcttccgtgaaacccccttcgagaaggcctgctataatcctctcaaaatgataagccttcaataatttcttcttctcctctaaaatcttgagggatttgcgggttctctcttcctgttgtgactttgcgtacatatcagcaaggaaaacatgcatttccaggggttcctctccagcctttctaatcttctgcacaacttgttcagcctcctgcactagctgcaacctagacaaccaatccagcaagacaaggtttgttttaactccaggtttaagtccatccttctctaacttcaacaggaagctcagagcgtggtccagttggttcttcatcatgtaggcaaccatcataccagcaacgcaacgatcatctggttcatgtccagaactcctcatctgctcaaacagggtatatgcttggccaacgtgaccaccccgtccatatgcttctataagtgatgtgtataactctggcgtgagctggaatccagcaagtaacatcgatgttttcaccctttcggctccatctatcatgccacgctgagcaaatgccaggattacatccatgaatagttcctttgtgggtttgatcgatctctccatttcacgtaacaaattttctgcttgttttggttctccagacttaagatgagctctgatcattgacgtgaaaagcttcatatctggtgggaagccttcccccttaaggaattgaaatgcctgattggcttgttcaagattccccaccttgcaatacatgtggactaaagtgatggatgtgacgacatcaggtgcaataccattctctttcattttacctagaatcctttctgcgtcttccacatgatttgctttagagtgaagatcgattaacttagagtaatcacgaatggttgcaccaaaggattcatcagccagcagaatttcagcaacctgtaaattacaacacagcatacatgtgaaactacaaaagagatttcaatgtaagtggatggctgaaggctttctaaactcagtggcagttggccaactttacaaaatgcaaagtactccctcaatttaaaaataatggatttaaatgccaattgtccacaaattgaagtttcatttccatgtgaactagcctgaccacgttaaatacagctgaaatagtcataggttacagagaaaagttggtgcagaacaactatctcaatcatgggaaagctggacatgtaatagcagtctatctgattatgctagtagctaaaacttaggatttcaatgggagacgaatgcaacatttgcactattcctaaataggcaacaatcatgaacaaatatcagataacacatcttattgtttaaaatcttcaacaaaacgctgaacaaaattagtggtcagaagatgcattttggagagggtgaaagtgagctatatctgatacagaaagactattacatatattgatggttcctttatcgtcaaatactataagtcaacaagtaatgtgatgcaaatggcacagttcatactggtcaacctaagaaagcataatcaggccattttagtgcagcagcaaaagcacacttcaaactgatcaaaccaagaaatcacataatcagggtattttagcggttagcgcagcagcaaaagcacctaaaactagaagatgtgccatgaaagaacaaggaattttacaacctgaaagtaatctacttgactagcatgacatacataaggcacaatagtagagccttcaagtaaaggatatatcaccttgagatacaactcaacattgcgggctttaagacgctcgagcagcgccatccagtcggcacgtttcggcagcagctcctccttccactcttccatggcaggcgccgggtctcctttcctcggatcaaccgccatcagcttctcctcagccttcttcgccttcccttctattggcttggcctcctgtggcacaaaatgcgcttcagcctcggccgcgcgctccacaacctcaccccacgttgggtccgacaagtccaacccatgtatcttgaacttgatctcccccttcctctgcggcaaggctgcgagcctgggcggcgggagcgcgacagggttagcggccgcctcggcctgggcgcgcatgtcgtcgaggccccggtagaactcgacctcctcgagcttctcccgtgcccacttgaagcggagctcgcggagcatctcgccgcggatgccgacgtccgacgcgaaccgcgtcatctccttcacctcctcgcagtggaggtagccccggagctcggcgcggacccggtcccgctgcatcccgtcgcgcacggcggcgctgacctcccacaccgccgcccagaggtcgtcgctgagctcgacggcgccgccctcctccggctcgaccccggtgaggcggcacaggacggcctccgccacgaggcggagcatctcgtcgagcacgtggcgggcatgggtggggaacgccgcggcgagggtcggccgcagcgcggcgacgaagcgcgcgaggaactcgtcgagcaaggggtcgggggccggctgctgttcttgctccgcgtccgcgtccgcgcccgcgcccggggtcagctcggactggaggatccgggaggcgacggggggcggcgcgtgatgaggaggcggtgggggttccgcgtggaggcagcggcggaggggcgggagtggggcgcgggcgacggcgagggaggggaggaggcggcgggtgagcttggagagggagatgagggctctcatggtggcggcggccgcgcccggtggtgacggcggcggcggtgggcagtgaggcgtaaaaccctaccaacgcagtaggggggagaagaggaaggcggggaggggatcggtcgatctggaccgtcgatgtctccgatccaacggctattcgttgttgcggcgcgctcgtcggtctgtcagcgatcagcagccttgagagcaggtacagtaggaggctataagccagctgtaaacatattttaaaaatataaatgagaagaaagaggagtagcgggctatatatttgtagccagctgtagcacggattcaaagacagtgtgtgtatgacaagtgggaccaggtattaatagtgtagtatataactattgtatgaataagctattggattggctatagttgaattggagctagtagttggctatcctattaaacttgctcaaatgatgatcttttgagtgatcaaaaggacacttggtggctacatgtaaatgttgctgtttattgaaggacgaatataaatttgtcaaaaaaattcatcttatttcgtccgaaaagaaaattatcctttgatatgttgcaaatcaagtgagagcagcgctaaaaaaaagaatggcagtaaaagtactaaaggtgtgatgataaaattattagtacatgactcaacctaacatacttcaaatcttcacgtgtaaaaaaaacacaaatgggtacactttgaatttgaatttagtaaggttagaaatttataataaagtgagtatagtttaaatggttagattccttgtgatcaagctagcttacccaaattcgagccatatactaaacatgaatgcttgtatttacggttaaatattttcattaataggtgatatacctgtcaacatcgaggcatttgtggtgacttcgtcaatatcaaaatatgccgtttaatctttcggatgtgcttctaggtgtaggatgctagtaagtctttatcaatctcaagatatactagtcagtctttcggatgtgctccgagcacccgcgtttgtaggtgaagtaaaaaaacaaattcatatcaagtgaagggtctattcgcaagtttgagagaaacgaattccgaattttcaagcggaccactctgcaaaagcagcacggggaaaattttcactcacgaaaaaattttcacccccaaaaaaacgttgcgaggcgcggccgcgcgggggctccccccttcttccccaattcagacctccattccccccattcccttctcccccttctgcacgactccacccacctccaatgccctccaaaccctagcccataacccctcccgcctcgctgccatgccagatctgagcaccgtctgcctccccctctcgccgcaacccccctccaccgccgccgccgccggcggggagctagcaggcgagcagcccgccgccgccgccgtcaccaccgccgcggcggcggtgtctgcgtcggcagaggcggaggcggcgggggaagcagaatccgcctccggtggcgacggcgcgcccgttctcccggtggaatgccgatggagcggccgagttcgcagcttcgcgggcgctggcgagggcgcgggcgcggccgctgtccccgcgtgccccgccccgcgccgcgggggcgggaaaaagccgtcctccgcgccgtcgccttcgtccacggtggcgaccgcgccggctcatccatcgggtcggccgttcgaggagtacgttaaggagtggaaggcgaagaaggcggcgctcggcgtgccggccggacgctgcgagctgcctttcctaaccggcacgcctaaggcggtgcgcgtttttcttttgctcgtaatgatatgctttgatgtagtaacagatgcttgagcttacttagaacttttgtttgaacaaactgaactgtctcttcgtgggcatgacgagtgaaattatgactttagaagtgatctagtggtttacaggggcaaaattgagtagataataatatataccatgtgggtgagaaaaaattgtaaccctgatgcttagactggtaatacatttttagataagtaatgcagcagtttgaaaacgtattagaacatttgaagttttgaatgtgttggttgtgtccttgtgttttgcagattttatttcctctagttctaaattcttagaaacattagaccacacgagctcggatttttgtatatttgaattttgaacaaccatgtattttaagcatttcctattatcacattagaatgatatgggtagattggtcataagacattcttctgtattattatttattataccctacaaagtccataaggacaatattttttgactgaagggagtagcactgcagtagcatgcagtatggaggtgaacacataaatttgacacttttgggtcctcccacactggtgtgcgtgcaatgtccattaaatgtcttgtcatcttgataacttcaaattccatacgattcgtgttctgtcaggtggtaatcagaaataatgtggataaaaagtagtagtgctaacactagatgtttgatggctgacacagaaatgctagaatgcatgaagtatttatccgtggggctatgcttgatgttgctaatatacttatgatgtgctgagacatgtgtttccgctacgcaaatttgtgtaatgttcaagcagaagcattttaaagtttaaaaaaccaaaaatttaataccgctgtaatgtttggtcactttggtgcaagaatcagtccttttttgggaggagtttcctcatgcattttgtttccctcattcggactgctaactgcactcaatgccaacagtaggactgagatatgtgtccgattctgaatgtttacgaaatgcctggttggagttctggaaacattgtatgagctgacacctaggtttctattattgcttgatgcttacatccttacttaataattatcaaacttttatgtgcgtctgccttgttaaaacagcagctcattaataaacaaatgtcaaattgattaatgaagggactgtttcctatgaaattctgtgtaaatcctgcagtaaaagcaggcttacatcaacatcagcactagtttttgttattgtttttttgtttgcttagcagctcatgccatgttcatctctgcacaggttgaatgtcgattatgttctaagattattcatcctggagaagaaataaagtgttcggttagtagatgtggagaattgttccacctgacttgtgcagcagaagataccacaaatttcattgctgaaagcttcaaatgccctcaacatgtaagctccgatcttatgaactggagtgtgctctagtatgtgctaagtctctcgtgcacataagggagcatgtaagattttactaaagaaccactctaaataaaaatccactgctgaaatttgtaggcttctctggccatcttatttaatttcataacatggatagttgttactttcatgcaatgtacagacagtacagctgtgcattatttattgttttgaggccaagggatgcagtatatactatcacacctacgggtaatacatactcccaccatcctaaaatatagctacttttagcattcaataattgtcccaaaatatagctacctttgtacctactctctcatctcaaccaatcacaaccatctctcatttaatgtcttcacctacttcctcatctcaaccaatcacaaccatccctcagtttattttacttttctgcttgatacccatgcccaactctagatgtcattatattttgggacggaaggagtatattaatactgagtcaaattctgtgtagttttaattgtataaatctatcacatgttcatggccagctgggcagtacaaatttatgcaatatgtgtgggggaaggaacatatatttaaaagtgaagacttaattatgatcttctaactttgagctggtcttgtttgtagaacattttttaaaatatcctattttagccctaaacattcaattttgctctattttgtccttttaatggagaaaacttcaatctaatgggtcccaagtcaccgaccatgcatcacatattcacatgtgttcacaccacatgccaaggcatggaaggctattttttcaactaagagcacaggagattttttttttctttttcaaatgaggttgtaatttaaggtgctggagaataccttccaaatgttcatgtcctaaaacaaatcagagctcactggtagctgcccaaacaaaagtaatttgtgaagttaaaagtagagtattggacatttatcaattgtccttctagaagcttccctagagtgttttgtctgtagccaaggagagttgctgcagtccatggtgctgttatgttataaacctcttttctctctctgtttttttttggtgttatgtttcacttcttgctcttggattaatagtgatagttttacttgaacttgcattaatttaattttatctccaatcagggctgtatggtctgtaagcaaaagatgtttttttggcgttgtggacggtgtacggttgcagcacatacaaaatgtgcaccatggccagtaattcatttaaaagatgaccaaggaagtgctatctgttggaggcatccctctgattggctccttcaaaatgaggtctatccttttacccttaagattgaccactttatgttgctagatgccccccaaaaaaaaatctagtacaatatgatatgttctcaagattcaagaaaaaaatgggtgtaagattaaaactaaattgttggaacatacttttttctccttgggtgatgttcattttcatttttttatctgtgcaacaaagctattttgttttactgtatgctgcattattttaatgtcgatgacaattactgctttggatggatatcaaattgtctttatatataattattttctcacttgtgctcagtgaatgtaagacatgttttccaagtttctttcttgtcgctttaacctctcttctgttttaactcatcttatcctgcttatataatattgtttgatcttgctagaagttatttacagtattagttctttttctagaagtgttaatgcttttttataagtgaaaagtcttaatcttctttttttctccatcttatcataacattgctggtattcgctgggttcctaggctaagcaagctagtgcaatcacacatgaatgcatcaaagtccttttggtgcagctgtgacactgaactatcacgatccttattcatctttcactgattcgtttccggaattgttttgacttcatcttctctataatttttgtactcctttcaactacatgaaatgattgtgacactatggttccgttcttattagtaaggttcatgtgtagcatcattttttctattacttgcttttaaccagaggttaacaaacttgtttcatggtttcaagcccaatgctgatgtctccattacattcaaaattttatcctaatttggattgtgggaaattaataaaaccataaaaggttgctgtttaagctaattcttttgaagaatacttcaaatagtcatttcatatgccttcttgtaatatttgtaatgtttgaagtgtctgacaggactactttgtttaatggtggcagaatgctgacttgacgaacagcatagaggttagtgttttgtatgatataactccattcttgctatattctcttctatatttgtttcaattgcttttagataaagccattgtgcacatttcatagctagtcaccttggaatacctggatggttcaattataggcttctgggcatgtttctcttgtttttttggaattctgctaaagtagtgctccccctatgtcacaagacaaatggtattttgggatgtgaatttttgcttcttttttttttacttcggctgatatttgtgcagctatatataggatgccacatatttttatgttcatttgtaattttagtacaatatactcctgctctgaaatgtttaatgttggttagttcatttgaatgaactaacgtcatacaaaaagaaacagagggagtattataaaaatttagttagcgaggctgtaatgtaacttggagacgaaaaagatgaaaacatcagttaatttatgccaggagggctatttgaaacttgcttttactatacacctaaagaacatcagcagtgcaattgaaattcacgaagattggcgaggagcatatttgttacactaatgctataaacccttgtaaaagtatttcagtgttatctcattcaaacaaaaaaacattttttttcttcagaagatgaagtgtgttgcctgtgaaatgtttcttcatggccacactgacatgtttgttctgtaggaagtattttgccgactacctgttccatatgttaatgaagacttcaagattgattcaaccatcagggatttcactgcagctgtctgcaaaccaccacactttacgtttatcagacgcagtatccttaagtaacagttatagaatgaagcctttagctattacattttctataatgaccttcgtctttgtctgcttttcatctctacatatcctatttgttttcttgatttttaaaagatgtatatttaatcaagaaaaaacgtcctgattctcgcgcggaagctgggtgcacaaactgcagtgctgattctacgtgcaaagatgactgcgaatgcaggtaaacagtcttactttgtcaatacatttcatacagaagttttcatgaaagctttagtttgattcgtgcacaaattcttcattgcgctctaaagatggcaccaatgtcctcttctaacaaaacagggtgcatgtctcagcatgtagctatgtcctctgttctttttacctgtatttttgtacattatgtatgctgggaatttaatgccaaatttatcaatatcattatcatataatgaactagtcttaaaatgttgaccatgcattcaaggactagtaagactggataccatttttccaatttgttttaatcaaatgtagcctgacatttgtttcttcaaaatatcattacgttacgtatgtgtgaaggttgccgttgttgttttcctatataaatctttatctgcttttgatagctgtactgctgtagctaatgctactgtagctgagggtgctttagcatcttttttgccactcatttcaaccactctcttctgccatccaaaaattgccactctctcgttaccactcttctgttgcctttttacatgtttctctgagttctaattttttcctgcactttatcaggggcctttacatgagttgttccaagaattgccactgctcagatatgtgtacgaacaagccattccgcaaggataaaaaaataaaagctgtcaaggtaattatgtcctgcaatttttttcttgatttcgttaaggacatcaattaccattacattcttccttacctgtgtaactctttcggcatacatataaagttgcatgctgtgatattatctgccgtaacttttcaaatttgtcaagttcctcatttgtcgaagagcctgtgcttttagctacaagttgtatcatcatggaacaactaacttactgattacattatttgaattttacctaaacttggaactgagcttcaaacgttgatgatatctaataacagaagtattgtgccaacgactcaaaagtattcaagtccacaaacctcctttgtattgttctttaatgtaaaatggcatatggctatgatagtgctgtttgaagttgtcatgccatcaaatgtagattactttcaccttctgttgacacctccgggcaccatcattcttcatttgttagggagaataagtctgtaactgcagcaactacttttctgtacagacaaaacgttgtggatggggtgctatttcattggagccattggaaaaaggtgattttataattgagtatgttggtgaaggtacaagttactctaccatttaaacttatattatacaaattagcatattctttagtaaactgtatgcatgtcattgtggagtcacattatgccattacagtacaatccaaatttcttgacatgaatatttcctgaagataaatttgaagcaacttattggtagttagcatgaaaaagcctgtttagtcattgcatctgtttaacagaaaaggtacctcagctttagatgaaaacttattatattaatctgaaaattggataacgagtgtacattttgttcccactctattttataacataacatagctacgaagcctacaattatgaacaatggcagttcttgttgccacttattcttgtgaccttagctctttgtggtttttattttattactccctctgtcctaatatgtagctatttctagcagtcaaagtgcatcctaaaatgtagctatttctctacctaccttttcatctcaacccatcataaccattctccatttaatttcttcacctacttcctctgctcaaccaatcgcaacctttccccatttaattcaacctacttctcaagaaatgcttccattttgggacagagtatgtctccttcactgttttttagttgagttttatggcgctgtgggatagcatcgtattatatctttctgggtttgattcaaaggctcttagctattctctctataactaattacaacaacttaatgctatgctcatctgttcttttcaaatgcttttctaatgtgttttaaacattattccagtcatcaatgatgcaacatgtgaacaaaggctttgggacatgaaacggcgaggtgataaaaatttctacatgtgtgaaatcagcaaagattttacaatagatgcaacatttaaaggaaacacatcacgttttctgaaccacagttgtgatcccaactgtaaattagaaaaatggtaatgccatctttttggaacagaaaagctctgtactcggtgtttgtgaacagtatgaaatgattaatgttcctgattgtctatgtggcttgtccaggcaagttgatggtgagacaagagttggtgttttcgcctctcgttccatccaagttggagaacacttaacttatgactacaggtatgtgcaaacaatagtttttcaaactatatttttaaggatcctaagtattcttactgaaaaaggtataatgaatacattcttttgatatggagatatagttcctgcatagagaaactgctttcctgcaatcagctatggttaaccatgatttgaaatatatgcatatctagtggagtatatgtacatatgtaaattctggtgtgtgaactagaacctttgtactattattgtgtggcatgtagcttttacatccacattatgggctctgtgaatgactcggcaagaaagagagaaaatttacctcgttttttgcacgcatgcttcccaaactaataaacggtgcttttttggtgcaaagaacatatatacgaaagttacttttaaaaccatattaatccattttcaagtttaaataattaatactcaattagttgtatgctaatggctcacctcgttttgagtatcttctccttatcttttctcctccactcaaacgttgttcacttgcttcccacttcctcttctagatggtgaatttccaaatcatgcttcggtagcagaaacaccacgatttttttctgttattttcttatgaaaccaattagcatttgtattagattaaaataccgttattatgtgggagcgttgaaacggtgactattctcccagcccacacgaagaaagatttttttttcttccaggagtcttgtgaataataatgattttctatgagcaacagtaacaatagttcacgttccttttcaggtttgtgcatttcggggagaaggttaaatgctattgcggggcacaaaattgtcaaggttacctgggcaaccaaataaagaatcctacgcagcgtgctctcgcaattgcagcattggagaacgagtggcttgaatctttgaagatacaacaggacacctctgcttcaagacacaaaccgatgacacatttgttaccttggaccaactgtatagaggtaccatttaacttgagaagcaaacggaaaatacaccggatatgctggggatgcaaaaggaggagatcagccgttgccgttacatctccaacaagcatacaagcgtcagttactgaagctgctgctgctgctgctgctgcatccctgcccgctttgccatgaagtggcaatagctgaagtcgcttctcatctgtataatataggatgacacatttctcacatgaaattgatttttgaacgacgattcttttgcattgctcctccccaccaccaccaaaactccctgttgtaatttgttacaatattcatttgattacatagtttgtttaatttacagttgttcgctgagaatactcgactatctcatgtaatcaatgttgtgctccaactctcgattgcctcagccctcaagttgaggcgagtacatgagggctattattgtcttagagaatcttatactattattttgacacattccttctggctagtgacaaaatatcagaaacacggagaaggcactggtacagaagagtatatcagatttcaacattcattcactcaacatttctagattgacactgaagcatttcttcgtggaaagtaactgcatttgaaatagatcaaatcaacaaagcaggggtacctgtctcagtccctgttgcagaaccacttgggtcactgataggtgcagaacagtgataggtgcagaacagaagtcatatttgccaattgccgtagtgttcgtacacagaatcaaatcagcgtacaaagtgctcaattcattgcctgatagcaacaaatgcagtctcaatcgactcgaatcagattcccatgcaaatccaatacgcaagatgttttgacggtccaatagacatgccaagaagtacctatcatccatcacacaagggaagaaaaacaagcatcttgacaaagaaataatgtgccgcctcccgcctcccaccatcaccagaatactaccacacaaccggaacaaacaaagggagtgacaatgccgacattattataaaatgacttgtattatattcccaacattaaagtttgatattcggatacattttgctcactgtggcagacaaagcagaccacctagagcccttttattcagaatatatgcaagataataaagaacattggtcatagcatatactagtactatatgaatagtctggctggctgcttcacaaagtaacagagtgatcgctactggagttttgagtattctttaatcttcagtgcgcttccctcatcagcagctcctcatcttcttaccctctgtgccatctatctcctcgacagcatcgtcttcccagtagagagcctccattttaccagctttctccgtgttttcatcagcaaagcaatgcagaacagatcgtggcgacccggtggcgatttcagcagtagcagtgaagctctggtaaatgagcaaacccccagaaggcagctcctgctcaaccatgttgctgcaagaataggccccgacatccagccccttggcccaggtccctgcatggttgcggccaccaaagatggtaaccgcaacagagaactccaacgggccaaagcatctcaacaccctcttgacaaggtcaccataggcaagggaagcagggttgaagcccatgacctcgtagctggcatagctgaagccatcctcaggagtcacatgaatggttgagaaagcagggccgtggatggcattcatggagtagccgcagggctcgaaatcgaagtcgcagacttccatctctgggatgatgtcagagatacctgagagcttggtcatttccttagcatatgttgtgtgtccatcagcagaagtcttgaagaagacagaagctttcttcttgtccagcccagtcatgcacatctcaagagtgaccacaggttgctccgggtgctgggtggcatagtagacatgccacttctgccctggctttgcaggatctccaatcacgtatgcgttgccaccagatttgagaccgccgaagtagcggttcaggactgcaacctcctcagagaagttcttgtgtggagagggctgtgcttcaggaaaaatgaatgtcccacgagagtacttcacagcttcaagtggcagagatagctcttcagcaagctcaagaatcctcggaatggcgagcaggagcttggtagtcccacaggtcttgatcacaatcttgtatgggtacacaaagaggctcgattcagaaaggacatacgagtcgaagacctcattggagagctcagacacaatggtgcacctcgccagatcaagaacagagtcaatctgagcacgtgacagtgcacgcaaccccctgccattggggtcagcaaagacaggcgcctcggagaaagtgatctcgaggcgtttctcatatccctcaaacccgatcgccgagaccggtggagagtcagcaactgacaggactgccattgtttcgaaggacgatgccagagatgaggaagaaaggaagcaggactgatgaccttcccggtcactgggaagcagctagccagagagatgtaagaaagcccaaaacgagaattcagaggagtaactaaactactaggtcaaggtagccaagggggctatcaagagggcttcctcgcgcactgcaagagatgaaaacaatttaacaccgtgagcaaccaatcaaccgccaattagagaaacaaactagtgttcagttgattcgatacatacgttggagtaagcagcagagcggaacttcttgatgccgccggcaggtcggaggtcctcaatgctgtagccgaggggagcttcgtacatcagggaggaacgactactgctagacttctttttgccacccttggactccattagtgcatcaatttgttgactgcagagaagaattaaaaggatcgatgagaatctgcaagactaggcaatgcaacagattgtctgatcgtcaaagtttcaattactaaagagatacattcatgtttcatcaaccgtatgaactggagggaaatttcagtaattcgttctgactatgactattatttgcaaaagcataagaaatttcagactcaaatagcagattgtcttgtcatcaaaatcttcgttgcttttgagacacattcatatttatcaaccatatgaactacacaaaaaaatcaccaattcttttggactattatttgcataagcataagaaaattcagactcgaatcatataaccaaagtcttaattcctttacattcatgtttcatcagacatatgaactggagcgggacaattatttgcatataacataaaaattcagactcaattgaagaatatttcaatcagccacctgtggctaacagaagagatgagatcgaaaatttcgactaagttttgacatacgaatctattacgatatagataacttatcatacatcgagcacaaggggatctactcagcaaaaaatcataaacagaataacacgatatagatcagaaaagaaaaatatgaattcagaattaccattcacaagactgagtgattaaagattatattttgacgccaacaaaggaaaatacttctcctaccattcgtaccgaaaataactacttttcatagatcatctaacatactagatcaaacaaacaaacgaagtactagacagaacatcaagaacaggtcgcgcgagatcttgcaattccttaaacaaaggaaaatacctttcctaccatccgtaccgaaaacaacaactagtcttcacagatcatcaagactatagatcaaacataaaacaaacgaagtaactaggcagaagaacaccaagaagaacaaacaggtcgcgcgagatcttacaatttcctcggaaataaagttacgattccccgctcctcctcgtcgcagatcgatctcgaaccttcagggagaagaaaaagatctccccctccggaaaatcggcagcgctcctctccctctctctcctctcggtttctctcgaccacgagacggggaagagaaacaaagtgtatgggaataccaaaacgaaaccaaccaaaagatgaggctgagaaggggaggccttcccttcgccgtgtatttatagtggggtggtggtggaggccgcgggggaggaggtctcgcgtgcaaaggcgtggttcactggacccgcgccgccatgtggggcccacctcgcgtgccgattccaccgccgtgggggcagggggaacccggggtgggctgtggaccgcgtgcacggagttttcctttttttttttcttcttttcttctcttgccttccaggctggctgggctggcgggctgattctggacggctccctctctcggtgggtatgacaggtggggcccgcacgaggtgctgggcgggacgcgtggacaggggcgcgtggaaacgctcgcgacctcgcgttcgctggatgcgtcgacgagtcgtgggggaaaagaattgatgcttttttttttctttttttgcgcggctatttcggaggagtccgtagtataaaacgtgttgctggatgacgtgcttatcttttttttagagagagagagagggagagagaattttttttttgttagagctatatgacgtgcttatcttcatccatatcttttttatggtgctgctgcgtcatttgaaaaaaaaaatatgcgtttgctttctttttatttaatttatatcgatttgagtcatcgaataaaaagacgaaaaagcaagtttcctggaacgacccagctttcggccggtctcgaaacttgcgttgcacggatcatgccgtcagtaagtaacggaggcattaggtaacatcggcttgacatcgtgaacacgctttctaaactgttaaatgtgctgctgcgtcatttgaaaaaaaaaatcatgcgtttgctttctttttatttaatttatatcgatttgagccatcgaagaaaaagacgaaaaagcaagtttcctagaacgacccagctttcggccggtctcgaaacttgcgttgcacggatcatgccgtcagtaagtaacggaggcgttaggtaacatcggcttgacatcgtgaacacgctttctaaactgttaaatggaatcatttctatccaaattttctataataaagtggctttacaaaatcatattaacttatttgaattttctattttttattaatatttaattaatcatgtgctaattagtcatcagttcgaaactatggtttgaaaccgcacgcgacctaacaaggaataagttcattttgagcttctttggcacagctccagctcatgcgcatctctcctaaaactcagttaaacagtttcagctccacctaaaatggtagtgtaactggggtggagctgggtggagcgctatcacaaaatgaactagagaggtggaggtgggtttaggctgctccacaactccacagcaaacttaactccttaagctaaatttaggaattggagttttgccaaacaggccctttaggtcccttatgttgacattgtaaacagcaataccaaaagttttgaacccccccccccaccaacttgtaaaatcggttaaattaggccctccgacggtatagatggctggtttcgctgatatgacaaattgatccgatccacttgtgctgactaggcgtttgcatgggaaaaaaaaacaaaaatgatcccacatatcatgctcactcttctctcatcctctcccccgcccccaattttctccccatctactgcaagcaagcaagttttaagcagtttacaggttttgttatagcttgtaggcttcaccaacaccgcacacgacgagtgtcatggtcagtttggtcccgaggacgacacgcacgatcaaggggatgccgacgcatgccgcagtggcagcgcaagcggtcaaacccagacacgtcacgagggtggggggagaaggtggaggtggatgcgttgtgatcggcgaaaaggggatggagcacgacggtagactgcgaggtggcatggccgaggatgacgaggacgcatccgttctcacgggaataggaggagtgcatcatggcacgacacggaagtcgtaggcaatttggttctagagtatggcggcctgccatgctttgcgtggtagtgggctcgcgttgttcctgccatggactccctcatcgcgagcagatagaaagaagagtttgtgtgtcgttattgaggcggcgatcgcgataccagcatccaggctcgattggcttggcggcgtgatccttctagctgccgtttgccagagatggagagaaaaaggcgagagaggagggggaagagtgagaatgacatgtggggctcatttttcctcatgtaagcgtttagttagcacaagtgggtcgggtcaacccacctgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgtcgtactattaagagggatgccacatgcatataattggtagaacactagtgctcaaaatcatttatttgaagtattcctgttttatgtctgtcggactatccgatgttgatcagactatccgatgctcagactatccgaaatttcacagaactttgctcactgtcttgggtctaagtgttggctaaaaaatatcggactatccgatataaggtcggactatccaatacgtcggactatctgaaatttctcagaacttcactctctgttttgaattgctttttattccttttgagtgagttttaaatcagactatccgatgtgatcggagtatccgatgatccagagactccgaaattcaatggaacttgagtctctgtgagaggatgaaattcttggttcaaaaataacggaatatccgatatgacatcggactatccgatcgatcggattgtccaaaattctccagaatttcgttctctgtctctggcctgcttggggggtcaaaaacatcggactatccgatgtcacttcggactttccaaggtgggatgaaaagattctctcccaacggccacattttgagggcttctataaataccccccacctaacccttttctagggttacccaactcatttcattctcattcactttgggttgagcttggtgctaaggtgctttggatctttgagctctttctccctctctcaaatccctcattgttctttgtgtggtggatcttggtggttgtggatttggggtttgagggcctagtgtgtgtttcactcgatcttgagcactagggttgaccaagagttgtgtggtgtttgttactcttggatgttgaggactcctagacggctaggtgtcactcccgagccaccgatctacgtgtggttggccgggagaagtttgtgaaggccggatctcgcctccacaaggaaagagataccccttagtggaaggaggagtgcttagtgcaacctcttgaggaaagggttagcaaagacccggctcttagtgagctcctcaacggagagtagaatcccctcaaggatttgaactccgggaacaactcggtgaatttcattgttggtgatatctcttctcccattatttagctttgcttttgtgccgctatagatctagtcgctgtttgcgccatactcttgtttgtgcactagatcttcttgtagtgttcttttagtggatcagacagtctgatccaacatcagactatctgatattttcggatagtctgactgttgatcagactttccgaccctaactcagttttagtttccgcataaagttttaaattatcctattcaccccccctctagacctaattgaccctttcaattggtatcagagcataatctcctaattaggcttaaccgcttggaagcataagatgaagatgcatttgaagtctattaacccatctatttggagaatagtcgaaaaaggttatgttttgcagaatcccgaagatcccaccaaggaggacgacgagaatgagcacaagaacgctcaagccgccaatgcaatacttagtgccttgagtggaagtgagttcaaccgtgtggatggcattgagagtgccaaagtgatttgggacacgcttcagaacttgcatgaaagcacggatagtgttcgtgagtccaaggtttagatcctcaaggggcaatttgagagatttgtgatgttggatggtgagagcccaagtgacatgtatgaccggttgagcaagattgtcaatgagatcaagggacttggctccaaggacatgaccgatgaggttgtggtcaagaagatggtttgagcaatcactccaaggaactctaccttggttaccatcatttgtgagcgtccggactacaagactctcacacctcatgatttgcttggacacattcttgcccatgacatgcttgtgcaagactccaaggaggtcatccaatacatcaaccaaagctcaacgacaagcatcaagaagtaagacttggcattgaaggcaaaggaagaagaagaagatagccacaagagcaagagcaaggaggagatcgatgatgaagaaatggctctcttcgtcaagaagtttggcaagttcatgaggcgaagcggcttcttcaagggaaattcttccaagcatcactccaacaagtcaagtggaagacattctgcaagagtgtgctacgtgtgcaaagagcccgggcacttcattgcggattgccctcacctcaaggatggttcccacatcaaggaagataagaagaagggtgagaagaaggatgagaagaaggagaagtataagcatagcaagcgggaacattatggccaagctcaccttgggatgattttcggctccgactccgagtcaagctcaagttatgaagaaggagtcgccacattcgccgtcaagccttcatcaccgccaagactcttcgactactcaagtgatgaggatgctcccatttgcctcatggcaaaggagcctaaggtaccttctcctcccaaatcatttaatgttgatcttgttagtgatgaggaggatgaggttgaggatgaggttatggatgacaaattgttcaagtccataactaaggaatctctaccacacttgagtgagttgcttgggagaattgaggaccaatatgcaactcttgagaggcaagaggctttgctcattcatgagaaagagcgatctcatgaactcaagagtgagcttgctaaggagagagagaaaaatgaggctttggcacggctttacaagcaaaccaaagagtctcatgctaatcttgaggtggcgaacgctcaacttcaagagagagtggatggcttggacaaagcatacctctctcttgaagagaagttcgaaaccttaaagaatagtgtctctctccctagcgaaccgtcttgttccaaaattgttccaagcaatgaatcatgtgtgagatgcaaagatattgatattgaagcttgtgctactaactctatttctttgagtgctttgcaaaagcaaaatgagaagcttatgggacttcttcacaatggcctacttaagtgccatatggatagtaaggccctaaaggagtacctaggctatcaaagggacaacttcaaccatgagggtcttgggtatgttcctccaccaaaaggaaaggtggacaagagtatgatgataaagaggccccaaggttttagcaattttgttaaggcaaaaagtatccttcctaatgattctgcttcacattgttcttttgatgcatcttatgttcttaggaagaatgctagtggtcgtgttgttgctaagtatgtaggaccaagggacaaaaatttttccatcaagagagttctttgggtgcctaaggcacttgtcactaacatgagaggacccaaacaagtgtgggtacctaaaactagaaattgatctcttgtaggaatatctctccggtggaagaagttgggtgatcgatagtggatgcacaaatcacatgaccggagaagaatcaatgttttgctcccttgatcctaatggctcttcgcaagagaacatagtcttcggggacgatggaaagggaaaagtaatgggattgggtaagattgcaatctccaatgacctttccatttctaacgtcctcttggtaaagagaatgtctcttactttcgtgttttcggtagtaagtgctacattcttaataagaaggctagatcctcaaagtttgctcctaaagttgatgaggggttcttgcttgggtatgtgtcaaatgaatgcgcataccgcgttttcaacaaaacctccggtattgttgagatcgcgcgtgatgtgacatttgacgaaactaacggctctcaagtagagcaagttgactcacatgtgttaggtgaagaggaggaccctagcgaagcaatcaaaagattggctcttggagacgtgcgtcctagggagccacaacaaggggtctcttcctcaacacaagtggagccacctacatcaacccaagccgacaatccctccacttcaagcttggatcaaggtgaagaaggcgagcaagtgccactctctccgataaatctagctcacccaaaaatccaccaaagtatccaacgagatcaccccaccgacaacatcttaggagacatcaacaagggagtatccactctttgcaaatttttgtgagcattactcgtttgtatcttctattgaacctctaagggtggaagaagctcttaatgatccggattgggtgatggcgatgcaagaggagttgaacaatttcacccggaatgaagtgtggactttggtggagcgacctcggcaaaatgtgattagcacaaagtggatcttccgcaataagcaagacgaggccggggtcgtgataaggaacaaggcgaggttagtggcgcaagggttcacccaaatcgaaggattagatttcagtgaaacatttgcgccgatagctagacttgagtcaattcgcatattgcttgcttttgctactaacctcaattttaagctatatcaaatggatgtcaaaagcgccttcctcaacgggcctatcaacgagttggtatacgtggagcaaccaccgggcttcgaggatccaaaatatcccaaccacgtatacaagcttcacaaggcactctacgggcttaagcaagcccctagagcttggtatgagtgtctttgcaatttttttgtgaaaaatggctttgagatcgggaaagccgattcaactctttttactaaaaggcatgataatgatatttttgtgtaccaaatatatgtcgatgacatcatatttggttctactaacaagtcttttagtgaagagtttagtaggatgatgaccaaacgttttgagatgtccatgatgggtgaattaaagttcttcctcggccttcaaatcaagcaactaaaggaaggaaccttcatttgccaaacaaagtatttgaaggacatgctcaagaaatttggaatggagaatgcgaagcaatccacactcccatgccatcaaatggccacctcgacctcaacgagcaaggtaaagacgtcgaccaaaaggtataccgttccatcattggctcacttctttacctttgtgcatctaggcccaatattatgcttagtgtgtgcatatgtgcaagatttcaagccgctccgaaggagtgtcaccttgtggccgtgaagagaattcttagatatttagtgcacacacctaatcttggtctttggtatcctaagggagcgaggtttgatctcattggttatgccgatgcggattatgccgggtgcaaagtggataggaaaagcacatcgggttcttgcaaattcttgggtaggtcccttgtttcttggtcttccaagaagcaaaactccgtcgccctatccaccgccgaagcggaatacgtttcggcggggagttgttgtgctcaacttctttggatgaagcaaaccttgagagactatggcctaaatgtgtccaaaatcccactcttgtgtgacaatgagagcgccattaagttagccaataaccccgtccaacattcccgaaccaaacatatagatattcgccaccatttcttgagagaccattccacaagaggcgacatagatatccaacatgtgagaaccgacaaacaattggcggatatcttcaccaagtctctagatgaagctaggttttgtgagttgagaagtgagctaaacatcttggattctcggaatgtggcttgatcttttgcatgcatttgtttttcatttactagaataggtttgcttgctacatcatgacaaagtgaacattcaattcatgaataaacactagtcataatctatgtggataacttgaatctatgtgtacggggatctcattctctaatgaatcttggtccttgcacaatttgctatagattcgtacattccctctctcgagggtgcctagtttttctttcttttgctgcatttgtccaagtaatagtctagccatcgagttcatcctatcaaaatgttgttgaaaaattcttccttgagccatcctttattgtctctgccacaaaggatgtcggactgtctgacatcaagtcagactatccgaccataatcggacagtccgatttcaaatcggactattcgacgtggggccaagggcaaggggacttaacctccctaggggtaactctttcttaccccttcagtcatttgtctcagtcgtttctctctccacccctcttctccactccaaaccctagttctaggccaccaaaaatcttcgtttcggagtctccgattgctattccttcgctttagggtggtttccctccctcaactccttccaaatcactggttccccagtgattctcttggtggttcttgaggtatttccttgtttttcctcgatctccctcatgatgtattatttcaagatttccttcggcgaatcttcttgttttagtgtctagatctagtacctacaagatcctttgattctattggatattcttgtgtgaatcgagatttgttggtctagggcaaaaggtcgtcggattgtctgatatgccgtcggatagtccgatgtacatcggatagtccgacgtcaaatcagactatccgaccttcttttggcccagtccaaatttctccttgcttcacatttaagtattcttcttccacttcttcttaatctttatcctctgttctaaatcagtgtatcctcatgatcaggggtcagttcaagaatcaactttactctcgccgtgggtcaatgagttctcaaggtcgctctccctcttccaaggctcgtcatgctatacggcgtatgtccgaatcccgcaaagatgccattgacgcgcaagctcaagcctctgaccaagcagctcaagtggctaatgtggagtgtggtgctcctcttcctcttcgccgcagccgagtcagtggagaaggatcaagtgcacctgctagcaaagtaaggagaggcaatcctacggattcttctgagccgggtcacggtagtggttctcatgcaccatcctttgaggaagagattcagttagaagaggacattgccgctcagcaagctgctcaggaagaagggcctttctttatcactgctccctctagagatcctaattatcatcgaagagtcgtaaggtggaaccgcaagtggactgaagtggagaaagagtgtaagaaagatccctacaaatttcaacagttgtccactgatcctcggttttggaacctttttcagcaggattactatgagatagtgattgcacctaagaagggggctattcttatgcagtgggttgattggaagtatatggaggagttgcatgatccaattattgatgaagtcattgaagcttgtgctcggcaaaacttgaaggaactcatgggcttgcaatacccatggtgcaaggaaatcatcgcacaattctatgccacagtttactttgagcccaacaaagaaaagactattcattggatgatagatggcatcatatactcagtgtcatatgccaagtttgctgccattttggggtttccggctccaatcgtgtcaagattcatgatgagaagcccatggacacaaattctcttcacttcttgtaccaagatgtggactatgagttaggcaccatcaaaggtctccttcccttctatgcctatctcaataagctcttgcgcaaaactcttaatcccaaggaaggtgatgctagcaacgtccttgcctatacaagaaatttgctttacaagatgaaggctcacccacagctctttgacgcctttgacttcatctttgaagaaatccggcttatctctatgatgcctaagcgaggacttagctatgggccttacattacgaagatgattgagattgtgtccaagaagaagtttcacaaggaggtggcacataccggttaccaagtccgtcccatcaaggctgctgttgtgccggctggacgaaccactcgtgcttcttctcgtgccggtcactccgctaccgtcaccaagccggactccaactcgtccttgaggttcttcaagtccatcttcaacttatgcaagaccatctcagttcggcaagccaaggaacgcagagcaaggaagaaggacactcgacggctcaagaacctccttcgcaacgcccatttgccgtgttctcccgatggttctgaggttgaggacagtggggaggatgtgattgaggacccttttgcagctgaggcaagctcctctcatgcggatcgtggcaaggctcctatggaggaagaagaagaggagaaggaaggtaatctatctcctttcgtgatggctagtcgaatcttgggcttttgtgtcttgttatgtgcaattatctattatccatgctcaaatgtgtgaaatatcttgtcattggcatatgcatgaggttatattgtcatttctaatctagtgcatagattgagggggagctctcctatttcatttctagcatatctttagggggagctccaccaaaatcctaatcttttattacttctaagtgtgttgtcatcaatcaccaaaaaggggagattgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgtcatactattaagagggatgccacatgcatataattggtagaacactagtgctcaaaatcatttatttgaagtgttcctgttttatgtctgtcggactatccgatgctcagactatccgaaatttcacagaactttgctcactgtcttgggtctgagtgttggctaaaaaatatcggactatccgatataaggtcggactatccgatacgtcggactatctgaaatttctcaaaacttcactctctgttttgaattgctttttattccttttgagtgagttttaaatcagactatccgatgtgatcggagtatccgatgatccagagactccgaaattcaatggaacttgagtctctgtgagaggatg

SEQ ID NO: 69852 - DNA, 14002 bp, Oryza sativa
cctgcagcccaggccaaaacattaaaacataccacccccggggtaaatggcaccacgatctggctaataaccggtagttagccagatcatcagtggcatatatcggagacatggctgacgatggcatgtagctgctggagatagtgatgggaccgacgatgacctacaaaccatcaccatccactcctacagtctctcatgacaatggagacatcgtcgttgtctctgttgtcacacaaacttagccaagtctacgccaccaccgcttcaactgcctaccattgttgcccctatccgccaccgtcgttggcctgctgctgtcttgctgtgggcttctgccttttactaccttatcgctgcctctgttttctcacagataagagaagatagaagatagaggaaagaaatggtggtcagagagagaaaggaggggagtgaataagaccaagaataaaatgagagaaaggagggttgttgagcgcaaggcgcacaatatttttcttcctatcggtgtccgaaccaaagcattttcggataaattgacaataaattttgctttagaggtcgtaaacttctgaaggagaaaagaggacgccactacaaattgaatgtacgatcttttttaaaaattgattaatgtttcatcacacgtagagaaatatttcatagttagcccaaaaatatttcacacacatgcaatatctcctaaaattagttgaaataattttctacatgaaacaacaaagataagttgaaacatgaaaaaaatcacaaacatttacacgcccgtaaacatcaatacacattgactgaagcatcaaaatttcaataagataccaatacacgctgctctctcctcttcggtggccaaattttcggctcctttttctgagccgaccactcaacagtgacaagagttggcacctccctcccccgttaacgcagagaggcacaatgccatctagaactcgtgccattgcgactgaggcaaggccacggtgacactaagtgcattggctgctacaacctgcttggtccgcaccaacccatctttgacaagctcccaccccagccactagctgcagtcccttctttgcgacctccgcgcatggcactaggtacatcatggagttcatgggtatgaaggttagaaacggcatgttcgacctaccagacttgagaatcgatcaattacgattcactaactacgaggttgcattgcacgcaatcatgaagtggccaatgacctccctcacctcctacatcgaggcgaaggcagccacacaacggtaatgatagcagtagatagcactgttggtagcacgggataggggagagagaagagggcctacgtagattggagtacctgataaaataaggggcgacatcaggcgaccgaatgcaagcatttttagagaacgtggtttaaatttgctaattaatttactacacatgacaacgttcgccatgtcgtaacaacagtactcgatgccactttgatatctcaaataataatgtagcattcgatctatatattcattttagatcaaacggtataaaatgccaaccaatgcacactattgtgaacccatagaggatcccaatagctgagaagtcgtcatcagtaggtgtgcgtggcggatggatgataacaactgaagatgctgggtttcccttcttgtgtggagtgtagtgcaaaaggaggaaaggggggaaaagtttctgagaaaatttgtttttccggagaaacaaagaacttgccgtttctataaacctccaatctcatcactccctttgtcccttataggaagtcaaataaatgcacatgcttctgtccttatttcagttctttcagtttgatgacgtgccattttttcccccaaaatgatcgtaagaattatcgcgttccagttcttttcccatgcttgacaatctcacatttaaaaccggtacctatctagctctatagtccatgctagaccaaattgacaaattccttccacggtttcatcagcagcatcggctgctgcacacgtgaaaggtagacaaagcacgtgtaggctgcataggatgataggaacatggtacatggatatcggatagcacgctagcatccgtcacttggcttcctacaccctataattaatcgtgtgcactctcctactacatgcacacagaccaaaagcagaggctggttcagcgaacagatcagcacgcaagatgctgccaattcctttcacctacgaccacgagcaagtggatgatccatcaggggtagggtgctggttatccatctgagaactttttgactaaccgatcgagctcttcttctactgtgctggtctcaacgtatcactcatcggcatcatccctccaaatccaaatcttaacgatcccgctcgatcggagagatcggcatcgatgcgggcggcgaatctttgcccccggtctgaaaagctactacttcacaacaataattcagtgaacaggaaagaaggttctgagctcggtttctagatattatcacgcaattcacaacaagtggtgtggggttctcccagctgtagatatctcgctcatctcacccagacatccacgagagagagagtgtgtgtgtgtgtgctcactcgtcacagatgcgagcaagcaccaataattagctcatccttatctcacagaaatttctcatgcttttctccatcgggctgaccagcattgataggtagcagcagggggccagaggccttccctttttatcctcttgccgtccaaaagcggctgcacgatgatgcaccggattagcttagcatccagtctttacctatcgcgctctctctctctctctctctctcacttgctgcatgcgtttggtggtgtggttccctgaaccagtgagagacgttcagatttgggttcaggttcgaaaccggaaaagcgtcgacgaccccaccaccaaatccggagcggcgaggaggacggaactcgccgtggttatcgcgatagccgactagccgaagccgatacgatcatcctaccgggcgcgcgcgggcggggatatgatacgcgtgacgcgcggtcggtcccgggggataatctagtttattgcgcggcgcgcggtggtttttatcctgatctgcacgtatcttccgcttcgacgcgtcggaggagcggaggtcgtcgccgcgccgccgacggttggggcttgatgggccaccaccaccccggttgacgacgcgtgcgaacgcgtcgctttcgcgagcgagctagcaagcgcgccatggggtgcttgctggatagatgaggcagtgtggcgcgccgaaaagttggcagtgtgcgtgcgccgctcacacgcgagcgagcgatctcgcggctggcctcgttgtcgccgcgacgtgagcggcgtttgtgtgtcccttggcgctgcggagggacgcggctaagctcgtcgaaaaaaagagatggtccgtcatgggtcagcgtcacacggcgtggggtgcatggttgcgtcgctcgtcgcgatggagactgtgtgggaggtaacgggttgatattcgtacgtgtcgaagattttaggctcgttcggagaggagctctgagccatagagactactacctacggtacagaggattatttttgttctgtgagaggagatgaatggaatctgagaagtttctcattacggcatggggtgtgtttacttcacgctaaaattagaagtttggttgaaattgaaacgatataacagagaagttggaagtttgtatgtaggcccatcacgtcaaaactttcctacacacacaaacttctaacttttctgtcacatcgttccaatttcaaccaaacttcgggtgtgtttagttccaaagtttttttttccagactttcaactttccatcacatcaaacctttcatacacacaacttttcagtcacatcgtctccaatttcaaccaaattctaaactttgggccaatctaaacataaccttcgttccaatttcaaccaaacttctaattttagcatgaactaaacacacccgtagaagagggcaaaaattatatgtgagtgctgaaggtcgaagactgcgacaaatgtgtcgtgtgaacagcatgaacaggtaaccgtgaacgcctcttggttagacggtggaattgcgaacactactacagataagtaggcgtagtttagttttgatgactgtcactacgtatagataagtaggcgtcaattggtacacagtataaaatactatgaagtttatgaatttaattttattcttcgtcagtttatgtatgtattgttgagaatatagacatataatgatttaatatattttataaataaatcatgatattatagatgtatactagcattaatgtatcattagatctacacatgtaaactaagcagtaaaacatgaatagatgaaatatacgcaacatgtcgaacacgtaccgaggtggcggaaagaccggttgctcggcaggaactactcgcggttgcgagcgtcgacgaaggcgcgcagcacgcgagcggagaggaaggcgagccgtcgcggatgaacagggagcagtcgcgcgaagcgcttcccaaaaaccttattgccgccttctcccggtgcaggacgtcgaaggcagaggttccgtaaacctgctctcccgatcgcaggtgcacgccgcgagcgggatggagtagtctacgagcgacggcgcaacacagagaaagaggcaaaccctagattgatttcgtgtgttttgcgtgaagggggcgcctcggtttatatagagataggtcgcttgatcagtgtgcccgcacgatctccactccgcgtaaccgaaccggataagtcacgcgtaacttatccggactccacgccattttttcacacaccggatttttcggaatgtttccaaaacaaaacaaatccgaattttcctgcagcaaaataaaactacaaaaggaggctgcatctgcgcaagggtgaggagccaattttgcggaccattcgacgcgtgcgtcgtgcacgcgcgccgcctgccctgccctgccaggccaggcgaggcgagcgagcgtgcgcgtgtgttccccctcttctctccaccacacatgtttcaagtggctaggagggcatcctcccttttaaggaggccccctctcctagaataagtaaggtggtactaaacttcacatgcatgccataccatgaggtgggcttttgtgattttccaaagaattaattttcgaatgggccttagcccatctattaattccaacaatcccccaccaaatctcaaaatcccactgagatttgctttttccaatgtacttttatataccacggttcgatggagaccgatcaaggttgaacatccgcctagaactctaagctacacttactcacaacttgaacaatggactacgccttgaattgcaagtcttgtgcaagcaagtttcattcagagtcttatctggtactagaccgtctgtagactacccctcgggtggagcgtataagtcatactcctaggtctttagtaagattcctagaagattcacccaaaatcttcatagactgcgaccaacagtcaagcttacaaaggtgagttctttcaagaatgctctgcaggatagcatcttcgctaattaaagtcaacagaactcattaaggcatagccaacctgccttgcagctcacgagagtacatgcatcttcacttagagagggtatagattggtactctcctctagtttactaatggtttgttcttcccaggttctaattcacgggatctccaatcacatagactgggttaccaccatagtatactcacataggtctcaaacccatctccttcgatgcattatctatcacatttcgtgaaagtcccttcgtgaaaggatctgccaggtttctagctgtttggatgtaatccaatgttataactccggagtttatcgatttcctgacagacttcaatcgtcttttcacatgtctagacgatttcatattatccttagaactattcactttggcaattaccgtttgattgtcacagttcataaggatagccggcaccggtttttcaacaataggcagatccattaatagatcacgcagccattctgcctcaacagtagcagtatctagtgccatcagttctgcttccatggttgacctcgtcaaaatagtctgtttgcaagacctccacgaaacagcagcaccacctagtgtgaagacatatccactagtggctttgatctcatccacatcagagatccagttaaaatcactatatccctccagtaccgcagaatacccagaatagtgaagccccaattccatagtacctttcagatagcgcattactcgctcaagcgcacgctagtgatcatctcccggattagaggtaaaccagctcaacttgctcacaacaaaggagatatcaggcctagttgcactagccagttacatcagcgagccaatgatttgggagtattccagttgattcctagtaattctcttgttcttgcgaagcaacaagctaggatcataaggtgttggagaaggcttactatcaatgtagccaaagcgattcaagatcttctccacataatgggactgcaagagtgtaatcacattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcacagaataactccctcaccccaccatggcgatagtacacacatttatctgcctcattgactgtaaagcctgcagatgtcaatgttttgtcaaatttctcatgcctttgcttaggaacttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattatggtcaatctagcaacaggtgagtaagtgtcaaagaaatcttcgccttctttctgagtatagcccttagcgacaagccgagccttgtacttttcaatagtaccgtcaggcctgagcttcttcttgaacacccacttgcaccccacaggcttacacccatagggtcgctctgtcacctcccaagtcccgttagcgataatggaattcatttcactacggacagcctccttccagtagtctgcatcaggagatgcgtatgcttctgaaattgacttaggagtttcatccacgaggtacacagtgaaatcatcaccaaaagacttagtcgtcctttgtcttttgctcctttgaggagcttcactgtcatcctcctcagtaacatgttcatgtgtatattcagtttgttctggtggtgtgattgaactgggaattatttcagagggttggctagaactactatgtgtatcattcattgggaaaaagctctcaaagaaggtaggatcacgagactccataattgtaccaacatgcatgtcaggtacctcagatttaactattaaaaatctatcggcaatgctgtggtgagcatatcccagaaagacatagtccatagtctttggtctaagtttgcgcttcttcgttattggtacattgactttcgccaagcacccccatgtgcgcaagtaagaaagtgatgattttctccctatccatatctcatatggtgttttgtccttatttctgttaggaactctgtttaacacatgattcgaggtcaacaatgcctccccccaccatgccttaggtaatcccgcggtgtccaacatggcattcaccaagttggtcagtgtgcggttcttcctttcagcaatcccattagactcgggcgaatagggaggcgcactctcatgtataatgccatgttcctcacagaataagtcaaactcgtttgagaaaaactctccaccacgatcagacctaagtctttttatctttctatcaagttgattttcaacttctgccttataaattttaaaatagtctagagcctcgtctttcattttcaacaagtacacatagcaaaatctagtagcatcatcaatcaacgtcatgaaatatcgttttccacccttcgtcaacaccccaatcatttcacagagatctgagtgtaggaattctagaggtgccaagtttctctcctcagcagccttgtgaggcttgcgaggttgctttgattgcacacaactatggcacttagaacctttgacaatggaaaacctaggaattaaatacatgctggaaagccgagacatcaagccaaaattaatatgacataaacgtgagtgccatacattagcctcatcatccacactgccacaaatatggttcacagacttattgcagaaatcagaaagggaaaagcggaacaggcctccgcactcataacctttaccaataaaatatccatgtttagacatgactactttattagactcgaaaaccaacttaaatccgtctctagtcagacgggagccactaacaagattcctgtcgatagaagggacatgctgcacgttcttcagctgcacgatctttcccaagtaaactttagatctaccgtgccaacaccatgaacagaagcatgtgacccattccccattaggacggtggaaccccgtgtgacctgataagaagaaaacaatgagatgtcagcacaaacatgtacattggcccctgtatcaacccaccaattagtagactgattaactgaaaaaacagtaggtaaattaccatacccgcttccatctccagtgttgccaatggtcacattagcagacttagaggtctgccctgcaagtgccttcatcctcttgcgttgtggacacttcctggccagatggtcaggttgatcacacacaaagcaagtcctctcatcctgattagaattgttgttgttgttcttcttcttgaagttggtggtctgctgagctttgtatttccccttgctcttgttttgggccttgtgcacaacattggctgtggactgcccaccatcgcccttagacgcggcatctttttcctgagctttctcctcaatatcaagagacgctatccacccctcaacggagtattcctgtctcttgtgtttgagtgcagtaccgaaacctctccaagatggaggtagtttcgcaataatgcacccggccagaaatttgtcgggtaagacacacttaaggagttcgagttccttagccatggtttgtatctcatgagcctgttcgactacagaacggttgtcagccatcttgtagttatgaaactactccatgatatacagatcattgctagcatcaatagcaccgaatttagtattcagtgcatcccacaactccttagcgtcggtcatatgcatatacacctcgaccagatgatcgccaagcacgctaagaatgcatcccacaaagagagtagtggcctcatcgaattctttctggtgattagcattaagaacgcccataggcttgccagtactcacaaagaagcatttcatagttgtcagccacagagtgaccctgatctgccatctcttaaagtacacaccggtaaatttatccggcctcagtgcatcggcaaaaccagccatagtaaaatcacagcgcctataataaggtttttggattgttgagaatatagacatataatgatttaatatattcaataaataaatcatgacattacagatgtatactagcataaacgcatcattagatctacacatgtaaactaagcagtaaaatatgaacagatcaaatatgcgcaacatgtcgaacacgtaccgaggtggtggaaagaccgtttgctcggcaggaactactcgcggttgcgagcgtcgacgaaggcgcgcagcacgcgagcgaagaggaaggcgagccgtcgcggacgaacagggagcagtcgcgtggagcgcttcccaaaaaccttattgccgtcttctcccggtgcaggacgtcgaaggcagaggttccggagacctgctctcccgatcgcaggtgcacgccggcgagcgggatggagtagtctacgagcgacagcgcagcacagaggaggaggcaaaccctagattgatttcgtgtgttttgcgtgaaggcggcgcctcggtttatatagagataggacgcttgatcaaggcgcccgcacgatctccactccgcgtaaccgaaccggataagtcgcgcgtaacttatccggactccacaccgttttcacgtaccggatttttcggaatgtttccaaaacaaaacaaatccgaattttccagcagcaaaacaaaactgcaaaaggaggctgcatctgcgcaatggtgaggatccaattttgcggaccattcgacgcgtacgtcgtgcacgcacgccgcctgccaggcgaggcgagcgagcgcgcgtgtgtgttccccctcttctctccaccacacatgcttcaagtggctaggagggcatcctcccttttaaggaggtccccctctcctagaataagcaaggtggtactaaactccagatgcatgccatcccatgaggtgggcttttgtgatcagcattaagaacgcccatagcaacagatacaattcgatgacgcgcaataatggcggcggcgacgtcccgccgtgtcgtcaggtcgccggcggcgaccagacgatgtccttgaccaccggccggagctcctcgctacagaccaaccggtactccatggcgtcgccgccatccttcttgacgtccaccacgagcaacgatggcgccacgctgaagacgtcggccgccacggcgagccgcaccccgcgcgcaccgctcctcgtcacgcgcgtgggcgtggcgccgcccgtagcaagcgcctccagccgcgcgaccacgccgcttgccgcctcccgcgtcgcgaacctgtggttcatccttgtcgtcgccggcattgccatgcgtgtccaccggcgtcggcacggggtcggcgctggggcgcgggacgggcgccgtcttccggatccacggtgtctcgagaaggccgaggacggtgatgcgggttcccgggttggggtcgagcagcatcttgatgagcttccgctgtagcgtccgctgccggacctccccgaacctgccttcacgcggaccggcggcgctccgattggggggcagcgccgaccacgcccgccgccgccgtcggaactcgcctgctccgccgcccacccgcgccgtcctctgcccgggaaggagagagagaggggaaagggaagaatagagagaagggagagggaagaagagaggagtgaggctgacatatggggcccacgtgggccccaccattttaaatttttttttgtgcagctgacatgtggggtcacgctttttattatttttccgagatataattgccatgtaagcgtcacgtcaatgccacatgggacgaagacctagtcaaacaagccacgtaggcgccacgtcagctaaaccgcctttgtaggatcaaggaggccgactagagggggggtgaataggcggttttaaaacttaatggcacttaaacaaaactaacctaagttgctaggcaaggtaaggtgtaaggttaactaagcaactaagttaagttttgcaaacctagatgatatgggctcaaatatgtctctatgaatgtaaatagcacaaatgtaaatgcaacaaataaatgaggcaagagacaaggaatttttcaccgaggttcagaaactcgccggtttcctaatccccgttgaggcgagcccaactccaccgctcaaccacgaagccaccgcacgcccccttcatcaaggggtgggcaaggcgggagccggcccacggagaggactacccaagcctcgatcactcggggtagttcttccttcactctgaaggtggtgaactccaaaccactcacaaacggcgccgggcctcctccacaatctcctcggagaggtcaccgggcaacacctacacaagccgtctaggaggcggcaacctccaagagtaacaagtctaggatgcttgccgagaatgatcaagtgtcacactagctaaaaaaatgaagcaatgcagttggattggcttaactcactctctaacacctcactagataaactgtcgcgaccgagaaaattgccttttcccgaacgctagtgtattaatccccgtcccaggaaaagccggggtacaccacacaaacatgatacaaaaggcacatctttattatatcgagaatatttacattattacagaggcgcttcaggcctggcaatcaaaaataaacagcagcggactagcgggcctacggctccatcttcacaggcgctcaactggggaataagccaggactccacctaagacatcttctccaaagcttctcttactgaatgggggaaaagattgagcaagaatgagtacaaccacagtactcagcaagccacaccggagatgcgtaattaatgcaagggagtacaaggggataataatataggggttaagttttgcagtaaacagcatttaaaagtcacttagttgcccaaagccattttaaaaagacgatcctagagctacacagtattattaatcagggtcgtgaacccacacgagcctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacagattttaggggctttgaaagaggaagagaggggtatgtccaattccaccataagccaaccattccatagtgtccaaatgatatgagaattcccaaagtctaaagttataaaaccacctaatgttgcctaattaaccagcgaagcatctacctaaattcataccagtggaaccatgaatagagtacccactagttggggttttattttcctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcaacttccatgaagagaggatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattccgagttcaaatggccaagttatggccatttgaaatttatatgct

SEQ ID NO: 69853 - DNA, 2299 bp, Oryza sativa
tacacgttcaagccattttataaaatttgtggatcaaattgccatttttcatccttcattcccacacgtctctctctcatctcttccatccacagctggcctcaaatccatgcgcctcctcgcggcagcggggatagcttgggcaccagcagggagagcggacatacagcaaaaatgcgaaaatgattgaaacaatggacaccaaatcggccaaaaaagtgaaacctagagaaactgatggggaaagaatatttccgctttgtaatttggatggatgcagaaggaaatatccaatcgtgttagcttgctcatgaacagatcagcagagcgcccgttcgtctgagagccatcgatccaaacatacaaagcacccgatacttgatacttctcactgaatcaaactagaaaataaaacagaacaaaagaacaacaatccaggaaaaaaagtgatatttttagggagatatgctgccacattgggttgacactcaaatttagcatttgtttggatttatagcaaattctcattagatttggaaactaccgagtctttcccgtgaaagcggtcggtccgccattgtgtggccagttagacctcatgtgtccaggcggtcagaccttcagcacaaagttcaaatccaatctagatatttcttgtattttcttgtttgatacaggatttctttaagttctaggtgatttctaagcttaattgtacttggaaacaaccctatgctaagggccgaccattttgcattaacactgctgcaattacaaatccactagcatcagcctccaatacaaaaggttgtgagaaatcagacatggccaagactggggattgggccaattgaagtttgatttgctcaaaggcagcctgctgttatgaaccccaattaaattgttcttcttaagagcatcaaagagtgggcggcaaataactccaaaattcttaataaatctgatcctgtagtagtccgcaagacctaaaaatcctttgagcagtgtgacattagcaggaactggctgtcatgacccaaaaaattgtattttttttacagtctgccgtatccttatatagcatatatactaaatacttatatatatgtccataaggatacaaggcaagatgtaatgtctaactatcacaactgaagcttggacacctacagtaatggttccatttatttttcaccagctacatttcttaatacatcggttggtttactgaccaacttattatcaccaggacgattccctgtacctagcatgcaggtatatgtcctcttgtatgactctaaagactaagtagaccacactccccactaggtctgcatgtcaccatttccctctgacatctcatcttgactagtttctgcgcacatcaaatagtaagaatatatgagtatgttgtacatactcagcaagattagtacatatatctacatatatatttttaaagaaaaatactactacccatagatattaacagccgataaatagtaaaagacactaaacatagtgagttaaatacattctgcagaggtattaaaataaccgtcacaatctcgttccttcaatccattttttccgcaagtagtgataccctcgtctgagatcacgccgccaaattccctacttgtgtgaggcatttctcatctcacactgatatcagccgacccgatatcgttgtttcaggtatcgactgtctcaggctaagtatcagtgtgtcacaatcacgttattattctcactgataaaatcatcaatccattattcgggtgaataatatttactgttagattgttagcatcaccatctcaatataatacaggtaagcaaatttagttagagatgattaagtaaaatagttgatgggcgcagtcttgcctagtttctgccgttctaccagcgcgtcccacctagtcaaatatgcaaatctttgatattaattaatatctagattttcatgcatgataactactaacatactactaggtagctagttgatgtgactatactaaagaaagagaacctaacatgtagtagcaggtgcttgcatgttagtcgagcatgcatgtaactgctgctagccattaaaagtactagtcttttcactaatatatatattttcttctagtgcatttactagacactgatccacctattctatggctagacatcatgtgtttatactacctatagaactagccatatactcgtaaaaaaccaaagcacaggttccaggcattacctagaaggcttctactagctctaatctcccatggccctcgccaca

SEQ ID NO: 69854 - DNA, 1720 bp, Oryza sativa
tgacagataggtcatataacacaaacaatcgaatactatctgatgctgccgccagcactatcatgctcaaactaaagatagataatgcttacagagactttttaaaataaagttgctgctatagtataccttgtttgacaaaaggagagccctctgcaaagtacttagtaatagagtgaacctgccagtagattatagtcagtacacaacttcacatgtatttcgtcatgtataaattataaacaatatccaaataatacataccttgccaccaatcacctctggtagccagggagccatctggattctgctcctgctccttttgctggattggacatacaaagagaacataaaagtgtcagtgatacaagcaaccagaagctgataattaagagtgtcaatttctacgcacatttcctggtgatgcatcaccctgctttggtggagtgttgccataaaactcccgagcaccgtaatgcacagaagagccaaaatatggcgactccgatgactcgtttggatatgattgtttaccatccttgtatgcaccacgagctttagtagggctgtgcgatttgccatctgcatgacgaaagattgcagttaagcggctgctgtatcacatagaaatggagaatctcctctccaaatcaagatgatgcattaaacatggttgaaaaatttataagaggtagcaaaattactacaaagatcaatgtgctttgatgttggatcaaatgcaacagcgtgtgtgcgactgtgcgtgcatgatcgttgacgttagacataacctgaaatcctaaatccatttctcaggacaactaatgacatgaaagatgattatcctactctgttcacaagtttagccgcaattaaatactagtgtcaaataaaaaggatatcacacaaactacctgcaaagccaccgccattctgccctttggagttctgcttgttcagcatcgcgtacaggtccgcctgcttcgcgtctttcgtatttgcctttcatgtaaaaacaagggcagcaacatcagagggatacccaaataagatttcctagaaaccaagaactcatccaacacaaatgaacccgcccgaaacaattcccgaattcccgaattcagaacaacaaaaaatccaccaaaggaggagccaacctctcgcgcgacaatcgcataacagaaacagagaacaatccttaaaaatctcacgaatcgaaccaactacgagtctacgagggcgcgagaggagagagacgcggtataccgtgggcgacgcggagaagacggtgctgaagtacccgttcgccgccgccggcgcggccccggcggcggtggagggcggcgatttcttcctggagtccatacacgtcggtggtttgggtttcttggcgctcgaggagaggagaggagaggagagatgaacctagacttccgtggaaggagaagaagaagaggaggacgagctcgtgagcgaggaggcggagaaagatagggcacgtgaagtggtcgttataggcggcggcgcggctcggggtcggaggtgggaagcgacacttctctgctcgcctcgtggcgccctgctccggcctccatctgtgcccgcggccccctccttataaagggctcgagtcgaggaggggcgggcgaaccccctgttctgaattctgatgtttgtattccgtagatctgcaggggctgaattgccaaagtgcgatcga

SEQ ID NO: 69855 - DNA, 20069 bp, Oryza sativa
cagttttattaatagaataaatgttacatggataactgatattagatgctgccggcaactttctgactcataagtcgtgctgttgtagatattacacatccaactcctgatcttactggttatatcactgagggacagatctacattgacaggcaactacataatcgacaggtattccacatttccacagtttcctgctaaactttgtttgatgacttctaaaccgaaaatttggattcctgattacgacaaaagaataagataagacttaattagctatttatagtaaaagcataaatagttggcatataaaaagttctctctgatcttattgctgatttcaatttggcagatctatccaccgattaatgtccttccttcactctcccggctcatgaaggtaaggtttttggcaataaagaaagctgccgcactctacatcctactttagagttttgcagggactgacatcgtcaatataaggttgataatttgcttataacttgaccggatctcttgcagagtgctattggtgaaggcatgactcgcagggatcattctgatgtctcgaaccaggtcggttgggcgttcatagcctatgttctgcacaaactaccttaaccaagtatatatatggagtatttactcggatgtgtttgtttcagctgtatgccaattacgccataggcaaggacgtacaggcgatgaaggcagtggttggagaggaagcgctgtcatcagaggacctggtaaccctcatgcatgacctgacattgttattcttaaactccttaattattttaagttttaacctcctaatcaactgatctatgaaaaaaatgacagctgtacctcgagtttcttgacaagttcgagcggaagttcgtgacacaaggagcatatgacacacgcaacatcttccagtcgcttgacctcgcctggtcactactgcgcatctttccccgagagctgcttcaccgtataccagcgaaaacccttgaccagtattatagccgtgatgcctcccactgatctgcaaagggtcgtgtgtaataagaaaaaaaaccatcccggactcccacttcttctctttcatttttgccaccaatgcattcattattttttgtgtaaaaaacacgaattatctagtgatgtgggcttccatcattgttgtcccaagcacaccatgtatcatatttatcttcttttttggaagaaaatgtattattttcttgccgtggaaaaatgaataagtgaggacgagtgagctagggatttggttaatgtaagaacacaatgaaataagccatttgcctcatggttttcgcctgtcaattgagtttcagaccctcttggcttcgtgtctttgtgcacagagatgtttgtgatttagcccgttaagatccatccatgtgaactttgtttcatgttcgcccagctaaaaagatgagtaaatttaagaaaactacaactatagcataaaaacgatctacaatgataacatggaaatttttcacaatactgcatgggaaattattacaaaactacaacttttatgtcatatgttgctacaaaacatctaggtgacaacaataagtttgggctatgtaaaagttacagttttatgaaaatttcctattatattattgtagcaaactgaaataggtcgctaatgttgcagtaaactagtagttttgtcaatgtaaatgcggttttctgaaatttactcaaaaagaaagatcttcgtgtatgaactgtggcgctctatttgccccgaataattccaaacagggactctgtaaggactaagatttgccatgtgcatgctcaatgtttaagttgcagtgtagtcttactacatgttccacaatgcttgatgatcatacagactttaaggtggaccccatatgttgatagaaaaaaatatttaatcatttgtttatattataatttagtatatagaagtataaattaagattgtagattctttaatctctactattataaaaattgaagatgtttttgccggtgttttgatacgtcatccgtgtatgagtcggtttttaagttcgtttgtttttgtaaatacatatccgtatttgagtcggtttttaagatcgttcacttttggtaatacaaaaagaatcatataagaaatctgtttaaaaaaaactcacatgctaacttgagacgatcggactcctaactgcagctcatgattttatatatatatatatatatatatatatatatatatatatatatatatatccaagcgaactcccacagtgaatttcattttaactaaaccatacaacaataataagattaaaatagacttcacccgttgcaacgcacgggcattttttctagtgataaaaaagtcattaaaataaaatgatatttatgtatttttttaatatctgatattataaaaattgaagatgtttccgcgatctgtcatccgtgtttgagtcggttataaaaattgaaggtgttttcgtggttcgttatatgtgtttgagtcagttttaattttatgttttggttttaatctatatctcttctcttctatatctctatctcttctctactattataaaaattgaagttgtttttgtcgtattttggtacgtcatctgtgtataagtcagtttttaagtttgcttgcttttgaaaatagaaaaggaagcttacaataattctgcaagcatacggcatactgctccgcgtggaacaaatgaaggaaacacacacacaacagaacataagcaagaacaagcaaatcatgggcgaatcacacatacttacgatggagtttgcacacacacaagctagcagtaccaggaatcagtgacaaatggatggaaagatggagaagaatgcagacttcttattagctttgttccttcccttcttttgcttcggtacgtcatccatgtatgagtcggttttcaagtttgtttgtttttgaaaatatatatctgtatttgagtagggtttttaagatcgttcacttttggtaatacagaaagaattatataagaaatctgtttaaaaaaaactcgcatgctaacttgagataattggactgcagcttataattttctaaaaatatatatatccaaacaaactcccgcagtgacttcacccgttgcaatgcacgagtatttttttctagtaagataaatggttaaaccttatatgtgaaaccagagaaaatatatggcaccaacctataaatcctaagtcgtcaagtattggttaaaatagaggtcccaagtcgtctaaaggtcagcaaaaatatgggcaaggaggttgtagtttctaatgaagtcgattttgaacatcgttcttaagtcttacttacgaacgagataccttatttatattttgtttcatctttcttatagtattttggtatatgtagcctacgacgaatcgacgattctttgcttaaaaacagctttgccgaaccaaagcagtaaagcacaaactatgttttcgactctgcttcttttattattactttttattttattttttttaaaaaaagaaactccgttccttctaaacccatcgagactttgatattttcctccgctagctttccgcccttcgcccccttcccccgccgcaagaataatcgggaggagaaacccaaacccccctcctcctcggcggcggcggcgggcggcggcgcgagcacatggcggccacctccatcgtgcgatcgaagcgcaggctcgccctgccctacctccaccgcctcctccactccggccccgcgaccccttcccccaaccgcttcctccgccacgcctcgccggtgccccgcgaccccgaccactcccccttcctccgcctccccgacgcgcgcgtctccacgctccccacgggcctccgcatcgtcacgcaggcctacccggccgccacgcggatggcctccgtcggcgtctgggtcgacgccggcagccggttcgagctgcccggcaccaacggcacggcgcacttcctcgagcacatggccttcaagggcaccacgcgccggcccaccgcgaacgcgctcgaggtggagatcgagaacatgggcgcgcgcctcaacgcctacacctcccgcgagcagaccacctacttcgccgatgtgcaggggcgggacgtgcccatcgcgctcgacgtcctaagcgatatcctccagtacccgtgcttccccgcgaatgccctccagcgcgagcgcggcgtcatcctccgcgagatggaggaggtgagctgtcgcacccttttgctgctttgtccccttccttgccgtctaatgcaattccttaatttaatagtcgatgtgaaacttgatatccttgtcgcacgagtgtagaacacccttatttgtaggtggcaaatgtttttcttctgcatttttggtattgttctcggctattgcagcaaaggaagtgcatttggtttggatagtgaccgtaactctcaggttgcacgttatgggtatggatgattgtatatttcactatttcagcattgttttacagtgtacatgtagaggctggtgtctttaggcacaatggatttttttttccttaaagaaaatatgtttcctgctctgatagtgtgatggttggtattgtttatattagccttgtggtgttggccaagatgataagtatgcttgaacactgattgtctgaatgtagcggttcctagtttttaaataacttcctgaatgcatactgtggtttagtgcaattagcttatcaaatccatgctcgatcccgtgcaattagcttatcagatctaatatacaatatatatattgtgtttcgtggatgcttgatctgtgcttacatgtgtttatggttagacaggtgcaaggaatgatggacgaggtgatatttgatcacttgcatgccgcagcattccaaggtcatccgctgggtgacacaatattaggtcctgtagagaatattaaatcgatctctaagaaagatttggagcaatacattacaactcactatacctgtcctcgaatggtacttgtcagccagttctgaaatttacaggcattgatttgttatcaccgagcattctagtgctgaatgttttattttgcctggttggtttaggttgtgtctgctgctggagctgtcaatcatgatgaggttgttgatcaagtgagagaattttttacaggattctctactgacccaactactgtagatcaacttgttgaagcaaatccagctatttttactggatctgaggtccattttcagctgtcaagatgttattagtcatttttagcctttttggattgattttatcttttggacttattccctacttttctatatcatccttaggtccgtgtggagcaaccagagatgcctctaacgcactttgcaattgctttcaagggttcatcatgggctaaccctagctcaattcctcttatggtgatccaaagcatattgggaacttggaataggagcattggggttgggaactgctcagggtgagatgatttgcattgattgattatgcttagttgaccaacaattttcttgccttgttgtgttgttgctaatctgctgcataaggctcatatgatctattggaactgcaaggtctgctttagctcgtggtatcagcaacggtaatttagctgagagcatgattgcattcaacactaactaccgagatacaggattgtttggcatctgcactattgctcaggtaaatttggtttatcaatcttttaaattgttcagctagctggaacattaaattagttttagtaaagtatgctacattttccttacttcttgatgccaatcagtaataatactagctatgttcactattaatttcacatacattataaaaaaactgaggtatgcattggatcaaaaattcccttttataatgttttcttacattttgtgaaatatgattgcagccggattccctatatgacctatcacagttaataatgcaagaatttagaagacttgcatttgaagtgtcggaaacagaggttgctcgtgctcgtaatcaggttgcttatccatctcaagttgctaattcagagtttttacccattgagtcatttctactgtgaatttgtggtgttagacaacatttttctagaaggcaaatcagacagtagattctcctacattattagtaggcaaaattttgcctttttaatattcctaggctctttcctttttgttttgtcaataactcatcttcattttcactagacaataccatgatatctgctatgctcatgttgctctgatgtaggacaatagcaagaaagttgatttcaacctgatgatcagtcgttgtaacttcactagacctgtttcactttcccttaaatgacactgatagtttgtggttagttttatatttatatgtatgatatgtctttatgcagtaccagtaatcattaagtacgaactctgcatagtttcatggctgatacatgtttttttataatatatgccaattaacttgcatctagaaatatttgttatactaattgtgaagtggtgaattatttcctacattttagcaccaacctaaaagtcagttctggtgccttggtagcttttctgttttatctttcttggcctgcctgtaagctatgtattgtatctgttaaggagaactgcattcagtgaagtggatggataacagctaacatttatttaatttcagttgaaatctgctcttttacttcacattgacggatccactgctgtttctgaaaataacggccgtcaggtatggtgaatgaaatattttcttaagtgcccatgttgcagttgctactatttttcctaactatgtatattccctcgaccatctggatcagatgctaacgtatgggcgagtaatgccattcttagagctttttgctcgcattgatgctgttgaccgtgatacagtaatggaaacagctaaggatttcataattgacaaggtaaaactcggcatcttcctagtaataatctggagtgcatctttgctattgctgtctcaacaagctatacggaagattcatgcactcacatgacttgtttgacaatcttcaggatatcgccctagctgcagtgggaccgctcacgaatttgccggagcttagttggtttcgctcacatacatactcggatgatgaatttagttcaagaacgttcttgcaggatgcacagaataattgaagctccggtcctggtagtgttgttgtagtaactcaagctcacccaagaaatattcgatcgtaggaagcatcaagcattttagttatttgttagatgttctctatttatttgcaaataactcccttcgttcggattgtaaactccttccgttcaccttttactttcttagcatacaattgcgtcaaaattctaaatataaaaaagaaaagaaacttgacataaccaaaaggccagacaaaagaggtacagctgaacacaacacatttaagtacacctgcagtgttaactaaaaaatgttctgttctctctcgacctaaaataaaccaattttatataaatatgttgagattcatttatagtttattttagaatagagagtagcatttattttgttgattggtttattttagaataaaaggagtagcaatgtggcattcatttttgctgatgtggacgagagagagagagagagagaagagagaagagagaagagattgaaaaaaaaattacgctgttggttgtttaatatctattcttgaaacctaaattgcaacttcgtttttccacatcattagaaaaatatggatcataggaggcaacaaaacatataatacctgccgttagatataaagaaggcagtaaaactataaaggagtggtcaaagttgattcttccacatatcctcttggatatttactgggccatcgttgtctgaaagccctaacccacatattcgttttccaactaaaaacgtattttagcgctaaattaaagtacgatataacaaatattacacacaacaatgccgcacattgtgaaaatacatgtattctagtgacttgagtagcacctgaagatcttgagttcaaacctttataggaagttcaaatcttcaaaggagtgaatttcatattgggttgttccatgagctaagttcctacattgtagagaccgggttaggaatgcataagggtaacttacgcaattgcaatgtaataacttatacttcctccatacttataaaggaagttgtttaggacaatgtttaagtcaaactttgggaatataaatcatgaataactcttaaattgttgagtttgaatatgtaaaaattatatgaatagatttgtcttgaaaaatactttcataaaagtacacatatatcacttctcaataaataattttatagaaacaagaagtcaaagttgtgttttggagaccgtgtcgctgcccaaaacgacttcctttatgagtacggagggagtacaaaactttcacataattataaaaaatgcataagggtacatgtgattagtgaggcatgtgaatgggacgtcgggggttcaattcccatgcgcgcacggtaaattttactcctcccgcacttcctcttgacaaatatttagcaactatataaatttaattggtttttttactttaaaatgtgaatgaaaagtttgcattaaattaccttaagtgatttttttgtcataataatattgtttattacatatcaaaataaatatacttttggaaaagtgccggtattgtggtggtgggatgcatgactccagttactactactaatcaaatcttggtaccatgaccatgaatattacacacatatggatacgagtacactttgaattgaaaccacctctttaagtgtatcttaagggtgtgtgaatatagagcagtgatatgtgctcacacgtgtttttcatgtaataataaagagaatagatttttcattctatctagacttcctgctgattttattttctaccattgactttccgtctttccttagccatgttctttgtttacattgttattttttattataaattttgtctaataattattatataggtaaacatttatatatttaataaagtgatattctatccataaaaaaatgtcaaccgcgtactatgtccagattcgttgtactatgttacctttttttaagaacggagcgagtagtcatagtcgcgtgaaatgcatgatataatgtactagtattgtatattgaatattaagctatttctctctctacaggtttatgggaatggtatctgtctaagggcccctttgaatcgtagaatgaaaaaaacggaggaataggaaaaacataggattctaataggaatgtaaatgtaaaacagatgattgcaaaacataggaatgatcgtttgattggaccacaggaaaaacacaggaatcggatgagagagatatactcaaagaatttttaccaagaggttggacctctcgctaagtttcctttaaaacctatatgcaacaagccattccataggaattttgtaggatttgaaaaactcaaatcctttaaatcaaagggctacatagtaaaatttcctgtagcatttcaatcctatgaaattcctttataattcctttgactgaagggcccttaatatttgtgcatgccctgaaggctgaagctgctgctcactgcaggaagccaggaaggcccccagctgaaggccagaccaatgagaccagtgagccaacatatggtgacagaaaaaaattactccttttccccaagtaaattaaatatacatggggcagaggcgcagagccatgcagcagcagcatcgcccggccgcccggccatgttctgctcgctcgttcagactgacgctcggataagcaaaacaagcaccgatcacccacacccatctcccggccatttctgctcgctctctcagatactacacgcaaaacaagcaccaataacccagtaggaaacagggtttacgttactgtctcgcgtcgtttctacggttaccagcttactacgggtacgataatataaatactacggtaacctccttaaattcaaataaattaaaaaaataatttaaatttttaataaattttatacggtttttcatggttaccgcggttaacacgtggtaaccgtacttaccgtcgggacgcggtaaccccggtcccggcggtttgggaaacctgactaggaaacgctgaagaattaggtttgcttcgttgctgcaattaatggcagaaaagacacgagcgctaccggctttaagcagaaccatccgtacgcgactccggtgaaggaaactgtgaatgcgtgaaatcctttggctcccgtgaaaaccaagcacgggccggtgcgcacgggtgcgcaaatgggctcacgccgcacgcgacgcgctccgtctcctctcccctctcccgcagtctcttccccacgcagccacgcgcgcgcccattaatcgctcacgcacttgcacgttgcaccatcaactcctctgctcccagcttccttgctggatacacgaacaaagtcccgtttgcttctgggtagaacacaacaatggcgctgcgttcttctgctgcatactactacatgaactaatttgcttctcccttacgttccgtttgcatcatctgccttgcacacacgcacgcactacaaaatggcgttgcgcgtgctcttcttgatgctgtcggcgttccccgcgagctgcctcgccgtcgctgctccgatcagtcccgacgccgtgccattgctcgccttcaagtcggcgtgcgccgaccctgccgccgcgctcgtctcctggacggaggcctccgacccctgctccgacaggtggcgtggcatcacttgccggaagccttcgccttcgccgccgccgtcgtcacctcctcgcgtccgtcgcgttgttctcgaaggcctccgcctcggcggggatgctggagccgtcgccgcgctcgctggcctccctatgctctcgttccttagcctcaagaacaactcgtttacgggctctctcggtgacgtcgacttctccaccttggcgccgcacctcaagctcctctatctctccggcaatggcttctccgggcggtttccggagtccgtgctacggcttcgccatctgcgccgtctcgacctctctggcaatcggcttacctgcacgattccgccggagataggacaccggctcccttctctcctgacgctgcatcttgcgcgcaactcgctcgtcgggcccttgccggcctcgctgggagcaatggccaggcttgccaagctcaacgtctccggtaaccacctccagggccggatccccaagcgcctcgccgccgtcttccccgcgtcttcgttcaccggcaaccccgaactttgcggtgcccctctgcgccgccggtgcaatgagcagctccacatggtgtacggcggcggcggcagcggcgctgacacgtcacaccaaccgaagagagggaggaggaggagcaatgaccggtggatggtggcgatgatcatggcggcggtgggcgcagcagtggcatcgctggtcgccgcggcactctgcggcgtactgtggctgaagaacaagaagccggagaggccgcgcgccagctcacgcaccagctcgatggcgcgggaggagacggtgcgcttcgacggctgctgcgtggagttcgacgtgtgcacgctcatgcggggcgccgcggagatgctgggcaagggcgcgacggcgacgacgtaccgcgtggccatgggaggcgacaacgtcatcgtggacgacgccagcgtcgtcgaggagggcaaggctggcgaggtggtggtggtgaagaggatgcggcggagggaaggcgcgacccgggaggacgagcggcggaagcggaagctcgcgcgggagatgggcacgtggcggcacgccaacgtcgtcagccttcgcgccttctacgcgtcggcagacgagctcctcctcgtcttcgactacgtccccaatggcagcctccacagcctcctccatggtccgtaaccctctctctcctgactcctctcatggcttcttctcatcaatgtctacatgatgacgatggcaacggattctttcagagaaccgaggaccggcgcgtgttccactggagtggcagacgaggctgaagctggcgcaggacgcggcgcaggggctcgcgtacctccacggcgtgtccggcggcaagctcgcccaccggcacctcacctcctccaacatcctcgtcgacgccggcggcaacgcgcgcgtctccgacttcgccctgctgcagctgctcgtcccggccccggcggcggacgaggccgcgcagaagcaggacgtgcacgcgttcggggtcgtcctgcttgagatcctgacggggcggtcgccggaggacggcaacgtggacctggcgctgtgggcgcgcacggtggtgcgcgaggagtggacctcggaggtgttcgacgtggagctgctgccgagcaggggcggcgcggaggacgagatggtggcgctcctccatgtggcgctgctgtgcgtcgccgacgaccccggcgagcggccgaggatggcggtggtggccaagatgatcgaggacatcagggacagggggagcaagaggagcaggtactcggcgtcgccgtcgcaggttggccactcctacgagtcatccccttccatctcggaggacaccactaggtccaccaatgcctcaagctcttgaagctgtggtgacagtttccagctttccttcccaaaaaatccaatggatgttgttaacaagaggtgctgccgtttagatgttagttttctgccatcatgattctgtggcatgtgacatgtcaggtacctgtgatcaatggaaattatcaactccttttgttttctgtccaacgaacgtagacagggccaagtttgtattacaattcaaacatgcagggaataagttccctttaggtccatgaatttgttgccaagtttgaaattcatcctgaactataataacagatataacgtgtccctcaatttacaaaaccggtgtactcgagatcccagacggaataatgtccagtttcagttgatgtggtggctgagttagcagggacccacatgtcaggacaattcaatctattttttaaaaaaaattggtggacctcacatgccagtaacacatcatctccttcttctctcggtttctctccctttttcttggcgggagcagggcgtagacgacgaggcagtaggcactgcatgcagtgcgcgaagacacaaggtgtgggcggcagcgaccggcagtggcacgaaggaggaagtcagcgttagtggtggaggtcgtcatcgcccaatgagcccatggccaccgcgtgcgcgtgcacccgcctacccctccaaaacggccctcttggcggcaacgaggtcaaggacctagccgaagtgctctgtaggagaggcctgccccggtgccgagcgagtggcgagtaggcggaggacctcctgcaagttactttccttgcaatgctaccttagggagggcccgatgttggcaggtgggagcttccaatgagggattggatggaaggggaacaccttgttggctctcaaaggcgagcacccagtcgtggtggaacaacaacatccatcatcggagtgcatccgaccaccaccgacgactgaatctgagcagctggagtcggcccttgttgctcgaggagtcgcgacaaaagagcagcagagagggcatcatcattccgagcatgtgtcacaataaggtcatcatagggaccctcaatgctaggatccccctgcccctccactagaaagggatctctctcgtgatgaaccatgtcagctgcagccgtcatccaaaccgctttaagaccttatttataccggttttggaagtttagaaacatgttatatgtggtattgcggttcagggacaattttaggactcgacgacaaacagagagacctaaagtgaacttgttctattcagccttcttctacggtccatttggccgctccgagtggtgcgtcaaagagagacgattttttttcatttttaatttttttaatatttacaaaaatattatatcggtgaaaatatttgcaaaaatataccctgccacccaagtggagggcagcaaggtgatgtggcacgcgacgctgtttgtgcattttgcacggaggtctctcggtgaaatgcaattttcgccgtatgtaaagttaagccctccgtgaccggcgaagaaaagttgtccgttgaatacttgaatgccttcggcgaaatggtcacctacgtctcgctcccactcccagactcgagtagtctggatgaactgccaatccgcgcggcgcgtctgtgcattagcgaagacaggagtggcaaactggaagcgcgtgcgcgcgagcgattcgtccagagtatcagtttcaaccccggcccaaaagtttattagctgcgtcgctcagggccatgcgcggcagggctgtgagggagagagacgtgacgagaagcccggatccgcctggcacgttttgggcccgaaatttcccctgcctcacactcgtatgtcagtcacacactcacaccacacacctgccggggtccggtgtgacacaggcgcacgtccagccaggcttatcctcctcacggtggcaaccaaacagcctcagaatccctgcaacgattgtgatttatgaacttgcgttttcatagctcgaccgccttgtaatttgttggccactcgagctcaagttagatcaccaactatggccagttgcatgcgtaaccgtgtagcgagcagatccagcggagaagaagagagaatatatgtctcaagatgctgatcatgttgcaacaaaaatttcagcttaatttcttatgatcggttcgatttgtaatatgtgagtatttttcagttgttcctatatcgatcacttgttcatccagtagctgcagactgcaagttctgatgaactcgatgcatttatgcatgtatgagaatattctgtcccccagcgtggaataggattcactcgcattgatcattaatttgatccacatctttgacgattagaccttactgagtacctgaagatacgtatgtgatagttgagctaatgatatttgacacatggaactcaatagaaaatacttgaacctgaaaattcctttttggcacgataagactccaggaaaatctagccaaatatttgtgtaggttctacagatgctaaacgaagaaaaatcttcccacgaagtatggttaccatacatgttgttttcatctcgtccataattatctggggccaagcactatttttcccccttcctcgtttttattgagaatcatatcactccacttggttagtgcaatcttttcctgttattatgtgattttctttagtttttttgtgtgccatggcttctcgctttgtgacaccactaggtacagtggactgggcaaagttgtttgtttgttccataaataactttgtggaagcacttgatactctcagtcccactgaccatattgtttatttgtttgtttgttccattaacaaatggacatgctatgtgcacaaaccacttgcattgcgtagtacatggtctctgcagatacaaggatggacaacggggagtcggggaccatgaaatgaaactaggttataatgtatatttagttttagttgaaaaaatagttcctcaagtggtgtctagatacatttttaaaaaatacataaaaaaattcataggatatgttcaatatataatatcccatactcactccgtcctaaaaaaaaaaagtgaatctattactggatgtgacatactccctccgtcccaaaaaaagacaaaccctgggtttccgtgtccaactttgactgtccgtcttgtatgaaatttttttataattcgtattttcattgttgttagatgataaaacatgattaatattttatgcgtgacttgtctttttaatttttttcataattttttcaaataagacggacggtcaaacattgggcacggaatccagggtttgtctttttttggaacggagggagtattatagtacaatgaatctggacatacctccgtccagattcgtagtactaggatatgtcacatccagtactgtgttggttttttatgggacggagggagtaggtcataaagcagttgctgcaatgaattaggtatatagtactccctccattccataatataaggtgcatatgcatttgaagattcaacctttaaacatttgaccaacacttagtataatatgaaataaactttatttgttaaaaattatatcattaaattgagatttaaatttacttttatatggttataattgtattgctaaaaaccttatagtatatgagaaattataagctaaagattagttttgaagaccgtgccaattttgaccatgtcttatattataggatagagggagtaagagaagacattagctttagtcccactcaattaggaaccaatgaagcaatgagggaggggggcgagagagagagagaaattatcattatttatttcttaaagccaagttttatgtatatgaatagcttatcatatagactattatatgatcacttttataatgatgaggcatgccatattgagttatatggataactttttatagatattgtggatgcccttatattttaaaatggacgaaatattttatattggaaggaatcacacaactatattacacaacattcctgatgaaaaaggtttaaaaatggaggacttttacggtatattgtactgcaagtatatactagcagtatatagaagggtatgtttggtatttgttaaacaactggaaatggctatttagtcatgtgaagttcaaattaatttatttcaatcggaagtacttgtcatggatcttgtcgtccgtgcatttggtagcgtttgttctggagacatctcgtgtggcgacggctcgatcgatgtctaaattacttatgtttggtgtacatgatcccgatatgtagaaataatggtgctttccggtcataatgcaaggttaattcagtcatgaaaaataactaacggttgatcacttgactgtgggaatatcatctcatcataattactgagatagccataatttttttgccagatatatccagttggttctcagtatctactatgttgattacttcaaaatttctcattcaataattagttcatgacgggatgatttgccagttctaatcctgcatggagagacggcgagttgggcttgcctcctcctactgcctgcccatcctggctgtgtgccttgcccggttgcccctggtatatgctgccgccgcccggatgccctacactgttgctgctgcttcttaggtgcgcgggaatgacagaagagaaggaaaggacaggaaatcgaatcaatcccggcttgcggtggcccggggcgcagcgtgctcacggtggctggcggcggcggcggtagcccatgtggtgaaggaaggggaatggagcggatttctctcgattcgccatttctttcgaacgacaaatcgactggatttctctcgatcgggatctgaccaagtaacaaaaacgcgaaaaatacaaaaatacccccacacagaaagatgaaaagacaaatataccccttttgaatttatattgcaaagctaaccgggtggaatatcagattaatcttcaccgttagatcgtttatactgctagtatatacttgtagtataatgtaccgtaaaattcctcttgaaaatgatccacccaacaattgccacgctagacaattatgagcctactagaaaaaagttactaaacaatgccacaaatcatagctcaaattctacacgaatatgaaaaaaaaatttgaatttggttgtgctttttctagggcacctgcgaggcaagtatttttaggtgagaaacataaaagtacttaagcaaatgccaaacagttactgtgctagctataattgaccaatttccatcctacaatagtaagtgtatcctaatatttagatgcgattcatcccatcagggatggaaaacaattgattctattaatgctttccttcagtggcaatgactttttcgtagaatagcttgcttcttaaaccgcgctattgtggtctggttgaattttgctccttttactttgtagccaagggaggaactcaaacggaaagagaaagatcacctacaagtaaggctggcctgaccatagttgtactaaaaaaaatgcacttctatacgcagtattgccaatcaaatttagcaaagaaaaacggtttttctatgtacgagcaactgagcagccggaaggaggtttggtggaacagcgacacccggcctcccaccccacgggttccgagagattctttggcggtaggtgatcccaaccaacgtcgtccaggccccaccccgcagatccaccaaaccacacacggccgtcgctgactcaccgatgcaccatcgccaaccgtactcagcgaccccgcgcgtcagtgggcggatcggaccgacgagccgcgctgctgggtgcactgtgcagcgcccacccccgcgacccacgtgttcccgtccccgcccatgcttgaatctggttacgttagctagatccctcgctccgtccgcggtcgcggtcgctagcgccgcgctgttttggcgactagttccgtcgtaccgggcgtttgccgctgccacaccgaggtgaggtggagtccccgacccccggtggaacggacgccgcaaaaaatgcgtcctcgcgggcgcgctgccgatttcccctgcgcgcacaaattttctgcggggaaagcgataaggctcccgccgcaccggcgtcgcccgcgcgtcgtgcccgcagctctccctctccctcgagtcaccccctgataccgctcctccccgcatgttcccacggtcgccgcgagcgacgtgctcgattctgtggcggggccttatataccggcaccggctcgcctcctcgtccatccaaacgccatccgcttcctccgcctcccgttgcaaataactgtgtcagcgcccacgtcatcaccggtcggaggggaaaaacatctcccgtgttctccacctcactccacaataacttggcggctgctcgtcaccggagaaagaaagaaaaacgcctgtttttttttcccctctctcacaatgcgccgatatatattagccaaccaaatcactccgtaaccgagcacccaaaccacacagccgctcttctcggcaggagtggaggccctcaccgggggacttccatttcctgctcctcgtgttctcccacctccaatctcaggatggagcgcgcacgccgcctcgccaaccgcgccctgctgcgccgcctcctcgcggcggcggcgtccaccacgtccccggccccgtcccgcggcatctcgaccctggccaaggcgcccggggcggggtcgcgcccgcgcgccccgcgcccggcgccccaccagtacaccacggggcggcccgtgtcggcgtcggcgctgcagccgagcgacacgttcccgcggaggcacaactcggccacgccggcggagcaggcggcgatggcgtcggagtgcgggttcaacaccctcgacgcgctcatcgacgccaccgtcccggccgccatccgcgcgccgacgatgcacttctccgggaagttcgacgccgggtttaccgagtcccagatgattgaccacatgcagcgcctggcggccatgaacaaggcctacaagtccttcatcgggatggggtactacaacacccacgtccccgcggtgatactgcgcaacctcatggagaaccccgcgtggtacacgcagtacacgccgtaccaggcggagatcgcgcagggccgtctcgagtcgctgctcaactaccagaccatggtcgccgacctcaccggcctgcccatgtccaacgcctcgctgcttgacgaggccaccgccgccgccgaggccatggccatgtgcaacggcatcc

SEQ ID NO: 69856 - DNA, 1157 bp, Oryza sativa
cgaacggcgggtaacggccgccgctcgccgcgccctccgcctcgacgacatggagccggcggcggctgcgccagaggcctcggtggcggaggaccgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgtgccctggggcgtgccgccatcgccgtagacgaggcggcgacgcgccccatctcgccgtcctcccccgtcgcccgcggacggcgaagtcgcggatctttcgacctccccgagcgcctccccccgcccaagatttcggcgagaggggaacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttagaaaaacacgcgcgccccctacctggcgcgccagattacggagcgtggggctcctcaccgggagaccgcgcaggcccccctttgccggttcggccgggggcgctaagtgaggttcttcgccctcgatctgaggaacgtcagcgagagaggaaatgcgcaagacacgggcgacgtagacaggttcgggccgctaagaagcgtaataccctactcctgtgttctggtggatctgtgcgtgaaggaatacagagaggccgagagcgaaagagagttcaggctgtagaaacccttcgccagagtccccactccccttctttcctctctctcctttttttctaggcctgggcctcctttttatctggtcaggggtcaccacatgggcctctagctgcctaagaagggaaacatgctttttacaatcagggctagttacagccggaagtgacctctgacaagcagagcacacgcctcctgccctgctcacctgctttcccggtggacgcccatttcaaccttcatttaatggccagcgacttccttgccatacttgcgctgaagcctagaatggatctgaccgggactgacataccaactccaggagttagcacgccagctccggctagggacgagagccaggaag

SEQ ID NO: 69857 - DNA, 1510 bp, Oryza sativa
taatatatttgcctacctatttatcatatgtctctgttaatctagtcttagcatatcaatttagctctatcggctgcttctcgttttagggcttctgccggtatcggctaaatcgatttgctagattatattagcttagacatctaccaccctgaaaactcagtcaatagcttgattgtctattgtctagatattatgtttctcttcatacttagtgctgcatcagttaagtttgatctactaagtggtgcttagaaccataatctctagctgcgtttgactgccaataagggtttcatcggggttttagccgatgaggtatctagacattgcatcggcttataaggattgcatatatatatatatatataagttggatttagctgatgacaacaaatgtttcactgttttatctaatcatttggattttatggcatcggacctccagccgatgtgtgctttaaccttcggataagtgtttattctatcatattattgttagtcgattggtttctactggattatattgctatattatattatcatcagccgattgccttcatatcattatctacattggacatatagccgatttcttacaccctatcgctatcggctggtatcggcatcggctattatcggctatcggctggaactactccatcggcttgttagccgatcggctgttttgatctactatttgcatatcttgtcagttgcaggatcaaactgactggtacgctcgcatctcatcaatctttggacctgcactggagctaagcagatctcccaggccggtgtgttcgattttttcgtcaacacttacgtatgtgcacaatctttaaaattatatttttaaataaaatatattactctacaaagtataaataaactaggtctataataaaaaaataaaatatcaaatcaacatactttaaatgtcactcttttaaattatatattcaatttatgatttggttgtatttgttaaattaaattgtagtgctaaatacatcacgagtcatgataccgacatataataattaatgtcataataattttttaaataatttcacatcatattttatggtgtcaaatattactcgacaaacacagaactctaatttaaatctatgtatgtaaaatgaaaaacataatttagttgtgtttttcagttagatctgattttattttatttttgtgtaaggttaatattctcaaagtttttaatttgtgttatttggtatttgataggtgaggagaatttccatagatgtgaaacattatcaaaaaaaatttccaaccagttatctttctataatacaaccccttaatccatcacgagaattatggtcatacatataggattttttttctttaccaaatattgttttggcaacagatgaacaatctaataagatgcgcattaaagtactattatatgtgtatatatacatatatatatatatatatatatatatatatatatatatatatatgggctgcagga

SEQ ID NO: 69858 - DNA, 1955 bp, Oryza sativa
agaaacaacccaatagcacggacctggtttagcggcaacgatgccacagacatagttgtgctgccatcagcacgccaccgtcgtgcctgtggggccatcggcaagatacgacgctggccgcttgatggttgtggcaaccgctctggcgatgccactctaagcccctggataatctgcaaagatgacagtgccctcagcgcttgttgcgtcggcagtagcggcggtccaggcatcggcgacaccaaatccctaacaaatctggagtcgccgttctccatggacatctctcgctacctacctacctacctacctacctagctatagtgaccaagggcgagatgccaagatctttgttgtagcttgatttgctttgtgggggtgattcaaccctgctatgtgaaggtggtatatatatttgaaaaccagcgaggtgtaacgcacagtttgactactttccatccacaagagacaaaagggagaagctgtagtgatatcacctacttaatatttgccagcaacatattggcatgcatatctagcaaattgaacatttattgctgccaagtatagcactaggggaggttatatgtggtatgcatgcacaactcgtttgacaactacatatgaattcctggtgtttggagcaaagcatctgccaagaagaagccaacacaactgtcatcaatatttattaagctgcaaatgaatggacgcccatatgccacgctgcgtgtcccctcacacatgctcagataaaaatcggacgtcctagacctctagcgcctgctgcatgtggtcccacttaatgtgcttcagttgttgcttgcaatacattttcaatgcactatgttttttttccttcttgagcttcttcccatttaatctagctagaccaaaatttcttgagcttcttcctttcaatctagccagaccaaatgtcacgaccggaaataacccaatagacattccatacgtgagtgtattaatccttgtcccaggaggcaaggtacaccaaagttcaaatcagagttttaacaagcggaagtgtaaatagtacttatattacaagagcgaccaaaggcccaacactcagagataaatgaacaaaagcggaagactagggcaaataccacaggcgcttgacagcaggcatgagctagacaccaaaaccttcatcctccaggaactccttttctggtttggggaaaaatagagcaagattgagtgcaaccacagtactcaacaagtcacaccgataaatgcacaataaatgccaagtgagtacaaaggagtaatcatatgggttatgttttgcagaaaacaatatttaaaacacttagttgcccaaagttattttggtaaacacgatcctagaactacacaatattattaatgaaggccgtgaacccacatgaacctaccttaacccaaggactataacgagttagaccgaactagcaacctaaaccggtcccagctcgtcccaagccaacccaagccaaccattccacattttagttgttaagcaagttttaggaattaaaccactaactttggtacattgctaggcttgctcataactgagggcgcggctattcgaatagattatactctgattaaaggtgcacatctttacccacaagacacaccttcctcatgtgttaccacgtgccacatcaaatactaacaattatttatggcatctttgctgaggaatggatgttgtatcatgttcgaacctgattcgtcctcgtatcttttcttttctcttgttcctttgtcttcttaccaacaatggagcacctttctattcaaaatctttatgctccaagggctgagttctgtgaggcaccattttctacaaaacttatccgttcatctggctatgaactccatcctaacattatagccatagttcgggaacaacccttctcggggcgcgaaagagaaaactc

SEQ ID NO: 69859 - DNA, 1282 bp, Oryza sativa
tcaaacatactttccttctttaccttgctaagagtgtagctggatgggctcaagcattggcttcctttctcctttggttccgggtggaggtcctcacgttggttcgtatcttttagatcattgcgtgcttcaagtgtatctttcgacttcccgtatacacctaggaagcccagcaagttgacgcagaggttcttagtgaggtgcatcacgtctattgcatgccggacgtccaagacttcccaatagggtaactcccaaaaaatagactttttcttccacattgctgcgtgaccatcttcgctggctatgggttggcttccaggtccctttccaaacactactttcagatctttcaccatttcgaacaaggttttaccgtttcgaaatataggcttcttacggtgcttgcctttcttccggacagtgtggttcgtaacaagaaatcgacgatgccccatgtacacaacttttttacaatgtttcagatacgtactttcagtttcatccaaacagtggatgcaagccttgtaccccttgtttgactgtccggataggttgctaagggcaggccaatcgttgatggttacgagcagcagcgctcgtaggttaaattccacctgtttgtcctcatcccacacagggacgccttatttcttccacagcagtttgagatcttcaaccagtggtcttagatacacatcaatatcgttaccaggttgctttgggccttgaataacaatcaacatcatgatgtacttcctcttcatgcatagccaggggggtcgtagatacacatcgtaacaagccaagtgctatggccgctgctcatctctccaaatggatccatgccatccgtacttaaactgaaccttacgtttcgtggatcctttccaaagtctttaaactttctatcgatgtttcaccactgcaacccatcggcggggtgtcttagcatcccgtcttgttgacgttcttctgcgtgccatcgcatcaatcttgcatgctctttgttcctgaacaaacgtctgagccgtggtattatagggaaataccacatcaccttagcaggaattctcttcctcgaaggctgtccgtcaacatcacctggatcgtctcttctaatgttgtatcatagtgcattacagaccgggcatgcttctaggttctcgtactcctcaccgcgatagaggatacaatcgtttggtatcctcaagtcctagagggcagactatattctttgcttcgtatgttgttttgggcaacttgttttcctccgaaagaa

SEQ ID NO: 69860 - DNA, 11832 bp, Oryza sativa
ccagtccggaatgttctcgtcttctacttcatcttcttccattcgaaccccttgctccccgtgcgaggtccaaacattatagctcggcatgaagcccgtctcaaacaagtgaatatgaatagttctaactgtagaatactctctctggtttttgcacttagtgcttggacaacggataaaaccattattctgcttgttagcttctgccactttcagaaaattatgcaagccatcaaaaaactcttttgaccgtcagtccgcgcgcatccattgccgatccatctacatgaaaagcacaaaaatcatgaaaaattaatccacgaaattcaaaccaattaaacaatattaaaaatagcaatatataattattataaaataatacaacaaattattcatgttttcattccccatcattttaaagttgtaaacaaatattaaatttgttttacttaatttaatttaaattaactaagttttccattctttttcatataattttctatctttttctttctcatctcttttatcacaagtttttttttccaaattctaaataatcatatttgattataaaataataccacaaattattcatgttttcattccccatcattttaaagttgtaaacaaatatttaatttgttttacttaatttaatttaaattaactaagtttttcatataattttctatctttttctttttcatttcttttatcacaagtttttttccaaattctaaataataaaatttgattataaaataatacctcaaattattcatgttttcattccccatcattttaaagttgtaaacaaatatttaatttgttttacttaatttaatttaaattaactatgtttttcatataattttctatctttttctttttcatttcttttatcacaagtttttttccaaattctaaataataaaatttgattataaaataataccacaaattattcatgttttcattccccatcattttaaagttgtaaacaaatatttaatttgttttacttaatttaatttaaattaactaagttttctaatctttttcatataattttctatctttctctttctcatctcttttatcacaagtttttttttcccaaattctacataaacaaaatttctatattatttcatccctacacaaactttctctttcatcatctcccattcccaaatttctagaggcaaaatagtatacaaaacatatctctaagtacaaatgcttatcacaaagtagaggaggatgaagttgctaacctttaactccttcaaattttatattttcaccaaaacaaaatcaccaaaaattttggcagcacctcccctcaaactcaacaaatttttgaagccttctcgggctagctggaggaagaagaagactttatatggatggacttttagtcccggtttgtgttaccaaccgggcttaaaaatcgccatgatctttagtcccggttagtaacacaaaccaggactaaagatcaccgggggcctaacacaccctgacaactggcgaaccaggatgaaatcttcccgttgaacctataaaccgggactaaaaattgtttttagtctcggttttttggtgaaccgggacaattgtggtttttcccctacccggcaaagatcacttctccagtagtgaaaggaccacagaaatgttgtaaaatcactggtagcatcatacagtataggagccatttcatttcgatattactccaacaagtctgtcagcaacgccttcgatctctaccatgattcaagacactacaaggtgttactgtttcttggatgtcttctaaatcagtcgtcacccatttgtgatacttttgatgctgttagcttgtatttcctagcacctcccagtcctagatcgatcaacgatcgatactcctgctatagtttgatgagacatgtaggcgtgcatactagcgaaattgatctatatatacgtatctgctagctaggtagaatgtacgaatgagagataattaatgttgctgccatagttgaattgattttacttacttgtttggccgttgggacgatgcattatatatatacacggtgagaacttgtcattggcatcatatttgagcaaaggagaagggaaataacttgtcattggcatcatgtttgagcaaaggagaagggaaataaacatatatgtcgttcattattttattttttttttgcattttaatgtactcaatttcgatcgtataccatctctgttatgataccggttattaactgcatctagtcagcttgagaagcctagctaggaattcagaacagagaattataaggttcttgagtactaagtacaataggtaactacacatgtgcagaacaaaaaaaatgacatataaaggatcagcagagcgcctcatgtttcccctttctattaattctactcaaatgatctattttatcttaatatgaggtgctctgctgatcctttatcaggccaggtcctttgatcaaacgcttgtgttaagaagacgcacggactaatcaggtcgttcaacccaggccttgatctcatagttggcttgtcattctgcaatccgataatctactcaaccatgttagtgttgtttctctgcatgacaaggtgcaactctgctcatgtacacatgatgttatggctcagtagttccctctgcctcccaggcctagctagctacatgcagttttggtatatctaaactgtaatgttcatgcatggctactggacaaatggacatggaggatgctgcttgatatagataaaattcatcgagaaggaaacgaagtagttggtctggtccatccatatgtccacctaaggtaattatagaccactcaagaggattttcgggcaggctcttcatcctgcactgttgtcatgtaaagtactcgttctgaactagctagcaatgcgcgacatattccaacaatttttaggatgcaactttcgaagtcttccactttcagactatcaaactttagcaatacaacaaaaattacattaatagatttatcaaacaccaaacgctttagaaacagtgttttttctttttactgtgatgatggttcattcagcattgaattaagcatccgaggaaaataaacttatgaagataaatagagcaatgtgcagatctatgttccggttaatgctaatctagtcaaataacatgaaattaatcaattctaagtgaaatgtcttacttgactagtctttgatatcagtcattgctgctcgccccaagctattcaacctagactttcagttagatcgagtcattgatctcatcaacttccacatcaaagctttgttcatgatgaacatcgagagattatcgatcgtcaacgttcacattgttcctgagtagttcaagattgagttggattgaatcggttcaaagatttctagtaccttcttgagacccttcgatggtttagaggtcatgtttctttttactcgatatccacatctttcccaatgcctcccatgccaacattgcagatatgtatgtattatgtaaacaaactaagttcatgttcgggttaccattttgtatgtaagagattaatagatgtgtggttcttaagaacaagaaactaaaaagttgactggtatgcaactagctagctagaaataggtatatggctatatgcctcgacagtaataaatgtgtgatttcaatatttgtctagcatgtttatgttagagagattctagatgtttaagaatgagagggggaaaaaaaaggaagagaaggatggaggagaaaagagataggggactaggaagaaaaattgttggggagctaggaagatatagcttcagcattttcttcagaacaaagaatacttgggttgtattctgtagcttgaaagttaattacatctagttgggttggaaggatggaccatgtctactgtgtaggtaactacacaagtgaacaggaaaaatgatatatatgagcatatatagcacaggttgatatggattaagtgtattcaggagcaagtaattggtccaaaatgttgcggtacaataataattatagtgcagtcaaaattttcggttagggtactttcgtgtaaagtaatcgttcttaacaaacaagcaatgtgcaacacattgcaacatttttatcagatttatcgaagtcttttccacttaatttgcagactaaaaaaataatccaataaaaactatattatctgatttgtcattattggaaacttttacaaatatatgatgtgtttatctggttcttgtgaagtgcatgagacaatgagttatagcatcttcagaggacagtaaaaatgtggcacaattactgccaaccatctttcttgatgccggacaaagtgcagaatatacgcagagtcattccatccaaattttgatacagctatactactccttcaacagacttgatgcgatcttctttaccatgattctactgcttcagtaaatattttcagaaggtgtacgcaactcttgttttgcagttgggccgatgcattacatatatatatatatatatatatatacacggcgagagagaagttatcatttggtttgtgcttctattttcctttgttctcacccatacagaggacgatcaactcgaacgtatagcattagactgtcccattatggcaaggtcaaacatctccgaggacatggcatcatggatccctggttcactgtgcctccccttcctagctagctgatgttctgatatgtacccttgctgtataactcgtgcgtagtctacaccaaggtgaagttgtgggcctccgccatgtaagttgtgagctgtcggtgcatcgaccactaggagatatatgatttttaatactggttgtcaacccctgttaattctgattgtagcaattgagagaagaaaaccgagacaaacaaggaaatggagactaaagttgttaatttttagtaccggttgaaggaactgatactaagatatatacaagtcaaaaatatgtggaatgtgggattccaactcacgatctctcatctcagcccttaagagcgttaccatcgcacatactacacacatctgagttctctagtagtggactcttaaggaaggggtcattgtaccagcccaattcatttaaagcccctgtattagtggtgtggttttggcccaagtgactgaggtgtagatcgattagtgacatacttttgctagtttcatgagtcgtgtgggcatgaattctagcaaacattatcagcctcatcttttggcttatgcttatgcttacgcttataagccaaaatttaaatttttaaccttaaatttagagttgattttagggcttttttatcgtagtttatttgtcagcctttgcttttagatcgctaagaacacgtatataaaagttttatttataaatcattatccgtttgtaaatatgccgtttcgcttatttcgtcgataagcgaaacgccggagtcctatcaatatgtatatggtagcacacattccaacaaatttctctgtaaaggagttgtactttgaggtttccgaggaaatgtttctaatttatcaaatgcaaccagcctacgagctttagatatcggactacgaaaatacgatgtttttctatggttctttgggtgtgaatgtgatattgaattagatgaaatatataaatgatgtaatgacattgctaataatcatgctaactaaaataatcgaaatatatagtaaatgcacaacacaatatcatgaacacaagtacattgtacgaccctatgccacaatattctcaaagccttctctgtccgtcgctgccgatgcatgaccattttggccccatcgccttgtatttcctaggtccgcccagtcctagatcttaattttttgtggcatgcatctagagcacatgtttattgatcttagttttggaaaccgtagtactcattcttcaccattgtaccactcttgctcgactcttgggacaatgatttatatagctgaaaagtttagtccggctttattttttgtgcaaaggaaaatcaatatcaatatcatcacttgttaccttctaaagtgctcattttttatactacttgtagagttacttaaatgaacctttcatttaacagtgtttttgattaatatagcttgacttagtggtggctgactgctacttaattatctctaaaaattacaagtgctttgagatttgtaaaactatacttggagaatgtgagagcatcattaaagtcaataaagggccagccaagatatgtgtaaacgtcgggtgaggatcctctaacataatatcattatcattacagttactggtatgtagatctcaccctcctattgccccacatatcattgtctatattttttttaggaatgtcagtacctataatggtagtgacattatggtagaggatgtgaacccgtaaacatcatagaacttagctatgtttacgtatatttgactagatagtggttaaatcctacgcttttcgtatcaattcctccctctttcctctttcaacactttagcctttttatcatataattgaattgaattgtcttggcaattagcatttgctctcttctaggacctaaaagccccgatatatcctactaaacatattcccaccataggtttagttctttctgtttgattctacaaatttaataaccaacttttgatgaaagtcttggaagagatatgttgagaacaacagagaatgatagcattatagctcatcaacataatgcaattgggaacaacataatttctagccatgaattcaaattttatcgtacaaggtgatgattaagtaatagctcaaatccggagtaatactcccttcgggctgacaatattagtcgctttgaacaagggtaaagtcaaactttgaaatctttgactataaataatttccaaaatatttatcttaaaaatatgaaaaccatatgcgtagagtagtgttaaaaaatactttaataaaatcatatatgttttgatatttttatatattataataaaaaatagttgttcaaaccacaagtattatcaacccagaaagagtaaatatactagaaaaaatctgcgcgcctagtggcacgccgataaattcatagcatgtatatcttattttaggactcatctacaatatagaaaatttacctacctttttttaattatttgttactctagcaaatttcacatcacacaagaacttactgcaaattaccttgttatgctcattaactatattttaatagtattaaaagcaatgttaactttgattaccagttatatgtggcattaatgaaaggtgcagatagaggatcacaatctaaaagttgaaatgtcagaacgatatgtaatttgatacggacggagtaatatatttttacatgagtaagtttcacaccataaaatatcattcaaaagacaaattaatggaatttaattttgtgtttgtcccagaagaaagaaatttaattttgtgtttatcctgtaagaatgagaaaaaccaaagtacgattgtaattagtgattgccaataactttacttgtgattagatttgctaactaaaaaattaaagttatgtttcctcaaaattgttgcgatttcattaaccaaaatattatgcatatagtatcaattgtaatatagtattggaaagttttcatccaatctttcaacttatttctgttatttagtttttatttctgattattatttatttgtagaaatatataatatcaatatgtatggttaggtacgcgactcagtttcgagttttcaccataataaattttatttattcagatggttttgacaaaattatttatactttttttctatttttaccttgttttatactatttctgcttggtcctaactgcacaattaacctgacaagacaacaatgcaaatgttggcctccggacaaccaggcctagagctgactgggctgtgcaggccagcatggtgtgagccggtgcacacgccaataggcaatagcctttttttctttcacggtgaaacggcaaagccataacacattcccaaatagctactacctccgttccgagatatagctatttctagcataatgttttatcataaaatgaagctatttttacacctaccttgtcctgtcaaccaatcacaaccattcttctcacctacttcctctttttaacaaatcacccactttctctaatcattctcacctacttttttaatacccgtgccaatcttaaaaatgactacattttgagacggaggaagtaaaaaactagtccagagttgccgtgtggaccaatgaaatgctggcagaacggccggctttggattgatagatagatagatagattaatatgtgaaccaatgaattgttatacacatctgcaccaaatatttgtgtatagctgataacgtaggttttaggtaatatgaggtgatgttgatgatcaaggagtaaacattattgtgatctcagaaagtacgagacacttcatccctctctgcagaacatcgcccacactttcctcatgctttccaagccaaaattgtttgtctcttcaaaattgggtgtcttattgatcagctgtttttagtatgtagcagcatcagagatgacctaagcgagaattaggacagagcaagagtgcaaagtaaagttgtaattgttttatcaatgtgttatcactgtcttttcttactgatagttaagatagggttcgaagatagacagtagaagctagcagatggaaggctaaagaggaaagctttggcgaggcaggagagaagaccataagagacgatacaagtgaatgaaagggatcggttgttttggtcgtgcattgttacaccttacagctacaccatatatttatgcatggtcttaagatgtatccataagaaatagcctaacagatactcctaaccatggttaatcctggtctcttcttgtaaaaatgaaatcattgtgtctacagatatggtgttaccatgtattcttagtttgtctagaggatggaaattatacttttatttttaaaagaaaaagataacatctaacaagatcgataacactaagtataagcattcaaaaaaaactaaaccaatcgttcatgatattaacagcagtcaaaaggataccaatttcagcatacttattttcctgacgcaaaaacagagttaattttcagtggcgcatgagtaatttaaactcactatgtgacaatactcgatactgtgtatgtcggtcaattatcccacatggctaaagtgtaaccgatgatgtgaacacgaagagaataattacagttcatatcagagttgtgttccaatattcataagctgataacagtgagttctctagaaacccaagtgttgcaagtggagaagaatgacctgatatcctttgtgtttttgtttgatgtccacgacgaccgagcaactagctatctcccaatgtcgcccaatccaaaattttcatggtaccatagtgcgcagcaacgggaattgtcgtaggctctccggaccttccattatacttgagagatgaaatgaataattcaagtcatcaaacaagcataatgaaacatccgacgcctcgagagaggaatattggagacattgctagtcctttagcctgccagtcaacttcagcctgagatgtgcccctcaaaccactcgaaggtagcgaccagatgtgttatacattcaggagacttgacaaaaatggctaaagatctacaacatctcaaatattcttaactcatactcatgtgaatctagttcccaggatgtgcactagattcacactttcatcttaagcatgattatacatagtaaacacaactaagatgaaagaaacttaagacttacaacagcttaatagatacataggccgaccggccaaataaacttattagagaacgccggaagcttgactacccaaacacaagcacaccgactaggggtttaccccattaagttctcatcctagaagaagcaatcggaacccgcatcactcaaagactaagtctaaacctgcaaacaaagggttatatcaacagcaagagtcagtacattaaacaagttaatgtactagcaagcacaatacaatcctaatatactacttgtaagacatatattaaaatgaaggcaatatgtagttcaatttcagcataaagcaagttttatttcgcaattcttttgtaaagaagttgatgcttcaattaacaaaacaaattttaagtttcaacattaaatccatcataattccatcataatcaatatcttgttgtcatcttttgacaacaagtaataatatatcaccacacacacaactcaacacatttatcaatttcaaaccaaggtcacatgttcacattttcaaacatagtctatactcatgacacttcaccaaagcgctcttgaccgtgagcacggctaatcgattagtttaaagaactctgcagaatttgtacacctttacccacatgatgtgatagaagcccggaggctacactctagatggttcggtgccggccaagcaccccacactctacattatgagtgcggactagaggtcacaacgaagcctttacactacttagagcctagccttgcaccatcacgatacgttttcctccatcctatgcatacttagaaatatgtctagaaccgttaagtggtgggcccacgccttaaacccacccacgtggcacaataccgttgtattggacagacttagtcacctaaactaccacgtcggggcaaataggaagttcctctgaatcatcgactaattcctcagaattatcgactaactcatacacaccggcctaccagaatgcaatgctagttctaaatagattaatcagcttaggccatcccatactagtacatgtggatgtacgaataactttaagttggtgacacaagttcggtccttacggtccttacggacttgggcaaacactccccctatcggcatgtaactaacaccatatgcacaccacttgccgcccaagtctaaaatcacattttacacattttagttcgtaaatacccatcatattcattttattccagcaaaggttcacatatgaaaatcacattttaaatatagatggaatgagcatttgcatatttctaaatatggctaagcaagtagttgcacatagagcatatataaacccatttgagcacaaagagtgtgctctaaccatttctaggggttcaaacagcaagaggatcaattattcaaggtagggaatgcagcaaataggtcgtaacaccttaacccaatttcaaataccgatataatctaattcacgggagacatccctctgctctagacagagtagagctagctcgagctcgccggcggcaaacggtggctcgtttgaggttgaggtcaaaagataaaatgaagagaaagctctcgcgattccattcctctagttttcttggttaggggacatcggagtagcgccgatggcgagtgtgagcggaaggtgttttcaggtgatggtgcatgtgcatctacagtcatgaattggttaagggggtgcatgcatgtgagtatttgaggttcatgggtatataccatggtgttggccggagttgatgaggtccggacgatggcagcagacacgaaaatggcttggcgacagcgcttcactccgggatgacgtcgacggcttgatctaccaatccaactagcatgcataaggtaatacgttgttaatcgaggtctcacggatgcttcttgtgcaaagaatc

SEQ ID NO: 69861 - DNA, 4962 bp, Oryza sativa
ggcgctccggtgcgtgctccagggcgtcgtcggcgtggttgcgttccggtggctgtgaagcacaaaacgggaggtggtcaaaagagaaatggttcggcattgtgtggagagaagggaacgcgaaaaacatagagatgacctcgactcaatcggcgttggcgaaggtcatcgtcactacgaccggcggcgaggttgaggatgacggagaagctgaggacctctccctcggcttctttagctccagactgatgtgtggagttgggcgactcggtctggaggagatggaggcatgactcagtgacttgaaggcatcgacacgtcgtcaccacgcgtcgacgcgtccacgactcggttggttctcgatctctccctctctgtgtttcttggtcggctgaggatgagggacagaggaagggcgagctggagaggctgccaggtggggccaagtcgatggaagctaggctaggaagagaggtatgggtaggagtttgggtaggcttagtttttggataattttcggaattatttcttccccctaagtttgcaactcaatatcttaatatgtggaccagaagaaatagtgtaaattttactggtggcagatgtttatatgtagattccattttctttggttgaacttaaaaataatgggtagactgctcacagaaattaaacaaaaatgggctataagaaagctagattgaatttttaggaggcttaaacagaggaggaaaattctagaaaaattacatttattcatgataaataatctggtatttcaatgaattatttcccatgttcacttatgtgcagttaaatgttcttttggatgaaatatggttttagccgattaaaatttaatttcatttcttttagttgtctactttgactgataaatttgaggtatccacttgagtgttaacatttgacaaaaattacagaggataagtttgtgctaatcactatctacataaattttttcatgattttatcttgcacaaaatattttagagaattaggatgacctttgtttgtatatgtgttcccacttcataattgcatctaatattattatagggattacattaaacttcttttagactgagaagatgatatttgagtttaataataagtccacaagttatcacccaagattaactataggtttgtttagtgaaataattcttttagattatgctcatgggacctattatgaaatgcaagaccaaaactccaaatgcacaaagaactcgagcctaggcatgcattatgtacatgtatgctcatatgcttggtgacatttctagtctaatgttgggaatgaaaagattttattttgctctcaaattttattttgctcggatccaggcatgtttttcttttattttttcaccgttattttctaatttttttaatctttcgcacacctctttacaaatgtagagttgaaagtttttaattttgacttgaaagttttaaaattttgtgttgaaagttttaaatttcgagttgaaagttttcaattttgtgttgaaagttttcaaatttaggttaaaagttttcaaatataggttgaaagttttcagaatttgacttcacgtataaatttcttttcaatctattacttaaaaaaatattctgaaaagaaaaacaaatcttatcttaattatctttactatctgaaactaatggatttttttacacgctaaaactaatggattagttacgcggtaggaaaaaaaatccgaaaaaaaatcgcaccgatgcgctgtaccgtgcgtacgcgtgggctgtgggcttgaagtgtgcgccggcgacgcgtatgcgcgaattaggaattctgctcactggaggctgatactagtcaatgctgatgaaggtgctccaagcgtggtacataaatagtagtggtgtacgaggaacgagggtaaaaaggaaaaccttacattgagatggatgatggaaatgtcagttgtagttacggtgacaggtagtccataattgattgccattagtttttaaggcttgctttgcaagcttttaggtcagatttttgaatgacaaatgaaatttaaaactgaaatatattgtttatgacaattttagaatttttgatgaaaggatgtattcaaaatcgtaaagttgaacaacaataaactgtatgccaaagcccattttgttaagaggagaaaaaaactcagctatgagtctctgcatatttcaaaagagtaaagtaaagtaagttgagtcattagtacatgattgattgaatattaattatgcaaaattttataaatggattagtctggttttcgaaaataattttctatataaatttttgcaagacacaccatttagaagtttagaaatagcgcacgtgaaaaacgagagaaatattctaccaatcggccggagccaaacgtggccttactgtaaaatcaaagtgttttttattcttactgtacaatcggcatcggacattattgtttttgatatttggagattattaacgaagtggttttggagatgattgatttgcaggtgatgaacagggttgttgtttttgtcaagaccagtcagatcgggctgtgcttgctggtcagaccagagttatgtgcgcggtcagaccggccagcccacggtctgactagccgactctgtgtcggtttcggttttgggttgtttgtttgtatatctgtgattgtttcatatttatggcttctagatggatactatgcatatgtaatactgttgtttgctaacaatgagtcaagttggagatagcttggtctcgaaatatggtttctttgtttggctcatgtgtaggtgatggatcgggagtcgacctggggataaggcgacgtccgtgacggtcagatatcgtgcgggatacttaagatagagttcaatgcacgtggttggtgaagattccatatggcatacgatggaggtattgtgtacgtatgggatgcggagtcgaattagggaggagttcaaatttggtatgattggagtttgtaaagtttgtttcttgtatgagaaggtttcctaggtggattaggacttctagtatgagttttcttcatggctttaggctgcctaccctaccctcatgtataaatagagagggagcgtgaggcttcctagtatcgcttttgagagcattgagttgtgaataagttagggtttcgagtgtagtcaacattttcatgaggagtgttgttgttgcactttgtaaatacagagagaagtaataaagttgtgatctacattgagagttcttcgattttttatctcgagtgcggcggtccaaccggcgagttactagcggtcagaccgacggcatctggacagtcagaccagtggatcaacggtggtcagactggcagcggcgataggaggcagcgacaggttttggcgttagaccgggtgatctataccggtcaaaccgacgactcccatgtggtcagaccggcgcatctacttcggtcagaccacaatccgtcgaatttgagggtaacttttaattccgcaaaaagtttggggttttgggtataccaaccattcaccccccctctggttggcttagttcttgtgttttgatcctacaagtgatatcagagccttgttttcttctttacattttaaccgatctagagttgttgccatggctaataagcttacaactaagccccatgttttcgattaaacggattttccttgttggtgtagtaagatgcaatcttacattatggctgaggatcttgatatttggagaaaagtttctaatccttatgtgattcctgatcaaactaataccgctgctttaaaaattgaatttgaaaataatttcatatctcgcaatattcttttgagtgagatttcttattcggattttgatcatatttcacatctccaaaccgccaatgagatttggattactttgagaaattttaatcaaggaactaccaatattaaagaacttcgtcaggatctttttaaaaaggagtacataaaatttgagatgaaatctggagaagctttggatgactatctttctagatttaacaaaattttgagtgaccttagatcagttgattcttcttatgacacaaagaagtttctcgtcactttttgaatggtcttgacatgtctatttgggagatgaaagttacatcaattcaggagtctgttgatatgtgtactttgactttggattctctttacacaaaactcaaaacacatgagatgaatattctttctcgtaaagttgattctaaatctagtgctttggtttctttctcgactactttgaatgttggtgcttcttcatctaattctactcttattgctttaattaatgccatctccgatgagcaacttgaacatttcgaggaggaggacttggctttggttactaccaagtttgcttgagctatgaacaatgccaggtataggtgaagaagtggtccaaactgttgctttgaatgtgatgctcttgatcacattcgatcacattgtcctatgcttgggagaggcaaaaaggaagacaatggtggagagaagaccaaggagaacaagcccaagagcacgttcaaggggaagaagactaaggagattctcaagaagttgtttgagaaagtctataccgcttttgagccattaagcgatgtagatggagaaagtgaatatgaagataagggaaagaacatctccgatgtttgcttcatggcacgtggtgaatcggattcagagtgtggagacaatgaggctttggtggcgaggtaggagaacatgtggatcgtggattccggttgtccgcggcacatgaccggtgataaaaattggttctcctccctcaaacaagcatccaagatggaatcaattatctttggtgatgcttctactagtgcggttcttgctacagttttggtcaaggtaaatgacaagtttgaattgaaa

SEQ ID NO: 69862 - DNA, 10637 bp, Oryza sativa
catcttcaaatatggagttttcgcgttgagtgtttctgttcacctagatgcttcggctttctggccgctgtctcacctagacagtttgaagacgattatatgtaaataatgtaatcttctctcttcttaataaaatatggacggtctaatctttcggcagtcctagaaaaaaggacgtgacaatgatgtctttactccatgtatgggcaccgtggatgctggtcatattactgctcagagggaacttttgccttctaacagtggcgagccctattaaggttacctacgaaagttgatgcgcggccagcccgaagaagactttagtctgaattcctacacagttggtgcttttgctctagtttcctctgatgtttcctggtgctatgagtatagatgaagcagtttgtaccaaacaaactctgtaaaacatctaaagaaaggttaattagttaattttgtgtaaagtgtttttctaatttggttaactaggattattgtgacctgcaagttatgattggaaagaacttacagagataacacaaccttttctctccacgtctgacaccattatctattatatactaaaatccattaaacttcctacaaacgctcttaaaccgcaaagtggcgctcctataaatactcttagatcgtcacatgacactgcttaatctcaccgtcgattttcacttaaattggtggacccaatattttagaccataagattagatatattattttaaaaaataatactttcctcctatgggccggaaaaagaagtattcaatacgtacgtacatctgaaagaaaaacattaaccttaccaactgttcactggatgagagaggaaagaccatgtacggcttatatatatatgatgaaaggttatttttaaccgttagattatatctattttttttaaaaaaaactcacttcttctaatctcccgttcactactgctcgtaaaaaaacccaaaatacaaagtacatgcataacgtactataataaaagtagattaaagcaaaaaaaacataattatatttgtgataataaatttaaaataatttaaaaaattatatacataattgtattagtactcacttcttctaatctcccgtacacaaattatatacatcaatttaaaaaatacacccacttccctctcctttccactttttccatgtatatgtgagaacataattatatgtatctattatgtaagtaaaagtccattaaactttttacaaacgcttctaagctgtcacgtggcgttcctataaactctcctagatcgccacatgtcactatttaatctcaccgttgatttttatttaaattggtggacccgttattttaaaccattagaatagattagatatataagtaatatcttcctcctacatacagaagaaaatgcgtacgtgtgattaattcggaagaaacaataaagcttaggaacgataaacacctgaacgttccatcacagcaaacagaccatctttattgggtacatcatgcttggtggagttaatgatcaggagcagcatgcccaccaactaggtaaattacttgaaacgtttaaagcggcgtgagaaactttctgttctttctgcttcatttcatcctgattatcttattaatgattcttttagatggttggaaaatcttcatgatcatctttgcggtttacttaacctggatgttcaatcgtttaatattctaatttctgcccacttgtattatgatttatgacccatggtccttctgttgggtcacggagtatttgtttggagaattttgtattatatactgaaattctattaaacttgctactacttgctactaacgcttctaagtcgtcacgtggcgttttctacagaccactctcaattgtcacctgacactatctaatctccccgccaatttctcacttaaattggttgacccgttattttacaccattagattacatatatacatatcctcaattttcttttaaaattggtggacagatcattagattagatatattatatatacataatattttcctcatgtatacaaaataaaatacatatcattggatcggaaaaatagtacatatgatttgaaagagacaataaagctttcgtcttaggaacgataaaaaagataaagccgggtgtaaaaactaaagccaaaaaaaatacgtacatagtatcatccaaaaaaatcaaaaatataattttctgccatatacgagaaagaaaacaacccatacgtacatagaaccattggaagaaaaattaacgatctttaaaatataattttctacaatatagagataaaatatattattccactaatacacattgttaaactagatctatataatcggtctataaacattcacattttaaaatattttaaaattatgtatctaattagtgatctttgttgtattcctttaattaaatgaatattataagacttataatatgtcataaatacatcacgacacgtggggccgacaaataataattagtgctatgatgcgtttttttaataatttcacgttatattttggtgtaaaaaatccttaacaaatatataacgctaatttaaatctacatatgtaaaaaaacataaaaaacaacaaaaaatagttttttcaactatctttaatttaattttgatttatttgagattaagattctcaaagttttttttgaattttttataactacttgattggtatttgagaagtgagcagcacatgatacatatatataaaaaaatattttcatccaatgatcttgatataatagaacaccttaatccatcatgagtatgatcatatatgtatgttttattctctttgccaaatagttttgataacaaatcaagtaatatgtgcaacatactactaatcatgctatatttttttatagttgaggaattccatcatgttatatgtttttatagttgaggaattccaacatatgagacataattgatggatgtatatcagacataattgatggatgtatgcgatatatcccaccgacgtgactataagtattatctcacaaattagttatatattgtaaataagttttgaaaaaaaataaatacattatccaaatgattaaaggtgtctcatgtgattatcaacgataggtgttgaaaagaaaccaaacgctaaactatagatatttgttaaaatttaaataataagatagtgctttgaagattatcttggtggtatgtcttcttagctataattttttagtaccaccgaatgaacctcggtcattttttaaagagaatattttgtttatatcatacttatttatgaagtaatagttaacaccataaataaatggtgtttactctataccataaatctactcgaaaattaaaacaaaaacactattctgatcacattcatcttctctttgtcctttactgaagggcaccaagcatagacaacagagtttgctacgctaacataagtatagcaagggcaaacatatggctaagttgaagtgtgctagacttactatttatcgatgccatactccatgagggtgtggtgtgaattaggcattaaagttgtgctcgagactggtatggaggggcaccactatatcgatacaagacccatgtttcaaggaaacacacagaaagtaagttttgctgctacaatcgacttcacccagcagagggacatttatatttcactttaacgatttggaaaataagtcagacatgaacacttaggtgcagtggataatttagtgtattaatgatctattagacttattttattggtatatatatgcagttttatctattaataggtacttagcttctaaactatgataatgagttgaagtgacaacccagacaaagtgatatgggagacatccttatcatttatatataataaagtctacagtttgaagtgacaaccaggacaaagtgatcttttttaatatgggagacatccttatcatttatatatattaaagtctacagtctatttcacagcgtataaatgatgcgatataacttatattaacatttttttcattaaactataaataagataatgatgcgatataacttatattaacattgttttcattaaactataaataagatacccgcgcatctgcgcagacttcctttctagtttagctaaagctagtaacacattcatcaacattcacaagagtttcagccttccatgagaatatataactactagagaaccaatctttactcgataggcaaaaatagaaaatatgtcagatgtttaacgaaccagttctaaagaaggtctttagcaccggttaaaacacacaacgacacatcgctatcttttttatcggttggtaacaccaacgggtactaaacaccatctttagtcccggatcacacttgtcagaacatgtcaggcctcccgggatctttagaaccggtttgtggcaataactgatactaaagatcactactttattaccggttggtgatacaaaccggtactaaagataattttgatctttactactagttggtgttaccaccaggtactaaagatcgttgctttttatactcttcttccttctccagcccgagccattgttgcaagtgaaagaaggaggaagagagaagctgccaactttttttttgaaaatattttggtgaaattatacgaatcgaagagatttaaaaggttagcaacttcatcctctatcgatgcatggttaacattttacctttctagctatgtttatatacattattatctcaaataggtatatggaaaaaagatgagggagaaaaattgtttagggaaaattagggtacatcataaaattagaaacatttgtatggaaatgtttaaaaaagacaacaaaggaaaagtatagaaaatgatgaaaaaagaatagaaaactaagtccatttgaaaatcattaaatagttagaaataagtagaatgcattaaaaatatgtttagaactttaagaaaacttaaaaataattgaaataaggataatacgtggaaaatgtatttacaatttattaggacagataaaatttttaaatagttaaccatgactctgattaagtccatttaaaactcgttaaaatcaatagaaataagaataatacactaaaaatatgtaccgtctattctcagtttagttatgatgttttacattataatattatgattgaatgagttttactttcatggacttcctttacatttgttatctcccgatgcggatgaattggcaatggtgtacaccgtggaccaatggtcgaaggagtttattgatggcgtgcattattttttgagtgtggacaatgcctacaagtctaagggttttatatgttgtccatgcacaaggtgcaaaaactagaagcattcttcatcaacagctcttaatatccacttgatgcaattgggattcatgcctagctataactgttggaccttgcacggagagttaggggttgcaatagaagaggatgaagaagaagacgataacatttcggactgggttcaatacggtggatttgcagaaaatacaataggcgtggcggacagtgctattgaagaaaacaagggtgcggatgatcttggtcggagttgtgtgacgtaaagaaggactacgaaagtggaaaggatgtccaaaaattgaagcgtatgttagcggaccacacaaaatgtcattgtacctagattgcgaacaagggcagaaaaagttgggtaccatgctgaaattcttataatgcaagacaaaaaatggtgtgactgacaagacatttggcgtgttgttgaaactcataaagaatattcttcccgaggaaaacaatttctcgaaacaacgtacaaagctaagaagttagtctgccctttaggactagaagtccagaagatacacgtatgtccaaacgattattgtaaaatcaaaggtgtatttgattattattctgtgatgaacaattggcatcggagattattggttttgttatttggaatttatttgtgaagtggttttggagatgattggatttcacaggtgaatatacaggtactgctgtctgttgggaccagtcagaccgggcaggtgttgccggtcagaccggtgcagcccgcggtctgaccggccgacgctgtgtcggtttcggtttcgggttgtttgtttggatatcattgattgtttcatgattatggcttaaagatggatactatgcgtatgtaatactgttgtttgctactaatgagtcaagttgatgatagcttggtctcggaatatggtttctttgtttgttccatgtgtaggtgaattgatgccgggagaatatttgcggtgatggaccgggagtcagcttggggataagacgatgtccaaggtggtcagagatcatgccgaatactaagggtagagttcaatacatgtggaaggtgaaggttccatatggcatacgatggaggtattgtgtgcgtatgggatgcggagtcgaatttggagggagtccaaatttggtataattgattatgtaaagtttgtttcttgtactagagggtttcctatggggattaggacttctagtatgagtttggttcgtggctttaggctgcctaccttgggtataaatagagagggagcgtgaggcttcccggtatcgcttttgagggcaattaagttgatagttgagttagggtttcaagttttgtcgaaaattttgtaaggagtgctgttggtgcactttgtaaatacagagagaaccaataaagtcgtcatccactttaagagttcttcgatttgtgtttcacccggtttcggcggtctaaccggtgacacaccggctgtcagaccggcggcatcacgacagtcagaccggcgggtgacctgcgatcagaccggcgtcggcgacaggcgacaggagctaacgtcggcggtcagaccggagatacaatctcggtcagaccgacggcaaccaggcggtcaaaccggtgcatctacttgagggtaacttttatttccgctaaaaattttggttttgggcataccaaccattcaccccctctcttgttggcttagttattgtgatttgattctataattatatcatttattgcggcgtggagtacgagaacctagttgcatgcccagttcgtaaggcactacgatacaagatgactccagtgatgttgacggaaagccttcgaagaagagagttccggctaagatgatgtggtatttcactaccacggctgccctaccatctatgtctggtcggctactctccactccatgaattgcactatctgcatgcccttaatatcaaggtgtctccaaatccatgctctttgactggtgaacataaacaacatgtggctggaaagaaacatccagaggaaaaaaacatgtgtgccactatacaacacatctcatcatgaccttttctttaattagagaatggaataaaaataccaaccaaagacataaaaaagaaattaatagtcacatattattaggtttccacacaaagtggaattaaagaaggcatacaacagcatttgcagcagtgaatgaaatacaaagttgactagtctatcctagggttggtttggtcgtgtatcaccttgtgtgatgctatctgttggtgtatttttgttgtatgggttgttgaatccttctcaatgaaatgaagcgtaactctctgttcttcgggacaaagagaaacttgagagcatttgttctttcaatgctcatttgccaactcttgctggagttcgattgattttccctgggacaccactcctgaatttcatcggatgattcaataccagaaagcttcttttggcgccacctgttttatggaaatctttctggtagctacttggctgctttggaaacaaaggaatgacctcattttttagggtgtgcagcccaccctgtctaggtggaatttttgtttaaagaaagaagtaagcctacatttacttaggcttaagctagtttctagaccctttctccaatcattgattaactctttgtaattttgtaaagctcttttttgttatatatgaaaatcaccgtgggggctcccccactttttgcaggtccaaaattaaaaaaaaaaagaagaaatgaaatatcatattttaaatataactacacacaaatgttagacctccaaaaccattcttgttgaatgtatgtatatagctccatgaaaaacttctccaaagtgtggcttgcccaacatagtcatcctccaatgtaattcctctcaattgggaagtgactttggtgtggtggagtaatcgtggagcaataaggttcaaattctggagtaacaaatatggctggtttgggagttatcaagaaaacagaatcgggttaaaagttgagaagatggactcccggtgaggttgcatctgcgtccattatattgtcattcacgcttgctgctagaactcttgcggacaatcgaacatagcttgtatgatcagcatgtaaactccactctcattgtggctgttatgtacgtgccatctatcctctacgaacaaatcaaattggagatgtgaagtacgtatattgtacaggttgaggttgtctttgcgttctggtgggtaactcagtagttttcaatgcattgcagatcagcctcaattgcgatccaagcatcaagttttaatcgaaaattgatgaaactactgtttccgaactcagaagcaggaccaagatttttttttcttttgttctagtatgagatccacgattatttgttctatatagggtttctttaaagctagcatacgtacatacctctgcacataagtttgtcattaacgaaactgcacaaggaacacaagcgtgtatcgtagttaagtactaaattaatgtcatcaaatcaataattgaatatattttcataacaaatttgtcttaggttgaaaatgttactacttttatctataaacttggtcaaacttaaaagcagtttgactttaaccaaagtcaaaacatcatataacctgaaacgaagggagtagatagttgtactctagataatattttgagcaggttcttgtaaacaattttccggttgcgacatggatatattaaaacttgtgcttcgaaattatattagttccagctaggtttgctgctaattaattaagctataaagctcagaaatgtcagtgggatgcatttttttgccctgctaaacagttgtgcaatagctctattcatctgaagcaacaatcatgccctttcttgtaaaataaaagtgtggttaattgttattttgtgatgaacaattggcatatgagattattagttttgatatttgaagattattgaaaaagtggttttggggattattaaattttcatatagtgaacaggaacgtgcgatcagatcggccagcccgcggtctgactggcggatgatgtgtaatactgttgtacgctaacaatgagttaagttggagagaacttgtgctcggatatggttactttgtttatacatgtgtaggtgagtcattatgcctcgggagagctttatcggtgatggatcgagagtcaagtttgaagaagatgatattcggacgatcaggatatcatgcgggatgctagcttaggctaaagatcaatacacgtgattagtgaagattttatatggcacaaacgagggagatattgtgtgtgtacaggatgtagaatcgaatttgcaataagtccaaatttgataaacttggagtttgtaaagtttgtttcttatatgggaaggtttcttagggcattaggacttcttatacaacgttggttcgtagctttagactacctgcctcgggctcttggtattgatctaaaactgaaatctgccagtcacccatctcacttctctattagattatatggttgttagagtcatatctatctattatatactaaaagtccattaaacttcctacgaacgctcctaaaccgccacgtggcgctctacaaacgctcctaagtcgccacatggcactatctaatctcaccgttgattttcacttaaattggtggtcccgttagtctacaccattagattagatctattattaaaaaataataacctcctcatgatctgtacgtatgtgtttgtacgatactactgctgatctttccatacgtacaaacgtaatgtacattatctttcctaatcttgctcgaacccaaaaaaaaacgtacacatgaaaaaaaaaagacagaaaaaacatacttccataaaaatcgatggttttaaaaatatgattttagataaaatatattacttcacaaatataaatatatttagttaaataatgatctatataaatatccaatcaatgttctcaaaaccatattctaaatctatctatctatctattatatactaaaagtcaattaaacttcctataaacgctcctaaaccgccacatggcatgctacaaacgctcataggctgccacttggcattatcaaatctcaccgtcgattttcacttaaattggtggacccgttattttataccattggatcatatctattattaaaaaattccaactttctctgtatatgatttaagagcta

SEQ ID NO: 69863 - DNA, 769 bp, Oryza sativa
aaaaagttcaaaaatcaccaaaacatgatttttgaacatattggagtgcgttgggtgctttcgcggctaaaaatcacttcgtgattcgcgcggcgaacttttgtcaattgatgccaacattggcatatattggcacacgtgggtgcgatgttttagaccggaatgaaaaagtttaaaaagcaccaaaacaagatttttggacatattggagtgtattgggtgcgttcatggcaaaaaatcacttcgtgattcgcacggcgaaattttgtcaattactgccaatattggcacaggtgggtgcgatgtttttcaccgaaattaaaaagttcaaaaggcactaaaacatgatttttggacatattggagtgtgttgggtgcattcgtggcaaaaaatcacatcgtgattcgcgcggcgaacttttatcatttactgccaattggcacacgtgggtgcgatgttttagaccagaatgaaaaagttcaaaatgcaccaaaacatgatttttggacatattggagtgtattgggtgcgttcgtggcaaaaaataacttcgtgattcgcgcagcgaacttttgtcaactaatgctaatattggcatatattggcacaggtttgtgcgatgttttagaccggaatgaaaatgttcaaaaagcaccaaaacatgaattttggacatatttgagtgttctgggtgcattcgtgggaaaaaataacttcgtgattcacgcgacgaacttttatcaattactaccaatattggcacacgtg

SEQ ID NO: 69864 - DNA, 52300 bp, Oryza sativa
  unsure (1)..(52300): unsure at all n locations
ggcgccgtgcgcccgcgcgtcgcaccgggcgcacaggaacgccccgtccgcgcggcagtagagccgcgccgcctccccgccgcacgagtcgcacgcccgcgtccccaacccccacgacgacgaggagtaccccgccgccaccgctcctcccactcccaccatcgccttgtcctccaccgcctccatttcttcttcgcttcgctttgccgctcggcgcgtggtgcgtttcactcgctcgcagctcggtttctcgcggagtttggctgtgttttttgggcgttgggcacgggggattcgactattcgcggggggttttgagggggtccgtggcacgtggagggactcccggccacgagacgcgcgcgcgagtgtggtccgaccgaccgtccgacccgcgcggtcactctccctccccccgtcggctcgcgtctcgcgcgtactctcgctcacattgcccggtgtttagccgagcagcggagagctgacggctccgcattggccgagccggcaaatcgccgtcgcagcagcagagggtcgccatctcgcgctgcttgcaaaacggcactgccagtactactgcattttcagcgcttatccgagtatacctttacgctcttgcattcgttttgatcgcgatgtgtatgagacccatagtttaaccaacggtttttaggcggcacggaatcggatcaaatcacttgctacgcaacatggccaccatgaacccatctctctgcttttcctgctactactagcacagaagcacgcaaaaaagccaagaaagaaaaagactttgtacatcgcgatgggcacgagctctctaggactgtagtacatctagccagatgccgttcacacttgcacgtccttttcctctgcgggaagagaaggaaaaaaaaaagaaaggagagcggtggttgcgccaccattgtcgcgacgcgcgcgcctgcgacgcacggggacaacggggacagagggaggggcccacccgtccgactgtcaccgtcgcctctcgcgccaggtgtcgcgcgccggttggctggtgcgctcccggcttatcgctttgcggatgaggtgatgccatgtcagcggccacggccaagccgaggccaccgtgggtggggggagtggggacgcggcaaatctcgtgcgagatctggatccttcacgtagggcttggtgcgtgctggacgctggacacttgcggcggcagcactgagctgggctgctgcctgctgctggtggccagttggcaccgcacaccaaggctagtggacatgtgtttgcgtctcccttccattctaaaataaacagactagtataaaatatgatatatttaggtgctaaaataaataagcttagtatgaaatatgatgtattcaagggctatgaatctagagagacatgctacattactagactcgtttattttaaaatagaaggagtactagacatgttaggcatgtttggattgaggttgatttttgtcctaccaattttttttggcaacttcaatagtaacgggctgttttggtttgaggcctaaattagccataccaatatttggtaatttaaatagtgtttagtgtctatttggtttaaagccaaattggcatgagtaagaaaataagccatttcaatagtgaacttaggctattttggctttaatccaaacacaactttgccttaccaaaattagtcatgccaaaacttaacaaaatttggcattgacaaaatttgataaggtctatttaggccacaaaccaaaccaacccaacatatagatgtttggtttgctaccaatttatatccacgctgctaaaagtactatactatcaatttgttagtgtcaaaaattaccaagattttagcgctaccaaaatattgattgggcaaaattggtaacaatccaaacaaacccgtctgcaacttgcgtagagtgtatatggagtactgttatacttgtgcaacttgtaattagactttggtgtgcgtattggaatatagggtcgctacttgtttggggtctatacgaattggtgagttcagcatttccggcacttgaagtgactatgatctaatccactgcaaccaagtcctcggtaggatttggtcgtcaatggcatcttgtgtgagaggttgagcttttgaagcaacccagtgtgtgtgaggaggaagcctagccacttaaaaggcataaacaacaaaatacatgtcaataatgaaatactggggaaaagagagttttttcccctcatattattcaatggctacaaaactcgtaatctcgccctgtacattgtaaattgttaatatatttgttataggagtcttcctacagtatttttccctaaaaattactgggaaatctaccaaacgagcctcaatgacaaatacggcaagtattattgaagtttaacacttttattaggattaaaataaacattttgtgaggctcatggattttatttaagtgtcagtttcttaagcatgcacccaggggcacacacttggtggtgtccgcatgtgtcttttccgtataatcgaaaaggtcatattaatgaagtttggctcttttatatgggctgttagacaattggctacattttattgttctataatagactatcttattcaacattcttaagaaatatcctaaagggaatgtttacatgaaggccacaaattgccacacccaaatgttaggcgtgtcatagtttactgggttagttagttactacttatatttggttggttgttgttgcgatcgtggagagtcacactttgttaattcacacattcggatcacatgtgtactcaatttctaggcaaacattgttaaacctgtactacagttaataaggtgtctacctcactttgtatggcatcatcttacttctggcaaagttaggcgtcagcctaattggcttggagtagccttgcatgcatctcaacagtcaagagtctgcttctcaactgttagatttaattgggtaattgatccatttaaatcaattaaatcaaataaattccaagcctcattatgctaggaattcatgtgtattcattctcttatgggatatcaatgggatgaggagttttgagaattaatccatttgattagggaattggtaacttatatcaattactcctatttgatggatggttgatggttgtatagtggaggatggttcatggctagttgatgacaattaattgctctattcctcttcctattccattggtaacctacatcaattactcctaattgatggttggttgatggttgtgtagtggaggatggttcatggctaattgatgagaattagttactatattcctcttcctattccatgatttttactcttcatcttccattcctcatataaaatgagaatggatttgatctcctaaaagagaagagagacacactttcatccattttcaacgctgttgctgctacagtaatcccatcccgacgagtgtgtgcacacgcgttgggagagtaggcctccgaaaccacgcgttgctgcgacgtttgtacggacgggcgtgcgatcaggtttttgggagcgcaaggcgcgactactcactgttcgtcaacatctacttcaccttcaccaatatgtcaaacactggagacaacggcaacactggatacaaggagaaggaggctcccgtcaacaccaacggaggcaatactgcctcaaactccagcggatgaccattcttagggtataaccttcttacattatttcaattagaagttttactgttaatattcatcgcaatgtcaacattgtgttattatatgattgttgatggttattctacattaagcatgctcatgttgattacattcaccactatcaccaaatcaaatcccattgtaaatatcatgtttattatcttgttattttggattaaaatatgccgaattatgaccaaattttcaacatcaactgagctcacatatctatgatccccacgattgttgcagtctcaaaacacaaagattacatgtgcccatgaaacaccaaccgaggtctacctctattttagcaaactgattgatcacatgtacaagaagttggcaaaagggaatccaaagcatttcacagctgctggacgcttggcactcatttcttcaatttaataatttccatgcagaacctggggggcaaagcaaaaggtaaaaaacctgaacatttctccatgattatacgtgggattcttctcagcatcccaaaatcgaaaccaattttgtggtgcttggtacacacggtttgggacttctttgagccacaaggttgaggcttaattcagagctgcccacagtttctccgtttcggtttattcagcggccatcccaaaaaggaacggtttcagttcatcacacactactcgacagccgacagtcactctcggagaagaaaggccgtgaacatgttggatagtactacttcgactaattgaccatttgctgctgccatgagaggaggacaaatcaaacggacagagtgtgacaagtcactctaaagataacagaattctaagtactagctttgctactgtatttgggcaacatggaaagggatattccacatcgttttcggcctcgagagggaaatgcggccgtttccggtagaaaatccggataagattacaccgcagcttgcagatcgcaacgggagagagaggagaggagaagaggagagaacccctgcacgcaagtgcggaggaggacgaggagaatggcgtctctatcggatcgccgacgccgacgcgtcgacgttggacagccaagtgagaaagtttaagatcttaaaaagcagttggttggtttacgagaatttaaaaaaactggaagaattaacttctggattttaacttattttgtgtattttgtaattacaacttttcaaaaaattagatgaagaactagactgtttgagagagtttgattctcaaagaagctacggctacgactgcctgtaactcccaaaacaagtcctcatctcgacctgaagccatggaccgcgaggctgagcctagtatggagattgggtccggcccaacttagaaaggttagcccaatcggtgattgggcctcgtataatgtagcggaggatagtgtttgggcctttgggcggggcccagcagatgctcctcgaaaggttcggccactctccgtccgtcttcctcgtcggcacgctgcacagtacgcgcgctgctcctaaacccaaaccctaaagccgccgattcctctcctctcctctccacaccagctcgatcgcgatcggggtcatggccgccgccaccgcggcgccgtcgatcgacgaggccaaggcgaagagcgttctccgccaggtgtccgatcccgccttcttgttgtttgttcacggcggatttctcccccttttggcgattttgtttgagcatttatttttgggggggaggtttgagcttttgatttggtttggttgtcgcaggtggagttctacttcagcgacagcaacctcccgcgcgataagttcctgagggagacggtcgagcagcgcgaagatggatgtaaatgatctctcgcgcagtacattttccacgcggattgcttttctccggcgcgatgattgagtgctgaacttagcgtcttttttttttcttctcattttgttggaaatgtgcagtggtaagcttggctttgatatgctctttcgcgcggatgaagtcgcacctcgggctggacgccgccgtgaagcccgaaactgtgccagaggagacagtgctcgcagtagcagaggtgctacgtcgttcccagatgcttcgtatctcggaggatggtgattcctctctttcctcttaattccagttattcgtgattcactagcaacgagcacaaattgctggcaattgaatttcaaaaggagttggtaaataccagtgaaacatgtgaagtgtacatttttagataacgatgtaaagtgtacatatactctgctttgtgacctgctattcaatgttgtcaataaacttttgttttccttctttagtaatgataaatatgccatgttctcaaatacagtgttagtttgggaactagagctggtctacttttatgtgagttaagtttctctagtaaattggtttcttttttatcattgctgatttgctgtatttttcaaatgcaggaaaaatggttggtcgagctagtgagctgttgaaggcagatgaaatcatcaagcaagtggactcaaggacagttgctgcgtcaccattgccttacaatgtaaagctggaagatgtccaatctttctttgcgcaatatgcaaaggtgtgtccaagtactgaacacttatagtgcacaacaagcttgcagttagtttgaaatgaaattgaaatgtaatgcaaagagaaaaggtggcatggctaggctgcataaattcgattcaaagttcaacagaacaaaggaagttttttttctcgtgaacctttttcataattaggattttgagtatcatgaacataattaccagttatgcatgctggctatctggagcttttccagtgttatgattacatgtgcaatactatactgcaaatatcaatgaattaacattttcttggtgtacttgtgtctgaattgtaggtaaatagtgtcaggctaccacgccatatctcaaacaaaaaacacttctgtggcactgccttagttgaattttcagaagaggatgaagcgaaaattgttttggagaataatttgttctttgcaggggcaaatctggaaataaaactaaagtaagccactaacatatcctttttgcatgataatcatacatgtggaatgtgcagataaaatgcttgctttagtactatcaccataaatttctatgttaattccaatatattcccctctagctgtactgccataccggtaagttgttagttatcaaacctcatttcattgccaacattgctttcttttctattaagtgcaatttgaatgaaatgtgcgaaataagctgcattaattttgtacttcttttgtttagtttggtgtcagatcatgcaagcatttccctctagcaagttccttgtcttgcatgtttacctcttttagtgatacttgaattaatgatgcctttcacatatttgcgttcattctgttgctgtatgtgacattatgtaacttataattcgttgcctgaatcatgaaggaaggaatttgatgctgaaacagaatctaaaaaagaagcatatgaaaaggcacatcctaagaaggacgagcagaatgaagggtgacatttttacaggctgtctgttcaattacttttccttcctttagagttcaaatcaagaccattttcctggaatttgtgttgcagctatcctaaaggcctaattgtggccttcaaattgaagagaatcacggttgatggtggggtgcaacaaaactgtgcagacaatgatactgccactgaagaagaaactccaaagtccatgaagaaaacatcaactggggaatctgaagagaggactaccgtgaacagtgatatggaggaacagaagtcatcagacgacatgactgaagcgaaagaagtgaatgctggggaagctacagaatctggtgacaagtgcacagttgatgccttgctagaaagtgaaaagaagggtgataatgaaacatcgatcaaagatgacagaggcctctctggcaaagcgaatagtccaatctcaagggaagatctaaaagaagcgttcaaaaaatttggaacagttcgggtattttaatccacaccactttctagctttagtttttcttggtataaacaccagtaacagttctgtttaacattatggaatgaaaattatgaaacatatagcattcttctagattcaaatatggtccacagagagctcagattttaactcatgggtcatatggcattatctttgtactttcatttgtccttaaagatctggtgggatattaagcatgacgagttgtaaaattattaagatcaattaactatggaatgggaaatgcctgaaaatgttcttgatacacaccataaaatcgtggtaatagactaatagctagtcctaattgtaaattcatatttgtaaaagtttatttatggtccttggaggagcacagttatgaggtagtggtatgacataatgttaattatctatatctttggtacctggcatggctgtggtggtgaactgttcatattgtatgtcactatgtcacaaattcacatgacactttttaattccgttttttactttcattgcacatgtttttcttcctgaagtatgtggacttcagtatcggggatgaatcgggataccttcgtttcgaggattctaaggcagctgaaaaagcccgcatgtctgctgtattagctgatgaaggtggcttgatagttaaagaccacattgttaccttggagcctgtgactggtaattgacaatttgacatgtgtttattagagtttttttaataccattactgcttgcattgtatcatgattaataaatgtagaatatccattatagaaaatttttagttccatttaatgatacttaggtggaatcgactcctattattgtttgacgctgtaaattaattcctcaaatctggatgcaattaaattggtttgtggggtcttactttttttgtttttgcaggtgaagctgagaaggattattggaatacaatacgtggcattcaagggaaatacaaggacaataggagttacaaaggaaggtattcaatgaattaacagtttaattttatttgtttatgtcctgtttggtactacgtacaatattatctctagaagtaattgcagacaattatcaggaaaggcacactacagcattcagtaattttgtggcaaattagaccgaaataactttgtgtgccttttgagaatgttatgactttttcatttgcaattttcgagctagatgacctgcgctaattgcaatttatttgtgcattgcagtattgtggttaccacaaatatgctccttaattccttgtatatatatgtcgaatagatacttccttgcacgaaaattgatcatctcgtatgcccatgtttaatgttctctgcagaatataatgtgtctttgccccttgtcatatatatgttattgctctttttctaggactggaaagagctacagaggaggaaagcagttcaatgggaagcgaggccgacattctgattcctccgaaaagggtgcgaataaaacacagaaggtcgaagctgctgcttaggctaattttaacgtcttcactcgaccgagaagtaacatgctacgcttactatcggtggtcttgtatatttattatatcagagaccatttattaccatattttgtgactgttattgtccattttttatgctaaccttgttccaaggtatacttccgtaatgattagcctttagtaacggctttgccgtttacttttgaatggctttggaggatataaccttgtatagctccaaacatgcaaacccggagctgtttcctgcagcggagcagagcagctgtcctgacaatcttcagatatcttcaccgtcctggattgattacaaaacgattatttcatcattctaattacacaaaaaaaaggtttagaaatatggctgatttcaccgttctgggatttatactttggggcctcagctcatgatcacgagcattttcgtgtaaggtttgcttttaggcttttagcttccagagaagatgnnnnnnnnnnnnnnnnnnnnaccttcaaaaaaaaattgtagtagtactctggatacataatgatctcttaaggaataataccttggaaattattgttgctaaggtccaactgcccaagcagtggaaggtctccaaagctggatggtgtgtagccaccaagattattgtggctaaggtccacataagtgaggtttcgaagcttttccatactgaatggtatactgccatggggatatattgttgtaaccaatgttcaagtcccgtaactgttgaagacttccgaaactagttggtatgtgaccttcaaagctgttctttgccagagataacagtgacaagtatgaaagatagccaatagaggatgtattggcccaacgaagttgttctgttggagatgcaggaattctagatagttagctttccaaattccaatccattcttcaattctaccagtaagattgtttctacttagctgcacatcagcgaggccccgaaagtttcctatactaggaggaactacgccggcgaggtggtttccgtccaaccatagttgttcaagactcaagagtgatataagttaccaatcgagcttggtatatccgcctctaggggtgtgtttggaaaatgggttaggagaggtgggattgagaaatcaaaatgaatgaagggataggataaaatatggtgaaatgaatggatggctaagattgaaacttaccctttgaagggtgggaaatcatatcccaaacccatttttcaaacattgcctagctgatcatgatttaggcggagcattctcagattggtacaatttccgaatgcccgcccgaattttcaactttcatcgttacttgcttcaggattgttatccccaagatctagtttggatagatttgaaagcataccaaaatgactaggaacctggccgttgaaattgttaaagcatctccaacagcctctctattccactctccaagttaaattttagccattctagaaaaaaaacgtgctccaacaacctctctaaccgaatggctaagccatctggctggccaaaacctttcctccgctagccaaatttggccagccaaaagtgactagccaaccgtgggtcccacacattcctcctccccatctcctctctgcctcctccatcgcatcgtttgccgtcctccgcgctgtcgacagtcgcgcccgccgagcctcctgagccagacgacggtgccggcgtcgcgcctccgaggcacgacgacctgccgcagcagtacgccggcgatcccttgccgccaccgctgcagcagcagcagcagcagcaggaaggctccccctcgcagcacgacgactggcacttgcagcacgacagctgccccttgcagcatgacgacggcagctcaggcactgccagagcaacgccaggcagccgacgcacggcgtcgtgcaggaggagcacttggggcagcagccgccgcagctgctacagcacggcgtgcaggatgaacacgagcaccccgtgccgcagctgcagcccaaaattgaggtgaataaacagcccaaaatcttggaacaagtcaacgatctgcacgaaattcgccgttgttgcttgcctacctttccattctccattcgcaatttttgcagtgaccaacaattccaaatcgatcggaatctgatcatatccaccctagccaaccaaacgcaacaaaaatagcagagaatgagcgagatgccgccgcacaccgtgtacttgccgttcccggcacaggggcacatcacgccgatgatgaagccgccgccggctcctagtccatgcgcccctcacctcgaccagcaggggtgagagctgctgggttgatggggattggggaagaggaaacatgtagaggaagagaggggaatacgtgtgggacccactgtcaaattggagaagataaatagagatgctgttagagtaaaaaacaaatttaactctctaactttttggcaaactagctaaatgagcatttggagagtgagatttggccatgctgttggaaatgctcttagatgacaaatctatcttctttatcccgaactcccgatgcgttgcaaaaaggaaattttgatacccctttctatgttatgttaaaaataccaaaataatttaaaaaggatcaaaatacccattacaaaccaacggtttgatttgaatatactatactggtaccaccagtagtggaaagtaccgtaaaatcccccttaaagaaaggtcgagttcctcgagaaacatgaggttgccaaggaaggggctgattgtgccggacaggaacaggtactgtaggtccagctgatccacgactcgcccagggcgcttcttccggccgcatctaacgccagcccaccagcatacaggggtgcgtgcctcccacgatctgcacaccgtcgtggagcaatggacgctgccaactccgtaagacagcagcagcaaaaacgccacaagtgtagcctccttgctgtgatgcagatgcagacgatggttggccttggcacagcaggcaaggccggcctccatgaccatctgccagatgtaaagcacgaacattaacatatatttcatcgcggaaaacggaggaaaacacagtaggatcgatcgatcacctcgctgctgtttaatttggcgtttattccggcagcgaccagcggcagctagtgatcgagttggaagctcactcgcacgctcgtaggcttcgcagctgctgcaaagaggcgtagctcggtgtagccaccatcaggtatataggttctgtttggggagctttagattctaagaaacagctgtttggtagccagcttctgagaatctggaaaagctgtgaaatctagcttcttagttcatttctcagaatctgtaactacatattctcagaaactgtggactgtttggagcagcttccccaaaagagggccataaacagcttcatcgccgcactgtgacggtgtccacgtgcttcttcaccggcgacggcgaccgctgaccccagcttgacttgctgtcacgccttacagcattaggcgttggctatgacaatcttgctttaactacgaagccatcacgctttcagtggaacaagagacggccaacttgcaaattaacggactgaagaactgatgagccaccgaacctttccctccaacaagatacgaccaacttgcaaattaagaggcatttgaattactgtgtatctaggtttgccagatttcaaataaatttatccaatttgtaccacccaaattgctaccatcctcagatgataaagactgttaatatcatccgtgacagcacatgcagttgggcaatgtagatactgaatgactgtggaaaggtcgccgattgaatttgggagacccgcgtagcagattacttatagctagtgactgtatattatactctatctgtagaaagctacagttcgttaacggatcaaagaatctccaccttctgctttctttaatagaggttggcactctgtaggaaattgtacagaagggaacaaacttggccgctaatccaccattgctgtgaggacctttgacctccaaaacttcttttccaagaagatagtctaagagttgcaaggaccttgacgcccaagacttctttttcaaaaagatagtctaagagtaggatcaagatttaggttgtgttggccactgggaaccctttctcctcagcacgcaaaacagagcagcgaattaacacacaattaattaaatattagctaaaaacttgaaaaatagattaatatgaattttaaaacaactttcctatagattttttttaaaaaaacacacactgtttagcaatttgaaaacgcgcacgtgaaaaatgagaaagcagaaattgaaaagtgtagtatagaacgttgagtattagtacatgttggtgcggttaacaacgagcaagagccagaacaaggaatttatctatgttttaagagatttacaaaaataaactattgttttaaaagttttgcaaaaatatacttctcctgtcctatcaatctattatagggcagggtgtataaatcgccctacggtagagcaggctatgagcacgtcatatagtgggaggggcacgccatggcaattttatagccccacacgacagcgcgagaaagggtcacttgtaaaattaccacgacgcaccccatgcatcaccaaactattgctaatgtcacaaaactaaatcatcctacgggaggttgagaagggtccgcctacaaaattgccatagcacacccctcccaccttatggtacgtcacatagcccgcgtctacctaggacgatgtatatgccccaccctacgatagggctggaggtgtatatttttttacaaaactttaaaacggtaatttatttttaaaaatattttaattaatccggttaattttttcgtccgtcattaaaggatgggcccacgcgattttcgccggtaatgcgaatcgcgacgcgtgacggcgattttgacgctccacaaataaaaagagaaactgaaaaaaaagagagaaagctagcaagcagcccaactaaagcagcagcaggccggcccaacaaaaagcaaacgaagcctagcagtcagcccacatagcaaagcagcagcccagtacagtactgtgcgatactgtagcaaccgggaataagttcacttgaggtcccttaatttatcgccgaatatgaaatccatccctaaataaaaatgccaggtaacctcatcctttaacttacaataccttgtcaatttcgatccctcggcagtatcgtggccagttttaactaacatggcaagtgggccccacacgggtcacatgtcagtgcacaaataataccacattttgcctagcttgggcagcactagcttaaatagaaggcttgcctgaggctactacaccaaaaaaaaaggttggatccacgtctaccaagaatcatataaaaataacgagcaattttattaatttaaaaataaaaaatcacatgtattttttttaaaaaaacatgtgatcaccaacaaaatgaattatttatgacaaaataaattatttttagaaaatagaaaacaatcacatgtcttttttttaaaaaaatgtaatcaccaacagaatgaatcgtgtttacatccaatttttttctattcattgtatgatttccgtctaattttttgagtgaaaacgattatgcgattggagtgcaatgaggttgatctgatagatagcgagaaacatttcttatattattgctactctttacaatatgtaaaaaaaaggtgtttatcaatatcaagtaccaaaaaataaccatgtattgcaaccaactcataataatacatgacaaaagtaaatactttttgggtttcaaactttagtctataatacataattttattttaaagtggtaataatacttttcctataatcattcatgtcaatggatttagatcaacaaataattatgtcatgttagcatcttacttacaccggaaagattcgatttgctcctacacacccattactattgtttttgggactatctagagaactgtcgaaagttttttatggagaaaactttcaaatctaactataatataattacaatataatttcactatagctataatgtaactcatatataagtattaaaataatatatgtataatatagttacagtgcagtagttacaatgtagttataactaaaatgtaactcatttaacttttccaaaacatgcagcagatcaagtggctagcacgcatggcttccaggatggggaccctgtgttcgagcctctgcaagcacacgtgtacagatttttttttccaaatctcgcgcggatcgcatggctagaaaatcatctcgcgcggatcgtacagccagaaaatcgaatcgcacagctagaaaatcatctcgcgcggatcgtacggccagaaaatcgaaagtttttagcctccaaaactgtcgacagctagccagcaaaaccattgttttttttatgtttcacccaatgcaacgcatgggcattttgctagtaaataaataattcccagaacaaggctcccattagaaatttgaaatgtgggcatgtgggccgcggacttgagaggccgtattaacttgggctcttggattacaaatcatcccgtattgtaaaggagagatcgttggcccatattgttaaggagagatttgtctccgagccaattccagccggaaattctccctcctcatagcctcgcgcagtcgcgctagctgacggccacggcgccggcgccgaagctcgcgtgtgctacttgtttccgtaattccgtctcgcacccgctcgcgctcactgtcacatgccgttgccttcggtacgcaactgtgactcccaccctcgctaatctaatctgagttgttacttgtcagtgctccggcttgtccttgatttgtttgctgttgctgtcatcttccgtgcagtgcaggctccgtatgcggcattggtcgctccagcgtaattgtcgatggggcctcaccgaggagctcaagtttagagtggtaagtgtttttgttttttttttcagatctctgacgatttttattctattcacgtatttctctttgtgaatttcagtatcagggatggttcaggatgtcgttggtttgagggttctaatgcagctgaaaatgtccctgtatcttctttactagctgatgaatgtggcttgtctagatagtaatggctacatattgttatcacctattatattggagctagggtttgaaatttcgtttcgaaagttccgaaattttgctccccaccggaaagttcacatctcgcctgaaattttaggttttttttttttgcaaaagtttctgaatttggtcaaaaatttattcaaattctttcaaaatcagtcaaaatttcaaataattttggccaaaatttttcaaaatttccgaaatttcggtcccctagtagaaaaaccaatttcaaatcagactgaaatttcggatccctccgatacgatattattttggcccaatttttttattttcttgaattttggtaatatttgttcaaaagtttataaaattcaccatatcggcacccccatacaaataccgaaaacgaaagattgaaccctaccggtaattatatatttccttgtttgccattgatttattaaggttttattataccattttttgcttgcattagtatcatcatctcatgattgataaattaatagcatccgttctataaaacttagagttcaattcaacaaatttagtcgaacttttaaaattctaaccattaattttatcagattgttaattattgcttttctagggccataaaggtggaaatagttcaatggaagcaaggtcgacattctggttcctctgagaagggtttgaataagaagtagaaggttaacatgcttccgaggctaaaatttttcggcttcactcgatcaagaagtaacatactatgctctctctgtatgagagacagtttattatcataatgtgttctttccgttcttttttgtgtggaccttgttctgacatatggtgatcctttagtaatggctttaccattttgtttttaatgtggttctggaagatgtaaaaccctgtatagctccaaacatgcatcctgggtcctcgttttcttcagcattactgaagttctagaagtacaataggcttacgcaaacggcaagtaagaaatttttgtttaggtgtctttcaatattgggttaaatttcacgaattaaaagttaacaaatgtggatcaaattcaccattctgaccttgatgtacagtatacagctcacagtcacatgcattcccttgtatgaggtttgcttttaactaacagggagatgagccgcgggaaatttattgaaccttcaaaacaaccttgacatatatgcatattttttttcgcgaacgcacaaaagattgcacgtcaatatattagaggaatagagtttttgttacacaccgcaattggccagaccggcctatgccagggaaggggaaaaacaaagtcaaaaaaacaaggaagagaaaaaagaaaaagaaaaactcgaacgctactccaaacaacgagagggggcagagccacgctacactcccaacaagtccccaaaggaagtgatgaaccttgagttcctctcgacactcaaggctattgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaatagaaatttaatacaaatgataagttggggtttcgaatacaagcagacggacggtctagccgatacgcgcgctgcaagcgaagtagcaatggctaaactttcatctaaacaaaacccaagaaaccctgaaggggtaactagctatatataggggtgggaggacgacctaggggtgcctagggtcgtgctccaccagcttggggcgcaccccacatgggcctcacctgggccagggtcccaaatgaggttacaagcccataggcccattacaggtgtcacagcaccttgtttcttcagttgctaccgactgagatggaatttggcaatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttggtatcttgttgttcatccatgatgtgagcaacggatgtatccgtagtagccatggtcacatcatcctccccttcttcacggaaaaccgtcctcggtttttccatatggtgttcttcatatagtccattcaaaataacctgtttcatccaatcaaaactagagaaactcgaaatagtgtgattagcaataacatgtttctctaaatccaaacaaatgaaaactctatgcaccaaatatattcctctatcattatatttgccaaagatatgaaaaatagcattagttagacatggcaaatcagacttagcaaataatttctccttcaaattatcgagctcacaaaaatcatcaaactgaacatagcccaaagtatttaaagaagatagcaatttacgttcctcaacttcattaacaatatgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaaggaattccagcatttggttccactaacggttgctctacttttgcatgaaaagtggacaaatttacttcgttaacaatgcactcaccttgattaatttcagtaccatttactttaccttggatgtcctctttagatgatggaggtgtctcgaacttgagtgtgaacaatggaattggtggctctttcatgtctctctcctcctttttgtgattacgcacttcctgcaaatagttagtaattggaggcaaagacatagcgtgtttctttttcatatcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaatgtaataaacaagcttgcatatcatgatagtatgaagtaacagttctggtatcttgttttaaacattgtagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgataagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcatatccctgccattgttagtagaaaacaagaaacatacacaaaaatatgcgcgttcctattaactactaggtagtggcagctcaaaaatcgcacacactcaagcttttaaccaaactcttacaagatcttaccaatgcaagtggaatggtgacatataccgactcaaccaagcaccccaatgaaggttggatgtatcgatgccttggcaaacacttgcggtaggctgtaatcaaatatgtggagctctgggtagggttaaatatgtagcaaaggaatagcaaatgctcaaatcagataatgcaaagttgaataattgttcaaagtcaagtaccgtgctggtcctaggctagaacgtactagagacaaacgataccacaagatagcactaggaacaactcatgcacaactctgatatatgaagtttagctcaaacataacagtattttctcttttctttctttcttctttcttctttctttttttttccttttcttttctgtttttttttgtgtggctttttttttctctttttttttgcacctttctgcctttttttttctcacttttttcttgatttttttaaacaaaaactgactcaaggaccttaatgtaagattacagggactcaaacataaatataaaatttacagggactcaaatataaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaattgagggagggggtcggactcggccaaaggggcgagtgggactcggcaaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccttggcaacgagccgattccgttttcgtaggtcccgacaacaacagagacacggtggcagcgacgactgtggtacaaaacgtgaccagaactcgaaactctaaacgaactagacgctaagaccagcaacacgacatgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctattgttggctcgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggtttcgaatacaagcagacggacggtctagccgacacgcgcgctgcaagcgaagtagcaatggctaaactttcatctaaacaaaacccaagaaaccctgaaggggtaactagctatatataggggtgggaggatgacctaggggtgcctagggtcgtgctccaccagcttggggcgcaccccacatgggccccacctgggccggggtcccaaatgaggttacaagcccataggcccattacaggtgtcacagcaccttgtttcttcagttgctgccgactgagatggaatttggcaatgaggcttgatgcattggaaagaggactccgagagctttccatcaagtactcacgggctgaaaacggaggtcgtatggagcttcggcggtcgtttgaagtcagcagtgtagcaggtggccgaattggattttggcacttggaggactcgaacttgatatcttattgttcatccatgatgtgagcaacggatgtatccgtagtagccatggtcacatcaggaagcaacgcccgctaacgaccacaaccggccctccgacaggatggactctaggaccactgagaccgaagagagcacagagtcaaacaccctggaattacgttccttccatagctgccacgagacataccggtctcttaaggtatgataccttggaaattattgtcactaaggtctaaatgcttgagcttttgaagctttataaaactggatggtatgttaccatcaagattgttgtgactaaggtctagttgaacgaggtttcgaagctttcccacattgtacggtatactaccatgaagattgttgtaactaaagttgagacgatctagctgccgaagatttcctaagttggctggtatttgaccatctaagctattctttcccaaagaaaattgtatcaagttagtaagatcaccgatggatgatggtattgacccggtgaaattgttctcctggagatatagaagttctagattcctcagttttcctacccattcttcgattgtgccaataagattgtttttacttagccacaaactagttaggccatgaaggttccctatactcggtggaaccactcctacaaaatggtttacacccaaattcagatattgcagattggtggataggttaccaatcgagcttggtatatctccttttatttgattacgagctaggttgagtgcttgaagaagggtacaatttgcaaatgcgtgtaaccatttttcattgtcacttgcttcgagatggttacccgctagatacaaatcggacagatttgcaagctcactgagataactaggaacctggccatagaaattgttgtttgtcaagtctatcaaccatagccccgaagcgttgataagggaagttggtatatgaccttcaaacatattcctcgctaaggaaaggaattggagattagggagcacatcgccaatgttgggtggcagtgcttctttccctagcatgttatcactcaaccataaagtctgtagagaagacagattgaacagttcatgtggaagtcggcctgatatgttgttcataaaaatgttcaatgacaacaaatctgacaatttcccaagctcacggggaatgcttccctcgagatggtttatttgaagagagagatagtttaggccggtaatgttgccaagggtgggagggatggttcctgtgaatgaattattggaaagacataagctcgagaggttcgttagaaggcccaatttggtgggaatttcaccaacaagagaattcgaggagagatccaacacccttagtctcgaacagtttgcaagcccctctggaatagtatcacgcagtgagttatgcctaagatccaggactttcagtctgtggagatggttcagcggaggcaatttgccggagaaatggtttgaagagaagttgagtgccttgagaaacgtgaggttcccaagggaggagctgattgtgccggacagggagagtttgaagagattcagcgccgtgacgcgcccagggtgcctccggctgcagctaacgccggtccactggcagaaggggacgcttgcgttccacgagctcatcgcttgcgttggatcttccgttatatgcttcttgaaatccatcagggagagcagatcagctgtgttgttcagagttgcttcacaacggatgctgccagctccgtaagacagcagcaacagcagcaaaaacgccagaaatgcagccatattcagaggatgattttggtttcaaaagatccagaggatggttggcctcagcgccttccttatctgccaaacgtaaagcgtgaacatttcagcacaaaagtacaatacgatagcagtaatttaacactagagatgtatttccagcaggagcagacgatcgatgagacgactttgcgatgaatggttaacatgcgcgataaattgcataaataaatatcgagagatcagaatgcacctcgcccggcgtgtttgcttccgccttgttcagtgcagaggttggaaactcgcttgctcgtaggctcgtagctaacgcggcgaaaggtacgcatgcacctggcacaccctatccggtataaaaacagcttgaacgggcgggcgtacctcagcttcgcttgatatcatgccttaggctgtgtttggatgccccctttcccaacccctctccctcgttttccgcgtacacgtttttcaaactgctaaacggtgtgttttttgcaaaaagtttttatacgaaagttacataaaaaatcaaattaatccattttttgaaaaaaaaaattccaaatgggaacggcttctagcgaacacactcttagcaggtacgatagcagactatataagtcaaccgtaagcacatatcaagaagataaataagaagagataagaatagcgagctataaatttatagtcagctgtagcacatactacaaatgtaatatgtgtatgacaggtgaaaccaggtactacttgtgtaatactctctccgtcccaaaaattaagaaattttagagttggatacggttattaaaaaagtaggtagaagtaaacggtgaagggttgtgattgaatgagtagtggaggtaggtgagaaaaatgaatggtgggagagttgtgattggttggaaagagaatgttggtggagaagttgttatattttgggataaattctaagggctaaaatttgttatattttaggacagagagagtatatattttaggtaacgaattagctattaaattgactatagatgctttggagctactagtaggctatactgttaaacttgctttattacattgcaagcaatgaatttcagttcttcaaacttttatttccttttgctttttaggcaataaaccacggccgcaccgcacttctggtggaaccatcacagattcacaggtgttcaaagaagagctgacacaacttgcaacagactgcttgaaaacaaaaggtaacggaggaacttccgatgctatttaaggtgaattgaaatcatttggtacttaagaaaaattgaatgcactggataattaaaccaccaagaacataaacgatattttcataattattatttacacgtaaacttcagagtaaatttcaaaaaactaaaagatatagtgaacaaactatcacagaactatagatctaagatgatatattagaaaactgtagatttaacatcaaatttatcgtaaaactaccaatttaaggtggagtattgtaaaattaaagatttagtaatagagttatcataaagagtaattttaccatccaacatttagtaccttaagttatcataaatttttttagtacctcaagatactttttagtgtaaaatttggtatctctcaaataaaatttagtccctcaaggtagttagtaccaaaattttgtgtgcaaaatatggtacctcgaggtaccaaatgttggatggtaaaatcgctctatcacaaaattacatattttgcgttaatttaatcacaaaacttggaggcctataactcaaacataatgggcatgttcggctgcacttaactttactgttgtgtagccaacacaaacagtacgttgtgtctgcagctgcagcagcaacggctgcgtatagtggctgtaccagctagctgaacagacccaatgttagtgctaagaatttaaacgctaaaatatgtagttttgttatagttttatttttaaatatgtagttttgtgatatttagccataaatatatagttttataatatatcatcttaaatgtgtagttttggataattggttaacctctgtagttttgtgaaatttgctctaaactttatatattatatttatccattatgttattagaaactttatatattattcactatgagggcttgcaaactttcatactggccaaagcggaggaaaaatgatctttttttccatcaaatacatcatcatttagtagtttgataaacatgctaacggataacgagaaagttgctaaaactaacggcataaaacaacggggcctaaagcaacttttaatatagctaagagcagtttcatgaaaacgtcaactagttttagataatttataaacatgcataataggtttgcctattcatatggttcaaatatctatctccactactgtaataatactacaagaataggttttgtttgtccatcgacgcgcaaagtttcggtccacacttcatgtaaaaaacaccctttctggatgaacatctggttcattctttctctaagattccattacaacgcacaagcactgtataatttgttaattacttcttccgtttcatattataaaactttctagcattacctacatttatataaatgttaataaatgtgtctagattcattaacatctatataaatatgagcaatactataaagccatataatatgaaacggagcgagtaacatacaatattctttttctcctcataggcttgcctttatctcatactaataacatactcgtacgttgttaaagtgatgaaggatgataactctgctttttagtactccctgttctatattttagtatttccattcttcgtatagattcactaatatatatgtgatatacatatgaaacacatatataaatccatacataaatttatttaaatctcaaaacattttataatccaaaactgatatagtggtatagaaaaactacacggcattccctcttaaatactaaggctgtgttcggtactttgctttcccaactccccctctgaaatacgaaagttgctttaaaaaatcatattgatctataggtttttcgttttccgtgcatgggatatgggttttcaacacccgcccccgaacacagcctaagagactaatgtcacgccatttcttaagtactagttaagccactgaattgtctagatttgtcaggtttccaataaatcatccaagtggtacaacccactgtcattatcctccgatagaaagctgttaatattatccagtcgacagcatgtacagatttaaggaacgaaagttccctgatgtagagataccgaatgattgtggagaggtcgccgattgaattcgggataaaaccgcgtagcagattattactccctaatgtataacgccattaactttttaacaaacgttcgacatttcgtcttattcaaaaaatttatgtaattataatttattttattgtgacttgatttatcatcaaatgttctttaaacatgacataagtatttttatatttgcataaaaaatttgaataagacgagtagtcaaacattggttaaaaagtcaacggcgtcatacattaaaatatggatggagtgctagctagcgacaatatttgcagaaagctagctttgtctgccagtagcttcaagtttgttttcaactccgcatctatccagtcaatatgacctaggtttggaacctttgagcaactccaacagattgattatcccactcttcaaaccaaacaatataaaacataataaaaaaataaggtctcactggccatttaaatgactaagccatctcactggccaaatacccaggtgggctggtcaaatctagccagccggtttagctggccaaaccatagtatcgaagcagtgctagtgagaattttctttaaaaagataataatagtattttaataaaagaatttgtaaaagtggagatggaccgtcagaaatcataaatttagtatcatatcgaccaaccaaagtttgatatggcacatatcgaagaactacggtttgatatgtgacctctcggtatgtggttgttcgataggttgataatttgattaaaaaaataaagaatacatgtcctaagcttgtttggccggataaaataaataaatgtgcatgacgcgaccaatcgaacttgcgaagttcgatatgtcctcctcaccgaattaaggaaaaaaagaagagtgtgcatgtatgatggccaatcgaactacgatagttcgatatatcctagctactgttcagagtaggattgattgcttttatgtttttttaatcatgccaacatcacctgtcgaaccaccacagtttgaattatggttgttcgacatgtgctaaatttgttatttcatccaacaggaatttatttttatatctttttattaaaaagctattatttttgaaaaaaaaaatcagctagtgacagcactttctaagtagctacctcgctcccaccgcctcctccccatcaacagttcctccatctctccgtatccaatcttatcattgctgccaccgtcttcctcatcttgaggaagacagccccgttgtcaccctggttgtcgactcgaaggcaggacaacgagaaggaggacggcaagccggagcctcctcccgcgctcctatgttgcctcgtccccatcttcgtcgccaccatctcttgcatcatcccctacccctatcgttggaatcaaatggagatgctggcaccaacaccgccaccagcctcccctgcatcacttgtcgccaccagtgaagaaggaggcctccaacaccgctgtacaccttggcggcagtatcccttgcgccgtcatcaccgtcacccccacccacgagccttgcctcaagcagccgctgaccgttgccaccacctccctatccggtgcaacaacgtagttgccacccggccccaccggcgccaccatagtcatcaacatatgtgaccctaggccaccatcaccccaccccttcctcctcgtcgtcatccagcttccaccatctcacctctcttctcaccctcttacacggtcgatcagttgcggcggtgacggcttgggcgacaacaggacagttggttgcggcggcggcttgggcagaggaggcggaggtggggaaagaacagcaatgtcctactagtggacaaccgaaagcggaagagaattttggagggaggaaagtatatacacactgacatgtgggaccgattgttagattgaagagtgtaaatagagaagctattagagtaaaaataaaattgtttctctattcggtatgtaagctgtggctaaataaatatttggagaatcagatttggataagctgttgaataggagtatgctcttaccagcataccgaaagacgtataggaatttctcccaaaaaattgttgttatccaaatctaaccttcctagtactgaaacattgcctagggaagctgccttcaaacatgttgtaactcagcaaaattaaagcacatctgcaagaccaggactactactcacaccaactgctgagataaaatgtttacgcacacgccctgggtgattcgggctggcggtggtgtggacgcttgtgttccagcggctcaatgctccaccctactggatcactggtgatgcatcgtggatctcaactcgatcgatcccattatcccaacctcttcatgtcttccactatcttttcgagggaatcacttagccacttcgctggatgatggtgaagtggggagaggacgggagggagaagggaaagcccttctcgcaccgcacggcacgacggccttttgctgcctgctttaattcgcttttgctgttgcctctagcttagcttagcttggccgccaatcgtctcggtgaaaagagagcttgaccgctgccattgtagcggagaccaccttgcatcggtgccaggatgatgaaccattgtagggtgtgtttggctcacggttacgtatggatgggatatgaccaaacatattttattcgatatggcgatccaattttttttgtttggtttgtatggataggatgatcaaatttcttgtttggttggagggatatagcttggatgggaaaagctaaaagttagtgggacccggcccatttgtcatatatatatttttatcaaaatattatcatccgatatcttattttaaagatttaatatagcggcccgcacagattgcgcggctagcattattatattttctctcatataatagcatatatatgttttctcaacgtattatttaaatatattgaaatgacaatataattttaaattttgtactaactttacgaaactactaatgtgtaatattcatattgtattttatatacgtgttagttactcattatttttaatatcaaattttagttatttgtaaattatattcctatatgaactctagactcgtctttcaatatttctttttttttaattccaaattttcgttatctttatttctatataggctctaggctctcttcaaatattattttttttaattctgaatttttattatttctaattgtatttctatatagattctaaactcatcttttaatattctttaatttttaatttcgaatttcagttacttctaaattgtattcctgtattgactttagattcttcttcccatgtttttttaaatttcaaattttagttatttgtaaattgtatttttatacgaactctaaactctacttttaattttattatgtttattccaaattttagttagttttaaattccaatatggactctatactctacttctaatattccttatttttaattttgaatttctattatttcttaattgtatttcgatatggactttagtctcctcttccaatattccttattttgtaattctgaatttcaactatttctaaagtctatatatatatatatatatatatatatatatatatatatatatatatatatatatatatatatatatatatatatatatgacacctatttgctactatcgggagtagttactccctccgcttattggatcgggttagtggaataacccataatccgataatatttgcacaaaatattagcttgtagttagttcaaataatttctaaatcatcggttgcatgcaaaccaattttaaaaaccggtagaacgtcagctaaaaaaatggcagaacataactgttttgaaaatatcgttggcagaacataatgtgaatcgggaaaggagcagaacatggaaaaaaaaaacgcggacagaagatattctgctcatatgaaaaaaaatttaagcggacagaagatatcctgctcatccaattaggagcagaatagaactggaaagagagcagaagatcgagcagaaattctgtttgaaaggacgcagaacatcagctgtttggcggcacatgaaattgttgatgttctgctcttttcaaattgattttctgctactagccagcagaagattatgtatgcgcatcaactaaaaaattggcagagcatcaactaaaaaaaatggcagaaactaatctgcatcagagaagtatgcatgcgcatgcagcagaagctaatctcccgttccttaaactatggatatgtaatagaatagcttctggtccttcaaacgatttaatctactactagagcaaggcccgtgcagaaacgagagcagaacattcctgcttcttctgcgcttgtagcagaacatggatcgtagtttctgcttgtgcttgtatttgggtttagagatgtagcagatcatggcacacggcagaactgggagcagaacatcacttctttttttgggtttagagatggacatgcactgatttggagcagagcatgatctgctatctgatttctgaggagcagaacatgttgcagatttggtagagatgtagcagaacatggcgtacagcagcagaactgggagcagaacatgacttcttaatttcttatcgcctaattacatttacaccagcatgatagtttctggtgaaaacagaactagagccaccaccacctgatacatttgcacctgctgcaggactgcaaagttgctgcaaatgcaaaacataaagaaagcgaattaggagcagaaacgatcaagaaaggaatcgagatcaggaaaagaatccaaaagatgaaaaaaataacagatgaatatgataacaaaccttggaactggaatcctccatgccagggctttcaccgttatctgcaacacagccgccggcgaggctacaaatctgacttcagttgggttatgaaccctccaaacgcagagaacaattttagatcgataatgttctgctcttccttaacgacggaaaaaatatcctgctttctcactttggataaacaaacacaagtttcaaatttcatatctacaacaaactcgggaggcttcgttcaattgttggatctactgtagaagataaacgaccttctgttgaccaccgagaaaaataaaagctggagggagtattcgattcattagacccggtaacagtcattggcattagtagcgatcgaattgagggcgcatagggagggagtagctactcccggtagtagtatataattttcctactaccgggagtagttaccggaaatgctagctagcgattgatcgctaggggtagctagcagcgatcagattagattttctcccctccacctggttttcttttttggcaccgcattactttcctattttaataaatttatgcacctaaagtttatacaccttaagtttacacatctaaagtttagagattcaaagtttataaattaaaagtttatatatccgatttaaatttaaatttgaattcaaatatttttatatatatagtatttctatacatctaaagtttatagacccaaagtttataactcaaaagtttatatacccgattcaaatttgaatttgaaatatatccgattcaaatttgaatttgaattcaaatatcctatttaaatttaaatttgaattcaaatattttttttatatatagtatttctatacatctaaagtttatacacctaaagtttatacacctaaattttatagacctaaagtttatatatccgattcaaatttgaatttgaattcaaatatttttcatatatagtatttctatacatctaaagtttatacacctaaagtttatagacataaagtttatagacctaaagtttatatacccgattcaaatttgaatttgaattcaaatattttctatatatagtatttctatatatctaaagtttatacacctaaagtttatagacccaaagtttataagtcaaaagtttacatacccgattcaaatttgaatttgaattcaaatattagtttatagacccaaagtttataagtcaaatattaaatttacatatttatggtgtagtaggaagagaaaaaggggaggaggaaggggggagaggagggagcattggagtaaggggagggccgggagagggagagcgatcacccgcctattaggtgtccccagtagttactcctatcccttagcggatcgggttagtggaataacagaccgagctgtttaattaagtaattaactaaatgatttattagttcagataagtgctaaatcatcggctgcatgcaaatcaacattcggatggagtttcttcctcacgcgtgctcgccttggcagaatatgctctgcttctgataggcaaaagatatatagcccgccaattgaaaaaaatggcagaacatcaggaaaaaaaatggcagaacatcatcgggaaaataaatgttggcacaacaaatactaaaattttctctatgtaacggcagtacatattatgcctattgattactaattgtagtttattatgtgtacgtacttaaataaaacgtatttcatattttgcatatctgaatttctgctcgggatagtttctgcttgtataaatgtacaacacacagccgaggtaagggatgaaactcttctgcacagaatttacggcagaacagaatttgtgcagcagaaagctataatcccgctcctgaatcaatggatagtaggataacagaatatcttctgctctttcacaaactgattccattcactattagacatacgactaggaagaaacaatggcagaacatcttttcctccccaacccataattcgtgacttctaatctgttgtgtccataagtccattcaggtcatttacaatttgtaagaacgtagaatatagagcaaggaatacaaagtgcagaataccttctgcctgttaaactgaatctcatcgtctatatgaagcttataaaacttgaaaatgagcagaaacaggaaaggaggcaggcagtatgtgagtatgtgacccgggaaaggagcagaacatcgattagaaagggagcagaaaaataatttgaacagaagcagaacatcttctgctcctccaacaaaatcatcactaagcagaagacgttaagaaggcagaaaattttctgctcgttgtagttttactcattgctagttttgcggccagtcgttgcacgcatggttatgaacggcatgtgcagcacacaaggagaacaacatcagttaggaaggaagcagaacatcgttttcgaaatagatcagaacatcaatcggcttaatataacaatctgcaacgctaacaaaaatatgcagaatataacaaaaagcaaaaactcttctcgacagaaactcgtcaagaccttctgctcggtttttaaatgcacatgcatgtgtaagaaaaaaaaaacctagattaaaacggagcagaaggttggtacgttcgatttctgctccgtacgttcgtttgtgtgctgccgatagtcaagccataatctagtatttagttatttatttgttaattgtttaattcaataaaccattacgtggactggttggttaatggatccccttcattaaatttgtttggagctccatggtgcgcgggctccatgattcaaattgcgtatatactcaattcaaatgagtatgaaatttttttaaatgtttaggtgttaacattaactactttactaactagttcaaaacaagtttgaactaaatttaaacatgtttttgttagattttgattctaggtatatagcatctaaacatataattagttaggtatgtaatattggattgtaaaataaagttaaatttgagttgttttgttgctaggtatatgtatgaatagaaaacttataactaggtatatactcacaatttgaaaattttgaaaaatttggacgaatttgtgtatttcataccatggtgcccgggcaattattatttagagtagttaaatatcatgcaaacataacatatcatttgcattttgttgtaattttagaactcaatatgcaagccatatcaaatcattatctccacatctttttcacattattcaaacatatatatatatatatatatatatatctattattttcataatgtataacatgtatttacccacctattctacaacaaaacgttgggtatcaatcagttgatttaagcctatagggcaataaattgagaacaagagaatgggaaaagacattaaaaaaagagagagaatgtaaaagactagagtgcccttgagacaccaagacacacgttgacacgtacccttgggcctaaagagagatagtacagcgataactgataagtgggcataaaaggtatatgaacgtactggtcacgcactaatggcatgttaagcatagaaacctttgagactgttataactaaggtccaagcgactgagttgacgaaggtttgccagactggatggtattttgccaccaaaattattgtggctaaggtccagctgcctgagcttaggaaggtttcccaagctgcgaggtactttgccactgagattattgtgactgaggtccaacaggacgagctgttgaagatttgccacgctagatggtacttcaccatggaggtagttgttgccgaggttcagccatacgagctgttgaagatctccaaacttggatggtatatcaccttgaagattgttgttactgagattaaagctcactagccgctgaagatttcccaagctgggtggcatcttgccttttagattattgtaactaaggtccagctgtgtgagttgttgaagatttcccatgttggacggtatgtgtcctgatagattgtttccgtccaaaagcaggtactgaaggttgacagacaggttcgaaagcttaccgagagagctaggaatttgcccagagaaattgttctctgacagatatatcaaatgtagctgtgaaatgttgccaagggatcctggtatgttaccttgaaacatgttaacacccaataagagccattggagattaggaagggcatagccaatgtttgacggcaacgatttccccagaaaattcatctccaagaatagcattcgaagagaagagagattataaagggcgcgtggaatttcacctgatatgatatttacactcaggtccaacgacgacaatttcgacaacttcccgagctcagaaggaatgtgccccgagagataattacgagaaagcacgagatccgacagctcagagaggagtcctatgccgaggggaatctggccttgaaataagtttatgctcaaatctagctgcgtcaaactggaacagtttgtaagcgtgtccggaatgatcccgtccaaaatattgttactcaggttgaggacttgcaattttcggagactgttcaggcgaggtatctgcccagagaagcgattaccagaaaggtcaagcaggtgaaggtaactcagattcccgagagaagcggcggcgagtcgaccggtcaagttctggccggcgagctcgagcgccgtgacgcgatgctcccggcggccgcatttcacgccattccaccggcagaaaggggtggttttgttccaggagctcaggacgcccgccggatcgtcgccgatggcatccttgaactcgagcagcgcgagcatgtcggagtcgtttccatggaccgccacgacgcagtggatgttgccggctgagtagcagaggagtactaacgccgcaaacaaagctacgagcatggcgagctacctgcacagtggtaaagcaagaaatacttagtacaggataaagcttttaaaaagctaccagtagcagctatattaaaaaggttatgaggatatcagcaccggcctgcacggctgcagttggtctcggttggaatctgactgtggatatgatctccgaacctctcgtgctacattttcgaaggaatcgtcgtcgcttcgtcagttgatttttctcgggctggcaccgtcgcgcacggcatggcggtctttctcgccgccttcatggcttgaccgccattgcagcggagacgaccttgaccccacaaaattttgagaaaatctcctgtaccctcgaaaattcgtttaatccccttacgtgcccataaattttatcccgttccccttgtgtgcccataaatcttgtcccgttccttatatacccctaagttcttactttgatcttctctatatccatttcgttaaatgtttttgaaattgactatattatctctctcttatacttatgtgctagtttagtgataaaaacacaattcttatatgaaaaagatctatttgtaaaaaaacaaagggaatataattatttgacaataaattttaaaaacaaatctaaaattttaaataaatttaaattaacttttatgaaactggtacactgttttcatcaaaatttgaatctaataaataaataattttggttcataatttctagctaaaactcatatggatttgtaaaaaaatgttcaacaatttaaattttcttttacatattttacaaaaaaaataattatgccccatttgattttatcatgaattacaattttttcacattgtgaattatggagtagatagcatgtaagtatgggaaatgggcgacatgatcattttagaaaaatctaacagtcaactaacggaatagggatagaagagatcaaaataaaaactcaagggcatatagagttttgagacaaaatttaggggtatagaagagattatgaaacttttcaggggtatgtagggaattttcaccaaaattttccctagcttcttccaaaattcatttctaaaccgaattaccagatataagaagtccctcaatttacaaaatcagatcacccgatgtcctaggcagtattgtgaccgattttaggtgtcttggcaagctgagtcactacgagacccatgtggaccccatatgtcattagctatcactttctttctctcccctctcccttctcttctccttgtctgtccagaacttgatccagcgtcgggccttcccggttgctaggttgcacagtccaggctcctgtgggtgtgggtggtggacgacgacgtgggagacggcaccggtgaggccatcgacgcggagagctagtgttggaggagtgcgcagtggagcggctccgctatgaaggcgtggaggaggaacatcatgatgttcgcaccgtcgacggtgacgtcggatcactacactgggtacccaaaagtactggaggactatagtgattcaaactggatatctgatactaataagataaaggccacaagtggatatgtattcacacttggatatggcgctgttttctggaagtcttgaaagcagacgatcttaacgaggtcaacaatgaaagtagaactcacagctttagatactgcaacagttgaggccgagtggcttcgttagatcctgatggacttgtcggtggttgaaaaactagtaccagcaatcctgatgaactgtgataatcaaacagtaattattaaagtaaacaattcgaaggacaacatgaagtcatccaggcatgtacaaagaaaactgaagtttgtcagaaagcagaaaaactccagagtgatagcattggactatgtcaagacagctaaaaatctagcagatcagttcactaagggactatcacgtaatgcgatagacagtgcatcgagggagatgggtttgagacccacttgagttgcccaatagtggtaacctgtcctttgtgattggagatcccgtgaattaggatggagaaagaaactattgggtgactgagaggagagaccctgaaatgggctcatctctatgatgtacttctctcctattctgtatggaaggatggtatatacctcaatgtgatttgagtggcttttcgtaaagcagagatacctacagaacatcttagaaggaacatacctatataagtctaactgctagtcacagtctatgagatctagttgatctttatatactcatgaaaaggcttggaatatgatttatatgctccaaacaaaggggatgtaaacggcagcctagtaccagttaagagttcgagtgaaacctgatcgcacaaaactgacaattcaatgtatagtccattgttcagttgtgatctggtgtagctcttttcctaggtggaagtttaacttaacagtctccaccgaaacaatggtataacaaataggttcagttttaagaacatttcttgtgagccatgaaatttggtggggattattagaataaatgggctaggcccaatttaattcaattaaaatctcaagagcccacaagtaatgttagagacaatactgccgccttgaaaatttaggtggaagaatacggtgatattagagacaaataatacatatatattagagacaaataatacgtacgtagagagattaaaagaaagatgaataagaaatagtgtatactcatctgagtgtggatatgtgattcagaatttcatgtataaactaaaaacagtacacaccaccatccaggagatctggtggtagcggtaggccgccacggctgccttggcttgacatatatgaaatcaaatcacagctgatggtgaaattaaataacaaagctgctaagatcgagacgttttaatccttgcggcatcaactggagactgacggtgaaactaaataacaaagctgctaagatcgagacgttttaatccttgcggccggcatcaactggagaaagggagtagatcagcgcatcgctaaacacctagatctatactcattctgtcgagcggaaagggagtagatcagcgcatcgctaaatacctagacctatactcgttctgtcgagcggagccagacgatgccgtttcgtggtcctgcgacgccggcagggcagaagacagcaggccgatgtggatcacgccgtcgcttccgactcgctgtggacgccaaatcaacgatgtatcctgccctcatcgcatcgctgccaacccctccgaatatcgagctctccactgataactgatttatcgatcatccaatgagctggtatttatcgatccggttttccgattaccacgggttaattgagattacggattttttttcttgttaaaaatgaaaacgggtgactaaaatagatttttgctggcagccgacagtgccgccagcgaactaaaagccagtgaaaataatacattttcactaccggtcagccagccgccagggaaaatcgagtttaactggcgacatgttaagacaaccactagcaaaaataccatcttcgccagcggcaagttaaagatgaccgccagtgaaaacattttttagggttaaaaaaaattaaaaatcagcgccgctagtcgccacggccgcatgcactgcccattgacgaaccccaccacggcggctctcttgccactgttggtcgccgccgtcgaccctgaagaggggaggttcccctgtgccacccactatagatctagagaggagatgagctagacttccctgcgccacctcactctcccgagctcggctgttgccaccggatcagtcacccgcaggagtccccaccgctggtccgtatcctgcccgagtcgccacggccaccccatcccctttgccgccgccaatcgtcactgctgagcccggagagacgatactcccctttgtcaccccactccggaaatggagaggggaggagctaggctcccctacgccaccccactctgccgagcccgtccgccaccaccagatctgttactcacgcgcgggagttgctgccgccggtcaccgccaccacccctcctctttgctgccaccgaagccgctgctgctggacccgccgccggttgggagggatcggaggaggagaggagtaaggcggtggtgcgccggtgaggaaggagaagaggagaggtgtcgatctgaggagaggagaatgtggagtggatctgaggatttttgctgtgcgtggttttttaatgcactgtgactgattttttttatgaggcggtggattttaaaggcggtgctctttagtgaccgccagcgctggcagtcgcttaagagatccgcttgtaaaaatatcttaagtggccgccaacgaaaatcgatttttgctggcggttggtgtccgcaatccctcttaagtatctttacaagcgtgcatttattaaatccgccagtacaaataaaagggtggtgctatgaaaaatggtttctattgtagtgacggtaacaaaatacataggaaacttgattgaatactcgatcaatccatgacaatatatatcaggataacacattgacacagcgacgcccggttctttttcattaagatacatattttacctcggtttccattagcacactttttaaacagctaaatggcatgtttcgtgtgaatattttctatataaaagttgctataaaatatcaaataaattcaatttccaaatttgcaataattaaaacttaattaatcatatgctaatagctttttgtttttcatgccttacttaatattcattttcattagtatcaaacaccactcgagtccctcgcaaaccacagccctgctcaatcagttcccccgcatgtccacttacaacgcccacgttaagtggcctaggagatccgtgcggcacacctcactggtgatggtgctgctagcacgactgccatggggcatgcgatagcggcggcgtgtgagaaggataaccaagcgaaatactgcaatctgcagttgcgatggctaggggtgggcagaaaaagaccgaaccgaaaagaccgagaccgagaccgagaaattcggtcatcaattcggtcctaggtagtgaaagactgaattttgttcggtcaattcggttagtctcctcgggtaaccgaatagaccgaattatcaaaaattatctaaaaacaacctacaatccactatgtttaataggattaaactctaattttcacatccctacttcttctaggcatgcaacctaataagagtctttactcataaagtgcttacgaattttttttgtgatttttgtgttgaaaatttccattatttctttgcatatatgaaaatgttgttgaatttcggtcaggaccgagaccgaatttgttggtcttgatattttttcactgaaattcggtctttatttttcaaagaccgaaaagatcgaaagatcaaagaccgagaccgaaattttcggttagaccgaatgcccacccgtagcgatggcggtcaagttctacatggtcgaagttgtctcgacataagttatcgtacactcttgtcactcgcactcctcctgcacaatttgagcttcaatttatcgatgtctttgtggtgaaatcccgtggttctatctaatgattttatttgaatggattagggtccaatttactgacaaattaaagttttttcaccttcatgcttaagttgggaatttcagaatggtccagactgggctaccccgtccctctacacttatcgcacagatatgaccgaaaaaggactatgggagggacaattgggacaaacatcctaaggcccggtttagttctttttttttttttccaaaaacgttacattgaatcttgggacacatgcatgaagcattaaatattaataaaagaaaaaaactaattgcacagtttgcatggaaatcacgagacgaatctttttagactaattagttcatgattagctataagtactacagtaacccacatgtactaatgacggattaattaggctcaaaagattcgtctcgcggtttccaggcgagttatgaaattagtttttttattcgtgcccgaaaaccccttctgaaatcgggtcaaacgtccgatgtgacacccaaaaattttcttttcgcaaactaaacaacgcctaaatttgttaagcggctaaatatttagtactccgtagtttctaattaatccgttgcaacggacattttttcttcctcttaaagctacgggcatatttctggtcctcttaaagcaatggtcgtattttcgtcctaaaaaaaagaaagtaaaaaccttttcctctctctctctcctctcctcctcacgccgcgaacgcggatgcggccaccacctggccctgcgccggcgcggcggcggcggcggcggcggagtcctcccctcctctccctcttcccgctgtggggttcctgcaatctgcatttggtcagcaatggcggttctagccgctaggtgaggatctattcctaaatcctaaccctcccaccatgttcgtgaaagggtttttgggaaatgagcgtttaggatggtcgaattagagtactcgatttgactctggtagaaaaccctagaaagtttgcttccaaatttgctcttattttttcttgtgtgtgtgcgtgtgtgcatgtggcagaggaaatttaggaggttggatgtacccagatttggtattttctggtgctttacctacatcggtgccaaagttgtaatccaattttgaggccttcaggtgttgtggtatgctaggagcttaataaggtatctccatgtaacaggaatcatctatatgtggaatcatttgcatactgctctagcttttatgcgtcgatttaggttctgtggactagatttgaatatttgatagagtaatgtttctcttcttaaaattgtgggttcttcattgacttgattctctgccatgttagctactatttttaagtggatcagtgtgctggcctcatttgatgctctcaaagtgaatggataatacatcatatagtactaaagtcatgggcattggattggttgaagaaaataggattgtttctatgtcagagtacaaggttgcatcaattgtggtgctgtagtaatatcgagtagaaggggcttcgatagccatcatcagtgatgtgcttccaaaatggatatttcataatcttgaattctaaattgaaaattggaagtaccttatcgaaatgttaattggtcatgtcatcatagttccacaatgtttcttattatccttcttgtgcctgtgatgagactttgttctgttcattaatgtcggtggcagtgcaattgagggttgtgaaccctcttcaaagctttctgacgattctttctttgaaggaggggatgcaatattgacatctgaggatatagtttgaagaggtgactatccttcgctttaccactcagttcgatatggaaattccagctacaaaatcgatggtcttgctcctggagactatttctttgatctgcatttgctgagataatgaacacttacgggccagaaggaattagagcatttgatgtccttgtgctagaagaaaatgcaaacacagtattcatgaggctcttaattttgtatcacaatttattgtcaggtttagctaaacaatttgacttttgattgatgcacagattttgtctgaatttgatgtgtatgcagtggttggaggtaacagaccccttcatatgcgtgatattagggtaacagttgagagtgacggtgcctttgtcataaacttcaaaggagtaaggggaagtcccatggtttgtgccatttgtattcgaaaaacggtagcaatagcaggtaagacacaatatattagattcaacttactccttcaaggtctaattttcagataagatgtttctgtatgctcaccactgttttacattcctgacagaacaagtccttgatagacaagctgatcaactgagaagtgtttcccaaaagtacgaatatgccaataaattatgggcagctgccatatctaacttggaaaataaaatcaaggtaaaagcagatttactgaattgataaatacatgaggtgctatgttttactaattatatcactttttaattttcaggtcatgaaacaagagcaaacattgctatctcttgaagcaagatggccatgcaaacgctgttcctgaaccgagtaagatggtaggagctgttcaagcattaggttatatccatcagttgcattattgtaaaggttttagagtatttgatgaaaaagtttgtaagcatttttttttgctgcagttgtgcagtgtgaagatcttaaactgaagtactatgaagagatggccaagagaaagaaacttcataatattgtcgaggagaccaaaggtgcctcttctgatcttctcctctgtattatgatgctttcacttagtactatggatgttggtcgtcatgtactaccgactgtttcccatgtgcttgcattgtgctaatagatatttccagtgatgaacccagaacaaaaaaataccaagagtccaatacatacgaattatgtaactatttaccggtatactagttaacatggcgtaatttagctagaatttaataatttacccagggtcccaaaggatccctggaaacataacataggcacactgctggatacttctacgctttactccgtagtttttttcatattgcagtgtggttttgttttatagttttgctcgggcttaattgaaacataattagtcagcttgctcaactccatgttcgtccctaggtgcaggactgcagggagctgttgtaccgtccaactccacaaatatgggctgcttgcatggtcctcctgtgctggcaagggcatcggctggtactgcaggcttggccgctgcaaggggtgctggcgccgtcggcagggcccagctgttcctgctcccaagggacgaccatgactgttgcagccatagtggtggccacgctttgcaaggcagtgaatgtgaattaacgacatggtcagccacaaagcaggtctgcttggggattgccagattagcaaggtcaatttcattggtaacttcttgcagcccctcctctacatcgtcaatataatattttcagcaaaaatcaggaaaaatctggttgaaggatataatattttcagcaattgttgctaagcgcagtgatgtcttcaattggactacttgatcttttcttcacttctcgttttcttttggtaatggtagatttcagtattgcatgtcatggtactttagtgggagggaggaaagctctgcaagttatgaatcttagtatgtaggatggtatgagacgttagctaaaatcagtaatgttacagttcaagtagttttggattttatgccttagatcaaaatatgtcgctgccttctgaagcattttatttgatttgataaaatatgtcgctgccttctgaagcattttatttgatttgatgacaaacctattctgaaattttctttttcatttaatgactaacctgttctaatgctgtcttctaagacattttaatctgaacacacccacataatgcaagaacaggtcatttcggtcatttgtctaaatttataaatttgctttaacttcctttttcgttcacaaatttgttgctttgcaatcaatataaattcagacaaattttcaagctgttaatatatcaatgaccgctacatatcctatagcaactgattaaagcttctaataatggaaatatttactaaaatattttccttttctcagcattggaaattgttctggctgccacaccattaagtgcggtgagactgaatcttggagataaattaccgaagaactgaactctaattgtgagtgcctttgtactttctgttcttttaaccctggtggatcttgtttgtaactgggttttaaattcaatcacctttaacttgactcctgattgcgaaagaagtacatatgcagcgcaattccggtgaccaaggttcagattaactcatgtaaagcaagtctctaaaagtcatataaactgctctgatcgttttctttcttttttttaaaaaaaactcaggtttgcacttttggttgcatgtcaggctaattttgtccacagctctagtaattttgctcgtattgctcattggtctatgttttgtaatcctgtgagatttgtaaaacatagtctgaaatacaatgtcaagtaaatgatgctagccaaatttacacagttaaattttggctgtttcaataaatcttttacttgttaccggcatcattggcaaattgatggatgattacattataatatagattatttacagtagtggacagttcatctcgttatcgcacctacagaatttgtttgatataatgaaatgaacaaggatgtgaactacagttggtacactgattgctaagagaaatgcttgtaacaacatctatagtatttaggattctcagtaaatacctgaccacaacctgtactgactataattctcaacctgtggtggcctcaccgatctgttccacctggagaaatgcttgtaacaacatgtataatatttaggattctcagtaaatatctgaccacaacctgtactgactataattttcaacctgtggctgcctcgctgatctgttccacccggccctgaaggtgcaggtccgtcacctggtgcacttcgtcattggatcttcctcctcaactccgtcatgtgcagatccagcgcacggtgcgccaccgttgtgaatgtcaaaccggttcagcttgcgatcatccatcggcttcctcgacgtcgtccttgaaagcgaccctgtgcaggtttgccgaatgcactcccggtatcctctccctcctgtgccattatgtgcaatttttgtgctgcatttcgtgctgaatccgtgcaaagaaaaaggcttaatagttatcattcaattccattttttgaatggttttcagtttttcacatggattatgctctgctctctttcatttatgaaagatgcttatctcaatttacactaatctcttttactcggtgtatgcatatatttattctagcctgctagatgtatattgctagcgttcagaaagtatccacggaatgctattattcatctaaatataattgttcatatgtttttaggagctactggtttatctcatgaaatggcccgaataacacttgacgtgtaaaaagatcagaatgtgttataaattatcgttttttcatttcaccaaagtgtttttttggattacccacaaagagttattttttttatttcacatttctactatatgtatcataaagtttctcttttcttttctgtgcctaataggaaaacgttgattcgctgaaaacttcagcaaaggagcacttgaagaataagtgatcgctgtcttcgtcttgatgcaagcatatttcgtattttaccgtttgcaccatgttcttcacaagcaaatttgtcattgttggtagtcgatttttgaagataagccaggcacaagttgttgaactcagaggggggctgaattcttctacacaaattcccagattggacaaggggcagaagcagaagtattgatctgatcatatagagccttccatgtgagagcttgagtgcaaccagcagccggactgtattgtcgtatatcttctttgtcatcgaggtgcactgcattggtgacatcaggtcatgggaggtgagaaacaagttttggcgtgtgacactacgctggtcataggaaataaaacacaatatgagaagatcatacaacggcctgcttttccagtttgcagaaactgtgatggttttaggatttcttgttcttttgtgaagtttaagggttgaggagacagcaaggaagaggtagagtattttgagattggacttcatttaacgatttttttcctttcacctttgtctgttcctttatttaactttatttctttgcagtggcgagatgagactgtgtactagagatgcctactttgttgatatcttgagacagtgcaggtagatccaaatgctcacttcactaattcaatatatgtaaattatgcaaattactggcttatttaatttaagtttgattgctatgcatgtatatcctatagaaatccatttctttatattctattttaaggaacggtacactttctatagatattatttttaggaatcagaacaatatataatcattttatttgtttggtttgcattatcaaacggcaccatagccttagcatgggtattttattaggtagaaaagcaattctttcaaaacaaatatgacagttcttggtgaaactagcaggctgtaccttccaagagcaaaatacactaaaatgacagttcgttgagctttgcaaatcgtagttgtagccaacaacaaactttagtaaaatgcgcatttctaatctctgatatatagtttagttaaaaaaaaaactatctatgataatatgagctaatagcatttccaagacaaagtcaaatatttaagagtaatggaatctatttgctccgctctgcatttaattgaagtagagatttcttaatctggttggctatttgctcaggtgaaagcaaatatttgaatgatattatgtggaacatatggcaggttttggcacttgacaaacactttattgacccacgttgtttattaaatcccacacaagaagtaatgagagggcattataccattaacagatgctgtgcccattattccaagcgtaagttttattttatactggtgaaaatctggttttcattattttcttcgtaaatgccttgtgtgtaattcttgtacatattctccctttactgttattaatatatttgattcgtatgattctgtcctgtgttttattaaaaaaactaggatatcccctaaaaaatgctattagctgttacaatcttatcatgagcaagttatggtctgcacaaccagtaagtgattgctaatttcatgttaaaatgatggcatagagtagaatgaattgtacatttgtttacaagttaaaatttttgggttatttattcttgtatttgttaatacaatgatgtcctgttgccttgcttctataacatggcaataataggttgggatactcaatattgctaatggcaactatggctcagatttacctttaaaaaaataataggaaactactaaattaattttaatttatctttgtaatgaatgattttttgggattgtgtttttctgtccgtgtgtgtgttggggaggggggatgtgaatctgtgtctgtggttaggggcatgcgaatttggaaatttcaatacactgggaatgacaaattaatttgcattcttcatgtatgtggtatttctttcaagtacaatagtacattgatgatatatattcagatatttgcaaatttcttactgtaaaattccgttatcagcttatacctagcagaaccaatttattaaagggtaccaagataagttttttttttctagaaaggaagacaaatggaaaacctgctacaattaccaatttagaagctttaaaatacaaagggcaacaaacattctcctcctctctgcttgatacttttttggtattctaaactttgagtaacatcccttgattattttgaataacatttcttgatttgttaatcgatgcatttatatggattatacatgttcagtttgtaacctacaattgttttttgttcagaatttgatgttaagttttgtgtgttcgatgcttttgcttgtattttaaagctttaattctgcatttctgattggattttgagactctactttggtacttatgaagttccttttcattgaaatatgtttcttgcatggcaattaatttggtattgagtgttttttacctttgcccaacaaatactacttgtttcttactggatacttctatttggactaaacagattcagttctatatgcctacttttattaaagttgatgtttcttttttaatcatttgttgcttcacacttctatcagcattctaaagctttaatttggtatttctaatttattatccaaaaattacgatttgttttgtcattacttggtatcatccttgatacttttattgggattcagaaaatttagatttggtttttttaaatctggtactcagaaatatgatattctagttcacgcgtgacccttttaatttgtaattcgttttcccccaaaaaacactgaattggtttcttcctggacacttgtatttggattataaatgtttaccttattacttttttttttggctttttacaagctggtgcttccttttatccataaatacattctctagattttggactgaagctctatttgaactcttatgctttagcttggtacttttggttggatttttagagtttggtgttcctttgtcacgttcattttgcatcgatacttcaaatatcctttttggagtttccaattttttcgcttgtcacgtttcgtcttccttaattttgtttgaactttgatttctggtttatgataacaaaatgttcttgtgcattgaagacaaccgttttattttgttcttacgttaagtttgagcttaaaattgagttgtatagttgggtctccatgtttatcgaaaacaaataactttattgagagctggacccatgcattttgttgcaccttgaaggttttataaaaaatcatggtttccttgtatgaaatgtttctaattttctcccttgacgcttcattttccatcctttcatttaaaccttatgcttttcgttggatttctttattttcgaaagttctcttgtattaatgcttttgacatgctatttggactttaaaactttattttggtttctcgagtgatgttcgttttttcacccttgaatttcaacttggtactatctttttggaacttctctttggactttagaactttattttagttctgaaatctcaatttcttaagttttgtatgtatttatgtttactagttcgtgaaaagattgaacattgttttctagtttgtaaaaacaaaatattcttttgcattgaggactaattgatttattttgctcttataattgagttg

SEQ ID NO: 69865 - DNA, 1109 bp, Oryza sativa
agaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaa

SEQ ID NO: 69866 - DNA, 13890 bp, Oryza sativa
ttaaaaggtaaacagatcgcccatttcttagttaaacaattgaagtgctttgcttaacaaaaaattgtaaatgcgagtcccttaatagttgtcagacctgaagaactgatactgttacaaattctttttctttgagccacccaccagggacctcaaatgccaaagcaacatctgtgttctgtttttcaagaaaaatccagaataagaagaagaacctaaatgccatgagatggcataaataactttataaatgccttaccgatgaatcagcagttcttctatattccccaccaacataggtagactttggctttgctggtccagttacaccaggcatgtcagacagaagtggttcagcaatagataccaattcatatgatcaacacctgttgcagctagaacaattcggggagcagtgtaattctcctgacatccatacaacaacaaaaaaagtcaagttatcgaaagcatgttaacagctgtaaacagatagaatacgacaagggcttcggacatgagtctcacagctaagaagtattctaggacattcgtattcaatcggctaactgaggattctgaggcaatcagaggggttgccaaagcaccagataaccagtagaatgaagagcctccaaaagaaaagtttcagggttacttgaagcttctgcaagctctgccttcagtttcattatctacaaagataaataagtcagtaatgaacacatgttaatctacattacagatttacagacatggatggcatgatattacgaggaaatacctgttccttgacttcccaatcaagaaaagcaggattgcgtacacaatcaataagcacctcaaccatttcaggcatgtaagttttcagggctgcataactgtagctcatcatctcacggttagcagatgctttcacattgccacctactgcctcgatttcacgcacaacacgcaaatggctcctgtttgtagtggttgtataggccatcttcttcaacagctgagtggcacctagtgtttcaggtgcttcatgtacagaaccacaattaacatatactccaactgaacaagatggtccctgtaaagcaaatacaaagcagaacagtattgctaactgcccacagaaacatgcatgaagcagttagatcatagaaatgaggagcacatactggagttgtctcagaagcaatttttacaccatttgcaagtgttgtgatttttgtcttgccaggctccacaaggtcaggtagcggaggtggaatggtgacccctggaagtgtaaaatctggaggaggtaatgcatttgaccgtgcacctgtcagccaggtccagaagccacctgatgacctctgtgcaacacttgtgctagcacacctaatcgcaacattcaacatttgaccatccagtccatgccgctgaaaaaagaggtaacaacaaaaattatgatcggtagcacaagctgtattggcctgtataataaattcaactactccaaaaaccagctgtctctgcttgtgtactgtcagagttaagcagtgcatagcacaacaatatttctatgtacggaaatctaatccatgaagttactagcatcctcatttaaaaggggttttctaagtccaggcttctgcactatgcatgatacaaacgaaagagcagcaatctgatgtcgaatggaaaaaaaaaatcatcaacacaacgtttccagtcaagtgaaatcaaatatcaaagatttttagtaagcctatataagaaatgttgataacataggaagtgaatcatctaaagaaagttatctaaactcttcagggtcatacatctaactgtatatatcattgcattcagagtaatcaactaagggacaacaaaaaacagaaccaagcataaaagataaaactgatactctccatattgagcgataagccgataacctcctgctctcaggatgattttagccgcctaactcatgaagttcagcaataacgagggaatgaccaacccagaacctattaaaactcaacataatcctatttcagaaaaatgtatgccctcatcgcctttccacgcctttgcagaacgtcaactgagatcaaacgtatccaaaaaaaaggtatgctacaaaacaaatccgtaataacaaccctcatcgtcatatatcaaatccaggcttttcccaattcactaggcaaccacgatcgctagctgcgacgaggggctcatgacctcacgcgcacacatcaaatccacaccgaagctcgctcgatcagaccactaaagcgtaccattccaccacgcatcgcgaagcgataaccctaagggggattcggatcggacgcatcgtggggtgataccatcagatctagcgaaatggagcgaggtaaggttcacggtttggggcgggacgggtgcggctgaccttgatggccccgaggccggaggcggcgcggtacatggcgacccggtgcccgcggaggggtcgctcgtcggagtcgtcgccggcggcggcgcggcggcggaggcggaggcggagatggggaggaagcgaagggaaggcgagggcccgtcagacaagtggaaggggaagaaattcgaggcgctggtccgcatatagaagtgggcgagagctcttaaatgggccgggccgaataagaggaataattctgtggcgattgggcccactttggcccattttctagatgcgttgggccttacccctctcgcctctcgtgggctcgtggggagtcgtggccatctgatctctctcacaaagccatcctccgctgcgccggcgctcgccgagtcgccgccgttgatgcgccgccccggctcgacgtctccggcggcggagacgaaggcggaggcggctacgcggagggacggggtaggcgtgcgacggcgacggttgtgaggctaacggcgccggtcgaatcctccctcaaagtttgcagatgagttgcttgatcaaatgccgattagggatgtcacgcttgaacgtgcttgtgcgtttcgtattttttttctcccctttctagttattgctgttggtgtctagttaattttgtcgcatttgcaattacgtctggggatttgctcctcgcgtggtagatgacttccaatttccacggcattgagtgaagagagagtgatggtttctgtgctgaaatcatccccgggtgggtatgcaatgcaactgatctgaccaccaccacctgtttgagggaattccagtttcagttcataaattttagcgggtacatcttctgttctgtctgaaagatgtgtcgtgtgcaaagttgtcgcttgtcagaatggtccaaatctgcttgttgagctgtgggctttcgacagattcaggacaagctgccaaggacggctctagatttcgagcatgtgtttggtgtatgcgtagggttggtgtatggaggtagttggttattgtgggcgtttgtgtagggtcttaacagttattgctttgatgtttgatcagatcacgcttattaggtggaggacctgtacagattagtcatttgcgtacaggagattgtgtcaatgctctcgcaggagacttttattcgtgtcaatgatctatgcagccatgcaggagaccttttagagtgcttgtgagacctaacatccgttgatcattttaagagggacacatattaacttgattgtaatgtgccttgtatgagggagtagctgctagctatagttgttggccaaccacagcaatgcattttgttcctatggtctttggatagtgtactgtccaatgtcaataaaaattttcactattggtggttgtatgttaacacaattttcttgcagtccttaaaaggagggcaaaaactttgccttgtatatgttaatagagcaggagaactctcttgcattatcagtttgctatgcctcccagttaggatgtagcttacatcctgagaatagaccgccatatactgtgttattgtctgtgtacatccaattggatgtagaggccgggtttaacccattttctaaaaatactgtgccatttggtggtgtgcatttggagcaaaacagattcatattccttctatttaagttgttgttattgattccttgaacaaatatattatattcttcctgttttcgatggaaaagttttacattgcttgaagtaacacaatttctgaagcacctggacatgtctgtgagacagcacatccacttaactgatagtattccatagtattattctgcaccttcttgttttagtgcaagcatctcagatgggaaaaactgcctgcagttgtaaaatatctttgttgtcacaatttcctaccagcacgacattttcatttagttcctcatgtaatgtttcttctctcaataaggtagctgttgcagagtgatcagctaatgattgttggactcttcttgtcaattaggtaaatacttaaaataaccgtcaaggcatcaagggaagcatgtgctggcggattgtgcttgatgatgtttaaaagtcctcatggcgcatgggaggggaactgtgctgcctgtgctttgagcatgaccgcagcaggtgcaagccacggttttatgcatgatctttatatgctcttttatgaaatgaatttgttatgtgtcgtaaacttgtaactgttcctcgaaagctcaccacaaattgtagttagcctcttgtatttcctatcactttcatgcagcatgtataggttcaattggtccgcgtaaaactgcgacaggctaacatttttccccgcatgatgtctgtttttcatcttccttccccccattaggtggcaatgtgttttcaataaatatgttggtagaatatgtgctctgatttttactatatgcatacagattaaattgctcaaagaagatatggcttagtttaccagcttcagaaaactatgtctctcatatgtctacatgcacaggtgaacggtcagctcgtcagaaagagatcggttgaagttgtacgcctgaatgcgactgcgtcaattaatgtgattcaacagaagacatgaattgatcaagagagttgcatgtcgttcaggtactttactctttgacattttcttgattgatttggtatactctgctaatgaatagtggagtagtatacaattatatacgcatttatacgctgtgacttgtgatcatatttttgtacgtataccaagcaacacattgcaattattaattatgagcttgtgcaggtccgtcggttggccagaaccacgactccaagtgtacgtacgtttaccacacacaaacctcttattattccgagcaactcatgcctcgtgcggattatgtatagtcaatagtcatatggcctcatgggtgatattcatgaaaccccccgtgaggtgttcctaccatatcattttttttccctgataacgagacacatgattaagaatgtgtttgcctaatgatgctgatgaatctttgccctgccaaatgccaagacggccggggctatcccccctggaattttctcgcaggtgagcaagatgtcgtgtcgacattgggaggaggaggggttatcagggtcataatggctctgatttgggcatgcatgagaggcacaatgcaacacacggccgcggggtagagaggtggactgatcggagcaggcaggaaggcagctgctcgacggatgagcccgatttttccctgttcaggatttatttacagctcctggagtaaggcgtaagcgaaggcgaccgcgcgaggagagacacagaaggagaggaggaggacgatgctgttccagtccaggtacggttgaacctaaccgagctaaccttatcgccgctgtcaatgttctgcaacctggtttatggatgtgtttagttcgtgaaaagaaaatttttcggtgtcacgctagatgtttgatcggatgtcagaaggggtttccgaacacaaataaaaaaactaatttcataactcgtctggaaaccgtgagacggatcttttgagcttaattaagccatcattaacacacgtgggttactgtaagcttaaaagattcgtctcgcgatttccatgcaaactatacgattagtttttgtttttatctatatttaatgttttatacatgtgttcaaagatttgatgtgatgtttttgaggaaaaaaaaaaggaaactaaaccaggcctatctatctgggcctgacgccggccgtcgtggtcgatcgatcgcgcccacaggcacaggcacggcaggctggccgtatcgatctgatctagctaaccccacctcactgcagcagcagcagcagcagcgcggggacctgatctctctccctgcccggtggggcccggagcaccagctccgctgctctggtcatgctttccatggcaggaaggaatgtgacacacacggtggtgccggggagaatggcagctgggccccagctgctagctgcgcgcgtgtactgggtcatcaattaacagttttcgtcagcttgtttggatgtggccacctaagctagcgctgaggtgacatacaaggagagcgtgtcgaaactggagaagacggggcttgctgttcaactgcttcagactttgcaggagggcactgcttaaggaggtaattaagcaactgtccagtgtcctactagcaatatatatattcgaagtacatccacattggatcaatcgtcctcgagtgaacagaggtacgacattctccatcagttatgagtacttgcatgcaggttctgtctggctcattggcagtttggcacaaaagcatttcaatttattgctgcaatttctgtttgtttaaacctgagcatgtagtagtagattattatctttatcgaatacggagtggattagatgctggccggcattcttgctgacacacaaaaggggttaattgttttggatgtctgagagccaatggctagggttctgcttgcaggagaaggttgctccctcccctgggcaggcatgcgaggcaacacgagcatataaaatttttatgtatgttctctctagccttagcttgtctacatgtacccttgttggggtccatcaagtgttgtgtagtactgctccatctgccttgggtgggaagcaagccctgggattcacctctctctctctctctctctctctctctctctctctctctagtctccaacatcacagactctcatgccgaaaaggatcatcattcgagcacaaggcctcctccatatgcccatgtgagaactcttatcacctgctccgtatatcttctttctactgcaatttgcaaaccccattattgtgcattggaaagaaatatccttttccatcattccgcgaaagcgaatgtgtgaaagaagtgtttcttcccagctgcatgcccaatacctcacatgattattttgttcacatcgtaattaatttagcactttctcctgtactggcaatctggatttaaagattttcttgttgagtatcaggatttcttttgtttgtttaacagcttgatgaagtgcatggcaatgcaacctttgatgagtcgatcgactagcacctagctcgccctccactcgtaggagctttatgctgcgtgtgagtgagtgcagtgcagtgcagtgtgtggaatctgcagtaacagctgtgatgtggtgaggcagcagttcttcttgccttttgctttttagttgtaggactggccagtctctcttaagctctctaaattaataaatatacatgaatcagctagctagcggtaaacgtctaagccaaaggtgcttggtgaggcgtcgggggtgtttggatccccgccaaacattgcctcgccaaacatgcggctgccacaacagtttggctgatgtttggttaatacgtgagttgtggcagccatactttttgctagttcatttgcatgcttatttccgccacagtgtggcgattatttctctcgccacaatctctggcggcgccacaatcttacagtcagttcaatttagcatagatgaaaggggtttgtgtgtcttgtgctatgcttaaattaacgatggagagagaaacagagaagcgatggagagagagtgagtgagagagatggagaggctaaggaggaggggccctttaacttttcctctataagaggtgtggcttcagttaaagtaggcaggaattctgctctctctctctctcttgtattaaacttgtgaaagcagcaggctgcctgcctcgattttttttttatatgtacacctctcccacactccttgctctctcgtttgctcttctactgctcatcctcctcctctactactcgtcctctttggtttgcttccggcctcttcttcctgcatagcttctgttattcgatttcgatgatcttgtcttctccttgaattgtgtgtgtattaattaactgtatgtttgtttgatcccttgcagctctattcacagctagcaacaagaaggaggcttacacatgcatgtgcacggtctctgccggacgcatatgaatcaggcatgaatagggggcacatcagcagctcggagctcatcgacgccaagctcgaggaacgccggatctccacggccaagcactgccccagctgcggcaacaagctcgactgcaaaccggtatgtgaagagtgaagtgatcaacttcgttttgcctagctcttttcagtaattgcacacttgcacctcggtcggtagcgagggttcttgggcttcttgctgcctggtgcaaaacttgttcttatggaattaattggtgtaactgcaagaaggattgggtggggctaccggcaggagtcaagttcgatccgacggaccaggagttgatcgagcacctcgaggccaaagtgagggaagaaggctcaagatctcatcctctcatcgatgagttcatacccacgatagaaggggaggacggcatatgctacacccaccctgagaaacttccaggtgagagtgagagagctaaggtagctatagctcaaaacattgcaccccccgcattgttttgatacagatatattcctggctttttgcaaaactttatcgggttttttttgctttccatggagtgatatatattgtatgctgggattgtttcgccatgaattatgggtcgtggttttggattttgggatatggcatatattcccttgttgttcttgatgtgctctcccccctctctattcttattactagtgtttctctacatgtgctcttggccggtatatgcaaagagaattattgtttatggaaagttgtgcctagtctcatctcccactctctcctctctgtcatgatggtaagatgcttctgaagtttccaaataggtttctttcctctcttcctctttttcagagaggtttgttgcatctgtcaagaagcataggccacccactccacactatactcttggatctcacaaaactctctatactaccttgatcctgctaattattctgtttgtgctgatcgatcgatggagcaggtgtgacaagggacggcctgagcaagcacttcttccaccggccgtcgaaggcgtacacgacggggacgaggaagcggcggaagatccagacggagtgcgacgtgcagaagggggagacgaggtggcacaagaccggcaagacccggccggtgatggtgagcggccggcagaaggggtgcaagaagatactggtcctctacaccaacttcggcaagcaccgcaagccggagaagaccaactgggtgatgcaccagtaccacctcggcgacctcgaggaggagaaggaaggggagctcgtcgtctgcaagatcttctaccagacgcagcctcggcagtgcagctggtcctccgaccgcggcggcggcgccgccgccaccgcatccgccgtgacgacggcggcggtgcagcaggatcagcagcgcaggagggacagcggcagcggcagctgctcgtcgacgagggaccacgaggtgtcggcgacgtcctactcgacggccgggtacgccgtcgccgccgccgtcgagatgcagcatttgaagcatgccgccgaccatttcagcttcgcgcctttcaggaagagtttcgaggaggtaattaatttaattaccacttgttacatgcatactgccacttttctgtatacatactgtatgaatctttgatcagttttcggagtaatgctggttaggttacgcatcctaatcagtttctctccaagtaaactgctggttaggttctgtgccgttttctgcatgcatcttaatcagtgcacgtcatgcagatcatgcaaattaaccatggtccatattcccatgcacgcatgcatggatatatatacactcgctcgcatggatatatactgactttctgtttttctaggtgcagattgggatacatatactttctgtttgattagatgagcttccttcaatttgttgcgtatggatgagcggtttggggcggggtagctgaccaaatgtgtaggatgcgccaatttaaagcaaaagatgagctacacatcacacagcagcatggacccttttagttcgagcctcacatcattttactcagattgcaagcaaccctaaaaccatccacgatccacccaccgtgaaagcaaaaactagtaatatatataattggcccggtctcattctttcaattattccaaccaaaaaatgtatatttcaagaaagttcaaataatatacatactactgtaacatacatactaactgaaagggagtgataaaagacaaatataatgggaacattatgcatgtatgttagttttataaaaaacattatgcatgcatgacatggaatttttccatttgtttgcatcaaacaggttggtataagtggtgatcaggtacactccaatcagcttgggaggtcggagcagcagcatgctggccaggaacaacagccgcaccggccgttgcttgcaaccacgacggcggtgcctgccacggccttcctgatcagccggccgacgaaccctgtatcaaatatagtgccaccagcaatgcagcatgcatctgtcgttcttgatcatgatcagttccacgtgccagcaatccttctccaccacgacaaatttcaggtgtgatttcatctcatcttatacattttctcctcaaataaaacatttccattatctaaaataattccctaaaattaatactaatttctctttttctagcagctgggtaatagattgggcacggtagctgttgaaaaaaaaactataggaacacatatatgcatgcatttatgaagaatattctttacatattcagaatgttaaatttaagtaaggagtaacaaaccatctccaacaaaaaacaatttcagcttgaaaacaagcaatggactcgctaggcagtacatttcatacttcccatctagacaaacttaattagtacggcttggtctaaagtccacattttcctccttcaagctaagagtttcttgctatcataggatccctttgaattctctaaaaataaactaaaaaccattctcagctttcaatttcaataaaaagaatcaaggatttgtgataatcttaagtgtcaaaattagtcatttttagttggtcatactaaacatattgggcaataatttatacaaataattgtgatatacaaaatattaaaaaaaattctagttatggcacttctaatgttgatttgtacatatgtagggtttttcaagtcgtgtaattactatttgatatgaactatgtttttttatatatataccaaggaagttgcatatggatgaaattaagctgtctgaagatgcattttctagactataaatatagagcctagacaattctggaaggattctttgtttacccatatatatatgtgtaatctggtaatgaatctgctttgtatttccaccgttcctatatatatgtatcactttaggtaaatctatatacaattgaactgtttatttcatatatatcaagatactaatgcattgtctcagctcattcttcatctctttggtgatttacttaattatattattgtagctcctttacttttttttttcgttttgctctttactaaagaatgctttagctactgttctatcccaacataattaacaacgaacatgcaacacagcagcagcagcaacaaaagcttgacaggaggtctgccggcttggaggaactgataatgggctgcacgtcttcgagcacaaaaggagtaagtttctcttgcatttttatttgattgcctcctcagcatggatccaagccgataatttaccagtcagaggctctacgcatgcagtaaagcattcctgcacatatccaattggaattaatatatatgcatgtacgtagcaattgcatgtgagacgcatgcatgtgtcccttttaaacggttttaatctgaacattagctcaggccaaatttaatataattgtagttatttatatatactgatttaaacatataatacatgggtgggaaagctgcaagctatgtcttataggcgaggtgaggggtttagaaaagaaagactgctcaggagggtcctgaggaaacttcagtgtggggcctcatagtttctttgtcgtcctagccagcactttgaaacaggcccttcaccttgacagctttttcctctcatttgtttccctatttttaaattcgccattttaggtgtgcttttacagcaagcatgccgacgagagagagagagagagaaatcttcagtactcctagtgagatagtagatagaagaaacatcatgaatatatgcaaacaaggaccaccctttgctttgcttttgagtgccaaagggggagagccaaagaccagcgtaaaaacaagaccatactttccttgctttcatgaccgtataggtgaaaacgagagctttctctccatgtcagtagcccctctcctcgcttttctgactgtatggctatagaatagttgtttactgttatctcttgcgaaaagagcaaaagaaaaggaggaaatattattcgtttcttgctctcttttgtctcttttctatgaaatgaattcacactgacaccatgcatgaggataagagaatcattattgtgaaatttgtttgcattaatcgttgtgaacttgttcttgtattacattactaaaaattaaaatcttgacatttacaaggtagtatatacatgcacgttcaggtaatatagaacaaaagtgtacttatttttgtcaaaactccattggatgattagacatgagtagtacatccgtctcaaaatataataacttttagctacgaatttaaacaagagtatgtctagattcgtagtcaataattgctatattttcgaacagatcaaggtagtaatgatatgtgtattgcatagttattcaatgagatcgttctttgacacgttggcctcattaataatatggtgcaatgcgttatattggagatcaatcattctgaccccgactatatactccgtataagtaagtgacaaaaagagttatgccttactacttttcccctcctttgttttcgcgttgaattatatgggagattaattaataaagtactgtgacaacacaactatagtactactagtctactaccgtggtatctgctatatctctcacaagagatccgaattggctaccttgatattatttaaatgaacatttctggtatcatctggagtgtaaataagagcaagtactataaaacttgctctaaggtagtccgtacttgaacagttgaaaattttgaattatttccctactgacattttaaagtgataccgtatctttcttattcaactgttgcacttcactgagctgttcttttttgacccccccttttccatattctattgcaggaagcttcaattcctcactcccaaga

SEQ ID NO: 69867 - DNA, 673 bp, Oryza sativa
tagaacatcttgattcactctttgctgcaaactccctggtctactgtcgtgtttatgcaaaagcatttgcattagctccgcggcagcttgtgaagtcatgcacagtccctattcatgtagcatccaaacacctcattcccaagtcccttagccgctcgtacggtcgccggcggcgaccaaatgccaccgcctcactcgagctccgccaccgcacgtcgccggctgccatagctcatttcttggccaatccgagccgtccaccacatccccatactacactcgttcattcccagttgcccattcctcctacctcgccgccgttcgccggaacccgttgaatttcgtccgccgtccaattgcccggcgatctcctgtcttggtcaaagctacatggcaggactagtcgtccgccgtgggcaaggaccttcagcggcttggcgaagaggagaagggccacccttggtcgctggagggggaggagatgtcgatcgcgctggaaatgatggaggcggagagggagatggacaagcgacgaagtcaacgatggatggggtcaggcgcttgacaatggcgaaggtttagagttactgaataataatttacgataatacccttatatgaattattatctatggacaaatatacccctccacgtttctactaccactatgag

SEQ ID NO: 69868 - DNA, 1073 bp, Oryza sativa
cgtttgggtactgatgctacttactttgtaacgagagttgaattcatctgccatgcatgttggtttcaaggaataaactggcgttgacatgcatgatttttgtggtctatatatatcacatatatatcagattactcgatgatctaactagttagtttactgctgtacctgtacatatggatttaagaatcagagtggtgttggctatatattaagagttatgcttgcatactgatactgatgtacatatacgtaagcacagaaaattcctttgttcatgtaaaaaaatatcagctctcaatatagacatgtgttgtatttatacaattaatgtgcagtagtgcacctgtacctattggcatttcaagtttcatttacatattacggtgtatatatatagctactaaattaaatacaaattaattaacagctatttaattattgcatatcaatttaatgttatgcatatagtgtgctattttttgacaagtttgattacagttttaggctagactattttcaggaggtacatacgttttttttttaccaggggaacaattaatgagcattattagtattgttggatatatactattacattttagaaatacaaatattagtatattctaatttatcactattgcatatatagggagatctctgtgcatcgtcatactattccacagaatatattttttttgtgtgttggggggcactaacaaatatcacagtataattaacacaccctgctatttatactttaataccgtgcatgcatgttattgtcaatttatttacattaagttgcatgccctacatagaacataaggctttgtttaatttaacaaaaatgactcctttcaaaaaaaatttaacaaaaatgatgatttttggagtacttgaggattaaactgaacgaatccgaccccagcatgtacgttgcacacacatatatatggaatgaaaccaaaattgcattgttttttactgctccttccgtttcataatgtaagttattctagcatttcctatatttatattgatgttaatgaatctaaacatcaatatgtatg

SEQ ID NO: 69869 - DNA, 4805 bp, Oryza sativa
attccatcacagatttacatatagagcatgtttcatcgtcacggttaattaccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcccggactttgtctttcacaacatagtactttatgtcaatgtgtttggcagcaccacttgactaattgttgtgagagtacattactgtgggttctttatcgcagtataactttagtggtttctcaatactatcaaccacctttaaaaccgggtatgaacttcattagccagttcacctgccccgtagcctcatggcatgctataaactcggcatacatggtagaccctgcagtggtagtctgttttgagcttttccatgaaatagctcctactgccagggtaaacatgtatcccgatgttaactttatattatcttttgcaaagtcagaatccgaataccccactatctggagcgattctgcttttctgtaagacatcatgaggccttttgttccttgcaatcacgcaagactttctataccaatttccagtgctctaggcctggattacttttgaaatctgccaaataacccggtaacaaatgccaagtcaggtcgtgtgcacacttgcgcgtactgtaggcttcctacagctgacgcatatggctttgttttcattttattgagctcatactgatttctgggacattgcgatgccccatacttttcgcctttgactataggagcaggtgtagcactgcatctgtacatattgaatttcttcaacaccttttctatatatatgccttttgagaaaatcccaatgcatactttgttctatttcggtgaatctctatgcccaaaacatatgaagcctcaccgaggtctttcatgtcaaagtttgaggacaagaatttctttatttcctgcagtagattgacatcactactagccagtagaacgtcatctacatacagaattaggaaaatgagtctcccattcttaactttgaatcaatacagttgtcctctacattctcttgaaaacccaaatttctttattgttccatcaaacttcaagtagcattgtctcgaagctttgctttaacccataaatggatctctttatacggcatcccatatttttgtttcctttcatgacaaaacctttcggttgcgccatgtatactttttcctccaaatctccatttagaaatgtcgtttttacatccatgtgatgtaattccaaatcataatgtgccactagtgccattataatcctaaaggaatctttacaagagactggagaaaatgtctcattgtaatctcttctctttgcgtgaaaacttttgccacgagtcgcactttaaacttttctatattccctctagagtcatatttggttttgtagacccatttacagcctactgttttggctcctttaggaatttcttctaaatcccagacatcatttaatttcattgatttcattttatctttcatggcttctcatggcctcttcatatgagatgggatcatcctccatatgcgattctttcaggccttctaggggcctcctattctggcacattatctgtttgaggctgtttcatctcctcctctgatgtggcaataatctctgttgaatcctgtagaacaggttcctcactttcattcattgttgccacaggagagataacaacaggtgttggtaccgcaacggcatgcattgctggcacaacattagcaggtagagagaagaaaggttcctgagtcgacggagcgggtacagacacccgcctctcctcaagatcaatttctcgaattaccgagctccccctaatcatttcgtcttccaagaagatgacgtgtcccgtttctacaaactttgtataactgtttggacagtagaaacgatgaccctttgatcttttagaatagccaataaaatggcagcttactgttttgggttaaatactttatcctttgcaggactcccccacacacggaggatccatagctcatacggtgttttgggcaccgatgcattctatgcattgtatgcattgttctaaaactgagaactccaatggaggaagaattacattcttaaccagtctctcaattctccccctcgaaatatggcctaaacaacagtgccataatttcgatgagacatcaggagttcgctttcttttcttttgtcaacgaggacacaacattcacattctcagaaagagataacaaataaaactgatcttgcaacataagaccaatacattcattattataccatagttcacatttgccatttccaaaatggcaatcatatctatcaaaatccaatttggatacacttattatcaagtttctttgcaaagaagggacataaaaacgtctggaagtaaaagtgtgaagccattcgcgagttctaggcgaagatctccaacagcctcaacttttgcttcaactccattggcaactctaatggatctttcacttctttgcatagtcctcattgaacggaatccctttaaacaattacacacatgaatagttgctccagaatcaatccaccatgtggatctagaataaccaatcataatgagattctttacaaatgtaataatgttctcacctttctttgccatgatcactgtcaggaagtcaggatgatctttcttggaatgtcttttcttgcaatgtagacactgatcttgtctcaactgtaaactgttgcttctgaggcagatgctgaggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatattgctcatcctaagaatgtggtcttttacaccacctccatggtacctctctgtaacaagctgctttatcagctgtgtcgcataaaactttgaagaaccactaaactggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccatctgagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcatataaattgtaacaaaactctgttgtttacgctctgtaaaattctcccgttggttcaaatttaaacagagataaaacatgtaaaacaattcaaaattctattgtaatttgcatgaaaaatacaaaatacatgttcagaagcatttctcacatttatctattctctaaacaattttcacgttggttcaaattgcttagaaataaacacaatcattaaacatattgaaaatgcttccttcggccgagggacttttattaaacttcctttcttttgattcggccccgagggacctaaaatgaactttttcggcctttgccagtcggcccacggccgccttgcgcgcgggcgggcgccccctcccctttcgccaggccgcaacctgggcctgggccgggaaagtggcttgccgtgcgctcccacatgggccgatttcggtccggccgccgtcggccgtccgatcgctagggtttcgatcggacggtcgcgcgggcggatcgggcaaacaaaaccgcccccggccgccggcgccgaaaacctagctcctcttctcttctttctcttgcggttgcacggagcggcgtcgccgtcgccgaaaccctagcacagcgccggcggcggcatggcgacacggcggcgccgtcgcactccccttcgccgatgcgcgcactcactcaagggtgagtgcgccgccgtcgagcggttgtgccgcggcgccctctcctttctcttgcgggcgtgcgccgtgccgagcggcgtcgccgacgccggcagccttcgcgccgccgcgccatggccgacgccctcgcgccgccacgccctctattcttttctcttctcccccccccaccgtctcacccctccacgcgagtgaagagtgagagaccggcgacgacggagatggtggccccgccg

SEQ ID NO: 69870 - DNA, 12065 bp, Oryza sativa
ataagactatctccctaaattattgggtggaccaaacttgtaaggcgtataagctgcaaactgttgtcttcagattcttacagcttgagttcaaaagctaagataataattaaagcagttgcttcgtggtagtcccttatacgttttcaattggtcagcctaatttaagctgagccaaatcaacaattaatgaaatactcatgcgttacaaatgaaataactgagcacaaatcaataagtagtgttgttacttcctgtgttagcaaaattaattgggaacaacagacctttcggcatgtggttattggatcatcagaataaaatggtggataaccaacaagcatctcatacatgattgcacccaaagaccacctgtagggcaaaagaagtacattgataaaatctagttatcaagaatcaataaatgtggctgaacataaatttgtgtacatcataccagtcacattccattccatatcccttctttagcagaacttctggagcaatatagtctggtgtcccaacagttgagaatgcctgtgtatcaaattgcattttaagaatgagaagggctgtcaagaataacagaagttgtattcatattttaagtgtgtatcccttccaagcatgggattccacatgatatcatgaaagaaaaacaaaactactgacaatacagggtcaatgggatgcttgttgtatacactgtaaagcagacataccagttttcttctgttcatctgccagtgctgaagttgttcatgttgacttctccaccttctaccatttgttgtttcagagaaagagctatcgatatccattgattccctcaaattgtcatcacccatcggttcatcttcattcaatgttgagagctttgaacaatcaattggcttgcacagcccaaaatctgacagcttcatgtgaccattcttgtcgagaagcaggttgtcaggcttaatatctctgcaaaaagataacaagccaaagcatgtagatcagaaaaagggtagaaacagaaaatatacaattatctttaaacaaaaatgttatagctggacattatggtataatatatcagcggcgtcacaatagagataagtcaggaattggcaagtgctacagcagttggagaatcctaataagctctctatttgagtttcatagttttgtagtaagagtcctagtagtatcaggttactagtatgtttccttttcccttatctagaggcacctcaatatataaaggtaggctagtattaacacaagaaatatctaaaggggattaacacacaaaaaaaagtaacctgtggatgtagttgtgtttatgaatggactcaatagcaaggatggtctcagcaatgtagaatcgagccacatgctcagttaaggtatcctctctcatgagaagggtcatgatatcaccaccagggagatactccatgataagataaaggtactccgaatcttgaaaagaatagtatagcttcacaatgcagtggctagcaacttcagccagcaagtttctttccgctctaacatgttccacctgacagatataaatgaaaggttgttaaacatatcataaaaggtagcagtctttttgctaaattaggtcttgagaagccctacaagtcagtttacaacagaagatattttttacaaacatgaaaaagcaattaactatgtgattctgttaataaaatacagtcatatagagatatcatcacatacgtagagtaactatgacaaagcagttagacatgaaaacaaaataccagtggaacccttgtggacttcacccaaacaatggactgaacaaaacaagaagattatacaccagcttttgctttctagcaacttcaaattcaaagcactaaaaaaatgcccatgactaatgcataacagcaatggtagaatgttactaaatgcaaaaggtcctacatgttatgaatataaacatgtactgccaatcttttgtgttatcttagttttaaatataaccttgctgtttcgatttcacaattatgtcatatttattactttgtggtcaaatcaacaaacgtggttggagatggttaaaaactatgcacatgctactaactcacaattatacctattaaaacataaaacctggaataaatccagacaaagttatcttacttgacccctgacaaccatatcagacttctttagctttttcattgcataaatgttgctagatgtcttctcccggcagagtcgaacctgtcgtatagttaccgcaagtcagtaaggggttaaaagcaacaggagcaataaaataaacattacaacagataagcattaagcaaatatgtagtagatcaatgtgcaaacctctccaaaagctcctctgccaataatggtgagcagctcaaagtcatcaacgcagattttgtgccttttaagccgcatgtactctgtttcctttctctccagatcttttagtagattgatttgctgctccctgggaacttgggaagattccagttgtcgctccaatctaaagcgcctgcaatgcataaggtcttactatgtgacacaagaagggcaaagatttctgtctgggcaggggaatgaaaatccacttagaatcaaatcatagtatctaagtatgatgaaggataaaaaaaatcactcaagttacacagtaatagaagatggttgacgactgaaactaaggtatgttactctattataagactaatacgtccaaactctaggggtgcaggccagattgaagccttgaggaatcgccagctttagttgatataagatcaatatcagaacaaacctccatagctggtaagttaaatcaactgtttgatttcgataaaagattataacaatgttgttagaaatgaaaattgccacccctgttacatacacacctcgtatactaaaatccattataaaatgatgaaatgaatcctactaaatcgtatctgccacctagcattgtacaaatgtctttcactatgatgtttcctttcgataaaaaggaacacacaggtcttctgcccttggtaaaatagcgcaccaagtcaccaagattgggcaagctattacgttacatggactctgactgcaaatagagtaaattaatagaagtgattaatgaaacacaggcatacgtcgtgaagtgcggtatcaaccacgtgtacacttatgaatcaaaattagtacgtcatcaatcacgcgttcactcacaattcaaactatcacataatatgctctatttatgcgcacctacttgctgaccaaccgcttaatacaaacaaatgatatgcgacaagtgtattgtcaacggcacttaaagacagacataaccgtcgcatccacacaacatttacagcacatttctccactgaaaaccttcatgacagcagcatacaaaatcaagtcaaccaactaagcaagctgttagatagtaacactaagctcagttcaatttttttcacgcctattactccatagaagcagttacaaccatttttgcttggcgcaaactgagcagacgctaagcattacaaacaactagcagaatcaagtaccctcacagctaaatcgtgctactccaaccccaaattgcttaccgagcaacaattcgagaatctacggttacgccacagtagaaacacctcaaatcgtggctagcggagctactgctacacgactcctactccccccgcattcctcaagcacacgcccaaaacttttcccccccaaatctagcagctcgagtccccgagctccagcgccccaagctctaaacccgcccagcgcagcccaaacccgtcgatcgagctcccaccactcgagatctaccccaaacccacgctcgcggcagcagcagcagcagcagctaaaattcgagcccgaaatcgccaccgcgcgggtggggggaggggatcgggatcgggggggtggattacctctccttgcgctcctggatgttcttcatctgcgagcggtagtggttctcgatgaacttcttcgccgcggcgacgcgctccatggtgagggtggaccccaccgccgcctccccgccttcctccccttcctccgccaccgccgccagcggctccgccgtcgccgccgccgccaccgccggtgccggcgccgcgtccgccatctcgctctccatcgccgccgccgccaccaccacccaccccctcgttgcctcgctggtgttttttttttctctcccctctttttttttcgctgcctcggtgagaatcgagtcgagacgatgagttgtttgttcctcctctcccttgtcgctgtgcgcgccggctgtatatatagagccccgtggactgcgccggctggagagttaattaattaaacaggtaattagtgtgggtgattaaggagctaatggtgggggattaactgcgtcgacgctggtgacagacagacagctccagttttttttttttttttgctttccttttgatctctctctctgctgtgttgtgttctggcacttttttttaattattttgtctttgcttgtgttgttgtgtgatctcttctgtcatgtcgcatgcggatgctgcgtagctgtacacacgtaggcaaaaggggtttgatttggagttcttcgttgggttaatcgatttcctttttgagggaacaagatgaacaatgttcacaagataaaatgcattggtgtctttttttccttctcttttgttctcggagcaacatgtatggacgttggcttgtaaaaaatagggggttttttttagtgaagggataatgatgacattcggctctggatgcgggatgccatgatcatcatatgatggatgtcttaggttgatgagtgtgtgaatgatgggcataatcttaacgtataatccaaaacccgatgaaaactatggaggattctttggatggaaattcaccacctatttattcttatataaaaggaatcaactataaatgtgtgttggtacgtttcttttaccctccccaccctccccccctcattttcagttctacatgccttgtttttactgcctttctaattatcaccttatattatttgctctacacctttaaatatatatttttcttaaaaatatactatatgttctattaaaaatttaacttgtcactacaaccaagaagatagtcgacatcaatcccacgataatctctcaagtgatctaaagaattgtcaaaggtagaagggcatgtatggtttttgctgtccatgacgagagagggttgcattggtaaagaaaaccgtttagctaacacctgtcaatatttcccttttcaggggtgtcttcggatgagacctgcctatcacgcgcgtaaaacaaaatgatccattaacatgtgattaattgaatattaactataaatcacttaaaattgatcaatataaattttgaaaatattttttctatatatatttattaaaaaaataccgtttggcagattaaaaaacgtgcgtatggaaaaacaattgagtacaggttagaaaaggggagtcccgaacggtgtacgttgcaccgcacacgcgacgcacgcgcctcggttaggtaggcagctcgaccagaccagaccagagcgggtcgtcgtccgtcgctcacggcagccgcagcgaccgacacggtcgggactgtgaaaagggctttacacaccacaccaccagggtccaggggtatcgcatcctcgtatcgtacgtgttgctcccttcgtcgatagcaccaacacaacgcatttgcttcaaacacatgtcggtatcgtcagtacgtcgtcgtcgccgcatcggccattcggcccaattagccggagtcgatcgattcgatcgccccctgtcaaatcgcagccagcttacgagctcacctaatactcctatctatctacccgtacttaattagccaactcatctagcttaatcattttctcttcgtaggccaaagcacggtagaagatgtggaggaggaataatttggcatcttcttgttgtgatttgtgaatcgagtgatgtaagatagcaagggtctgtttaggagagtttatgattctgagaaacagctggttggtagtcagttcgtgagaatctggaaaagctaggtttctaacttctgtcttctaatttatatttaaaattctatatctagagtttttagaatctgaatcaagagttggactgtttgaagaagtttctggtcctaaagaagctgcagcgattaaaatctctccgaacaggatcaaagagagagagaagggaagagagggagaggcatggcaaacggcatgggatgttggggcgcggcggaacagggcgtcgcgcgaggcagaaaaaataatgcggcgtccaggctgggcggctacaggatgaacaggtcgcgcgtgtgatgtgctctctctctctctcgcgtgtcgatcgccagtggacggatcgatctgtgctgcaagctgctggtgcagatgcaggtgccccagctcagatgccaggctaggccgcagctgcgcgagagagaggccaccattattttttatctccatttttaatgcccatttgccggatctccgaactcacctcacctcacctctttggattccaagcctgtccagcgtgttagttaggttttttaaatattttttttgttgctgtgtgtgctttgctttatcttacacacggatgaaaatgggtagtgaaaatcttctgattgatcaaggatcgtttcgtaaaagatataccatttccattttctaacattataaaagtttggttattctaatttctatcatgcgtcgtattataatcaccactaaatagttattaattattataatcaccactaaatagttaaattaatagtaaatgtatacattataaactgaccaagaatcattttcgtaaaaattggattgttttcgtccctaattttatggattttttttttattttgttaattaaggtggatccctgacggttggatcagcgtgtgtttcggagatgggtgtagtcgagattgagcccgtaagggcaggtggtacagtgtgttgtcacagtagcgtacgtttgttgcttagtacttcctccattccatcatttgtactacttttcatttgtcccaaaataaatttaattttatagtaatcattatatcgaagcttgtaaaattaggaaacggttgtactataaaaagataaagtgagaaataattgtattgagatttaataaagtagagatattttagttttcttatttttattggcatgtgtaaaattgataaaaaataaacttattttaaaacgaaaatagtaccactagcgtgagttgctggtgaatccgtgacagtgccgaactggctgttttccactcggcgcgagttcagacgatcggataactatactttcatgttgatgaggtgacatcttcttgtacagagtcaaataaagaagacatcgtcatcatgatgctctcgtagagtcaagagaaacctaacatttctcagaaaagaaaaagggggaaaaatcctaagaatgtgtgatattagccgaaggcccagagaaatcggcccaaactttggaaatagtcaaggggcccaaaaagggaagcgtatggcgtacggttcctgtctgaaaacaaagcccgtctgttgaaaatgtgaaggcccatgagatatggcccatatattggcccgtcatcttgcctataatgttcccacgacagtgagtccaaaacatacttgcacttcatcacgcgttccattttcagtttttttttctttccatcggatgtctccgaactccgaagagactcaggttttgactccaaatatgatacgcgcgcatgtggcttttgtttggattttttgcgcatgtttttcgtttgagataccacgagtttggtcctgtttggactgtcgacggagaaggttattccacacttattctaattgtcacatctcgttctaagtcggtcttttatgggacggaataagtatcttttcagaattgagttgcttccctgtagattttttgtcgtgttccaaaatagcacaatgccacaaattcaaaggtacccaccattttcagacgagaggagagcaactgtagtgattagtgctactattatcacgtaacacatgcataaccccatagtatatccgtatatatgcagctatgcttgaccgattgaccctgcagcctccgctgcgtccgaccagttcccccatcgccagccacagcccactctcatatatgattccaatgtgaccgaccgcttgttgccacatcaaccagcaccaattaaagctgcatccacacgtacggacttcagatttgagagtcattcgatggcgatgggattgaaactgcacgaattacggccagtctcgatcgctcagcttgagctagctaagctatggtacggggcacttctaagggcccgtttagttccaaaaagtttttcccaaaaacattatattgaatctttagacacatgcatagagtattaaatataaataaaaagaaaatctaattgcacagttataggggaaataacgagacgaatcttttgagcctaattagtccgtgattagccataagtgctacagtaacccacatgtgctaatgatggcttaattaggctcaaaagattcgtctcgcggtttcccgacgagttctgaaattagttttttcattcgtgtccgaaaaccccttccgacatccgatcaaacgtccgatgtgacacccaaaatttttttttccctaactaaatacaccctaacttgtgaacgacgagccggtgaattgactgaccagaggcctcgagtaatagtagtagctagctacttcctccgtccaaaaaaaaaccaaacttaacatggttgggacattacttaggacaacgaatctagatatgctttgatctttttcctattttaaacttttaagtctgactaaatttacataaaaaaattaccaatatctataccaccaaattagttttgttaaatataacattgaatataatttgatagtatgtttctttcgaaatgctactgtccttttcttttataaacatggtccaatttaaagaaattttacttaaaaaataaaaacatattataatatgaagaaggaagtacaactaatttgagatacttcgcatctaaggctgtgatcgggaacccctcctccccggcacgcaaaacaaagcacctattattgtatgattaattaagtgtttgctatttttttttcaaaaatagatcaatatgattttttaagcaactttcgtatagaatttttttttacaaaaaatgtatcgtttagcagtttgaaaagcgtgcgcgcggaaaacgagggagtaaggttgggaaagggaggtaacgaacggagcctaagtttagtgctttgattggagccactattgaactactcccttcatttcaaaatatatgacgccgtttactttgcgcataacatttgaccattcgtcttattaaaaaatatatgtaaatgccatttatctttttgtgacttgcttttatcatcaaatagtatacttttacatatttatattttaaatttttaaataagatgaatggtcaaacattacgtgagaaaatcaacgacgtcatatattttaaaatagaggtagtttatgacctaccctgtcagccacccagccgactcaatgccaacttgatatatatccggtccggcgaaaacacaatgcaaaaagaaagaagaagacaaagagagagagagagagccactggaggtcaggtccaaccaacgccctcttgcttcccccacacgtcgcagccggagaacccgacagcgacggcaagcgcgcgggcgcgaggacggacggcgaagcccagaaaccccccggatcgagctctctctccgcccacaccgcgtcgcgtacttttcggcctcgtgcaacacaattactccgtcacgagccgcgtcacccagccacacgtcacgcgtggctcccgccacgccccgccccgccacaccggccgcgtacgcgcgcgcgcgggcgtcgctttcccctcccgtccttttatttttgttttgcaaaactggtcaatcaaacatcccgcgcgcttgggttttctttaccagtaggattctcgccacgccacacgctgcgtctgcgtgagtgcgtgcgtgcgtgcgcgtcgcggaggggcacgagacgcgctgaccaccaccacgcggccggcgaaacgtaaaacgcacccccggcccaaacatggaatggaatcatctagaattccgtgtccttaattccacccccgtcaacacaacacgggtgtgcgacagtgtgagcgtctgcacggcaaattgggcagttggcaagccgtttctaaactaaaaacacgaatattaaaaaataagcaaatatcaaataaataaaaagggtgagacttcgaactcagactagctaactcaccatcttgtagagctagccagaagatctcttggcaagccatttctatggggttgtttcgtacatataccaaggaaaataaagatatattaaaaaaaatcaaaaatcatagaaatacgactgtaaaatactccctccgtcctataatataagagactttagatgtatgtgacatatctagtactttcaatgaatctggacaagccgtccaaatttattgtactataatgtgtcatatctacccaaaattatattataggacaaagagagtggtaagtatatacagtgatgtgtatgtttggaacggaggaattttaattagaagatgtatcaattactccatagcactaatcactttccagtcatacattatcatgaggcaagaggcaacaaccagcctcatcattaactgctcgttcctgcccagaggaaaggaaaacatgaggttggaccggacgtttttatttcctgtgtttttgcttcaattcctatgaaccaaacatatatatagctacgatagctttccatagaaggaactgccctctataaaaaaaattcaatcctatctataaatcgacatatgcgtacgtgtacatgttcgtagctagtaccttttaaaactccttggaaaatcttatgatccgaacggccctaatggaggaattgatttgagttcctaaacaatactacttctactcctacatgggccaccccccatggtccatggatctgaccattatttgtacgtacttggaataatgctgcaaaagaaacgtgaaacttgcctgctgtacgtatagatctgcagtacgttgcatatttggaagagatacctgtttttgcttgtgccatatcttctacactactgctccccagttatggatcagccattcatggccaccaccattaacatgttgctaatttggacataggaggagattgtaaatatgtgaacacgttcgagaggaaaaaaaaaataatggcagcttgtgatgcattgagtttgtgctccaagttaagtaattactgatgcacgagatatgttactattactgctgctccgttatttacttattttgggatcagagccttatctacgttattatactcctgctttggaagatatactatatttttttagatatattttaatgcttctaaagatgtgaacatgtttgagaaaaaaagaatatggaaactagctgtgtgcattgagttgatgcccgaagttaattataccgatccacgagatatggtactacttaatactgcttctctaaagataatcaggtttggctcatatgtaaaccagatagaaacattagaagtccattactatttcttatctaaaccagctagaaatattgaaagtctactactgtttcgtatcaaaattttgctgtagcgaaagaagttcattgtggtgttagggttgtctatggatcacctaggtttagatctagtcgggtggttctatttgcgatggatgattgaacaacaatagagaataagggaaagggtttagggatgtgaccggttgacgcgttggatgaagaggaagtcccagccatcgtcgttgtcgtcgctctgctcgacgtgg

SEQ ID NO: 69871 - DNA, 2631 bp, Oryza sativa
aaaaatctttttttattttttcattttggaaattattattttttaattcaaatcttaattaattatcatttggtattctggatggattgttatttcaatattctgaatttcagttatttctaaattgcatttctacttgaactcttattttttttctctgattgatgttagaatttctagcctccacaatgaacatggtactttgaattctttcaaaaccattttaataatataataaatttaatgagatcaaggatgtgcctgtgcctttggttttcctctcttttaagcgtgtgttagaggtacattcgagatgtgtgagcatggtgttgtatacttgtgtgtgcatctgccatataattgaaaaaaaaaatcacttgtagtactttacactcacactatctatatcaatatatgagtttatatggtcatctcttatatattgaaaaagagtttacatcattattgcacacgtagccatcagcttgcgccagataaataaatccctgatatataacacttaatcatttcagccgcaactcgcagcttaatctcagttaaataatcacaacggcaaaatgtgtcatgatgccggtgcatatgccctacaaaaagaatcaaagagttgggctttcggtttttaggagggggatggctagctacatgcatatttacattctgctacagcctttgtgatagctgatcgatggagagatgcatgtgacctatctttggttgcttacaacaacttgagatgttacctttctaattagctaatcattagcagttaatgatgcgcatcttgattaacttcttgatagaccactttggcctatatcagggtcctcaaaaaccatactcctgcacagaattaattgcaaattgctggaccactattggtcgttcccatccacaagaacctggctcaccgtacatacatttttccctcttagaagaaagacggaaccacataaaaaaagacatgactacacagctagtggtagctggttctatatctatgagagactctatccacctatatttcaaataaaattttctcttaaactactcatccgatctacgatccgattacaccgttgtgttcgtaataattaaatctttataacaagatctcacatgattatattttgatgaaaaatcataaattacttttatgatatgtctaaattacttttagatttcactaagttacttcttagacatataaaagtaaattcagcaaagcctaaaggtaatttacatatattatagaagtaacttagaacaaaagaaagtaactttaatgcatgcatttttcattggacatgactacacacctagtcgtagctggtttatactccatctagtgtctcctttcaatttgaaaaatgcaatagtatgtatcttatgtgtgttgaagttatcattgaacttacttttaaaatttgttaaacctatgtgtgttgatctgtactgattaaataaagttttctatataaattcatattttatccctacaatgaatttacttctaatgtcgtgacaaagttacttccgttttattttaatttacttttataatatatataaattacttttagactttattaaatttacttttatatgtctaagaagtaatttagtcaaatctaaaagtaacttttatatatatatatatatatatatatatatatatatatatgataaaagtaacttacgtatataataaaaataatttacaaatataaatattttttcatcgtaatataatcatgtaagattttgttgtgaagatttaattgtaacgaacacaatggtgtaattggattatagatcggataagtaatttgagagaaaattttatttgaagagaaaaaaggcatacatgtctatctcagtccttcctactacgtgggtgtgtcagcctctctgcagtcaaatactagtggagaaagcgataacgtaagccgaaaataaatagataatgagatcggacggtcggaggtgcgtcgcacgattagactaaaacgagagcgcgcactgtttagattttacgtaacaaaaagaggttaaggctaaactcaagatctcgctagttgctagccgtccatttcgtaacactccaaccgaaagctttagctgatctgattagcagtagtgtcgaaacatgatttcggcaataataaaagggggtagcgtacgagacctaaaagtggatggatgcggagacaaaggatttagacaggttcaggccctctcaatgagaggtaataccctactcctgtttggggatttgaatccgccgagtgtgtattgatctgacgatcaggttgtctcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccataatctccacagtagcccctgagaccttcacagtcggaaaga

SEQ ID NO: 69872 - DNA, 7584 bp, Oryza sativa
tgaaaattcacacagcaaaatagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagccagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatggtcccgaataacaaatcttttggtaatataaaccaagtgtagttaatatgaatagcttctgatctgaatgattatcccttatgggatactccaaaataggtgtaacaattgaatcccgactggcgcaagtattcggttgatagcccttacggggaataataattggtccagtctttgagcatagaaaatagactcatgactatgaatccatgtggaatgtatccggaacaagtccaaattggaaatataatcctcacgcttgagttgataagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagccatggaggcgaagaaaccagtcggcggcagacagataactaacaatgaagatgaaggaacccagcgataaaattgtgtagccatggcagcaaaataatcagtcggtgacagacgaggtagatcaaaggtgatgacaaaatccaccaatcatgaagatgaagaaaatagttgacgacgacaaacgcaaccgacatgatgaagaagacgatgtcggtgatccagccaatagcagtgtagcaaccaatgataatgacaaagacgctcatcagcatttgcatagtagtcaaccgtgaaggtgaaataataagtcggcgaaaacataatcatccattagcaacagcggagatgtcagggccgatgaagcagaggtgctggtgatgatgtcagtgacaataatccatcaaattaatgttatggctgtcgtagatgcttcacttgaaggagagttgatgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgtgaagtagcagcaatagagtttgctggttccgaagataataaagatgaagtcgctccaccatgatgacaaagttgtgttgccgtgatgaagtgaacacgagtcgtcggcaacagaagcaaactggtagtgaagacgcgcagttgtgaaaataaaagcactagtcggcgacggaagacgatgatgttcatcagtagtggtaggctgtataaaccagatgtagagacgagggcactagttagcagcagacgagacgaccggcgatgaagatggtaaggccaatcaacactggcagaatcatgcagccatggaagtgaagaaaccagtcggcagtcatggcaaacgtaggcagcttgtgttgaagatactgatgcctattagtagtgacagcgatgtagccagccgtgaagaagatagcatcagttggcgttataacaggccatccgtgcaagcggtgacaccagtcagcggcggatgcggcggccggccggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaagccagccgtgcaggcgaggacatcggtcggcggcgacgaaggcaagccggtcggtgaagacgtaggcgcccaacaacggcggcataataggccagccgcgcaggcgaggacaccagtcggcggcgacgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatttggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatctttctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtatttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacacccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcctgttggtgaagacatagacgcccatgtacggtggtgtgaccaaccaaccgtataggcgaaaaccaatgaacggcagatgaggcggcgttaaggcgagttgcccattagtcgcgctagagtcggccggatcgatctcttgcaatgaatccatcgcatatgcaaaaagaaagcaaacatatagatctctgttagtgaacaggaaaatatagatgcttatcatatactagaaaacatctatttaatgtatagcatgataaaaaattttaatccacgcgtgttgattggatcaacacatcgggcatgctttccagggagctgtaatttcctggcctgagctttcctgtgcatggagtaggtatgcatggcgagagcacatatatatccatattaaatcacatgcacgtagcagctggtcaaagcctggaagcatcagcatgtcgcatggttcccgtgaagacgtggccggcttacgacttggactcatgatgagtagacggagcgctttgtcttgcacggcagcagcttgttaggtagttagcgtccatcagagcaactcagccgccagtagtatatgcggacgtgcaaaagaagaattagaaaaacaatatcaatctgtgattagaaactaatctaacagagattaaattaaaaggatgaacccagatcatgcatgtcgatcggtcgacatgtgcatgtggattactcctggtggctggcgatctcgtgcgcgagccgtgagcactgccgttccacgttgctcccatgtcgggttacaccgccaccggcatctgcacacggtgcatggaggaacacgaggtattgggccgacacaccgggatgacagccattggtcttgatctcagtcggcatgcaaaaacaagagaaagtaataggagattaatctgtagctagaaatcaatttaactagtgaaacgataaaattatccaatgaagttggagattgaatcgatgaaatcgctgagattaatcccttcggctgaattgaatccaagacgaaaaagacatgcttcacgaatccggcgatgccgaagattggttccatcacacttgtcgacgaggaactcgacgcacccctacctggcgccccaactgtcgaaacatgatttcggcaataataaaagggggtagcgtacgagacctaaaagtggatggatgcggagacaaaggatttagacaggttcaggccctctcaatgagaggtaataccctactcctgtttggggatttgaatccgccgagtgtgtattgatctgacgatcaggttgtctcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccataatctccacaagtagcacgaatgtgaaggacagtaattcgctccagttccatatgtattaatttcctgtcgttttaaacattaccttatttactcactagtgattatttaaggtgtctatttactaaggccatttactaaggccattcccaacccaaacactagacatagttttcataaactccacatcatcaagaaactagtactagacactacttttctaatgtgaacaccactatccatacttaaatttaatgctacttatctcacatgatattttggatgttgtgtagaaactatatctcatgcaagacatggtttccttctctttccttatttattcacttgccacattatttttcatcctaagtggcagtctatttaatgctatgaacactatcctagtcattgagttgtgaatggcctaagtagtagtctctccgtattttaatgtacgatgctgttgactttttaccaatatttaaccattcatttgtttcaaaaaatttatgtaattattatttattttattgtgacttgatttattattaaatgttatttaagcatgacataaatatttttatatttgcataaaatttttaaataagaagaatggtcaaatgttggtaaaaaaattaacgacgtcatacattaaaatacggagggagtacattttaagcataggagagatgtcgttggagaaacaacaacttttcattaactatataagagtaaactcatccaaaatgtttatactccctcaattccaaaatataaggtacaaatactactttttaaagttgtttcgtaatataagacgtgcatgcatgcatataattaattagcatgttctctcctctaaattattattattttaaattgtacactcacaagatttttaattctattggttgcatgtattgtactagttagggtggttcatgacaatgatgtgatattaattatttcttggttttggattatgggtggttatgccttatattatactcctttcatctacttttgatagccatatttcatcttggcacaatgacgaagaataagtaattctacttatcatccatttaaacatgctactagtttttttagaattacacagtacaacgcaggcgctcataacacacgcacactcacccctatgaacgcacgcacgcaaaccttacccctatgagtatattcgaagactgaggcagcaaatcctgaagattgacgaagtcaccgcaggcgcctcgctgtcgacgggtatgtcacctaccactgaaagcacaatgccgttaaatcttgaaaaattcgctcctatggggagtctaacccaggacataaggtgctattgatgctcttgtaaccactaggttacaagcctttttcgctaaacatgctactagttattcctcgtaaacaaacgattcattaatatttatatttctcgatgcccatgtagccaatcttgtgtagaagaatgaagagtcacacattaaatccaataaagtcattaagaggatatgtggccggattgaaatatatctattaaaagtaaattatttagttttagaaatacgtttatcaaaaatagatggagggagtattaatctctccaactacagagcattttcattattcatcctagtaaaatgcttcaacgacaaaggaaattaatataggactggagggagggagtacaatacgaactaaaccaaattaagctaaaccccatttaacttcttgatggaacaagctaaccaaagcacagtcacatcccc

SEQ ID NO: 69873 - DNA, 10281 bp, Oryza sativa
tactttttaagaattaagataatggaaaattttcgtcacttgcttcagcagaagccaaaagccaaattattagtttgcagcactctatctgcatcacaaagtgataaaagaacgttattaagagcaaaccctattggtaaataattgatggcgctgattaacttggtagctgtttctttatactacttataaaattatggtttgaaatgaatatagcaatgtactccctccatttcttattataattcgtttaactttttttaatcatattttctttaagtttgactatgtttatagaaaaaataaatattagtacaaaacaaacatgttataaaaatatattcagtgttaaatttaatgaaactaatttagtgccgtagatgttgctattttttttcataaacttgtcaaacctaaagaattttgatcaagaaaaaagtcaaacgatttacaatatgaaacagagggagtagtttttgacctataaaatagtataatatactcccttagtttcaggttataaaatagtatgaaagtttactggcacgtcgttaacaatttgtttgaagtcatcgaagaactaaagatgtggtttagggtagttcattgtgcaacaaaggcaaagttacctagtctaaagtgaaaagtgaaaagattgaacaaatggtagtccaaagtgaaactttagcaataaaatatagctcaaagtaaaattaactcttattttttctataaatttggtcaaacttgaacagcttgactttgaccaaagtcaaaacgtgttataaccagagtagaaattattgctgatcaaattgaaatggagaatcaacgaggcgaacctatggagagaagtgaggagggttggtcatactattttagccctctgattataaatagttgatgtttaggataaaatttgagtaatattttaaattttgattaaagttaatttctgaaaatgcttagtttaaaaataaaagaaatggtatacacatatatttttgttaaaagtattataataatatcgtaagacttattagaatttataaacttattataattgccaaaattacaaaagtttgacaacattttgtcctaaaccgttaaatatttatgatcgaaagtagaaggatggtttgttcaatttctatgaaattaaggctctgtttgtttcagcttaagattattataatctagattattaaattagattactttaagctggattataataagctgacataaaataagttatgtgttgtttatttctttagattattagaggcatctaaggttagtgagtctttagccactcaataatctgaaaaaagctcctctagaggagattattggattatagcaaaatctggcttatagattataataatctaccataataatctacttgtttgttttagcttacgcctaataatttagattataataattctaagctaaatcaaacagggcctaaaaggtagtatagagtattctattaggttttttatgttgagacacgcctacgagtaaggttcatatctctgcatccaaattttggggtaaaagaacacgattactattgttgactactactctctctagtcaataatatttgacgtgagagaagattagttagtactctcaacgttaaatattattaactggagtgagtataaaagcatgggtacatgtttcatttcccacaaaatatatatccatcacatttctcttttttaaaactttttattgagcgagagataaatcacatttcccttgtaccttgttctcaccttctacattcaatccaacaaggcacctacaaagtacacgtatatagtagttgaacaagaatgaattaagtggttgcaatatctaagctattgtttgtcgatcataatcatcatgtcgtcatcaacaaaatgtggcaagacattcacttgccacgagcccgtgtttttctgtaacttctctacatacctctaatttcttaattactaaagtttcattatttgacagaacactttagaagaagcagttaatcagttcaatcgatgtgacgacagacgactcaattatcatcaatctgtgaacgaatttaactcgacttcttctctgctaataattaattaattaattaaatttctggtcggtgaactaaacgatgatctagtacttgcatcgatcagcggtcgtcgcagccacgatcagctttaaaaacgcggtgatgttcttagtttcgtgttctggatactttggattaagtcaatcaaattcatcttacttttttttacctaattttggaccacgacggctgcgaaagagatgtcctagtaatcatcatccaacgaccacaaaggtctcctctttatagaatgcgagtttgaacgcttattgcctgcacgccaaactaattctacacctaatgactttccctcaataatttagcccctaatcttcagcatcatcctcttgcttaattgtttctagggttgctataatcacaggtgcaactgtgcactatgttgtttcgaggcaggagagaggcaacctgcacctgcccatggaggactcggattagactagagcacaagatggcgtgcttgaccaagtatcagcacgccacgaatgcaacgaattaacgcgagagatgttgtataagtagtgtgatttgatgccaagttcttgcatcttgtcaaatagtatttgggcgtgttgatgatgagcgtgcaaatggcggcgtcgctacgtgtgatcgttgtgttggtgtgtgtgacggcgggcgccgccctcgccgacgcggcggccggcggcgtccgcgtcgggctgacgcgcatccactccgagcccggggtcaccgcgtcccagttcgtgcgcgacgccctgcgccgcgacatgcaccggcgcgcgcggttcgggcgggagctcgcgtcgtcgtcgtcgtcgtcttctccggcgggcacggtgtccgcgccgacgaggaaggacctgcccaacggcggggagtacatcatgacgctggccatcggcacgccgccgcagtcgtacccggccatcgccgacaccggcagcgacctcgtctggacgcagtgcgcgccgtgcggggagcggtgcttcaagcagccgagcccgctgtacaacccgtcgagctcgccgacgttccgcgtgctcccgtgcagcagcgcgctgaacctgtgcgccgccgaggcgaggctggccggcgcgaccccgccgccggggtgcgcgtgcaggtacaaccagacgtacggcaccgggtggacgtccggcctgcagggctcggagacgttcacgttcggctcgtcgccggccgaccaggtgcgcgtccccggcattgccttcgggtgcagcaacgccagcagcgacgactggaacggctcggcggggctcgtcggcctgggcaggggcggcctgtcgctcgtctcccagctcgccgccggcatgttctcctactgcctgacgccgttccaggacaccaagagcaagagcacgctcctcctcggtccggcggcggcggcggcggcgctcaacggcaccggcgtccggtcgacgccgttcgtcccgagcccgtccaagccaccgatgagcacgtactactacctcaacctcaccggcatatccgtcggcccggcggcgctgcccatccctcccggcgcgttcgcgctccgggcagacggcaccggcgggctcatcatcgactccggcacgacgatcacgtcgctggtcgacgcggcgtacaagagagtccgcgccgcggtgcgctccctggtgaagctgccggtgacggacgggtcgaacgccacgggtctcgacctgtgcttcgcgctgccgtcgtcgtcggcgccgccggcgacgctgccgagcatgacgctccactttggcggcggcgcggacatggtgctcccggtggagaactacatgatcctcgacggcggcatgtggtgcctggcgatgcggagccagaccgacggcgagctcagcacactcgggaactaccagcagcaaaacctgcacatactctacgacgtccagaaggagacgctgtcgtttgctccggccaagtgcagcacgctctgatcagacgagagttgtacagatcgattcatgtgacacgtgtacatttttctggttattagtagtatatgtttctggttatttttgtatagtttctacctcgtttcttgagggtcttgatcggtagaaatttctgtaaaaagcttcttaaaaaaatgttgtatgagactaaaacaggaaagattcagcttagaattcacactctttcgtaggaattgataatttgcatttgaccaggtggaaacagttttttccagtgatagtctaagccactattaattgtgactaggactttggaacacggcaatgctgtaaggcatcctggaaatttcaatgtgattgtaatgtttaaatgggagcaaaaccaaacaacatacgctgaaaatagttaacctgtaattcagagagtacatctggacggtgagtttgtgaacatgatacaactaagttgaaagcaatgaaaaaactgtgaaaaaacagaaataaaattagctataagtaaaagggactttactaaaatctaacttaatacccactcaattttcacttaacaatttcactaaagaatacatgtaagatgtaacttaaccagaacacaggaagtatctatatatgacaaagtccggacaatgacatactagcatatatctaaaaataacaaatgcggataattgacatttttcatgacctcgtcagtacgcatcaccaaaaccaccatagaaagttcaggcaaatatgttatccacgtttggtgtcctcaatgacctcatctgtcagcatcctttgttgagctacaaccacaaatgtgatttattttcttccattgtactttcctcttcgccgtcggtttccacctcgcccttgacctctagctcgtaaccagttcgtcctactcgttgatgcacccgttggtcggtcattatactgacctttcatgagcaacagcttgtgagcttcagcctctcttaatgtccatagcaggtcatagtacttctcatatcttgcagccctgtattgccgatgtagatgaaggttaattggatgaaatgtagataatgtcttctcaattaactcctcctgcgtgatttctctaccacaaattttgaatcgagagattatgagatggagagctgagtcatattcagacacaagcttgtagtcatggaaacgcaagttcaaccagtcattctgagcttgatataggaccctggccttctgctcttcttcaaatcgatccttcagggattgccataagacaaatggatctctttcagcgcgataatcagtccgaaatcctttgtttaaatggcgccaaagaaaagccaatgcctccctcttttgggtctcggtacactctgaattagagataagtgccgtacagagacctttcatgcctaaatggatttgagcctcaatagcccgttccaagtaattgcttccatcaagagcaagctcatcaaagtcttcgctgttgaaatcgaacatgttttcctacagttaaaagtatttagtctacagatagtcatgaataaaataaagattaaacaaaccatatatatgcgtcagggcttgcaatgatgtcaatgctaatatgcagtacatcctgtccaaactacaatctctgttctataaatgaggctttaaggagaacttatcatattaccaatatttttatgaattttatatgaaacctaactgcatcatccttaatactccctcttgtcataaatatttaacgtgtaggaaaatatttggtccatattgaaaatatactttaaccatagataatttttcaaatgcttagttttaagtaaaaataataatgtgcatagatttatctcgaaaagtactaatcacaatatcataaacacattttaatataaaactgatggccaaagtttcacaattttgacctctaaacatcaagtatttattaccagcatcagtatttaacggctaagcatacagcttagacagatcgtttgtcctgacgccaaatatagtattgtgaaagtgtaatttataaacctgatcaaataccatatctaaaacaattaactaggcttaggtctactcccagtgtcccaaaataaaataattcctcatcccaagaagattttagtaaggagggaaaatgactaagttcctcattaatcggagatggttggtggatagacaagaggtattgaagagtttaggaatacaactttccaaacaaattttgaactctgtgaatcaacttattttgagatggagggagtatattattttttgtgttattgtcttggttgtacttgggtgagttactataagacacgaaatgttcatgtctgtattagggttattatttttcttttctaggcatccctggttgatgtagaggttacgtgtaattcatttttaatgaattttttctcgttatcttaaaaaatgtatatgttatttgtgctactgatcaacaaattaattgttacttatgaactgattcaattgactagccataataaatactagacgaaagtatctggctatgaacaatgaagaacaaagaatctaaaagggacaaggtagccgaatattatcacacagcaacaaacaaggaattaatagtccataacacaatatctcgtcggagaggatgcccctctcgtacggcacggcggaggaaacgggagcaaaatctgggtagaactagagttaatctacatgtatgatgtatctcagcaatttatctttgtagggcaacgtctagagttgaaaatggtcaaaggggaaaatgcggaaatcaaatttcatatattggcgccggggaaggcagggaagaaatcgagaaaatcagtgagatcaaatgttgtgatcttgttgatgagattaataaaggagattttcaattgtgagatcgtggcttccgaacttgaaattggaacagaaaaaaaaaacctttcagtttcacaacactcaccatgatagtgccggacgcgctggccgctgtccgaaactgaccctaggctaaccgcgggcgccgggcggcggcggccgcggcggacggcggtgcagcgcgaccggaacggcgtggttattggattggaaccgacggcgactagcctgagagcgactgttccaatccaacagcggagtagaggcggagagatccatatataggggaggcgaaaaagaaactgacagcccagagaggaacgagtaaacgggccatccgtggacagcccacatggctctagccatccggcccatctagcccacgtcgcgtgtaagttgaaggttcgccgcgccacgcatcaaaccatatctgcatcgacgtgcggcgcacaccgccgcgactaccatttcgactgatagatcacccaccggatcgcacgcactctccatcaacgtgccactccggattcaactaacctcactgcgatgaaacaagccatatgatattatgattgatcaagcgcaatgtgggcagaaaacgcaacaaatcacaccgtcttcggttcggcttcgtgctctggtcttggctccaatggcggcgtttctggtatggattctcctcttgttaccgtacgttgccatttcgtccacggcgagccatggcgttcgtcttgagctcacgcacgccgacgaccgcggcggctatgtgggggctgagcgcgtccgccgcgccgccgaccggagccaccgccgcgtgaacggcttcctcggcgccatcgaggggccgtcgtcaacggcgaggctggggagcgacggtgccggtgctggtggcgcagaggcctccgtgcacgccagcacggcgacgtacctcgtcgacatcgccatcgggacgccgccgctcccgctcaccgcggtgctcgacacgggcagcgacctcatctggacgcagtgcgacgcgccgtgccggaggtgcttcccgcagccggcgccgctgtacgcgccggccaggtccgcgacgtacgccaacgtgtcgtgccgctcgccgatgtgccaggcgctccagagcccgtggtcccgctgctcgccgcccgacacgggctgcgcgtactacttctcctacggcgacggcacctccaccgacggcgtcctcgccaccgagacgttcacgctcggctcggacaccaccgtgcgcggcgtcgccttcgggtgcgggacggagaacctcggcagcacggacaactcctccggcctggtcggcatggggagaggcccactgtcgctggtgtctcagctcggcgtcaccaggttctcctactgcttcacgcccttcaacgccaccgcggcgagcccgctcttcctcggctcgtcggcgcgcctctcgtccgccgccaagaccacgccgttcgtgccgagcccgagcggcggcgcgcggaggcggagctcctactactacctctccctggaagggatcaccgtcggcgacaccctcctcccgatcgacccagccgtgttccggctcacgccgatgggcgacggcggggtcatcatcgactccggcacgacgttcaccgcgctggaggagcgcgcgttcgtggcgctggcgcgcgcgctcgcgtcgcgcgtgcggctgcccctggcgagcggcgcgcacctcggcctcagcctctgcttcgccgcggcgtccccggaggccgtggaggtgccgcggctggtgctccacttcgacggcgccgacatggagctgcggcgggagagctacgtggtggaggaccggagcgccggcgtggcgtgcctcgggatggtgagcgcgcgggggatgtcggtgctcggcagcatgcagcagcagaacacgcacatcctgtacgacctcgagcgaggcatcctatccttcgaacctgccaaatgcggcgagctttaggattcgcatgatcaaagagatacatgaccatatgtacataacttgaattttctatcagttgcttttgcaattattctatggaggtgttttcgttcccaaggcgacattccctctgtttattgcatgtcgagaaacacacttttcccttgttctcttgcatatgcttggttgattatgcgtgtgcttggtggtgtgttctgtgttcatgttcttcaaagaagtctgatgttcatctgacttctaaaatgctaaataatttcagctgaatgcagctcaatcactgcagctaaatctgaaatccaaacttaacatacttttatttacaagtgcgtgtatattacacggactgtacattattctccacatccatatctacaagaatacgcgctgacatatgaaaaggtgatcaaagccgaacaacaaatgtatgtaactcgaaattctagccagccaagagaagtacgatcaaataattaaacaacataatatgtacatatgcaaatacgcaatagagatcactcccatcgatcgatcagtacgtgcgtctcggtctcgatcagatcttgccgcaatccgcgggctgcacggacagcacggagttcttgagctcgtacagcacgtggaagtccatctgcaagtagttcccgatgcgcgagccggtgctcgacttgccgatcatcaggcacagcacgtcgccgccgccgccgccgctctgcttaccggtgtaggcgaagtagttaccgaacagcagctccatgtccatgccgtcgaagtgcatcgtcatcgtgggcacggtgacgacgttcttgctcgcgtcgtcgacgaggaagcacaggaggccgctcccgttgacggcctcgtacgtccgagacatccgcgccctgaacgcctccacgacggcggtgtaggccggctcgaccagcagggtcgccggcgcgccgatctggaaggcgacgccgcgcgtcttggccggtgtttgggttgaacgcgaacgtgtcgttgggaatagcgaggcgtgtcccgtcgacggagatgccgagcaggttgacgtagtaattggcgtcgtcgggtaggagaggggtggatgaaacgccattcccgtccatgctggccgtggacccgaacagcacagggctggcaacgttagggttcgacgcgaggcagtaggagaagcggtccaagcccagctggcccaccagcgacagtttgcttctacccagcccaactacacctgtgttcctgtttaatttgatatgaaaaaaagaagagcccacttataccacttaattaagccatcgcccatatatattcttaatttcttattactgtttgtg

SEQ ID NO: 69874 - DNA, 32027 bp, Oryza sativa
agaaagatagcattctatcggagctcctaactctccaaaaggaagtcgtatacttgtcatcatcttctttgatgaaagagaaggagtctatccgaaaggaacttgacagaacaaaaacaaagttaaaagagaccgagaacaaacttaaaaattccattcaagagaagataaaacttgaggtttgtttgttgaaattagtattattaatatgcgtggtacttcaagtttgttaattattttatatgtgtaaacaagaaaaccctacattattcgctaataaccagttctttttactgatgaactatcaatatgtatttcccctagagtgaaaaggctgaggcccagagagaaataaagaagctacagagccaaaggactcttcttgaacgtgatttacggaaacgtgattcgtttactgttgacaaaagacatgaacagagtgtgaagtcgaaggagcttgccggtatctatgatcaagctgtccagattcaggttacaatcatcccttgtattacttttcagtcaatttgttgtgtaggaaactgatctaattgactaattcagggtactggcataatattgttacaacttgcaataataactctaataaatcacaacagtcactcgacaataatattggccaatatgctcccaatcacagaccataccattatgcgattccactgttccagaatatgtgttttagactgtggtggtttgaagctaccaagtgctaatgtggattcaatatttctagtacagggctagtggttcataaaatatgccatctctctggtttctggtttatgatggtttatcacttcgttggtctcacaacttggcaacctgcaatcatggaaaaaaatctatttattgttccgcatagcttttattgcatgttttataacccaaatctcttttgttgacatccagaatgttcaccatttcagtattgatgtggacttatagtcaacaaagtacaaacactcaagagcatccattttttttgtctatttcagtattacatatagtaaatttgaaacagaaggtcatttcctgatatcagttagggaacagtgacaaagatgccatgttgagtgaggaagaagaaatttcagtcatactgtctattcacatatcatcccagcataacactagagagttttacatctgtaggatgacctaactagctatgctatgcatgtagtgatggctcttttatccttttcaggaggactacggaaagcttgagatgcatgcttttgatatggaggctgaaattgcttcgttacaagaagctttagttactaccattgcagaaaaggaagaagcattatctagagtggagcttctcacatcagcagtggaagatcttgaaagtaggttgaattcagcagaatcagagactagttccttgcttgaggagactgctgtcttggtatacttgatttgtcttatgcatattttggaagatttgtttcccatctatttgtctaatcctaaatgttttgacaccatgaaattttgttgtgtttctctttgatgcagactaggaagttagatgcatctgaatctatctctaaaaaacttgaggcttctattagttctttatcaagggaaaaagaagacatgggaattgtatagctctgtgcttatgtcaaattgattgatgttagctgaaagttgaaacttattgcacttctgtctgctgtaaaatacaggaacttactgatgttcttctggaaatggagtctgaaagatcaacgtggactgccaaggagaaagcttatcttgaagccaaacaaaaactgaatatctgcaataagaacaattgcaaattatcagaagatttgattaaggtaacaacaatagagttcccattgatcattgcacatctcccgtgtgcccagtccattttatgtatgcagtcactagtcatgctatgtggttttatcaacaactcaatattgtttagttctggatcatgctatatcaatttgtgtcaatactgtttagatttggatcatgctatgaatatcaatgtgtcatatgtactgctgcacttacctgttgtggttgtttgctatgatattttttatttaaatatttattgcacatttcttttcttgcctagcaacattagtggggaagaaagcatgtttggtttccttgtttggttcttttctggacaagggtttccttcttttaagggagacaaaatttagctcgcctctttagcatgaatttgctttcctaccagcaacttagaaaggttagttgcgtcttgttaaagaactagacatgccctagttgccttgtattgagttgatttacataatgtagttcttctaatgttgtcttgccctagacgactagtttcattttcctaatgtttttctttttttgttcaaagtaatagtcaagcaacctccacattcaatgttttttcaccaatattttgaagaactttggtatctctgttactgatattgcaatatactgctaggtgagacaagaattggcgtgttgcagagaacagtacagtattcttgaggctaaaatgattttctccaagaatgacacaaatgaggagaaatactggttagtcttgtagtaattccatcaatctgacatattgtgcttcagtgttgtatgatcgggacaacaagtaatacaacaaccatgtaggagcatgccttaagctacttttaatatttcttttgcaatactttctagtcctgagcctgaagtttaaaatattcttttaaaggagttactctgaaaatatacaaaatgaacaaactggagtggttgtgccttatctaacaagcacatatcttcgatgtgctaaaaggacagttataataaacataaaaatgtttgacggggtgaaccaatagctgtttgtgagcaataggaacagataggtgaaattgtcctagtaggaaataaatacatcacggcctctcttggcgacccgggaagcgaagctcgtctccccagcatgccttgccggccttgccgccacctgcagtgatggtcggcggcggcagcgcctccctccttcctcccatttccttcctctttcctttctccttcttcctctctctttttcccttcctccttttctctagatctgaggtgacccgggggacgtcgttcctgagcttggccctccccacgtccggcaccggtggcctcccatcccggaccgcggtggcggtgaaggctgcacggggcacggcatgatctggccatgctaggtccagatccagcgcatctctggcgggttccgcgcgtctccctggcacgagaggctggagttgcggcggcggccgacggcggtggtgaaggcagcaagggggacggttggatctggcccctccaggtccagatttgggtgtgtcctagtcggggttgggcgaggccggacccctcgtggcggcggcgtcgacgggtgggtggcctgtgtggcgccgatgagctccgcagctcagtggagctccgccggtccgggtgaggtggcagagcaggttgtcaacagcgcttgtccggttgttgtgcaggtgttgcggtgtgcaggtggcatttggtggcatttggtggcttccgttgcggacactatgtttggatgggactccgaggtgaaagccttgctcggcttgccgatgctagcaacggcgacgccatcgggcatcgttcaccttgttgaaggcgttgctattggagccctcgttcaactccacatcaagggatttctccggttaaaaccttagattcgttaggatcaggcgatatcgccgttctgtcggtgttttcttcttgaaggcttcgttttatgagtttttcccttgttggactgctgttattaggttcttgggttcagtatgtcaatgccggggttttcgctggttttccataaattaaccgtgccgttgtaaggttttagggtccggttttccttataaactggatcaactctcttcttctatagtgtaatgtaggagctcccttccgttacctcgaaaaaagaaaacaaatacatcgccatctgttgtttaatatgccgtaggctcaaatgttcggctagctgatttactactgacactagaaagtttgtgcagcagggagacttttgaagaatcagaacgacttctgaagaaagaaagaaacattgacaccggtgtgaatgaaaatgtaagtcttcagtctattccttttgccctccattgtgaaaagtcttcttataacatgagtaaatcaaatggaagaattttcaccctaaatcatatagtcacaagtcatgaccaattactatacatgcgtgagaaaccatcacgtgggaagctacaatgtttcgaactttcgatgttggacattctttgttttcctagtgaaaaaacaattgagcagtaacttatcttgcagtttttctctcattttgttttgagcaggaacttcaccaacaactattgtcgattacagaagaacgtgacaagttactttctgagattaaatatatgaattcagtcatcaatgaatcagaggttttaaaagagaatcatagtaaaaaggcatgttaggtttattgttgacctgctgcacttaatctctgtgagtgagtggttttctcatgtgctttttgattatttgtgcagttaatacaggccaaagctactatagatgagttgagttctaggatatctatcgtggaagccaaaatgaaaaatgtaagcattaatgtacttgtcatttactgttaatggaagtatattattactgtagctgctgtttaaaatatttcatcttcgaatgcagagttactggttaccattatcaaacttaggaatagatgaatgttttgtgagtagggttccatgtgcagcctctcataagagcatgtgcatttgttatcaacaaatatttctacctgatttcattcatttttttagacaaggaatgtcacaaagttttccataacatgggggagtacgacttcaaaaccaaaactgtataaaataaaaagtccaggagtttcaattgaactccagaacagatgccaaaattgcttctgttgcacagtcgaagtattttttttcaaattaccaatggaccaccacaggaactacaatttttttagataatggattttcattaatccggcctctgtattcatgaaggatatacacagccaaaacatacacgagttcttaaactctaaacctcgcacaagggaaaacacaaaagacacaaaaaaagaaaagctactagaagacagcttcaatcttcaacgagaacataatctttctgtcacagcgtgagagggagaaggggagaactggaactggtccttgctgcctttcgccaaaccatctccgcctctgtgtattatgaacgtctataaccaaagtctgtttccgagcttcagcatggaactacttgtctagtaatctaatttaactttcctttctatggttgcttggaattgcaaaccccagttgaaacttgctgtgccccttttaggctgctggttctaagccttgacctaaacatttgcaaaattgactgcatatgttctgttgctattttgacggactattgtaatttatgttcgtcctgcattttgaaaacatggaagcttgacataatacaataaaagtttgccaaataactggaaaacaccagattcaatgaaccgatgggatctagtttattgttgggaagcctgggataagggtggtctgccagcaaagcttgtggatgcatcaggcatgtagtagataagcacagatacatacagtataactcaatcagtgtactgcaaactataaatcccaagggccaaggcatcctcaagaacctggatagccataatttctatattaagagaaaatgttaggcacttaaaaggcactgcatttcctgaagaaataactactgttgagcagtgactctatcattcctgctttgttaattatccaagtgatagctttgcatagaggaaaatcattttccaatttgaatgtatcttatttcagttttccatgtcatttaattttgaaaagcaattcaacgatggccctagttgttcctctttagagaacaagccaccttactaattactcactgacaacttgcacttttctgtatccagtaattccgtaacatgctttcttttgcaggatgcttcggcttataacaaagagaacacaaagcttaggatgcagattcggtggatgcaaccagaacttgatgcacaccgtggaaggcttaaagaagcaataaatgagatgaagctgatggacacaaagtatctggaagcatccaccaagctgaagaaggacctttctttctactgtcgtgaggttctgaggttgaaagaacagcttaaagaatcacaagttaaagcatcttgaccctgaaatctttctgctgagtaattcttgtgtggagaaactcgtggtagtactaaccatatgacaaacaattggtattgcctcaatgccacttcatacaacttttgtatactgctagtgtatttgtttcaggtaggtgtatagtgctacaattccctgtagatcattacttcctaatgcacctgactcaaattataaagcagtggaccgtctagaacttttaacagcctttctcgcactgcgagtctgtgatatagggtgagttattcatattgtgacatatagatactggtttttcgtttggttctggtctgtagcaagtatatacctactacagtacttacgagtatagtggtgaagtgtggacgcatgattgattgcgcatgatgccggtgatgcagagcagtgtaagctgcttgtgccgctcgccgtctccatctgaaacgtggtctcgtcgctctcgcgggtgcaggcgtgcagccggtgccggagatgacgcgacaccaatgaaaatcacgtgagaagagaagctcatcggatcggaacatctagtgacgacgccaagcgatggcccagaaacacacggcctgccgacgccggtgcaatcgggacgggccgtggcttttgtgctcggacgttgggcctcccctgaggggacattggccatgttgggccgaattgacactagattttcagcctaggcggcgggaggagtcgcagcgcagggctgagttcgaagtagattgacgctgaacctctgattcttcttttgcacattttttttttctcgggaaaaagtaattcgaagctgatagctcgcggcggcggcggcggcggcttcgcgggcgatggcctgggaaggaggcagcggcggctcgggaggaggaggagcgcgcgacatggacgcgctgcagggcgtgcgctctatcgtgctgaagccctcggagtccctcgacgaggggcggttcacgaggatcgccggcgccgacttcaacgacgccggactcgggctctccgggatgctcgcgtcgctcgccaccactggattccaggcctctaacctcggcgacgccgttgacgtcgtcaaccagatggtaacgttactactcccttgctgccttttttagtacaattcatgatagagatgaggcagattgggggatactgtagcttgaaattgttgtggttctggatctgtggagcttctgatgaagtgcattttggactagatagggcgtattgctgtgttgttggtgtactcggagagtaggaggtgaagccatagctatgcctgctgtaaaataaaatgggaaccttgcagctattgttcatcctaaagctaacactctactgttggttttctcgataattcctgtgagacgaaaccgttattagtagattggaatggagtagatgtataaaaaaaaatgctacacactttttttatttacatcgtgaatttattggacaaattcaaactgtatatatttgagttttctcttgtataacctggaggtaatccagatgaaaaaaaaatatctctgttataatcttacatgtgtgttccttaatttttttccccatcttcatgcttgtactgatttttctacatgcctaagaggttactaattcctatatttcctaaccctttcttttctgtacttcaatacattgaagttagaatggaggctgtcccatgagaagccacgtgaggactgtgatgaacctgagcttgaccctacatatagagaatctgtgaagtgcaaaatattcctgggattcacctcaaaccttgtctcttctggcattcgggatgttgtccgttttctagttcagcatcacatggtgaatactccacttttttaatttccttttattaactggtttgttagacacgttttggcatgcttttggtaacatactagcattattaaaaggattgagatctcatccctatgatgtagctaattccctatggaaaaaaaaatgtgttatttaggttgatgttattgttacgactgctggtggtatagaggaggatctcatcaaatgtcttgctcctacttacagaggggatttttctttacctggaacgctgctgcggtcaaagggattgaatcggattggaaatctattggttcctaatgataactactgcaagtttgagaactggatcatgccaatttttttaccagatgttacaagagcaatccagggaggtactataacatttttcttctggctgaagcccagtagcttgcaacaaggtgtttgattctatatgacgcacatgtgcttatggctcattagctataaagtggaggcatcatgtagggggcagtaatatgaaaaggcctaacttatagtgcttagaaatccactaatgtaatggtacagaaaggttgtcattatttgaaccagtcttcattagctccgtttcaagttggcctctgtgaatttacgtagtaatggtacatgaataaatccataatccaaatagcactgaaatatgaggttaccaggtatagtttctgtacaactggtcacttgccaagaatcaataaggaaaaggttccacactggtagatatgttttgtaagctttactgctatgcccttgatgtccaactattcaattatcagatatgcgtctttctttcagaagcaactcttccaactacttttgtgcttctctctcttctgttcatgaagcgcaatcagttttacttacctgcagaatgtttggacaccatcgaaggtcattggccgtcttggcaaagaaataaacgatgaaagttcctacctttattgggcatataaggtaacatatttattaactcacctgcatatccttgcaaagtgcaagtgggagaacaaaccatcaatcctgttcataaagcccctgcatctttatcttgagtacactacacaatgatatactaggtagtcttgttgaattttttttcagagttcccttaaaaacaaacaaataaactatattattatttgagttatttttgtatgtattaatgttttctaaatgtggaaactcctcataatagtgccatatgtacatcttttcccctaggaactagtgtgccaccatccttaaagttgtgcttactgatgttaatctaatgtacttggtgtccatatttgaagctttattttgacttttagagttatagttgagtggatttgatcaagatacttgttcttttcctcttgatgttacaatagcatggtattttcatgttccttggtttaaaattcatatggccaagtgcaatgttatgatctgtaactcaaagactgaaaacgagacagtactgactctccaaatcttgatcagaacaatattcctgtatactgcccagcattgactgatggatcacttggagacatgctattctgtcatgcagttcgcaatcctggcctaattattgacattgtacaaggcaagttgtgtgcttggttttcttgcttttgctatcacttttgtttttctcatattatgcttgaaaaacttggcagatataagattgatgaatggggaagccattcatgcaaccccaaggaagaccgggattatagttcttggtggaggtctaccgaagcatcatatatgcaacgccaatatgtttcgcaatggtgcagattttgcagtctatatcaacacagctcaagaatttgatggcagtgattctggagcacagcctgatgaagcagtttcatggggaaagataaagggttcagccaaacctgtcaaggtatgtttctgtaacttgaacaattttcacatgtctttttaatgttttacatacatctaggcagtcaaaagtgtctatcaaagatcatgctgcacgtaaaaatgcctttgttgatttcacctgagatgaagtatgtcaatgatcttggactagattctaatcctaaccatcataacttacctttatttatgtgtatagcttttgctctgtgtaataccacatgtgatgcattaaagccttgaagcatgcagccatttacttttgtttaatgatttatgcgatcatggttgacatgattttgttttgcctgctatagaagatatatgtaagaaattatgacacggcatgatctatgtaagaaattgtgacacgaaaagatcatatgaatgcacttttatttaattcaatacactacgactggttattactgtaaagccgtatcttaataccgcggctcttggaaatgcaggtgcactgtgatgctacgatcgctttcccgttactcgtggctgcaacattcgcacgcaagctgcatgatacgaaacaaacctactaaattttctgggtgctgtgggctaaatcggtccttgtcgaactcctcacgttgggtgttagactgcacgctttttgcaaatgatgcagtggcaaggtcttgttggtaccaactcacgaacagtaccgcccttcccaatcatatttgttccttgtacacttcatgttaaacatcaggtagcagctttgtttttgccccctttggcaattttgcgtgctgcagtggaggcttacattgtacaataactgcaaattgtgaccgatcgggtgattttgagttctggttagtgcgatacaataagtgatattttctctattgtttgcaagtgcatttgagttagttatcggtttgcgcctagatctctcttcctcttcctctatctgggacggaaattgcaatgcatatgacccaattgtctaacccacgtacaactgaatttgatcaatagttgtaaacggttgcagtgtgtataaacatgctctcttttggttgatctatgatagcatgtttttagttgtacaactcatatgggcctctggtttctggatatccccagttggccatagtgctgtactgctgtccaaataaggcaggccaaatcgttgccggcccaggcacggctgtagcaggctggctaatgggccgggccgtgtctgggcggccacaacggcagggcgttccaaaacaagcatggcaccggcacgactcggcactgtctcgtaaaacaaacgagggtacaactaagtacagaatctttggaactggagctagctagcacgcatgggcccctaatgatcaagcgacagtgacccaaggaagcagtagcctccattccaaagcctgtgcaaggcaacatcacaaagctgatcacctccacaatgatcggcgacggcatgcagccgcagggcaagtaaccgagaaaatttgtcggtcgtcgattccctcacgcgagcgtgaaaatggatggccatgattcgcgcaatcacgcccgctaagctgatcccgtctccaagatactctcgaaagacagattttctcgagtgaaataatacgcaatcatagacaccaagacatccccacgctagctaactatagcaggttgtcccgtgtccaccctagtaccccgtctcaaattatagcgcagccccgttttaacaaaaatcaaactcggtagctattaactaataattatattaattatatctacactaagtatgttgtatcactagattaatactttaaagtactttcaaattactttcatgtgatactaattttatatttgttaaaatactagttaaagtatgttattaaaaaccgtgtaaaaaaatatagagcttataattgggggacagagtgagtacgttattactgtcccacactgggagatcggtctcatcttagccgtccgtggccgatgaacggtctggatttcatgccgggagcaacagaaatttaaggtaattgaatttttagataatggaatatagtatcccggcctaatttaaggtaatcgatgatgatgaataataggttagcgtgagagtagagatttcatgggagaggggaagtgtgtgtggtgtggccgcatgattgctcgtgatgccggcgatgcaacgcactgcggggctgcagctagcctcctcctcgtctccatctgaaacaaactcatcatcaggagcatatcatcaatccggtggagacgatgatcatgactgacgagtggccgcgcgtcgttcgagctgagctcgccgtgaccggccggcggggcccccatgtggccgccgtggtttcgctttactccggcaatcattgggcgagccgagagatcgatgatgcccctcttctcacgcttttttttggcttgggttctttatcgtgttccggttcccgagaggcagaaacggccagggacgacgatgaccacgagcagtgctgtagcttcgttcgagtggctggcgccaggtcggtgtccgtgatccgtctgtctcagctagcttctcgtccactgttccacgcaaaaagctccccaaacagcatgcgtgagatgcgtacagtggcacgtacagagtaccactactagatacggatgtacagagagaaccagcaaacgattgatcgacaaatagatcacacatagatcgagcagagagcacgggtgaaaaaacacaacggctgcacagccggttggctaccagggtttacgattctgagttgatcttccgtttcgtgctatggagtaacgacggttttcgtgaaatccgtcggaaagccggtagatttcgaataaactagctgggtggtccgcgcaattgcgcggctaacacccatataaaattatatatttttagtatgattctatttaaaatttattaaatagttatctcgttgtcttaagattttgaaagaccaaaccttatcatcctcgtgtttctaatttcgtagtttttaaaagacacatcagttgctaccccttacttctgttatattattttttattagcttgctcgatctaccattgtttctatttattctccttagaacctttatctaaaaacttatattttttagagtttattgtcctgttgggcttcttttttataatttttagaagtctcgtcaaatgctgctattatactcctctacaaccgtccactgtatcttccctttactgtcattgttattttaaaaatcgaacataattattgtttagcttcatttttttactttctagaagttttgccaaaacgttagtaactttgtcactgtactcctctacagctcgcccgctgccgcccttctttaatgtcattgagattttaaaatcaaatatgattatcgttggggatttttttttactttttagaagcatgaacctttaaaaattgaacattatagtttttagagttttattgtctcgttgggtttcatgttttttataatttttagaaatcccgtcaaacgctgccactttactcctccagaagacccaccaaccatcggcggccctaccattatactcctatgcgacccgtccgctgcgtctcatttttactgtaattgagattttaaaaatcaaatatgattatcattagggtttattttttttactttttagaagtccccgccaaccgtcttgactgattgcttcacgacctgcccgtcgtccttccttttaatcgtcattagaattctatttggtcatttattaatagttttagatgtctcatcaaccgccacctctctgctccactataggcctgttacttaattaatctcgtcatatgttttagatggtcttttctttcatttgtcttattttttatcactagttttagttatttataaattgtattcatagttgaaatcattttttctttttctaatttcagaatttattttatttattattatgttcttttgatatttttatttttaatttttaatttcagttgtttcaaaattatattcctactttaactctccttttaatttgcctaatttcggattttattttatttttattctgaattttacttaatctattattgggttcttatatgtactctcatttcaatatttcttatattaaattccgaatttaagttaattttaaattgtatttctacttgaactcttattttcttttcttttttctaatttggattttttaattttttttattctgaattttaattaatctcgtattggattattgtatggactcttctttcaatattccttatttctaattccgaattttagctatttataaattgtattcctactcgaaatcttctttttttttctttttctaattttgaaatttatttttttattattctgaattttaattaatcatgtattgggttataaaaatattcgataaattttatttatttttatcacaaattttagttatttataaattgtattcctaattgaaatcttaatttttttttctaatttcagaattttttttaaaaaaattagttaatactgtattgtgttcttttaatgtttttattttttattttcaatttcagttgtttcaaaattgtattcctacttaaactctattttaatttttctaattttggatattattttattttttattctaaattttaattaatctcgtattgggttcttatgtggattcttctttcaatattgcttatttttaatttcgaatgttatctaattttaaattgtattcctatttgaactcttcttttattttcttttgctaatttctgatttatttttttattctgaattttaattaatctcgtatttggttcttatatggactcttcttttaatattccttatttttaatttctaatttcagctaattttaaattgtattcctacttggactctcattttcttttctaattttggattttatttttttttattttgaattttgattaatctcgtattgggttcttatatggaaatttctttcaatattgcttatttttaattccgaatttcagctatttttaaattgtatttctacttggactctccttccttttctaatttttgattttattttagtattattctgaattttaattaatcacgtattgggttcctatatgaactcctcttttcatattgcttgtttttaattctaaattttagctatttttagattgtacttttacttggactctctttttcttttttttctttttctccgattattatgggaatttctagcctccacagcgaacgtggtgcctcctttcaaggatgttttaataatataatagatttcataaaccaaaatttaaatataaattcctcgagtttaccaataagctcgcgaaaacctgttggcttaggcgagattccaagcgaaatcatcaaaatttcaatcggtaactagaaaaaaggtaaacttattttttttcctttttttaattcattattcttttctttcctgctgtaaattttagtaaatacatggaatatatcaattttttcgaaaatgtatatcccaataggttaaatgaatatcatactatttataagattttatttgattttttttcttttttatcaattcaaatttgaatttggattaaactcatcgaaatctcagacggcttctactttcgagcatcgtcaaaaccttaaagtttcgcagaattcgatcgaccggttttcgtcggaattgtgaactctccccgacacgcatgcacgcagtacgtatatagcaggagtacgttgtgcactggtgcagctcgtcattgtccggaagggcatgagccgatgagcgatcgatcgatggcgacggcgagcacggcgggatcggaggagcacaaactaacacacggcgaatcgccagggagatatcatatcgttcgtcaggtcggctagatcctccacacacgcgcacgtgttggcacagtggcacggacgctcacctcccacccactgatcaacccacacacccatcgatcgtgtccatttttccgcgcatccgcgcgcgcgcgtcggtcgctgacacacgcgcggcactccgaggggtcgtcgacgccgacacggacgggatgacgggtccccggctcgcgagttgcccgcctaatgcatccagcgtacagtgttgttgtaccagcgcgcgcgctaggcgaggcgatcgatcaaaagtcgtccaaacagcggttgcctttgtccgcgtcgttgaggccagacgtccagcgcctaggccaccgatccaccgtggtctattcatccgtacgtgcatcatgcatatggggggtacgtagtacgtagctgcacgtacgctttatcacgggctatagaattacaaaagtgtggcatgctttgtaaggtcgctctccagctccatttttcgcaagctggtcaatcacgctcaagcgaacaagcctctggctggctggctcctttcaaagtgtgcccaaatgattgatctctctctgcctgcacggctgcatcccaacccctggccctggctagccggagcccggtttgttcgagtgatcaggtcagagagctcatcggaattcagaagtcagattgccatccatcctgctgcatgcggccgtggggcccacacatcgcgtgggcctcggcaaaccagcagcagctactctcccggccctcggccccaaagctttgccccgggtgaatcacgaggggtggcgcataaggccatcaccaatacctcggcccgtgttccctagcaccattcgttagcctttccgtctccgcgcccccccctgcgatagaacacgtctctctgctagggaatatatccctcgctcgcttttgcagggaacacagccgaaggggcgtgttgggcgcgagggtgtaacttgtggacaccgttcctaccgaaaaatttcctcttccaccctcgcccctctcactcatcgccctcacggccaccggcgacggaagagagagggagggagagaggccaacggcggcggcgagggtggggggggggagaggtaagagtcggcggcgagagggagagggagacgagcggcggagacgatgccaacgacgaccgggatacgatgttggcggcgaccacggatccacgcgccgctcaccgagccatcggcgcgctgggccggagtaggaggcggggccatggctccccgtgtccagatctcgctctgccacgtcctcctcgctccgctcgccacggccaccgtgtcccgccgtgcggagggagagagaggagggcatcggtggcgggagaaagcggcaacagcggcttgagagggagaggagggaggcggcgacggttgctggggagggcgaggagggaggcgcggcggtggtagagagaggatgagggagagagccgtggcgcgtgagagagggagagagaggggagcgatgagagagagggaggagttgccgagggtagatgaggaaatttaacgcgatgaccttttggtaggggtacctatagattttgaggaacccatctagctatggcctccattgtgagacgattgtctatataagtgttttcagttagtgagaacactcaatggatatcttacattgtagatgctctaatacgcatgaataacaaggtcacatagggcttacagcagggctcaatgcacggcacggcacggcacgccatggctggaccgtgggtggctgattgggtggtggtgatggctcaccaaagaaatatttatcactcttacatattcaattaaaatttttaccattaaactaatatattatagatatatgagaactcatataacataaacacgtgagaactcacgcgtcacgaattatgagttataaatttttaattattatattttaaaagtgataaatagttaaataccttgtagagtggagaaaaaaaaaagagatcaaaactcccagctaaaacaagatgcggatgaggagacaccgagagagccagacaggcccctgggacctgggtggatgggtgaagatgatctcatctcacacgatgctactcactacacgcagttcacgcgtccaggccccgaccggccattaatggtgctggcttctacgtgaaggaagcaactcccacgcctcacgaggccgagccagccagacactgcatcaccgattcaccggtgcgcgtgccgtcgaatccgaggaggaaagacaaaaccggtgaatgcgtgcgtgctttagagcaatgtgaatagtatagtccgctggtggctaagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttctaagtaggaaaatatgctgacatggatctcttgtagagagcttatagataaccactgtgggtgccctaatagaacatggctaaagctaactactggtacaatagattgtctattagctgtctgtatcttataattaaataattaattataacatgcacatatcaatgcatgtgattagcaatgaattgtatccgtgtagctatttgtgttgtgagatgaactttgttcaccaaacaccaagatcatttcacagatcataccaaacaagttatatgttgtataaaaattactacatacaaaacaaacactagtgtttcgtggccaagaaacgctcacgaggaaggattatattccctgttctttttcccctccaatcttatggccaaaaaaacaaaaaggacatgacgctattgctgcatcacgtacgagtatcactccagatgacagctgatgaccagcgttaatcttttccccgatgcagctttgaaagggaggagccaatgcaaatcaaaagaagattcttcgtcgtttcagcattacagcctcatttcaacggttataaataacagtatatatctcgatcgtactctcgcgacttgttatcctgatcagatcttgaagatcggtaaggcgatcgatcgacctgatcagcaagtggattgttagcaggagtggtggtacaagcaggccggcacatcctgcggcaggatactgatataggacgccaagttgccacttgatatctcgaacttatgagacaagggttgacatgctcatgttgacattacagatcatgcatgaggcatctgctactaggtgagagtaagcacattggagtgtggaagggaccaacatgtgtgctatgtcttcggcttgtccggacctcatgcatgtgtattgccatagtttgagctaattttgcacgaaagaaaaataaatcttaagaggaaattcatatagaatacgcacaagtgtgtacggacacctgcaggtggtagagttactccctccgttcgttctaaagtactccctccgttttttaatagatgacgccgttgactttttctaacatatttgaccattcgccttattcaaaaattttatgcaaatgtataagatataaatcacacttaaagtactatgagtgataaaataactcataacaaaataaattataattacgtaaatttttttgaataagacgaatggtcaaacatgtgagaaaaagtcaacgacgtcatctattaaagaaaagagggagtgtactccctccgtccttaaaaaaaagcaatcttagatgaggatttgacctcacctaggacaatgaatctggacaacctcatgtccaaattcgttatactaagtgatgttaaatcactaactaggttgttttttttaggacagagggagtaacgcataaccatcactaacgtaaatatcaagaaaaataatttaatcacctcctcgattaaatcatctcaatgcatataagcagtgtgattgatgttaatttgaaggtagaagatttaaaacaaatcaaaatttagaggagaaagagatctgtctagttaatgtatgtcggtatacacgttttatattatgagattcgaagaaaaaattggttgtcttatattttacgacggaaaaagtatgaggtagttaactcctaaacaatactccctccataaaaaaaaatcaacttctactgtttaaattttgtctaaaaaaatcaacttgtaccatcttatctactcccaactagtaaaatgagaatttttatcacttcaatactctttacctatctatcactcttactgtttttttaataaccaagagtattttagtcattcttcatcttcactaattttttttgttggaatgctagaagtggattttttttatcggagtacgttacaacagcgtacatccgaaacaattaggagcaggctgggcacgcgtatggttaaaattgttaaatttaacaaaacctcgatatcagcaaaatccatgattaaattgtcagggcaccatgacttaagcatgaccagtgcattgtgatattggcaccataaattttctagagctgccccaagaaatatgtaatcaaagaattggcgccgttcacccggaatatttagcctgacagcaggtgatcacgttgacatgtttaggctgtgtggtttgatcatggtcggtgcttaattaggttaatacaaacgatagtacgtactgcatgcagacgtgcagacgtgattcccggagaacgatgctcacgcgcaggagccaggaccaaaccgaccgtctgccggtgagatgcgtatatcgtacaaataattacatatggcaacgtgcttggtaggctatcgcttaaccatcctgttcatgacttacactggtggagaaatccttcgtagtcccggttcgtaacctccctttagtcccggtttccaaaccgggactaccaatccgggactaaagatcgctatctttagtcccgggtaaaataaccgggactaaagatctatctttagtcccggttgatagccccaaccgggactaaagatggctcagccgtcccggttggtgttatcaaccgggactaaagatcgagctgacctttttttttttgcatgaccctgttgctgcatggtttatatatatataaaccatgcatatatatatatatatatatatatatatgtttcagtacatatatgcatatataatatatgcatatatatatatatattatattatatttatacatgtttcaatacatatgtacatgcataatatatatgtatttatacatatatatgttatgcaaatgcatatatatatatatatatatatatatatatatatatatatatatatatatatatatatatgaccaaaatatatttacattatagaaaatgtgtacacatgcatatagaaatatatgtagtcatgtattaattacaatccattatatgtcctagctagctacgatttcgacgtagtagtagtcgctagctcagaagctaaggacctatgaattgtgtttccgtcgtagtagaattcacccttgggatcaaggatttgttcgttgatgaatcccatgagttgttcttgaaccgccgcgataaattccttgtgcgtggttaggttatcccttatgcgaataaactatatgaatgtatgaaattgattagtaattaaacaagaaatcgatacgtaatgaaattttgaatttatttgtacgtacattgagctctcttgtggtgatgatttggtctgcaaggcagtggcaatactcgcacacgtaatagccgcacaagttagttcccttcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaaatcctacatggagtttaaagctatgattcgtagtagcaattaacataacaagattttcttaattaacagaggaacttatgacggtacctgtctataagtttgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagtttgtacgggaatgaaatttggtataggaagacagtaaaattaaactaactctgtgttgtacggcaacagtatgaacgtcttgtaatgctgcaccttcaggagatggacgagattgtcctctgtggcttgcggatattggtcgagcattgtgacgtttactttccgagggtcgatgaatccagtatcgaaaaccccccgccgtcgggccctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattcccttgaaattgatccagagaatgtcatctccttgcaagaagtctgtgtccctgatcctcgctctgatcatctctctaccggtggcgcttatctctatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattcttctatcgtcatttctttaccggtcaccaacggctcgatctcctggtttggttgctctccaagctgagggactggtttggactttctagaagatgctttcttcagcgttcgctcatagtccgatagcttaatggcctccttggcaggtgcagacatacccctgaagaagttcatgacactcgggtctataggaatcttcttttctggacttcgaggcttgaattgtctcttgacttctgatgccacgtaagcgtcaagctcctcttgcgtgcaatcgtaccccgagtccttgttcttggcggcgtcaactttcgccttcttcgtagcccttgtgtgggcaggtggtggagcttggggggcccttgactttgaaggtgacggaagaggagcttgcggaggagtcggtgtaggagcccgcggaggagtcggtgtgggagcccgaggaggagtcggtgcaggagcctgaggtggagacggtgctggagcatgaggaggagacggtgcaggatgctgaggaggagatggcggagccggaggagatggtgcacgagacgccgcttgtcgcccagggaggatgatgtaccacctgcgccatagaataatggcatggcttgtgtctcgtagatgcgtctcaccatctcctccaggataatccagctcgaggtcctcgtatgcgccttcaaccaactcaacttcaaccttggagtatcctgctggaatcagcctgcagtggtaagtacctgaagggtccattgggatggccatgcccgacgccaccttcatgtggtgagaggttatttattagtaattaacatatataagcagcaactagcggaatgggcaaatctaaaatatataaactacgagcttacctttattgataagttcttgaaaggaatatgcagctcacatggtgtccgctgagtgatgtcatcaacggggcaggtggattcgtcctgggtttgcatggcgtccatgctctgtgatcctacctgtcccgttgaggcgcagctgctacggtttcctgacgggctggggatcattggaccgatgtgtggccatgcgttcatcaaccttccttgccacctcctcttgcatgctgagctcgtagctcgataccctgaactcaagatttgcaatcttcgcctcggtatctctcttgctcctcatccgactcctgtacgtgtggatgtcctccttgaacccaatcttccaaggaatcacccatttccctcgtgttcgtcctggatgctctggagtctgcagggcgagtaacagctcgtccctctctctatccggtcggaacgtgccctgagaagagacttccactgcgtctgttagtcgacgcgcaacctctcgtatctgatcgccgaagaccagtgagccatcagctgggttgagcgttccatgtaccaaaacttcgatcgttccggccaattagcggtggccggttcgatacccctctcaagcaagctagcctccatctcctcccacttcggcatcgcgacgctatagccgcctgaccccaagtggtgatggtactttttcttggcggcattttctttgtttctttccatcatcgcctgcccttgttcacctgtcttatatgcaacgaactcgtcccagtgatcccttagctttgggaatgtgtcgaagttcggtgtctgccccttcaggatatatttcattaacctgcctataattgcatttcacgttcacgttcgttggctcgttcacgttcgtctgacaacgttctcgttcacgttcattcaccttgttctcgttcacgttcgttctctcgttctcattcacgttcgttggctcgttcacgttcgttcgctcgttctcgttcacgttcattcaccttgttctcgttcacgttcattcgctcgttctcattcacgttcgttggctcgttcacgttcgttcgctcgttcacattctcggtgtggcggcagcgggacggcggtgtggcggcagcggagcggtggcggagcggcgcggcggataaaacgtaataagcaaatatatgatttaaaattaataaaaattctaataatcatatatacttagcatatgaatgatattattaaatctgtaaaaactctaattaacatacgtatatacatacggcatgatttaaaattaataaaaattgtaataatcatatatacttagcataggaattatattaaattaaattgtgaaaaactctaattaacatatgtaaatgccacatgcatgatttaaaaattttaaaaattcgaatagtcatatataattagcatatgaatgatagtaaattaaattgtgaaaaactctaattaacatatgtaaatgccacatgcatgatttgaaacttttaaaaattctctagtcaattataattagcatatgaattatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccatacatcaattgatttatatggataatcaatacatccaaaatagtttatatcgtgtacacaataattacggcaatacatcggcggtgacggttgaccacatgcactttctcctcactattgttccctccttgtgatcgctacgtgagtaaggggtgtcttcatttgataggaggatgctagggtcaatcgtcaccgtgaaaggggttgcccatccaactgatcgtaatccttgtcagtcttgtcctcaactccgacgatttttcttttgcctgggagaaccacgtgacgcttaggctcgtcaggccctctgcccttctttcctttgctagacatgttcttcacgaaaaagacttgcgttacatcattggcaaggacaaaaggttcgtccgagtatccaaccttgttaaggtcaaccgttgtcatcccactgccatcaatcattacgcctccaccagtcaacctaacccattggcaccggaacagagggaccttgagaggaccatagtcaagttcccatatgtcctcgatggcaccgtaatacgtgccagttgttccattgtgtcccatggcatcgacacgaacagcgatgttttggttcgtgctcatcatgtcttgggctctcgtgtagaatgtgtacccattgatctcatatctctggaatgtcgcgatcgacccagacggtcccctcgctaggaaggcaagttgttggttgatcgactcgttacccatgagatgttgtcgtatccacgcggggaaagtatcaatgtgatgccgtgtaatccatgcatcggacttaccgatgttcctggcgcgaactagagccaagtgctcctcgatgtaaggagctaccaatgaagattgttgcagaaccgtggaatgggctttacggaataaattattgtctaccgtcattattgctttccttccgagagttccctttccccgtagtctcccttcatggcgtgattcaggtatcccgattgggcgaagatcttcgataaattctacgcaaaattcgatgaccttctctgttccataacccttggcgatgcttgcctctggacgagcacggttacgaacatacttcttcagaacgcccatgtacctctcgaaaggaaacatgttgtgtaggtacacaggcccgagaatactgatctctttcacaaggtgacaaagcagatgcgtcattatattgaaaaatgaaggtggaaatatcaactcaaaactgacgagacattgcaccacatcattctgaagggcttctaatctatccggatcgatgaccttctgcgaaattgcgttcatgaatgcacatagctttgttattgtcgcccggacattgtctggaaggataccccttattacaactggtagcagttgtgtcatcaacacgtgacagtcatgagactttaggtttgtgaacttcttctccttcgtgcttattatttgcttgatattcgtggagtatccagacggtacctttatgctctccaagcattcaaacatactttccttctctgccttgctaagagtgtagctggctggactcaagtaatgacttcatttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgctggcgtacgtccaagaattcccaatagggtaactcccaaaatatagagttttttttccacatcgctgcgtgaccatctttgctctctataggctggcttccaggcccctttccgaacactactttaagatctttaaccatagcaaacactcttttctcgttgcgatatttaggcttcgtacggtggtcagccttatgttcgaagtgcttgcctttcttccgtaccgggtggtttgttgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgatggtatgttaaactcctcctgtttgtcctggtcccacacggggacaccttccttcttccacaacagcttaagatcttcgaccagtggttttaggtacacatcgatgtcgttaacaggttgcttggggccttgaataataattggcatcattatgtacttcctcttcatgcatagccagggggggaggttgtaggtacacatcgtaacgggccaagtgctatggccgctgctcatctctctaaaaggattcatgccatccgtactcaaaccaaactgtatgtttcgtgcgtcctttccaaattctttaaattttctgtctatgtttcgccactgcgaaccatcggcggggtgtctcagcatcccgtcctgttgacgctcttcagcgtgccatcgcatcattctagcattccccttgttcctgaacaaacgccttatccgtggtattatagggaaataccacatcactttagcaggaattctcttctttgttagctgcccgtcaacttctcctggatcgtctcgtctaatcttgtatcgtagtgctttgcaaacagggcatgcttctaggttgtcatactcctcaccgcgatataggatacaatcatttggacatgcgtgaatcttctgaacttccagtcctagcgggcagactatcttcttagcctcgtacgttgtctcgggcaatttgtttccctccggaagaatgttcttgacgagtttcaataaatcgccaaatgccttgtcactaaccccattttttgccttctattgcaagaactccagagtggtatccaactttttgtgcccctgctcgcaacctgggtacaacgaagttccgtggttctctaacatcttgtccaatttatgggctcccttttcactttcgcagtcctccttggcgtcttgcaacatctgaccaagatcatccgcaacgtcgttaccatcagcatccctttcctcctcgcccgtttgatttccttcaaatccaacgtactgagcaaagtccggaatattgtcgtcttccacttcatcttcttccatttcaacaccttgctctccgtgggatgtccaacaattatagcttggcatgatccccgactcaaacaagtggaaatgaatagtcctggatgcagaatactccttctgattcttacacttattgcatggacaacaaataaaacccctttgcctgttagcttcagccactctcaaaaaatagtgcacgccgtaaataaactctttggaccgccggtcagcgtacatccattgccgatccatctacatgagtcgaaaaaaaatcgtacaaaaataattattcttacaataatgacagtcatacaataattataagataattacaaactgttttcaacagtcatacaataatgacatatctttattcatacaaaaatcataaaatattacaccaaataattcttttttactatttctaaagttttaaactaattttaatgtgttttacttcttttaattttcattttagtttgttttctagtattcaagattaactttcagtatagttttccttctcaactattttataaaaccttctttagcaaatcaacttaatttctatatattctttcttccccacacaaattttctccctcatcaacttacaactaaattttggagacaaaaaagtgtgcaaatcatagctgcaaatgtaatatgacaaaaaaaacattggaggatgaagttgcaaaccttttaggcacctccgatttgtatgttatcaccaaaataaattcactagaaattttggcatgacctcctctcttttttgaagaaattttgaagcttactcgggcagctgaaggaggcagaagacatatatataggggtgggactttagtcccggttggtgttaccaaccggggctaaagatccccgagatctttagtcccgattggttaccaaccgggactaaagttacaatctttagatcccgaggggcctgacaggccctgacagcatttgaaccggttaaaaaggcaaccaggactaaaaatcaaatatgcccgttaccctttttaaccgggactaaagatcatctttagccccggtttttattgcatccgggactattgtggaattcggccgaccgacgaaagatggtttctccaccagtgttaattagaacattaattaatttctcggttaatatcagtgacagacatagctttaaaatacaggttaatgatcgataaaattaaataacgggacttattatattgcaatagcatataaataaagtacaatcaattaattaagacgcaaaagaacatctaagatggtactgatgcaccagacaggacagtgacgcagccatgatcgtatatagaacagatgcaccgcagaggacaaagacatagccataatcacacatagaacacactcaaatcaaaccatagtaaggaggtcacaaaactagcatcgcacgaatcgtgtcaagcgagttagcggaggagatgaatagtcattacacgagcgaggtggcaagtttagtagtaaagacgaaactagtggagaaaccatctttacccggtcgaccaaaaatcacaataatcccagttgtaataaaaacctggactaaagatggtttttagtcccggtttataagcagaacgggactacacgatctttagtcccggttggtgttacgctgttagggccctccaggatctttagtcccgatttgtattatcaaccgggagtaaagatcacgatgatctttagtctcagttggtgttactaaccggtactaaatatcaaaacgcactatataatccctagtactcatcctcttttcccgtctacacaaacttctctctcttcatctctaatccttatctctttccttcctccttatttcttttctttccttatccctagtcgtgtgtggctgagtagtgcgcaggaggagggggagggcgggccggacagcggcctgcgcggcggcggccggggagatggcaacggctaagccggctggcggcttcgctttcttttctttcttttttttaagattttgtgatccattgtatggattgagatggagaatttgtgattcattgtatggattgagatgtataatttcatttttgagaatatgtgattcatcgcatggatatgtgatgtatatgatttgtgtatttgggatgttactttgatttggggatatgcatcccacccaatttgggagaaaataagttagagattaagtagtaagtagcaataaatgaaacaaaaagaaactaactgggactgccgctcccatctacaccaaccaggattaaagatcgatctttagtcctgagtatttgaaccggactaaagatagagatttttagtctcggatttgtagtgggttacgaaccggaactaaaaacgatttcttcaccagtgcgagatgacaattggtgatgatataggggtgtgggggcggcgtggaccatatatagttggccaatcgccccaccctatgccctatgggtgtgtccatccctgattaatatatgtttttcaattatacacacatgtgcacgttgcatatatatcctgtcataacttgtataacaaataccattcacgcatgcacatatatcatatgtgcatcctttcttacatgcactcaacgggtagagagatcgatactaggtaaatccataaaccttaaaaagagtcatatggtcattagtgtatatcatacattttgtaagaacattttatttttttaataatgtatagaaattcggtttctatatccgcacgtggatagacatagttaaaacaccaatgtttcataaattaattcattaattaagaggtgtataaggaagacctaaaaatatgatccataataaattattcgcttgaaaggaaccacttgagtaatagactcgtagatgcatatataattccaattatcatggttcaaatcccaattgatcactacaaatattatacacacacaagtgatttaatattcctttttaaatttgaaatttaagttagttttaaattatatttctacttgaactcttatttttctttttcttatttcagaatttattttagtttctattctaaattttaattaagctcatatatattgggttctagatggtcttttcttttaatattcattatttctattctaaattatagttattcctaaattttatttctacttgaactcttatctttgttttctatttttctaatttattatttaaaaatcaggatttaattaacctcatgttgta

SEQ ID NO: 69875 - DNA, 2635 bp, Oryza sativa
ttgcattctattagttacctactataaacatcaagattttgcccttacgataatttaattattttccccacttgttgaaaatatgtatagcaatgcacttttataacataaaaccagttgcgaagtgatggggaaaaaactaacatttttttcttctatcaatcttaggggcaattgagcagtggacttaaaatagcagtcaagagactagaaacatgttctttacaaggtttactggagtttcaaaatgaaacccaacttatagcaaagcttcaacacaaaaatctcgtcaagctgctgggctgctgcactcaaggagatcaagaaaaaattcttgtatatgaatatatggaaaacaaaagcctagactacttcatctttagtgagccctttattttctatgtgctcgaatgtgatgctgtttataatttatactaaatgttaactaataattgcaaatgttctgcaggtaatgtaaagggagcacaactaaactggtctaaacgtcttcacataattgatgggatagggcaaggacttctttatcttcacaacttttcacggttatgtgttgttcatcgggatttgaaagccagtaacattctcttggatagtactatgaatccaaaaatatctgattttgggatggccagaatattctattcaaatatggcagagtccaataccaccagaatagtgggcacacagtaagaacatagtagcacatccattttgttgcgcatcatattgagatttgagatatgcttctttcttcttcttttgggggttgtgtgtattttccttgggggagggggggcatgcatgaagcatccaatcagcaatatttaaattctatctttttcatcagtgacaagtatcgattttgcttccttcacacagtggctacatacctccggagtatgcatttgagggggtttgctcaatcaagtcagatgtgtttagcttcggtgtgttaattttggaaatagtaagtgggaagaggacagcccacttctatcaacacaatggaaagctatataatctcatttcatttgtgagtactgataccccaaatcctgatttacttttctatcataccagttgtttctataatgaagtgcgcatgacacttatttaacgaaagcacactattctggtattaggcttggcaactttggagagatggaaaatggggtgatctgatttattatcctccagggaataaacatcaagagatagaaaggtgcattcatgttgcgcttttatgtgttcaagaaagtgcagaatttcgaccggctatggagcgggttgtcacgatgctaaacaccaagaatgtgagcttacccatgcctatgcaaccagcttacttcaatgtaaatcctagcgaggaagaagtttcatcatgcaacattactgtaagcatcacattagaaaggtaggaccacatagccaacaatgtttttcactacaaagttgttctcaatgctgttaaagatacaagttatattaaaaaaaatgtttacatctaatatagtgatttgagattgcttacatttgttgggctgaacttctttggattgaatcttcattgccccttaaggcacggagcattcttgatcctatgctagttgtccattcctagaataaactgcacaggaggagtatagaggaagcaaagcagcatataggtcagtagctgttaccagcgaggtggctgtagttacagctgatagtaaaatggccccgcaaaaaaaaaaaaaaaaaaaaaaaaaaaggctgatagtaaaatggaattggcaatcaaccgaaaaatagtcgcgcttcctagctatccccattcgagagagggaccgcgaaaagggactcctaccaattaatagcggaagatttgcaattcctaaagcatctcgcacctatccaagttacagttttgctgccgcgccatcgatctctcgccctcacccgcagaaaagataagataatatcatccattcgctatccctagccaatctaatcccaaaaagtgaaatcgcgacgtctcgatgttcaattcgaaaagcagaacaacaataatgcagctgcagagacgaacctgcggtgtgcttcccacccccccccccccctcccccctcttctcgtccagctaggcgaggttcggccgcgcgcgcgcgcgcgcagcgcggacctcggaggcccggatccgccgtcacggtgggggtgcttcgccggtggagctcgccgcctcgccggcgccggcgccggcgccctcaaacccttgcgccgccggccaatgcagccatcctgggcccaaaaccgccatggatgacgaaaggcgacaggccgaagaacatttgttgggctggcgggcgtgacgtaagcgacgccggcccatttttggtggtcctttctcttgcatcttgccaaagcgaaacatccaatccaaccgtgtcaaaaaaaaaaaaaaaaccaaacatccaaccactgccattgattttataataaaataaattaaaatggttcatatcagagctcctctagcgaggagaccagacacccctttgtgagtttggttagggtgtaagttttaagctcgggtcacacatgaagattgatacaaagaagtatacagattcgg

SEQ ID NO: 69876 - DNA, 707 bp, Oryza sativa
aatagaatttcccattctcatattttactacatggactatgcagtagcaaaacaaataaaaacaacgtatacagttgtactacttttcttcaaaaaaagcaccttgagttccatttcttgtgctacagtattctgttagtggtactctggtacattcagtttcatagctttatccattcatattacaaagtgatcactccactcttgaatatcatattgcaactagaaaaccaccagtccagacttgttaaaaaaaagtcacatctgttcgtttcagcaacaattatactgcgattctccacatcccaatcctttatttattcaatggtggatcattgcttcttttcttttcgaacaagccgtacagttttattcttattttatttttattttttagatgcagttcccttcagttcctgcgaaacaaagacgaaggccaagaaacttacagcaagtgaaggacaaggcgacggcaagcgcgctggagaccgcggccttccatggcaccgctcttccgaggtcaccggcccaagaagcagcagcaaccctgcaagcggcggcggcggcgggcggcggagtccgacaagcggagcagcggccgccgagggaagaagcaaatattggtcttggacgagcagataatggcgacgacgcaaatgcggatgctccggaaggtgttatccgaagggcgtggcaaggaaggagaa

SEQ ID NO: 69877 - DNA, 4064 bp, Oryza sativa
ttgaaagcaaatccgttttgaatgtgttttatgcaaataaaatttgctttatgctaaaaagaaccatactatgccttccttgattatataccttgcaagtagggtgtaggcttgtcttggtgcttgccagtacattatttctaataatgtactgactcttgctgtggaattaacttttgcttgcaggatttagacttagtctttgagtgatgcgggttatcgactgcttcttctaggacttgaacataatgggtaaacccctagtcggtgtgcttgtggattgggtagacaagtttccgctgttctattatttatttggccggtcggccaatgtaactaaagtagatgtagtttttaatcgctttcatcttatttgtgtttgctatgtataatcatgcttgagatgaaagtgtgaatctagtgcacatcctgggaactagattcacatgagtatgagttaggaatatttgagatgtagaactttagccatttttgtcaagtctcctgaatgtgtaacacatctggtcgccgccttcgagtggtttgacgggcacatctcaggctgaagttgactggcaggctaaaggcctagcaatatctccaatattcctctctcgaggcgtcggatatttcattatgcttgtttgatgacttgaattattcacttcatctctcaattataatggaaggtccggagagcctacgacataatgttaatagattgttgctagagaaaatattgatggtttacaactctaatatggctaattatagtacaaaactataaatgctacaagtcaactatatgggtatgggtacccattggatacccgttacccgcacgggtgtgggtatggggaagattttctactcgtgatgggtgtgggtatttaagtgggaatatttagacgtcacgggtgtgggtatggggcaagagaacccgatgggtatgcacccgttgccatccctagccgcgccgcacgcgcctgtcacgcgcgcgcccacgcgcgttgaccgcgcctggcaggcgggtcccgcctgtcggacccgtcttcctcccccagccggcctcttctctctcacgtgcaaacctagcgccgttcctcctccaaatccaccccattcaagccggctctttccaaattaattggggggttttaatccccattgaatcctcttcaattccccccaatttcccccttgaatcgtgcccccaatcgccgggaatgcccgcgccaactccggccaccttccatggtcgccggccgccttttccgccgccgttccgacctcccccgtggccggctccctctcctctcctataaaatggaaccccctcgccccgttctctcgttttagccccctcccgcgatctcctgtggtccctagccacctccccaccgtggcccttctctttcccccgcgccgggcgcctccagccgcctctccctcctcgaccgtgcgccggccggccgtgccgtcgccttccccggcctcgtagccgcctcctctcccatggcctgccctccgtttcgcgcggtgaccgccggaggcgcgttcccgccgtcgtccagtggcgttgccgccattataccacctccagccgcctgtgccgcctcgccggtgcagcggctgtcgtcgtcgccatcctccctcgacatcgccgcatcgccctccaccccggcctgccctcggtttcgccggaacgccgtcgtgccgcgccggcctttccatccgcctcgctggagttccttcggcaaccccttccgccgtgcccgtgtgccggccgacgtcgccgtctccacctccggcatcgcagcggcaaggtcgccctcggcctcgcctcccctccccctgaacaccgccggtgtccgtcgtcgtcttcaccgttcatcctcgccggctcgtcgtctcgcggcgccgcctccgtcgtcggattcgcagcggcgcgttccacgtcgtccccgtctccgtgcagctgccgccggctgccctcgtcgcctcctcgccggccccgggcgtcgtcgtcgtcgtcctctcgtcgttcccggtcgtcgtggcgttcgtccctccgtcgagccattctcgtccgtcgtccgcgttcgtcaagcgagccgctgcagccccgtcgtcgtcttcgtcctcggcttcgcatcgtcaagcgttgcgccggccgcgtctcgccttcgtccaaggatcgccgccgaagtcattccctcaccgtccgtctccgcctcgcccgttcgtcgttgtcgttcccacgcctcgtcgcgtggtggtaaggatccctctccctcgctgccccgtcctcgtcctttcggtgtcgcccatgcctattgtgcggttgtcggccccggtacccgtgtatcggtgtcggcagtcgttcgcttgtgcgtgtggtgaccgtgttagtgtgtccgctcagtagcagcgtggtttccacgtgtgcagcccgtgtggtgtctagtggagtccgtttgtcggccactcgcctcggttgacacacaggatccgcttccgtcgacccgtggaccgtctctgtgtactcggtctaccgcggtcctttatgttgacatgtgaggtccgcatgtcaacagcgcagccttcctgtcttttccaggttagcgcttacacatgttttgtagttgcaaaaccaaattacaataatccgtaaatctccatgtaacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgcggtcgtcgccgagggtttggaaggccgttctctctgagcaaggcaagtcacatcatccttgagcatattgaatcccagtttataaaattattttgatttaaattaatgcattatcgttttatttaaattcccgcgttatcactgttttatttagccatgcctatttacctttgttatgatattattattgctattgttattattaccttgttcaccctagaataaacaaaaccccaactagtgggcactctattcatggttccactagtatgaatttaggtagatgcttcgctaattaattaggcaacattaggtggttttataactctagactttgggaatattcatatcacttggacactatggaatggttggattattgtggaattggatgcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaggtacacggatggagatggacgaagtcgggggtcgatggacatctctaggacaaatgaaggctacacgggctgtggcccggtagtcgagatgtcatggcacagggttggtgtcctgctgctaggggctcaattctgcctgcctgtctgggggttccggccgtaggtgggttgggtcggtactcttgtctatggctaggatgggttggaaactatgtcatgtcttccgtccatatgccgtggtggtatgtggcacgtggttgcacgtgaggaagacgtgtcttgtgggtaaagatgtacacctctgatcagagtaaaacctattcgaatagccgcgccctcggttatgggcaagcctagcaatgtacccaagttagtgttttaaattcttaaaacctgcttaataactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaa

SEQ ID NO: 69878 - DNA, 6726 bp, Oryza sativa
tccagaatcgtagtactaagatgtgtcacagttatctaaaagcccttatattttgcgacttagggagtagcacttatatagaatgaatgatgccgtatcgtgtataaccatgagctaagctaatgttttgtaagaaaggagaaagaaacagagaggcgtgactgcacaacacaagctttctttgatttccaagctcttatcttttccatatccatgagaccaagagctaatcccatgctacctgctggatggaacttggaacacttgcacctgatctgaatcattgagtttagacatgtggtgtcccactgctcccgttcgctttatcgtttctatcgaatgcgacgtttttattgcttttggctcccccctagatccatccatgatagcccatggttctcggatcaggatgcgagcaccggcttagtcgggatgacatgagtgaaaaaataatccttcagattagcataggtcgtctgaagaaagttcaccatctatcatctgatctgagaagaaacagaagataaggcaaatggccctgggtccatgccaagattgtgatggtaatgttaatctactgaatcagccgcagtctgtattggagacgcatgcggatcttcgcgtgatttttttggctgcaagtagggacaagttgctgtcatgatgtagtaattctgaaaggttggatgagttctaaccggcaaccgccagccgttatgaagagacaaagcgacacgatcgggagatgcttagctcgccattgttgacattttggagaaagtggagtattatatctatgattaatagtgtgtggttgtctggtgacatcactagattatagtacagtagaaaagtttcagaactgggcggctgcttgatggagcagaggaaatttggcactctgaaagataaaattttaatatcaaagtcaaacaattgatgcacgtaacaatttagcatgaatttttatatcgtatcaggatctgctgattcaaaaaattgaaaaactttggattgatgcaggtgacgttcctgaagtgtggaggcgtggccgtcggcacgggcatgcaccatgtcacgatggacggcgcgggcgcgttccagttcatccggacgtggacggggctgtcgcgtgggctcgacgccgcggccgcgtcgccgtcgccgccgtcgcacgaccgcaccctcctccgggcgcgctcgccgccgcacgtcccgttcgagcacccggtgtactccccgagctacctcaacgggctgccgcggccgttcgtgacccgcgtctactccgtcccgcccaagctcctcgccgacatcaaggccgcctgcgcccccggcgtgtccacgtacggcgcggtgaccgcgcacctgtggcgcgccatgtgcgtcgcccgggggctcccccacgacgccgagtcgcggctgcgcgtcccggccaacatccggcagcgcgtccgcccgccgctcccgtcgccctacttcggcaacgccatcgtgcgcgacctcgtcacggtgcccgtccgcgacatcctgtcgcagccgctggggttcgtggcggagcggatcaagcacgcggtggcgcgcgtggacgacgcgttcgtccgctcggtgatcgacttcctggagctggagtccgagaaggggaaccaggcggcgcgcgggcagttcatgccggagacggacctgtgggtggtgagctggctcgggatgcccatctacgacgccgacttcgggtgggggcgcccggcgttcgtggcgccggcgcagatgttcggcagcggcacggcgtacgtgacgcaggcgccggacaaggacgacggcagcggcggcggcgtgtccgtgctgttcgcgctcgaaccggagtacatccagtgctttgagaaggccttctacggcacagagtgatatgatgcggcggcggcggcggtggccggagtttagagctggaggacatcgagcgacctgggatgcatgatgacgccgaggtggtgtcgacgtctgctgactctgtgtcatgctcaatacataacataatatgcgttatttgatttgcggtagaagtatttagtgtatgctggtactgtgcaacagtgcaagtgtaatgagctgctgccttgttggttgcagctctctctacacagacactttggtctgtcttaagttcgtatgtacaaaaaaaaaatcaaatggaaatgaaaatgactatggaagcaaagaaagttcgcaagcaaacggttggttatttgtagaataagcgaaacagcatatttgcaaatgaaaaataatttgtgaacaaaacttttatatacgtgttcttagcgatttaacttttatatacgtgttcttagcaatctaaaagtaaatattgaaaaataaacttcaataaaaaaaccttaaaatcagctctaaatttaagtttaaaaatttaaattttggctaataaacattagcctaagcgaaaagataaagccctatggtgcacggctcgaaaattcgatcaaaaccggacgaacttcgtgaatttcgttgtttccggcctgggacgaaagcacaatttcgtcagggagttcgaacacttttgagattttccaaatttgagaaggacaatgaaaaatggggaaaaagtcctaaaaacaatcatgtttttgtggtacagactggcaaaaaaaataataaactgcatttgcataaaaattgggggaaatcctgaaagtagtctcttttttttttcaagaaacctcaattgacgaaaataaaaaaagaagtttgcatttgcatattgggccgagaccatgaagcatgacagaccggttaggcctatattgagcctgtatgtttctctatttgtatgctctttctctcgcacgcagtctgttggcatctgaaatttcgctcatctagcttggaatttcgataactcaaccggattttgatgcgtgccaagtggacttctaggatttgaattcaaattttctttactcaatttatccaaaaactataaattttttgaatgactttcgtgattttcgtcatatcgccagcgtccggcatccacggcgtattcagtaatgtaaacctaggtggttactacgttaaccttaaggtgatcatattaatataggatgtatgtacgtatttatacgagtaaatatgcacatgcatatataagtgtgtttgtactatggttcgaaaaagaaaaaagtgtatttaattttatcctaactatttcattgggtcacttaatctttcaaagtatgttttagcttattttaccacaaaaccattgaaaatgattcattttacccattgataaaatttctcctttttaatttgtacagtttatattttaaggtaatttttttacaaccattgataatgtcattatcaaaattttaatagtgaatcatttttaatagtgtactgtaaggtgcaaaaagactgaaaaatagttaaggaggtaggttaaatacttaaatgctttgacgaaatagttagaatatttctttttcgttactggacattgatttggccctcgtccgtgtgactggcgcacacgccgtggcgtgctcacgtctcaccctccacgcgaccacgccgcgcccacctatggcacttggcgcgccacctctggcatttggggggtgagttttgtgatacgcgccacgtgttttaggttgtgtctggttgggcttttcaatctgcttttgcttttgcaaaagccaaaaacaaatcaaagggctaaaagccacaattgcttttgctccaaagctgcttttagtgtagtataaatccaaaagtagtccctacccctgctttcattggcttttgagagaaaaaattacccacctatgccattatgaaaaaacgattcgcactttttctttctttcccgttccccttctcgccagaccgagcgcctggccattcgcagttcgacgcggcactagggtttgcgccaccgccaccgcgcgccacccatgttcccgccgccagcgtgctcccgtcgtcgcgagccgcgtctcccggcgctggcatgctccgacgcccgtctccccattgcccgcccccacgccacccaacgccgccccaggctgcccgatggccgacggctgtctccctgtcgctcgcccggtggccgtctccccgtcgcccacccgacgccgccccacgccgcgccgaagccacctctgctcgacgctgcttgaagacacccctgctcgacgccgcccgacgctgctccgatgcctttgccactgctctagccggtttgaaaggtgaggccgaatcgcccctgcccctgctcttgtgttgatgcatgtgttgtccctagaatattacagcaaattgatttttggcctgcaaattgattgaagaaaaatttatttggttcaagaatgggtgacaaggcagattggggtgatgattttataaggcatttgtttgatgtttgcaaagaagagatagaagctgggaatatacccatgggaattttcaccactaccggttggaaaaatgttgttttcaagtttgcagaaaaatcgggtgacaagcgaaccaaaaaaaacaattgaagaggaggatagttattttgagatatggcatcattgtatgaatgctctgtttatgtggaccatatcactttgatggatgaaaaactaatatattttgatgaaaaacttatacattttttctacaaattggccttttaaatacaaaatattgaacatattaggttaggtttgtacgagtaatttgcatataaacagtcctttcttatacaacttacagtttcacagctgctctaaccaaacgggcttctgcttttcccacagtttattttacacagctgcttttccacagcccacagatcacaacagcttttccaaaagccacaactctaccaaacacacccttaggctatgtgaaaatttttgccgcgttacatcagatatacagacacatatttaaagtattaaatatagtctaataataaaataaattacagaatccgtctataaaactacgagatgaatttattaagtctaattaatccgttattaaaaaaatatttactgtagcgttatattgctaaatcatgaagcaattagacttaaaagattcgtctcgcaatttatacgtaatctaactaattaattttttctgtatatatttaatactttatatatatatatatatatatatatatgtccaaatatttcactcattttatttcgtgagacagggtgaaaaaattatcagctctccgtctgcccagtgatatccgcactcgccttttctgactgctgttccctgaatgcacgtcgcatcaagtcaggagaggcattgaacaggagatagaaaagcccacaagttctcttcgagaaagagaagtattagttttggacaatttttaagttaaccttagaaatataaatcataaataacttttaaattattaagtttaaaaatataaaaattatatgaatagatttgtcttgaaaaatacttttaaaaaaatatacatatatcacttttcaataaatatttttataaaaaaagtcaaagttgtgttttgaaaaccgtatctctatccaaaacaatttcttttataagtacggagcgagtactcccgcatcatctgcagaatttttacgacggttaatttatttttcataagaacggaagtacggaacaaaacacccgcatttcacccgcatttcttaagatgatgataggtgtcgggtgaaaatctgatctgcacactagattagctactaattacacacttcgccattgtgttcggtaagactagaaattattaagaaaaataaaataaattttaccccgttaaattgagtagcttaaatcatacaagtattagttgcatacaagtataattatacaagtattaccccgttaaatggagtagatgcacagtattagttgcatacaagtataattgtacatataaaaacaaaagatcaaatttataatatgaaattcactcctaaatttaatattaatatataaagctgtatataaaattcagctcacgtaagattgcattgaaaaatcccctagtttggactttggactaacacggtagaaaacgatcatgctctttagcttatcagctgcaaccaaaatttaaattttaaatcttaattttgattattttaatcgtagttttttttcaaccattatttttataaatctcgaatcgatataaaagaaaattgaggactgctacaaaacaggatcccgttgcaacgggatagacatattaactattctcttgtacgagtatcacaggtattaggtcctaggtatcacaagtaccgggtaagaggtatcacagatatcaggtaccatgtagctggtaccaaaacaggtatcatactgtcttatagatgatatcctgttacaacatgataccgttgtttgaagaaaattacccacacattatttttctcgcaaatcatcgcttctgaagatcacacaacggaagtccggaacccacgcccaaatcaaaaagaagcggacgccccccaaaaagttcaaaactttccaaaacatcgtgtgcgcggttgcatcgccgcccacccgcctcatcgcatcacaactctcgcctaaaaggctaaaacccttcctccgtcggccgaacccgtcttgattcgccaatggagttaccccgccgcggccaatcctcccatcccgccgacgccg

SEQ ID NO: 69879 - DNA, 2507 bp, Oryza sativa
cttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttaatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctctggatcaaactaaactacatcttacaattaacactactgtctatgtctcaattcatactattatattctatgctctggatctacacatatgtgttgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttatagggggagaggcaaaaatcgccctcgcggagggcggcaagggagccgcctgcaaaattccatgccccctcgccgcccatttgcaggcggccccccccacagtacaaaatcgccctagcggagggcggcaagggggccgcctgcaaaattcgttgacggccgtcgcccgagagcgaacggccgtctgccacgtcattttcgccgccctctgagagggcgatttttaaaaatcgccctcccagagggcggtaggcgactaattccgtcaattttcaaaatggaaaattatttttgtaaaacttttaataaaaaaattataaataaaaaaaattcgcttggaaggccggttttaggcccaaatccctgtggaaatgatcggcctgaaaaggttttcatggtgggctccaagtgctgtttaaatgggccggtttccggtttaaatccccggttgagcccatatctatctatctatctatctatctatctatctattattctattatattattaaaacagctttgaaaggaggcaccacgttcgctgtgggagctagaaatttccatattaatcggagaaaaagaaaaaaaaaaagaaaaggagagtccaaatagaagtacaatttaaaaatagctgaaattcggaattaaaaataagcaatattgaaaaaagtttccatataagaacccaatacgagattaatcaaaattcaaaataaaaataaaataaaatccaaaataagacaaggaaaggaaagtccaagtaaaaatacaatttaaaaatagctgaaattcggaattaaaaataagcaatattgaaagaagtttccatataagaacccaatacgagattaactaaaattcgaaataaaaataaaataaaatccaaaataagaaaaggaaaggagagtccaagtagaaatacaatttaaaaatagctgaaattcagaattaaaaataagtaatatcgaaagaagtttccatataagaacccaat

SEQ ID NO: 69880 - DNA, 18650 bp, Oryza sativa
gcatatagcttgcccttctgtcgtggtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagccatggaggcgaagaaaccagtcggcggcagacagatcaactaacaatgaagatgaaggaacccagcgataaaattgtgtagccatggcagcaaaataatcagtcggtgacagacgaggtagatcaaaggtgatgacaaaatccaccaatcatgaagatgaagaaaatagttgacgacgacaaacgcaaccgacatgatgaagaagacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcggagatgtcagggccgatgaagcagaggtgctggtgatgatgtcagtgacaataatccatcaaattaatgttatggctgtcgtagatgcttcacttggaggagagttgatgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgtgaagtagcagcaatagagtttgctggttccgaagataataaagatgaagtcgctccaccatgatgacaaagttgtgttgccgtgatgaagtgaacacgagtcgtcggcaacagaagcaaactggtagtgaagacgcgcagttgtgaaaataaaagcactagtcggcgacggaagacgatgatgttcatcagtagtggtaggctgtataaaccagatgtagagacgagggcactagttagcagcagacgagacgaccggcgatgaagatggtaaggccaatcaacactggcagaatcatgcagccatggaagtgaagaaaccagtcggcagtcatggcaaacgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggccggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccacaacggcggcataaaagccagccgtgcaggcgaggacatcggtcggcggcgacgaaggcaagccggtcggtgaagacgtaggcgcccaacaacggcggcataataggccagccgcgcaggcgaggacaccagtcggcggcgacgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatttggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatctttctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtatttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggcaagccaacggtgaagatgtagacacccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcctgttggtgaagacatagacgcccatgtacggtggtgtgaccaaccaaccgtataggcgaaaaccaatgaacggcagatgaggcggcgttaaggcgagttgcccattagtcgcgctagagtcggccggatcgatctcttgcaatgaatccatcgcatatgcaaaaagaaagcaaacatatagatctctgttagtgaacaggaaaatatagatgcttatcatatactagaaaacatctatttaatgtatagcatgataaaaaattttaatccacgcgtgttgattggatcaacacatcgggcatgctttccagggagctgtaatttcctggcctgagctttcctgtgcatggagtaggtatgcatggcgagagcacatatatatccatattaaatcacatgcacgtagcagctggtcaaagcctggaagcatcagcatgtcgcatggttcccgtgaagacgtggccggcttacgacttggactcatgatgagtagacggagcgctttgtcttgcacggcagcagcttgttaggtagttagcgtccatcagagcaactcagccgccagtagtatatgcggacgtgcaaaagaagaattagaaaaacaatatcaatctgtgattagaaactaatctaacagagattaaattaaaaggatgaacccagatcatgcatgtcgatcggtcgacatgtgcatgtggattactcctggtggctggcgatctcgtgcgcgagccgtgagcactgccgttccacgttgctcccatgtcgggttacaccgccaccggcatctgcacacggtgcatggaggaacacgaggtattgggccgacacaccgggatgacagccattggtcttgatctcagtcggcatgcaaaaacaagagaaagtaataggagattaatctgtagctagaaatcaatttaactagtgaaacgataaaattatccaatgaagttggagattgaatcgatgaaatcgctgagattaatcccttcggctgaattgaatccaagacgaaaaagacatgcttcacgaatccggcgatgccgaagattggttccatcacacttgtcgacgaggaactcgacgcacccctacctggcgccccaactgtcgaaacatgatttcggcaataataaaagggggtagcgtacgagacctaaaagtggatggatgcggagacaaaggatttagacaggttcaggccctctcaatgagaggtaataccctactcctgtttggggatttgaatccgccgagtgtgtattgatctgacgatcaggttgtctcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccataatctccacaagtagcacgaatgtgaaggacagtaattcgctccagttccatatgtattaatttcctgtcgttttaaacattaccttatttactcactagtgattatttaaggtgtctatttactaaggccatttactaaggccattcccaacccaaacactagacatagttttcataaactccacatcatcaagaaactagtactagacactacttttctaatgtgaacaccactatccatacttaaatttaatgctacttatctcacatgatattttggatgttgtgtagaaactatatctcatgcaagacatggtttccttctctttccttatttattcacttgccacattatttttcatcctaagtggcagtctatttaatgctatgaacactatcctagtcattgagttgtgaatggcctaagtagtagtctctccgtattttaatgtacgatgctgttgactttttaccaatatttaaccattcatttgtttcaaaaaatttatgtaattattatttattttattgtgacttgatttattattaaatgttatttaagcatgacataaatatttttatatttgcataaaatttttaaataagaagaatggtcaaatgttggtaaaaaaattaacgacgtcatacattaaaatacggagggagtacattttaagcataggagagatgtcgttggagaaacaacaacttttcattaactatataagagtaaactcatccaaaatgtttatactccctcaattccaaaatataaggtacaaatactactttttaaagttgtttcgtaatataagacgtgcatgcatgcatataattaattagcatgttctctcctctaaattattattattttaaattgtacactcacaagatttttaattctattggttgcatgtattgtactagttagggtggttcatgacaatgatgtgatattaattatttcttggttttggattatgggtggttatgccttatattatactcctttcatctacttttgatagccatatttcatcttggcacaatgacgaagaataagtaattctacttatcatccatttaaacatgctactagtttttttagaattacacagtacaacgcaggcgctcataacacacgcacactcacccctatgaacgcacgcacgcaaaccttacccctatgagtatattcgaagactgaggcagcaaatcctgaagattgacgaagtcaccgcaggcgcctcgctgtcgacgggtatgtcacctaccactgaaagcacaatgccgttaaatcttgaaaaattcgctcctatggggagtctaacccaggacataaggtgctattgatgctcttgtaaccactaggttacaagcctttttcgctaaacatgctactagttattcctcgtaaacaaacgattcattaatatttatatttctcgatgcccatgtagccaatcttgtgtagaagaatgaagagtcacacattaaatccaataaagtcattaagaggatatgtggccggattgaaatatatctattaaaagtaaattatttagttttagaaatacgtttatcaaaaatagatggagggagtattaatctctccaactacagagcattttcattattcatcctagtaaaatgcttcaacgacaaaggaaattaatataggactggagggagggagtacaatacgaactatacaaattaagctatacccacttaactccttgatggaacaagctaaccaaagcacagtcacatccccatgttacacacacacacacacacccctcaaccaaacctccctaactcctgagtagtggcgtattaattaggcctctaattaatcgcgcctttcgcaccgtcggtttgatggcgatttgtttaattaatcactcccgccttacccacaaagttaaccgcctccccctcgtcgtcgtttgactaagattctcccccattaattaaaccaacaaaccaaagcacatcgcacatcaggattcgatcgactgacgccgcatgcggcacgcgtacacatacacagtaggagtacgtgatttccaccatcaccaaacacgcgatccgggcgcgcggtggtgaaccaccaccaccaccatcaccaccgggacaacgccccactagaaacaccgcgggatcacgagagaaaaccacgcgaaaacccaaccgcgcgcggcgcgactggtggacgcgcgcgcgtacgcacgctgcggcgcctcgcgtcacatggcttggaccgtgccacgccggtgtttcggttaaaaatttttttgagagagggcaccgccaccgcgagtagtctccgcgacgtatcgtacattcgtacgtacgttagcgcggcgcgcgcgtggttgatcggcggaaaaatcaagcggccggcagccggtttcgcggcgtcggcaacgtaaacgcgggcgggcgggcgcgaggccgacggcgggggtcggcaggggcagcagaaaggtgacggggcgagggagtattatagtggtacgacggagggggaggtcacggtggcttttgggcaaagctttttgtaacatattgttatgtggtgatcctcccaatctttttcagagcttggtcctccgaggtgtgacgtgcttagctagggggggcttatcggctaagcagatagagtttggcccatgaaaaggtggttgacactagtcacaatgtagggaagctaagctagctgttttgctaatctgcgattaatttttcttttgaaaagcgatataagcacaaacgctcacaatatacgtacacttatcgtcataaatacacacatacttcttaaccatgtgaatacctctaaaagtttgggctggcatacgttgagattgacgaaatcgtcacagatgtctcgctatcgatgggtacgcaatctagaatttaaatcgggataagggctggactagttctacaaaagaaaatataaccagttgaactacgatcaatttgcaatctatcatttttaatttgttagtttctgctgttcttctgtaggaactgtagaatagaaaaaccgctagctttccgctgctctagtgttaatctgattccaagcgaatattaacactacttgaccgattcaagatcagataaaaacagctactgttttttttaaaactgtgatgctcaacctagaggggattttaaacctgtgagagaatgtgttctcctttttttacgcaatgttcaaataattatgaaaaaaaatatgatatgactagaaatcatagatcattgtacatatatgttacatattcctcacaactatgcaagatcgaatttattttacacatggagaaggagaagttgattgaatgtgttcttgtatatttgtgaactgataatgacacaaccatcaatgttttatcttcttttttttgccactattttttccacaagaaaagatgagtgcatacacgcttgtgcttaaaataatagctccatcaatttccttgctacttaaaattcagattcactttccaaaatgtgttcttccaataaagtacttctccgtggatttttctgatctgacattctgttcaagtatttagcatatattcctttggtcctgtgaagtacacatttcatggacgtccctctcctctctgcatgtagcatgacgctgcggccttaccaacctctttgtctgccgtaactttcaatccaaaatgggatcaatttgtataaaccaagcaaaattcagagaaacatttgctcatttatctcaaacaaaccggcttttgtgctggaaacaattaacttacacctagcacacatttttgaactttcaactctaaccaatcagatttttacggaggaattcggctttcaatacaaaaggtttgagtttcccttaagatttccaggacatcacacttatttccaaagaactaagaacctactctctctgtcccaaaaaaagactaaccttagagagatgtgacaaacctttgatggatgtgacccctcatagtacaacgaatttggacatccaagatttgccttttttttttaagacggatggaataggttacataccaagccaaatgaatggtggggagctaatatttttctaaagaattccataagtaaattgctagaaggtcaatcactgaactctactactgtagtacatagtagtttttttttttaaaaaaacaagtacataggtattcgagttgtataaacaaatgtcactatacatgttgcatgtcaaacttaggataacatatgtaaacagtacaagttcagagaaaagaggagactctccatttttgtattgcaaaaacgacgtggacgagccttctagatgacaagaggagagagaaagagattagagagagagagtatggatattgtgtatacgtcattacggctgcgtttagattcaaaatttagatccaaacttcagtccttttccatcacatcaatctatcattcacacagaatttttcagtcacatcatcttcaatttaaaccaaaatctaaattttagatccaactaaacatagcctacatcgttaagtttgctaccctcaaaattctctcgagaaaaagaaagaattgtttgcttctctgaaccgcgccgcacaccgaaagcgacctgtgcagctgcgcgcaaaatcacactaccatccgttgtaaaggctggcgcaccctgaaacactactaccaaagaaaagcaccctactaaacaagtgattagcccagctaattgctggagtaagtacggtattatatataatcatagcgaaagtaatcatctcggagcatcagctaagagcatggtcatggtgtaagtactattattagtgcgttgaagtgaagaaaagaggtgcagagatcagaggaaaggcaacaagtctagagagagagagagaggagcagtatgttgacattgcaatttgctagtgagagcagaagagaaggcggcttcggcagaggagagagaaagaggagtgagaggagttaataatatcccatcattcacactccacggcatcattggcaactcctctcttccattccattcaaccacatctgtttctttaattgctgcgtttaatcactctcctcctcaccaaccgcttcgttctccgttggtgtatagttgccgcagcagcagcagcactcgccactgttctttctttctctctttctcctcctgctgctgcgttgctttcttcaggcagctagctcagctgcttgtgcgtgcatgggaaggagtaggaggaggaggctctgagagggagggaggaggaggaagaagaagaagaagatgaagttcatgaagctgggctccaagcccgacgccttccagtccgacggcgccgacgtcaggtgaggcgccgccttcgtctcctctccaatctttagcttcggtttgggtgaagaaaagtgtgatcttcgcttgcgtttctttgggtgtctgactctgataacgttgttaggatgcaaaggtggtagtcaaaatctgttcttttttttttcctttgcttgtttatgggaggcgtcgattacgaacgtgtctggttgctgttcatcatgttggtttgctaattattggattggattctttcttgggtagtggtgtaaaagaacgatttttttgaagcttttttggggagatatcttgcaatagaaatcgttcgtttgatggcttctctgtgtttatgaagttttgcgagaatgaaggtggcagctaatagaatgggagtcgtttggaaagttctcttcttgcatcagttttctagcttctcttaattaatagaatgggagtagctatgttttcttttgtcatcttgtggcttgttcatggatttggacctcacattatgcttgagtattggttacaagtcccctgttcgattgctaataccaaatttgttcgtactttgtacttttgttttcttcccaaaaatggtctcccatttgaagttgctgggtgagttgactactgattcttgggaagtgctaagctgtttatcgtttctgctctttctttttttttcttttttctttttgcaaactgtgtcctttgtactaatgtatagcatgcgtgattctctacagttttgtgaactggatccatcacataccaaagtttttccttctgatctttcgagctggcattccttgtttctcttgggattaattttctttcgtgtctatctccttgtcgtgattctatatgctagctgttaaacgtcttagtttacagtgatgggcaatcatctgattaaataaattactctcgttgtgatgcggttaatcattgggcataagctgaagccaaattgccttcctggtatccgtagcttggtagcagttgtttcttggttgtgtttgaattagattgctcaaagtcatttgtcgactaaaaagaaaggctttgtttatgcctgctatatctgagcatgtacttgtttctttttcctcctctttgtggctagggcgctaggttagtgcagaatagatctgagggttaggagaattaagcttcactctgttactattatatggtaggcaccactatgttttgttgttttgggcaacttggtaaagttagatggtttaatttattattaaggaaagaagaaaacgatggtcatctcaccatcttcctaataattgataggagttcactttcccttcagttaaagaatccacactgcaagttgcttcgttacggccggcttttgaaacaatctggtagttctgtactactgatgaatgcaataacatagtgatgagaggcataaagcagaatgtgatgttgggatcttatggcaagatgctttcgtagcaagctaacctgatgaaaacaaggcaacctgagcttaagtcatccttttgtacagataatcctcaaaagagagaaagggatggtgctaatcttaagtgaacatgataggtttttggacattagtggctaacagatgcatgcgtgtcctgattaccaactctagtggcgcctttcgcatgcttttcttaagtgaactggaataaccggaaagcgaggtgtgcaaatgtgcagtctatttaacagccacctcatgttttcgtccattgtcgatagacagtgcatgtctttggcaagacctttataccttagaataataggaatgtgttttgttgttgtcatttgtttgagagagcgactgttcatgatttatgggcagccatatgctggttggatacgcatttgatttcagaatattgatctgagactgcctttaggctcatatactagtttttttttgcaccattctatggttatccaccattgatgtgtgtaatttgaaaaaaaataactccataagaaacgttaaaactaggtaaaagctattattagaattttttaggactattattatattatctagggaaaatatatgtttgtttttgcaatattatttgcttacggtttctattttatgcatgcagatatgtgatctcagacctcgcaacagatgtcattgtgcatgtcagcgaagtcaaattttacttacataaggttgggctcctaatatttctccacaactgcactgaagttaactcaaaagtattatatcttttctttagaatagtgacaaaggtagaaacaagcactgctgctagacatgtattacaacttacatatagtatatcctgaggcttagccgcataggtgctcaaacttaggatttcattttcatactctcagtaacagagcatattcactattcagcatttatgtttcacatctgattgttgctgcgctatcgctttccaataagctgcatactgtttcatgttaaatttttcattggcagtatctcaataaatgtttggtgtgattagtatttatttgtaaatattagaactatagtgaccttgtcatattttcgtttgcatggaaagtttctagcttaaagaaagtgatctatgctgcatgaaaagctgttgaatcaagtaaataataggctgcatggaccacttctgtacttgatcagttgatctctgtgctagcaacccttttgcaagtaattactgttgtgtgagatagctatttaagtcctgctgtgactatcagattgtttcaacaacaattatttgactgaaaatactacttaaagaaacagtaccttggaataagagggatacactgactagtgcaattctccaccttttaagaaaaaacaaactccgacattttgcattgtacaaacgttatttcttataaatgtttatgttttcttgctggtgaatggtgatgattggtattcagggaaatgtcttattgacaaacataactgaaaaaatatttttgattttgattgcttgtgcagtttccccttctgtccaagagcagcaagcttcagaggttagttattaaggccaccgaggaggggactgatgaggtccacatagatggctttcctggaggagtgacagcgttcgaaatatgcgctaagttctgctatgggatggttgttaccctcagtcctcacaatgttgttgcagcaagatgtgcagcagagtaccttgaaatgactgaagatgtggacaagggaaacttgatattcaaaatcgatgtcttcataaattctagcatcctccgtagctggaaagactctatcattgttctccagagcacaaaagcactattaccttggtccgaagagctgaaggtcatcggcagatgtatagatgctattgcttcaaagacatctgtggatccagctaatgtaacctggtcatacagtcacagcaggaaaggaatgagctgtactgaaatagttgaatcaacaggaagaacatcaatagctcctaaagactggtgggttgaggacttatgcgagctcgatgttgacctctacaagagagtgatggttgctgtcaaatccaaggggagaatgtcacctgaattgataggggaagcccttaaagcatatgctgtcagatggctgccagattcttatgatgctttggtcgcggaggattacatgagaaggaaccaatgtttggtcgagactataatatggttattgccgtcagataagacatcaggttgttcttgcaggtttctcttgaaactgttgaaagttgctatattggttggagctgggcaacatgtgaaggaagaacttatgagaaggattagtttccagttgcacaaagcttcggttaaggatctcttactacctgctgcttcacccagtgatggcgcacacgatgttaagttagtccataatcttgtgcagagatttgttgcaagaacagcgatgtcccacaatggtggttttgttgagaaatctgatgacaaaatgattgagcttaactttgaacaagaatccactttggctttaggagagctggttgatggctatctatctgaagtagcttcagatccagacctttcattgtctacatttgttgaactagcaacagcggttccagaagcagctaggcctgttcatgacagcttgtactcagctgttgatgcatatctcaaggtatgttcataacacttacaaatatgtgtatagtactaccctgtttgggattgtgactcatcaataagttactcggtgctgcactcttctaaaactcaagattaatgcatttttatttttcttttgctctggcatagaagcagacttgataaatcacttgtatccaactcaacccctgtaaatgttgtatgttataacttataacggcatctgatcatttgcttctttctaatcaggagcatccaaacataagtaaagccgacaagaagaagatctgcggtctgatagatgtcaagaagctttcaacagatgcaagcatgcacgccacgcaaaacgaccgcctaccgctccggttggtggtgcaggtcctcttcttccaacagctgagggcgggttccagcaatgcgcttgctctaacggatggtggaggacacacgtgcgcaaagcctattatgaaggatcagagtgacatttgcgaaagacggataccaaggcatccaaactcgctgaacaagcaagcgaccagcctaagcgcgagagaggtcgagcaccggaagagcgagcacaggggaggaggcaggaacagcttcaaggaccagcttggcggcttccttctgcagtcaaggtccaggaggatctttgacaagatatggagcagcaaggggcagggagagaatggcaaaggttcagagacgtcaggtagctcacagagcccgccattgtcggctaagcctgcagatgtgaagccctctcccctcccacctcttaggaacaggagatattctgtttcatagggttcttgtttacttcttttaatttagctctgggttaggttgtacagaaaagataagttgatcagctggctgcacatcatttttggtttgatccttgctcagatcagtgaagagaaaggtgtgggggtaagggtgtaagcactaagtactaagcacttgttctacctgctgctttctgtatgtttatcaagttgtagcttactatagtgtcatcttgacttgagagagatttgctagggccttttattggaaatgtctatgaacaagaagcgaaaaactaatgaaaagggttcatgaggttggtgtttaacacttatcctgttgtttataccagaatacttgagattgcaactttgcaaggcatgacattgaacttaagagtaatggattgcatgttggcataagtggacttgatttttgcactggacttgtctggctactgcactatttgccatcacaaaaatcataacactacgtgacatctccaaattcagctatcactgaacactgatttagcaaaagaattggcgaccacagaagattcaatcaacggagctaaaaccacagcacatccaacagtgaagactggtgaatctggaataatatgcctcaaatcatataagataataacatggaagacaacctctcccactaggcaaatgtgcaaagctagcatgttattatcccttcgcaagttccatgccaacaagagtaaattttctcagccattcgaaggtattgagctaagtactagcacattagctttactaataaccacccctcagagcaaggacaagatggaggacagagccaccttcgatgttatagtccttcgcagtcttgtcgtcggcaagctgcttaccagcatagataagcctacaagaagaaaccaaatacttttgtcagctcagataatactagtcctagatatatagtagcagaccacctttgcaccgatgtgtgaaaaatttagaaactggtttgagcagaatatgaaatgcagttccaagaatatacacctttgctgcacgggaggaatgccttctttctcctcaacacgctccttgatcctatcgatcgtgtcggtgggctcaatgtcaatttcaatctcttttccagtgagggtcttaaccttgatcatagtgccacccctgagcctgaggaccaagtgaagagttgactccttctgaatgttgtagtcggccagtgtgcgcccatcttccagctgcttgccggcgaatatcaaacgctgttgatctggagggatcccttccttgtcctgcgacagtgaacaaaataacttgttagcttagtttccactgaccgaagtagctgctacaaactgtcactgcacttgttttttacaattgtaagacaggcatcgacaacgcagaattatggatgatattctgatcaaactggcaacaaacgatatgataggaccaatagaccaatgatacgcttctaaatctcatggaatcgatcaatcattagacaaagagtatggggaccttcactgaaagaatgaattccataaaggcagtaaggttcgcatgtctaggagaaataaaggacaacgtcataaataatgagataaaatatgagtatgccattggaccacaccatttgacatattctccactaccctaggcagcttttcaagattaccatctatctttatttcttgactattgactaataatctatatactaatacaacacacaactcaaagcatctttaattccagacaagtcaaatttcatagcaagggacgatgttattgattatttattgaattgtacagtactattcaacctgacaaacattgtgcaatcacatggaaatggagcgttcattatcaaatttgcacgaattcggcgatctcaacctcaagaggagcaactaccgtattcatcctcaatgttaatttctccccgaacatattatcctactaccgtattcatcctcaatgttaatttctccccgaacatattatcctttcgtgcttgatctaattttaggcatagctcaaaattagtgcaactaatctacaaactgtgaatggacaaaaatatacagcttcagcttctcaaaaccacttcccccaattcgaacctgaacaaaacccaactctgatggcacagtaaataactaactagggcaagaaccatcgcgcgacacgggcgcgggctagatcgatcgatcggtcgatcaagcccctcccccaagagggaaacacgaccagcgacagcgatccatccaacgccgtcgcatcattcacagctatagcctagcttggaggaatcaaacctggattttggccttgacgttgtcgatggtgtcgctgctctccacctcgagggtgatggtcttccccgtcagggtcttcacgaagatctgcatcttcttttgctgggatttgcctcctcctccttctccctctcctctctagtggcgggcggcgaggcgaggcgagagctgcgtgaggaagaagcggaggcgaacaaaaaaaaaagaaaaaaattccttccctttttttttcccctcttggctggatttttcggtggctcgggccgcgtggatttataggtagaacggacggtggtcggcgagtcgtctcgggagatcggacggtgcgggtaaactaggttttcaattacttttcacgttttttggtggctttggttattgttcggattatatccctgttttcggctcgctttcgctttaagattcacgcctggtgatcagtttctgactctgatactctaaagctttaagattcgcgctcggtgataagtagatcttgttgctaggatgatttgttttcagaggacggggtccgacaggataattggataaattgtagacagaaaaattagtcgtataaatggaacaaatatgacaaagttaataaatagcttaaagaattattgaagtaaggtttgatttagaaagttttaagagattgtaagcgtggcataataattctaactccgttctaaaatataataatctaggatacgtctcatctaggatgggaagagtaatgacaagtttaaagaaatctttctttatataactgaattcacatcgtgttacggaacctcatatgtataaatttccacaaggttagattgctgtagatatttccgaggctactatactactacctccatcccaatatacctatcatccttctctgctaatactctctatttagcaaaaatgactacttattccgtttcacattataagactttctagtattgcccatattcatatatatatatatatatatatatatatatatatatattaatgaatctagacatatatgtgcctagattcattaacacatatatgaatgcgggcaatgctagaaagtcttataacctgaaacggaggtagtataatactctctattaaatgatacttcctccgtttcacaatataagtcattctagcatttcccacattcatattgatgttaatgaatatagatagatatatatgtctagattcaataacatcaatatgaatgtaggaaatgctagaatgacttacattatgaaacggagggaatatatggttggtaggcagagagtagaatggagaaaattttgatttgatgtgattgatatgacaaatatgaactttaaagtga

SEQ ID NO: 69881 - DNA, 2506 bp, Oryza sativa
caaaattaattcgtctagtgcatggattgatgaaccgttggtgttgattcgttgtcagatttttacttctttgtcatttcgatgtttctgttcgggtaatccaatccccatgttctgctcttgccggcgaatccccttctcttcgcggattgcaggctgacaccctctccgcagcttcacccgagatggaggatctccccatggggcggcggaacccggcggccagcctcaccgacgacctcgtcgtcgagatcctccgccgcctccccgtccgctccgtgtgccgcttcaagcgcgtctgccggtcctggcgcaacctcatcgccgaccgtgagcaccgcaagaagctgccgcagacgctgtccggcttcttctacaaaagcatcagcggcgagcgctgcccttgctcggcgcaccacttcaccaacgtctccgggaaaggggtgcctctcatctacccgtcattctccttcctgccccagtgcgacacggtcgtccccttggactgctgcaatggcctcctcctctgccgctgcttccagcccgggcctaacaacagcgatgatgagattgagccgttccattatgccgtgtgcaatcctgcgaccaaggaatgggtgatgttgccggatgccgactgggctaatggcgagacccgcattgcctgcctgtgtttcgacccagcaatctcctcgcatttccatgttcttgagtatgtggaggctgaatatgaagatgtcacgggggttgagatctactcttccgaaactgggttgtggactcttcatgtgagtggatggggcgatgatgtgtttctaaggcattgggccaatccgagaagtgttttccttaatggttttctgcattctgctacgtgtgctgctgagattgcggtggttgacatggaggggaagaaatggaggaccattgctatgccggagcctgaaggtgatactggcataattcatcaaactcagggtcgcctatgtgcttttaatgttgatccagatgacatcttcaaactgtcaatttggattcttgaagattatgatacagataattggatattaaagcacaccgttagctccttgaggctgtttggagggatgaaatatcggtttggatttgactaccaaataattgcagttcatccggaatgtaatttgatcttctttgtttatggatgggacaaaacgttgatggcatatgaaatggatcgcaaggaagttcgtgctatacgcaatctcggacatgactcctttgagccatatctaccatatgttccactctttaatgagtcattagcagatgggtgctaacgtgcagagtgtcgcttcacttctatcactgcaaaaacatccttttgcaccaaggataaccaagctaagagtgagaaaagccaatctctgatatttaattaggaagttcagtttgtactagaatgatgtcttttcctttgtgttgttttgagaatgctgctaagtctgatggtacgtagtaagtaaattggcttttggaaagtttgtcattgttctgaagtgtatgacttgttttattctactggtgttttactccatggtagttaagcttggatgccgtgttctaagactggcaggtctttttgactgtaccagtgttatcagtttagggtaccatgaccaatgaccaatgttttggaacttcaattggaagttaggaacatatcacatatgtacttctcgatttcttcattctttttctttttttcttattttctgaagtatttgtctacacgtttcttttctgtttggtgatcgatagtgatctcatttattcaaatattgcttcccctgccatttctggctagagactactatagttctaactatccaggctagccgctggcttcctctgattgttacccttctgaatttgcaaattacctgctacatccatgataaaggttatcaaaactgcaactactttgattccttcaactatcgtccgagtatgattcatatcctccaactacaaaaccgggtatatcgactccaactatcaaaatcagtgcaaacaatgtcccttggtggtggctgacgtggcggtctcgatcgatctttgccctgtgcggcgcttatgttgaattagaataaaaacaaaaataaaaaaaatatatgtcggaccatatgccattcgcacaaaaaaatgtattgtggtagccaccgacatgtgggacccacatgtcatcccttcttcctcctccctccatctctcttccccggcttctctcttcaccttggccggagcggcggtggggatggcggtggggatggcagtggcggtgaggatggcggtagggagcgaaagcgacggcggcgacagcgttcagccgaagcacgaagcacaagatcctccccgaagctggagcagtagtgtgactccgaccaaccaccccgctgccttcttcggctcaccccgttcggcccttcccgtggctcgagcgcaccgaaaaccccactagcgagct

SEQ ID NO: 69882 - DNA, 6005 bp, Oryza sativa
ccattgtttttattacaaaacttttgaaatttgatcacttgtcatgcactcatgcttattagcagcacaatgatgtctttgttttggcaggaaacattataaatttcaatgttggtgcattagttgatttagacattcctcggagcttttggagtcgtgtttcagggaagtacggaaacatgttcttctggaaagaaaaggtaacattttgttattcaatctagcagttaacaataaattacatattcatagtgatgttttttttttgtcctcctgattctacaattagaagagcactaaaatatgatcattagcaatggaaacagcacaaacttttaaaaccatccaatagaaactatcctgcagttacctttcaaataacaaaattcctccgactgatcaggttctctctttttgtgcttcagattttccttccttgtctaagctggtttcaatgtctgaatattttgaacaacaatgtaaattgttagcaaaaatatagtaagctcaagttttttttggacaaaattttatgttttgccctgtgaaattgtggataaccatgccagtccctgcttggaaactctcttctagtttctatatatgttgtccacaccattgccttcttgaaacatggaacagggggaggatgcatcaattgaagctgctgtgatggccgtatcacgctgtctgagagagcccactggggcaaataactgctctgaggttctgtagatgtgaagacaagcaagtgcaacatatgtatagaagcgaaaaaaaaagtccaagagctatactaaatagtacgaggccaaggaccattcaggtttcttttttcagttgtacacataaactcatcattttgactaattctgattttttagcaaggatgaagtctctcttgttaatagatgcgaactactttgagatttagggcctgttcactttgatgccaaaaaaaaaaacctatgttgctaaaattttggcaagataattattttgaatgtgttcactttgttgctaacgtacattctaccaaattttggtaacatctggtagcgtttagattgcatccgaagtttttactactacccaacagacgtgctgtaccaccctctgtcacctgattgcttcaagcagaggcggaggcggaatagccaaaatttgggctgcgctggcccatgccgattttggtcagtactgtgcaagttaccaaatttctagtgtttttaccaaaatttggtaagaaactaaacatatacacaattttagcaaatttaccaaaaaatggtaaggttagaaatgacatcaaagtgaacaggcccttaagaccaaataaactattaaccctttttaaggaataagttcatttgccttccctcaactttacgtctagtctgattgatatgccatgggacccaagttacacggttttgtatagtctaggaatgccaatcaaactcgttgagggacagcaagtgaacttatctcttgttttaatcatctccacatggacaaatccagcccactcatgagcaaaatcggcccacctcttatttcacgtgaacaaagtctgcccacctctttcactccaacgaattggcccacctctttaatgtgaacaaaggcaacccacaaaggaataagttcaccactgtggtctttttatcccttaaccacaataccgagtattcctctgcccttcatccccggtccgactcgccactgctaccctcccatgtccaactcaacatcgccaccctcccccgatccggctcaccaccgatgtctacttccttttttttctctcacctatcagtttttattttctcttaatttattaaatgggaaataaaggagaacattatccagtgtcagaaatggagcctctattgccaatttgtcacaagttattctcttgccagtttttcattgcaacaagtattatttttttcataaacatccatgctaattgtttattatcatttgcaataaatctacttgctataagttttcgcagcaacgcggcatagtgctatctagttttttttaattctaatgttaaataagcgtcacggtgaaagccacatgattatttttttaattagtatttgattaatcaaacactaataaaatctttcgtgggggagaccagttttcagcatgtcatgcattttacgtgcaggggagatcaattttcaacgtgccacgcggcccacgccgaacacagccagttggcagtatgcgcagaagaacaccaaaaattcacaattttccaacggccagaacacggcaagttgaaaactaatttgcccagcgcagcgcatccgtgtccccggccgccacgatgcttgcagctctcctaatccttctcctctcctcgccgccgtcgccggcggccggcgaccggtggttctgcggcaacgccacgacgtacacgccgaacagcgcctacacgtcgaaccgtgattccctcgccgcatcactcatcgccggagccacgaagctgcactcggctaccggcgccgccggcgcgggcgccgacagggtctacggcgccgtgctctgccgaggagacaccgccgccgccgactgcggcgggcgcctccgcgaggccttcgccggcatcgtcaacggcaccagcgtgtgcgcgctccgcagggacgtggcgctctacgacgagctgtaccacctccgcttctccgaccatgacttcctctccgccttcagcaactcgccggagtgggtcgacgtcaccaacctgaacaccgcgccggccgccgacgccgagcggttcgaggaggtcgtcggcgagctcctcggctcgctcgccgacgcggcggcgaggcgaccggagaggtacgcggcgggcgatgcgccgtggccgtcccgggagagggaccggactgtccggacggtgtacgggctggcgcagtgcacgcgggacatgccgccggagcgctgccggagttgcctcgacggcgtcgtcgccgagaggcggcggaagatcggcggcggcacgatgggcggcgcgatccatggcgtgaggtgctcgctgcggtacgagacggacacccagttctttaccactccaggcaagttaattagtatatagcaatactaattgagcagtattaagtattaacatccttcacccaatctgaacgaacattatgaaagtaacggctcctttgaaatgcatgatttttcaaaagacaaaaataagaaaaaaaatacatgtttgaaatgtcgtagcacctcaaatccaatagattgaaataaagcaagagagctactagaatgaccgtttggatgaagcctatgaaaagtgcatgaatgaaaacgatccccccagtcgttcaaaaaaaaaaagaaaagaaaaagaatcctcataggaaaattttccatagggttgaatttctccaaaattccttcaataatccagtcttccaaaggagccccaaggtcatgactccatttactgtgttattctaaaaatataattccatttggcattttccatataccttgaattctatttactgtttttgtcttcagagtagttggaccatggattggctagataaacctctaaaaaaacaattttgctttcaggctgctgaatgcatactaaatataaaaaggactgcatgctactctgcttgccaaatatgtatattttacatgtatatattgactgaaagtttaagatgaatcctttcggtatggtacaaattaagattcaatttagctgatcaatttggccaaaaagaaagaaacgaacacttgaatccaaccgtaaggcacactatcttagcaaaattcaggagctaagtctttgatattgtagaactgattcattcactacatgtaaaccattctatgtttcaaaattcagggcaaaagaagggacatgcaatcttgatcattgctactgtttactctctttccatcatctgcacacgcctgtttttctgtttcctaagcataagaagaaaacaaaaaagaggtaagcaaatgaataacagtacatgatactggcagctaaaatactagatcatttctacttacttcagttacatgcaagaactaatgaaggatgtgcatctagtgaaaataaacttgatggagcagaccacagacatggatgaagttatgcggctttggaagatagaagatgctggttcagagttctccttgtatgatttttcccagcttgctgatgctacagacaacttctcagccaataacatattaggcgagggtggctttggcccagtttacaaggtactttcttgtaacagtatcatctaattctgatggcatcatatgtatgtaggatttcattgatgaaatttacaggggctgtttcctgatggacaagagttagcaataaaaaaacttggtgcacagtcaagacaaggtctagtggagttcaaaaatgagatccagcttgtagcaaaacttcagcacaaaaaccttgttaggttgctcggttgctgtgttcatgaggaacagaagatactgatctacgaatatctgcccaacaaaagcttggatcacttcatttttggcatgttttactccctagctattgataaaaattgcatttattctcgtgtgtagtacaagtattaaaccttgagcctgcattatattgcttgtagatcctatcagacggacatcactaaactggaaaacacgaagaaaaatagttgaaggaatagcccaggggcttctataccttcacaagcattcacggctaagaatcatccatagggacttgaaagcaagcaacattctgttggactctgagttaaaccctaaaatttctgattttgggatggcaaggatattcccatcggatgcctctcgagcaaaagcaagcagacttgtgggaacattgtaagagcaagaaactagaaatgctagtagttactaaagtttctacctacacatttgctttctaactctactgcatgccatcttgtcagtggctacatggcacctgaatatgcatctgagggccttatctcaatcaaatcagatgttttcagttttggtgtcctgcttcttgaaattatgagtggaacgaggagtgcaggttttcagcactatggagaatttcaaaatcttcttgaatatgtaagcaattgaattggcagaaaaaaaatgttcctcacatatctattactgttgaggggtggttgtagatcattatccagttttcttttccataaatcatagggataatttcccttccttgctctgatttattgaatttgagtttgcatttgtatccaataactgaagaaatatatggatattcctaccatcacacttagcaattattttttttcaggcatggggaatgtggaaagacggaagatggtgtgatttcattgatcaatcatttggtgatgaatacgaacctggagaaatgatgaaatgtcttgtggtggcactaatgtgtgttcaagagaaatcagcggagcgccccaccatgtctgatgttgttgctatgcttagcagcgatgacatccccttaacggaaccaaagcaaccagcttactcacatatcagattagatgtatcagtagatgtcgatgtatcgtgcagcagaaatgatataaccatcacccttactgatggtagatagtacaatagatatacactagcaaggtgtgggctagtggtattggtcttcttgcactaattaattagatagggcattgtttgtaatctattgctcatattccatacgtaaccagattttccatgttatcatatatacgtgtttcaaaattatcagtaaatatacatttaagtctccaaaaacattccacaaaatattatcataaacctgctggaaagaacttgacaattccaaaataccagaacagatagacttgtgcagaatattcaaaaagacgtagtcattgacacagctagcaattttagttttttttttcacaacttaattaagatatatttcccggcttgta

SEQ ID NO: 69883 - DNA, 28291 bp, Oryza sativa
ctagtgttgttgatgttagactttgttttatgctctgcagttgattttgtttgtggtgtttttggtagttgggaacatacatcagtgttgtttgggtggttttgttctaggggtggggcattaccattatgtgctacattgttgccaccctgcttgcttccccccttgctcttctcttctccactcttctcttctcttgttgtggtggtatctttttgtgtgaataggcttgcttttgacatgtagacgcaatccaaaaccttggcagctagttgtgcattttttccgtatgttgtgtcagaatgttctcttgtgaaccacttgcaaactgtggaaatgtcatcaatgagctgcatttaaaaaaaacacaatagaaggtgggtaaaaaaatcatatatacaaaactagggattaacaaaaggaaaaaagcacataaatcattataaaaaatgtattcatcatttaagtgtggcgaggagagggattgaaaagggtgattataatctgattggtaggattcatacaataggagtgactatattggagcatacatatacaaactaggaaaaaacaatttttttaaaaaaacagagcatttggaggagcaaaaaaaattactcgtgggttaaatgatttgctatggtattgccagagagcatcgttgcatgacatgttgctattgttgccctgttgctcaatgcaacgggcccggggatcctctagcgtcatatacttaatttctccattgctttgatacgagaaaataaacagagtatgatctaagaaaaaaagaaacaaattgacacagaataaaatttttctgttgtttttacttactggtcgctttccaaaatctcctgttttgcattcatctatttttgaatactcttttatcattccgcctttccaaacagagattctaggtggtggaccaattgggatatttctaattccaaaatctttgaaatcaagataattaatctaaggaaacaacacaaaagaaaaagaataagtcaatctttagaaatattatgggtttaaaaaatgacttaagtaataaagaagagatgcatacagcaagtaagtgtccgcagccaccaagggttttgatgtttgttccttgattaactctccttttggaacttggctatgtatgtcataagccattcataaacaaactttgacaagttccactttgagctggacttgatatcactcagaggttcaaggtattttgggctggggtgagtgtctgagttggggcaaagaaaggttgatagtgcaaccaccatgaaacaacgtaggacatcatcttctgatagtttgttcacacccttgtcgctaagcaacttagtgccaaagaaggaaattaagggttttgtgctcccaaaatgctgatgaaaaaaatgttttcctgcatcattgtcattcttgatctctaaacctccatttgggataccaagtatgaagttggtggtgtttgggttgattggtatggatctcccattgacaactatatctgagcagctgacatcagtgtgactagctatccatttgacaaaagatagtggtatagcacacctttgaaagtttagaagagaaccaaaagcagaattctcaataattgacctttgctcgttgctaagcccttcaatcaaattggaaaagtatgtgatgtttagtctgcttcttggttttggggactctgcacttccagatttatcttggtcatattcaagttttgtgcgctggaagaaaaaaaatagagatgtaattatgtcttgttaacaaagaacaacataaactaattaacatactagatgtggaaaaaaaatgtttaggaaaaaaaagacagaaagtgataccttttgtttttgtctccttactggtttgtctgtcctagctcttttccttttgatcgatcctgaaaactaacagaggcaaaacaagtatgaagttaaagttattgatagctgtctgtggtagtagaaaatgatattttggaaaaaaaaaggaagaaacatatataccagatcttttaatgtgctgacgagatctttttttgttatgtatttgtcagaatcactggtttcttcctcttctgaaatagagttggcataatcagaatctgccaccttgttgtccgacttgctatttgatgaacattcatcatctgatgatgtcctgtcacttgccatactggaaaaaagaactagagaagtaagcacattaaaaggaaaaaagagagatcttgtcaaatgtcttgatattttcatgtgtaaccaatcaaaccccaaaaaaaaaaaattctcaatgtcctgataggctgctaagccacatgttaaactgtgccaaaaaaaaaagaagcagtgccaaattcaaacaataccacttgcatcttgttgctttttgagaattcgtgcaaaggttgaaatcatgtgcaaaactgcatatgcaggtataacattattaattcacaaaatttaatgtgttgcacagaaaatttgattactatctcatataagtaaatgtcaactacaacatcttggtattgtgaaaaaatgtgttaactattagcatgattatagttgcacaaaatcataattaaagttgcacgaattaataaccaaagttgcacaacattaaaaaatggcgaccgtaggaaataggaaggtgcaatttttgcatataaaagtaggacaaactggatagatatgacattatattattcgaccgcccacatttccaagctcaccagcaaaatcaaaaaacttagcagaaggaaatgtactcttcttggcctgcagcaagctcctcccccgtagatccaacgctccctgaaaacaaaatcgtagtgagttattacatctgagcatacaatcagtctgaagttgtgcttgtttataaccaaaattaggaaaaaaaatcatatagtagtcagctaaaaaagaattagttgcacgatttattaattgaaattgcatatatttataacataacttgcgcgaaatgtatagtattagttgattttgctatttggactatgctgctggggtgtagatggttgaagcggaaaaacacagtaaatgaaaaaaagagacacacttgatgtcgtgtgttcatgagaaaaaaaagatacaacatgaaaagtagtatgggttgcaaaaagcaaaaacacatgaaaagttggacaaaaaaaaactttataaaccaaacttgtagagacttaacctagaagttgcccatgtttgaaaaaaaaaggcaattactaagctatataaaaacatattaatggttgcgcatgtctagaaaagtgtcaactacaacatcttgggtgtgcaaattctaaaaaaagaaatcagtactgccaaagagatttatgaaaaatgaagaaaaaggtaactaataacaagggaactaacttctagccacaagctccaccatcccactgtcgaaccactgccaatccttctatatccaatccatccttagactactccccaagttacagccaaaaaattgcaaagagagtcactgttgattatactactactgtattagcatccgcagtttgctcaggtttttcaccagatcaggtatttcaggtttttcaccagaaaaacctgagctcgccaaacatccaaaagaaccgccgatttgttgtggcgttgatcccgagtcccgcaaaacaccaaatgaatccccttcccatcataataaaaagaaaaagaaaaggcaatgaaattactaagaaaacaagttgtctaccaaaagtcctcacttgtatgcatgttttcccaaacaacaaacgctatttatcaaagtaaatggaaatttggttaaaaaaacattagttgcacaaaattattacatgacttgcacgaaaattcaaaatggctactacaatagtcagggagtgcaactagcgtagatacataattttcagaaaaagaaataatgaaaatttaaggccatgtgctgatcgaaagcataggttttagtttgaggccatatttaaagcagtaaataagtgaatcattgatacaacataactgtacatagcatatgaagagatatgctttatactgtccatttatacagtactatcgcaaattatattatccatttattctctgtattttagtttcagattaatcctactgtttccattaatctcaccctcgtttgcgtttgccactgtcatttgctgagttgctaatgacacagaccgatgcttttgcgaattgcgattactctcctctctcagtgatctactggtaatctcaaaaagattaaacataattgataggagcagagcctggagttcatttttagggaggcttatctcagattgatcactgatggaatggaagcaaaagtggcttagtatgtcacagttgagcaggagtatgtcacagttgagcaggactaccattaaaaaaaatacacagcacacaaaacaacagatagcttttgtctacaagcagaaaacacaactcctccctgtatacagtgacactgaaatcccaaaaaattgtggtatccctgtatacagtaacctctgattaaactccctgtataatctgacaatactggggacaaatgtaagaacatttgctgggatttaatgaaatattggttagttcttgagctcgaattgctaccaaatccctaaacccctttctaaaatgccacggcacagaggtcatcactgccctacaggattaacgactaaatctagagcaaaaccatgtgtgtgcattccatgatatatcagatccaactagtgaaactgcaaaactccctaacaaatgaagttagagagaaaataattagtgccaaggtttagaaccaggcagaggcacagcccacctcccgccgactatatcatacacgatgtgcagtaaaaccctaaaaaaatttcccaaactacatcgaacaaaacatcaaagcacacacaccatgtggtttcagatccaggatgctttactcgacattgggcaaaatcaactcaaaactcaagcaatgaaacaaactccacgggattccccccccttgaaatggtagccaatccagccctaatagctcacaatccacaggatagaaatctggaccaaaggaaatcaggccgccacggcgtgaggatttgaacaaaaaagagagatgaaaaacctgcagtgcatcaactcctctcccccgcctctcttctccggcgccgtccgcggccgctcgcggtgcacagcccacctctcgccgcccccctccccttcccctccactgcctaccttggaagaatctccggcgccttccgctcgcaggactccgcctcctactcgagaaacagaaacgtcgagaagcagaagcgctctctagagagtcacgggtgtggtggatttttccagagctatttgtgggctgtgggctgtgggctgcgggctctgggcttattagcaaggaaaaggtgatggaaaagcacgacccatataaaaaaagagcctttccactagcccgatagcgcgcacaaaagttgactgatcgattaaaattttgcaggcgactacaaaatagcaaatgcgttgtttttatgtaaaagtttgaataatttgtgttactcctctcaaaacttaaagagaactgtaaagaaagtagccaacttggttggtaacatatgacaaagcctgcatagcgcataaaggaataagttcactttaggtccgatcgaatataagtcaagtttgatttgcattcttcgaccgcaaaacttggtacaagacgtgctccaacttctaaaactagggcaaatcaagttcatcggtagcatttgagagtggtttcctatatgtcatcctagttagcaaaaaataaaataaaaaagcaaaggtcatgcgggacccacttgtaagtggccaaccaccatcttcaacttttgtctactctttctctctttaatccttgtggtggcggcggcaggatctcctggaggtcgtggcgaggaaggtggacatgccagcaacagaggagctcgaggaggccacggcgacatgggagcttgatgaggccggcgagaagggtgctcgccacgctgtccccatttggccctcacctccccaatctcccccgctgtgctcgttggccggcaacaccttcacggagccaccagtggacttattatttcgtgcacaaacacatactccctctatcccataaaaaacgaatcaaatctagtatgatgtaacacatctgttactagattggtttttttatggaacggatagagtacgtgatacgccccgatatggtttagaaaagttgctcacacggcccaaagagcccatagaagttcggccttttggggccaattgggagcccaccaaggagcaatttttatgggtgggcttcgagccttccttgtccagcgtggggcggggcactcccacatccaccgcatcccaagccgacggccgcggtggcgacccgccgagtcgccgcgtgccggtgccgtgtggaccgggagcgcgccgtggcgcggttgaagggagccccaccacacccccttgagttcttgtcgcccactcagcctcccgtcgctgccggcgtggcgcccaccctaggacgcccgccacctgctcgtgcaaatgcgagagccagagccggccacagcggtgctacccgtttacgcgcattgtcgttggggggaagagtgcggtcatgattcgcgtgtgcctccagtaccgtcctgttggcaggctcacagcagagccgctgcggggctccggtctctgtcgtggagtcacggaactgctacttcgtcggatccttcatggagattcaggtaccaacctctcaaatttagctggtttacaactgaaccaaggtgaatttggtgatgattgttcaatgttcagtagatatatgtctgattatcacgtagtagtaggattgtaggagttgtttttcccttcttgaggatcttccccaaccaagtcaaatttctttgcagggaacaaatggtgcaattttcttgttccgaagaagttgacagcacagaaggaaactcacacgcttgtgcatatggatcacttccactataattctataaaggtcagaattagtatttgctaatttatcttgtaggtagttactgataaggctaggaattagctgctttggaaaggtagtggcatgctggcatgcgttctcttgttgcgtaagctcatgggaacagcatgcaactctaaatataaatagcatgcacaatcttcttaagaacaggcatatctttgatggtggaatagtgccagaaatgtgtaaactgaatatcattcttttagttaggaacacaaaagggggcaaatgaaacattctcaactctcaaagagtgccccactagatttggttaaaagggctggcatgatgtacctaacaaatcatttaagaactgtcttagacatgtaggcagatctttctagccacacagtcctgcaatatcacaatgtgctaattattctttgacactttcttgatcacctagatgtcaaaaaaaggagtgagtgtcataggtagagttttctggcccaccgctcgtgcgaagcagcaaaggtcactctcctaggctgaaatttatattccccataaaaatctacaattgcagtgttgcatcataggccaaaccgttgaaaatctgatgtgtgaatcatatgtgaaccttttgaaagctggaattttttgctggacatatataggggcgagtatgcatgtttggcatgatgaatggaccccatgtatataccctgtgaagtcgggtcctgatggcaacaggccagataaatgacgtctccatgagagttcagttagttgaggccagcttatgtgttcttcaggggtatgtctattgctcccaactcccaagttattgccacgcatgcaaaatattacgtgaatggtacttcctccgtttcaggttattagacgttttgactttggtcaaagtcaaattgctttaagtttgatcaagtttgtagaaaaaaatagtaatattttcaaccaaagacaaatttattatgaaaatatatttaattattgatttgatgaaactaatttagtattataaatattactatatttgactataaacttagtcaaacttgaaacagtttgactttgaccaaagtcaaactgagggctaggaaaaaaaatcacataaacccctagaatgacaagaaactgaaataacccagagagatatgactacgtgagataaacagaccatcaataattccgtcctccttttgtattccttgtccttgtgggagggagaagttacttcttctgaattttctcttctttataatgggcctgtttggagaactatcccagggatattttttgggctaaagattatcccaccaaaatagccccctaacaaaatagccctcttgctgtttggatccaaaggctatttagctattattgtaccatcccaatcatttgcctccactaaaagtatacagcagccggatcttctatggctaatccaatacaggcacatacaagcatacacaattccttacaagcacaaacacataatttgtctcaaatatataagcaagtatgtaaaacaatcgtgtcacataaaagatacaattccatacaacaatcgtctcacataaatatacaattacataaaacaattgtctcacataaatattaaaatccatacaacaattgtctcacataaatattaaagtccatacaacaattgtctcacataaatattaaagtccacacaacaattgtctcacataaatatacaagtcctcaaaccgtaaaaaaaaattacaatccattaaacaaagcatttgccaagtcatcgcggaagaaattcatgttgctatcctcaacaagaggttcatcttctggccagttagagtgaggtgatgtaggcattggaaaataatctgcatccgcatccagctccttcctcgccgccaccctggaggaaggcaccgtactcgtggaggtgagggaactcctggcccgacgccgcctgggtgttgaggtccagcgtgtccacgccggcgcggggaacggatccgtgggaagggccggacgccgacggctgcgacgaccaaatgttgccggcggcggacgaaatgggatcttgggagaagaaatcgaagccgttggggtccatctccgcgcggatccggtgcaaggcgatgcgtcgacgacggatctgatggccggcaacgcgggtggggtgagtcgccggcgtggatgcctctcggtggatctgaaggaagggcggcgcgattcgagggagagggcggtgcgggtgaagggccgggcggcggcgcgggtggggggagggggaggcgaagctggggccgggcggcggcgcgggtggggggagggggaggcgaactggggccgggcggcggcgcgggtggggggagggggaggcgaagctgggccgggcggcggcgagggttctggagagcgagcgagggcgagagcgaggggtgagagcgacgatttctgccgcaactggatccggcacaagtgggggaaagtgggaatcggtggggcccacagcaaatagccccaattagcacccctgggggtgataattttttggggtgggctatttgcaaatggccctaaaatagctctcatgtttggatccccttgagctattttaaggctaaaaggggtgggctaaaaaaaatccataggatccaaacacccccaatgttttggtttaggcccaaagcctcaaattagctaggccatctaactggattatgctagcttaaacagttttatcaacagagatctacctggtccaaacttgcttcttatctagccagattagcctcgcaactgaacacactaaatcaatttttgcatgttgcttaacaggctccagttttggtttttatcgttttaatcacttccctgttgagaacactgtatggaatggaaaccaagttgattctgtccatgcatcctgcaggctgcctggcaaacaccacacaccactcaccggtgcaacccgcaagtgcagccgtgtgcaggtggaagacgaacagtattaggggagcttaagattttgaaaatcagttggtgagaagctcacgggtgagaatctggagactttaattcattttttgaattctaaaactataacttctcaaaatcagagtgaaaatttggactgtttggggaaagcttttggtatctgcagattccagaaaaatctctagctgcgagaagctctcccaaacaggctcaaaacccgcagttagctagcgtgcgccaagcccctcctacattccggtgcgcgcgcgccagcgcccggagcccaccgcgagtcgtcgaatgtgcgcagagccccgtccctttcgtccgatccctcggcgacttgcttccccggccggcagcctactcatcatgcacgaacccatcgccccaaaaaagagccgcgcatcgtgcgcagcataatcatagctatcgctgaaacgcctgcaccttcccctcctcctccattcgcttacctcgccattgacatcgcatcagctcttctccatctgtatctgtccgtttttctttcatccatctccgtcttttcgtgcaactctccagcttcagcttcagtgccttctctctaccaagtacgtgaagaagagcttcatctatgcctctactagatcagagatgctagctagcgctctagctagctgctagcaaggagcgcaccagcaagggcaccaccactggcttaagtacatggctttaggggagagggcgagggcgagggctcctcccatggtcgtgcggcgcacggccgtcctcctcctcctcctacatctcgtgttcgtcatcgccgcagcggctgccgcggtggataggcgtcggccagccgaggcgatcgtcggcgggtggcggcagcggcggcggctccaggctctgatgcaggagaaggccacgctgctggccttgaagcggggcctcacgttgctgtcgccgaagctgcttgctgattggaacgactccaacaccgacgtgtgcggcttcaccggcgtcgcctgcgaccggaggcggcagcacgtcgtcggccttcagctctccaacatgagcatcaacggctccatcccgctggcgctcgcccagctgccgcacctccggtacctcgacctgtccgacaaccacatctccggcgccgtcccctcattcctcagcaacctcacgcaactcctgatgctcgacatgtccgagaatcaactctccggcgccatcccgccgtctttcggcaacctcacgcaactccggaagctcgacatatcgaaaaaccagctctccggcgccatcccgccgtccttcggcaacctcacgaacctcgagatccttgatatgtccatcaatgttctcacaggccgaatcccagaagagctctccaacatcggcaagctcgaaggcctcaacctcggccagaacaacctcgtcggcagcataccggcgtcattcacccagctgaagaacttgttctacctcagcctcgagaagaactccttgtcaggttctatccccgccacgatcttcacaaattgcacgcaaatgggtgtattcgacctcggcgacaacaacatcaccggcgagatccccggcgacgcctcggatagcctttccgacaggttcgccgtccttaatctctactccaacagcctcaccgggaggcttccgcggtggctcgccaactgcactattctctacctgctggacgtggagaataactcgctcgccgacgatctgccgacctccatcatctccggcttgcgcaacctcaggtacctgcatttgtcgaacaacgtccatttcgcgagcggcgacggcaacaccaacctggggcccttcttcgccgcggtgtcgaactgcaccagcatactggagatcgaggccggagcactgggcatcggcgggcggctgccgagcttgctcggctcgctgctgccgcctaacatgtcacacctcaacctggagctcaacgccatcgaaggcccgatccccgccgacatcggcgacgtgataaacatcacgctgatgaacctgtcgagcaacctgctcaacgggacgatcccgacgtccatctgctggctgccgaatctgcagcagctcgacctgtcccgcaactcgctcaccggcgccgtgccggcgtgcatcagcaacgccacgagcctcggcgagctggacctgtcgagcaacgcgctgtcggggagcatcccgagcagcatcggcagcctgaagctgtcctacctctccctgcacaggaaccagctgtccggcgagataccggcgagcctcggccagcatctcggcattgtgcggctcgacctctccagcaaccggctgaccggcgagatacctgacgccgtcgccggcattgtccagatgtcgctgaacctctctcgaaacctgctcggcggccggctgccgagggggctcagcaggctgcagatggcggaggtcatcgacctgtcatggaacaatctcaccggcgcgatcttcccggagctcggcgcctgcgccgagctgcaggtcctcgacctgtcgcacaactcgctcaccggcgtcctcccgtcgtcgctcgacggcctcgagagcatcgagcgcctcgacgtctccgacaactccctcaccggcgagatcccgcagaccctgaccaaatgcacgacgctcacctacctcaacctgtcgtacaacgacctcgccggcgtcgtgcccaccgccggcgtcttcgccaacttcacctcgacgtcatacctcggcaacccgcggctctgcggcgccgtgctcgggcgccgctgcgggaggcgacaccggtggtaccagtcccggaagttcctggtcgtgatgtgcatctgcgccgccgtgctggcgttcgtgctgacgatcctctgcgcggtcagcatccggaagatccgggagcggctggcggcggtgcgggaggagttcaggaggggccgacgccgcggcggcggcggctcgtcgccggtgatgaagtacaagttcccgcggatcacgtaccgggagctggtcgaggcgacggaggagttcagcccagaccggctcatcggcacgggcagctacggccgcgtgtaccgcggcacgctgcgcgacggcaccatggtcgccgtgaaggtgctccagctgcagtccgggaactccaccaagagcttcaaccgcgagtgccaggtgctgaagcgcatccgccaccggaacctcatgcggatcgtcacggcgtgcagcctgccggacttcaaggcgctggtgctgccgttcatggcgaacggcagcctcgagcggtgcctctacgcggggccgccggccggcgagctgagcctcgtgcagcgcgtcaacatctgcagcgacatcgccgaggggatggcctacctgcaccaccactccccggtcaaggtcatccactgcgacctcaagcccagcaacgtgctcatcaacgacgacatgaccgctctcgtctccgacttcggcatctcccgcctcgtcatgagcgtcggcggcgtcgccaacgccgccgacgtcggcgcctccaccgccaacatgctctgcggctccatcggatacattcctccaggtaaattaaccatcatcatcaagcaaactcatcatcatttttctcgtgacaaattctaattaatcgattcgattctgaagagtacgggtatggctcgaacccgacgacgaagggcgacgtgtacagcttcggcgtgctggtgctggagatggtgacgaggaagaaaccgatcgacgacatgttcgacgcggggctgagcttgcacaagtgggtgaagaaccactaccacggccgggccgacgcggtggtcgacccggctctggcgcgcatggtgcgggaccagacgccggaggtcaggaggatgtccgacgtggccatcggcgagctgctggagctcggcatcctctgcacgcaggagagcgcggccgtgcgcccgaccatgatggacgccgccgacgacctggaccggctcaagcggtacatcggcggtgagaccacggccacgttcgcgtcgtcgctgggcttctcatcctcaacatttgaagatctcgacgactagcagcaggcagcagcatctcctaaggacgcatatgaatcatgcatgatgtgtaaatagctaggaatttagctaagaggcaggaagattatttgtcaggaaattaaagaagtgtgcaatttgtgcagaaatattgcgagatttataggattctttggaagtatctgattaaattttgatggagtgatatcttcggttatagatatcgataaatacattaatcccagtgtgtagctgattcagtcgtattgcttatgcatgctcttccttcctatctctgcgtctgttcaaactgtatatgctgcctgaagaacatgaactctagacaaccatgctaaattgactctagcttagcaagaaactgcagtgtaattaaatgagaagcaaaattgcgaaaaggtcgactgaaaaaaaatctaatagctttgacacctttcttcttaggctttacaaagagggttaggtcatgaatgacatggtgtagctgcacataaaattttcagaccaaaatctggtctatatgactctaagctcatttattaaggaataggctggtgacaaagctggttattggaaaattgtacacgcatcgttgaggtaaaccgagcgtgcgatatgagcacgtttgaggatgtgctgtgcactggcaaactagcaatgcctaaaatggaccagtctagcaaatataatagagggcaatagcatgatcttgcatactatgcggttatgcagattatgcatatcattgttgcgctcttatccaaatattagtctactaatgttccactgatgaggattctcattggatattgttaaaggctttttttagcatgttcagagcaagtttaatagtataaccaattactagatccaattcatctatagccaatctaatagctcattcatacaatagttacatatatactacactattaatatccgatcccacctatcatacacacactgtattttggagtccgtgctacagctggctacaaatctatagcccgctgcccttctctctcctcatttatctgcttaaaatatgtttacagctggcttatagcctgctattgtatatgctctcagagcgaaaccgatcattgccgaaacttctatctacattttccggtggcaaagcatatttttgataaactttacaaaaatattgtatactcgtcttctctgcaggatactctgtgacactatataattcactatattttctgtctttcttccacaatggcggtctacaaaggtattgtccatgatattttgttgtaagatccacttcaccacataagctatctagcatgctatcgtctgttttttttgtcccaaaataagtgtttttagacttgttccaaaataagatttttttttacttcttaactatctccgttttataaattaagaagttttatcccaatacaccttaccttcccatcctctattaccatttctattaattagatccactttgattttttcctcactacaaagttttcaccagatataaggatccatttattttaagacaaagagtacatggtatcgtgagtatccactaacaaaaaggacatatacaccatggtccattccatatgcaaaactttccaatcccatcataaattcagaattcaagatccactagagaatgaaaatttggcaattgaaccctttttaaaatcttaatataagaacagatcatgtcaaaacttatttcagtaataaaccgtaacttgaatacacatagtataataacgccaaagtacaacatctcagccaaaaagggtatgttgctacgaacatcgacacactggtgcgaaattcccatcagcaagggcaccaaggtaaattgtgttgaccttatttataggttaaataggtgataaagaataaccgtggaaaatcttatcaatcaatcaatcatcaatccttctcaagccggcaattttacggatgcaggtcgtttgcaactgacatgtgggccccacagcccctcggacccacatgtcagtgaacattactgtaagggatctcaattgcaattttaccggatgttgattggtccacgtggcgtgccaacgtttaagataaatccaggagtaatgaggattaaaaaaatgctaggatatgtaaaaggagattaatgaatagaagtatctagaaatatgcaatattatgtgcatgaagtgaatgatctagatgcatccagtcatgtgtgtgaagttaaaaacaaaaggtaaatccaatctatatcaacgggtctcagcttttagtatctgccttctctgtaacacacacagacatcaactaatctcaagctagcatcaattggaccacatgatgttgttaaatattgagataaatcaagcatttaccgatggggggaaaaaaaagaaaaactcacttgtgtaggacaagaaacagagagagaagaggttaagatatgagaaatctagaaccttctcaaatataaactaaaatggagaaagcgagagcctttaaaaatctgaactgctgtcttattctccttcggttactccaatacagaaaccagtaacaaaaattcacagggcaaatttattaaaaaaaaatcataggaaaatttaaaaggaaagaggaaaaattgatggtaaacacatagggggccatatagcggcgcgccaaaaggtacgctacttttctagtcttatcttatcttatcttatcttatatagtgaaagcagcaagctttttcacacgaggatgcgtcacatcaaaaggtacacatgcaataaaaaaacaacaaatgggcgtatggtaatttccagaggtttctagtgccaagagagggggcaaagataataaagaaataaaaaaacttggaggcttctagtgatttctcatatagcacaacttagctaaatctatagttagcttagaccaattgatactttgtaaatcaattaactcatgttataaccttctataaactaatataccgtatacaaaagttattatatgggatcaaaagtcgcgcagagcgcaactacgtggctaacatatggtaaaaatcacatcctaggtagaaacttgtcgaggtgtgatcctccctagcgggaggctgtgaggctcccctttgtgagttcggctaggggaccgggtgcaatgccaaggaacgtgtgctcacgcaagcgaggtggatccgcggggattgggcttatgaggtggaaggcgagggattatacaggttcgggccgctatcaagcgtaataccctactcctatttgagcgatgatctttgtgtggttacaaagacttcagaccctgggagtaccagctagggcttggccggcctcttcccagaatccggctttctaagagacgtccccttactcgtagggcatggtccttcttttatagaagaaggggataccacatgcatcgcccctacactctcctcacaggaaaggggcccacattgcctatattaaaaagcatcccatgccttgggccagaagcgatccatgcagctgcccttgggtggcccccactgaatcctttcgtctgacacgggggacatcccctgtcatcccctattaaacgtttgacgactttgtgggcacacgcgcatgggaggtggcgatctgcatgtcctccccttgtgcatgatgggacggggcataccagcccccacgccgtctgacacaaagcgggacgtgggtgcgctgccacctatcccatccatccatcaccgggtcacagaccggtcaaaaagcggtcgccaggcgcacgtccatcagtgggcggcgcacgacctgccacgtcgcattaaatgcgacgggggcggttggagcgccgcccataaatgcgcctggcgaacggcgccctgcccgctcaagcccccacatggccgtcacgtggtggccgagcgagggcctcgggggcggttcatcccctcgggcccgaggggtacgacaaggtaccccaagccccccccccccccccgagggggactgggcccgccgtgcgcgccgcacaggaagagcttcccttccccctagttcaggtatcctcgggcctatatcaccgacaaaacttgaaaccttttatatatatataaaaggtcttaaaaaaatctcaaaaaatcacacatgtaagtaatgtgtaaacaaataaccctacaaagttgcacgaacaaattcaactccctttatgagatataaaattaacaaatcatagaggaaagccactatcatctttttctccaatgtttctcaattttatatctcataaacggaattgagtttatttttggaactttaaatggttgtctaatatcaacttagctatttgtgtgatctctttcaaaagatcagctgtttagctgggagggggtgtaggataaagctgtcctatatatgatatccaagaattaaaaaaaaaacactggctagtaaagtgtaaaaaaagaaatgtcaccaaatagaaacaacaacaaaaatattgctgtagtgtcaaacatgcctcgtccacatatatgcacaaacttcgcgccaccgcactaagctctaattattgctcggatggcgctattacttttgtacctatataagtgaggtcagcgccaagcttaatagcgctaaaccttacggatagggatttcgtgccaatgtgataatgttctaaacgctaaaaggtatgtgcgcggatacattatacttcagcgtcatcctcgacgatgttgaattgtgatttatttctaaaataatttcttggcacggttctttttgttgtaataagttaaaaaaaaccctaaattgtcaaaatttcggccactagttgggatattctgatctgatccctcatcaccgctagcagatctctgtaatctcaccactgaagcactgctgatcagcagccaccaccaccggtcacccctgcaggcctgcagctgctccaacggctttccccctccgtcacccactccctatccgcctatcccatcccaaaacctcctctcccctccccccccggcagccgccgcctccaaagttctctgctttcgtcaccgccagcctccctccaaggtaaaccacagcaccgaatgtgaatcttgcagttcgcgagctgaccagctgatctttttgtaaagaatcgtttggtcctgcacctcgctgatcgcggtctgtttcgctgttttgctatgatgcgcaggtattgttcgatccggagtagtgagtctatgcccttgtccggatccgaatggctgccctgcggatctgcacgccgggtggtggtgctccggaggccagaagaggcagtcttgctgctgccgggagcgcggttcagcatggaccggatttgatcgggttcagttcttgggtgctgccaatcagcgccggatatgccgtggaccggaggcacgcagcagctggtggagttgccgcatgccatgggctctcgtgtgctgacagtgggaggaggaagaatcatcccagggcaagtctggtgaatggtgtggtttcatctctggaggacagtagcggcggggagcctgcgctatgcgtatctgattcacctgaagacgctagctccagtggaaaagtgttgtccgatttgcgtcgggacatggtggatggtattagtggtattccaagaatttctgcgggaaagaagaaggggatgaagttcaggagaagagggcagggtggaaatagattgacacggcgtagtgctccgaggcgtgccagtggaaagagtgggcaagatcagaggattttgttgagcgaggatgatattgctgcaattttgtccagtgttacccatgaatctagcatcgaggagtgcaattctgttctcatctgtctcgagaagcatagtgataagacagctcttggtttctttgagtggatgaaggctaatggaaagctgaagggaaatgctgaggcgtatcacctagcgcttcaagcgatcgcctggaaggaggattgggaagcagctggacagttgcttcatgaaatggttgctgattcgggttgcgctctggatgctcaagcatttaatgggcttatatatgtttgtgccaaacggaggcttgttgactggggaacaaagtggcttcatatgatgcttgaaagagatgtgcagccgaatgtgtctacagttggtatgcttatgggactttaccagaggattgggaaccttccagaagctgaattcacttttgctaaaatgaggaaatgtggcattaagtgtgttaatgcctactcagctatggttactttgtatacacggttaggccattttgccaaatctgaggaggttattactctaatgaataatgatgaagtagttccgaacatggaaaattggttagtgcggctaaatgcttattgtcaacaaggcaaaatggaagaagctgaattggtattgaagtccttggtagatgaaggaattgctctgaatgttgtggcatacaatacggtaattacaggttatggaaaagtttctgacatgcagaaggcaatggaagtgtttgataggcttaagagtgcaggtttagctcctgatgaaacaacctatagatcaatgattgaaggttttggtagagcagacaaatacaaacaggcaattttgtactacaggaaactccgaaactctggatttaaaccaaatgcatccaacttttacacaatgattaacttgctagcaagacatgatgacagtgaaggtgcaacagagattctcgaggacatgcgggcagcaggctgccagtgttcatcgattgtcactgttcttgtccgagcatatgggtcagtaggaaggatgcataaagttcttcagattctaaaagcatgcttctataagaagattttgtttgatgccacctcatgctctattttagtaacaggattcgttcaaaattctctagtagaagaagctatgcgtgttttgcgcgaaaagaagtggaaagattctgattttgaagacaatttatatcatatcttgatctgttcttgcaaagaggctggctgttgtgatgatgctgtcaggatatataatcagatgcctaagtcggcaacacatccaaatctgcgtatttattgcagtatgattgatgttttcagcatcatggagagattcactgatgctgaagctttatatcttgaactgaaagcatcatcctgtgttcttgacatgattgcctacagcgtaattgtgaggatgtatactaaagctgggcgaccagaagatgcctgtttggttttggaagacatggagaaacaaaaggaaatagttcctgataagtaccttttccttgacatgcttcggacttaccaaaaatgtggcctactcgagaaattatctgatacatattactggatactaaagagtcaagttgaattggatgaagccatgtacaactgcattataaactgttgtgggcgggcaataccggttgatgagctctcaagaatttttgatgaaatgattcaacaagggcacttggccaacactgttaccctcaatgtattgctagacatatatggaaaagccgggctttttaataaggcagaaaaggtatttctcatggctcgcaagcagggtatggcagatatcatatcatacaataccattattgccgcgcatgcaaaaaatggggattttcgtagcatgatttatttcgtccagaggatgcaagaggcagggttccctgtttctctggaggcgtacaactgtatgctggatgcttacggtaaggcaggacagttggaggagtttgctgctgttctgcaaaaaatggagagagcaggatgcgagtttgatcactatacttacaacattatgatcaatatatacgggagaaagggttggatcgaaggagttgcaaacgttcttgcggagctaaagagccgtggtggcgagccagatctgtacagttacaacaccttgataaaagcatacgggatagcaggaatgcctgaagatgctgttaaactgatgcaggagatgaggattaaaggcattgccgctgaccgagtaacctatactaaccttatagctgctctacagaggaatgagaatttcctggaagcagttaagtggtctctctggatgaagcaaactggagttgctgcaactcgaacatgatgtgcctaagaattcagagttttggttgcatgcaaattctggcatccgcacacgtttatatttcatctttcagtagagtacatacatacatgtgagtgacattgtacagagaactatttctgattgttctacacatcctatgggtaccggagattcagaaaaacctcctacctttccattctcttacaagatgaaactcaatcagtggatagcaagataggaacttttatcataccaatcatacaattgtaatttttttaccagaactggtttgaacttctgataataatgatcaaagattcattgagaaacccaagttcaatgtccattgtaccctctcatgtctgtcaatctgtcattgtaaaatctgtgcgctttctgcgatctcaattcaggcaacttttcccgcttgattttgacgtacctgaccaaatgttttcggtcagtttgtagttgtatggccttgtttagttacccaaaattttttctcaaaacatcacatcggatcttcgtatacatgcatggagcattaaatatagataaaaataaaaattaattgtacagttaggaggaaatcgcaagacaaattttttagcctaattagttcataattagccataagtgctacagtaacctatatatgctaatgacggattaattaggctcaaaagattcgactcgccgtttccaggcgagttatgaaattagttttttcatttgtgtccgaaaacccctttcaacatccagttaaacattcgatgtaacacctaaaattttttctttttacgaaagacccgatctccaaatttcaacctttcgtagtactactaaacggtcaaaaaaaagatgtgacggcaattccacttcctttgactatccatactaaaaagtcaaaaaaaaatttgccgaaaatgtcagcaacacctcgtcgcctccatgccttttagtcaacgcctcgccttgttcagatgcagcaggtgaggtgagagctccacctcccggagctcgaggcttccccggtgaacacctcctcccggacaaataaactaatccaaatgccgacctcgcttccggtgctcgagctcatcggcgaggcgtccgcacgtgcgccaagaacccctcatgagcaggtgaggtgatccttcaagaaaccagcaaaagaaatccaaggtcaatgccggaagaacaacaagaagcggaagaggggatcgccggcggcggcggcggatgggcgagcacggcgctgcagccggtgcggtggctgcggatgctgtgccgggagctgggcgcgacgttcgtcgccggcgtggtgctggtgtacgggctgagccaggggttcgccgggtccttcttccgcgtggcgtcggactactactggaaggacgtgcagcgggtgcagccggccaccgtgcagctcctctccgccgtcttcttcatcccctgggtcctcaagcccctctgggggatcatgaccgacgtcttccccgtccgcggctaccgccgccgcccctacttcctcttcgcaggtcagccactggaatcctgcatctcaaaatgatgagattgatgatctttagttggcgtgcatagatagtagagattagagaatcttatcagtagatagagtatgcgcacagttaaagaacaaaaaaatttgtgaagattttagcaatatgcttgctggtaagaacatcctgaattcctcctgtgtccataatgtcgtagaaattttagttgtggtggcatatttggtactccctccgtcccataatataagaacctagtctgggaccctaggttcttatattatgggacggagggagtatttggtaggcatagtaagttcttaaatgatatttggggtctgatgtggtggtaattgaaaacatagtgctagttcagctttttcaaaaggttcagggggttgctgggggtagagaattgataacacaacgagtgcttggtgatagtacatacttttagactttgtagagagaggttgagtggagactggagaggtagttccaggcacgagcaggaactgtttatgctaggtatcagcagctcattggatggaattggggatgaagatgtgttggttcaactaccatgtggatttcgtttgggactttggatatttgatgatatatgcattgtttattggaggtctagccagatcttaattagtaggtgcaagatttggtgtaagatgttatcttgccaattcttagaacaattgaagtatcaatgtgatgtatctgtgatattgcactttacaaattgctgggcatgatcattttaacaattccttgctgtagtaagtttttaaagtgagtctgagaaagtagcaaacatggaacatattgatcagaaacttatatgttacattttgtcgatttctacagcagttataaacttgacaaataaatcccatttatttctggtgctgacaggagtacttggaacggcttcagctgctattgttaccatggttaatggactaccgatgacttccgctatactttcctttgtggggatatcaacagcagttgccatagcagatgttacaatagatgcatgcattgcgaagaatggtattgataagccatcattagtcccagacatgcaaagcctttgtgcattctcatcatctctaggtgcacttattgggtatgctacaagtggaatgtttgtccaccatcttggggcacaggtcaattacagcctaaattcttgaagcttattgaattgccaagttccattttttggtatgttgcttcattgataatttaaattttgtatgattctttttgtagggtgcattaggtgtgatggctttacctcctgcaacgttggtttttctaggatttttcatatatgagctgaaaatgtatcagcataatgtgaaagagaaggtatgccgaagtgaaaagcaatattgttctatctacttgtgacagttttatttgtgtgcattgaaattttgttccctttacttgtgacattttttatttgcctgcattgaaattttgttccatttaattatgatatttttttgtttgcctgcattgaaatttaccaagttttgaatatcaatatatatttttggtgtcttcatatggtcgtacagatagaggatggtttatctgatatcgctgcatgccacttggcttagccaagctgagacgagtggcttgtgtattgttcttctgagatgtgtaacatattagcaaagttcacaataaaatgaaactgatgcttcagtgactgagattcatcacaggtcttgttaaagcaactaagacctttacggattgaatcccaagtaaacacagacagtgaactcaataggctgtaaagcataggcagaaaccaagtatatcttaatatatggtataacaatgaaagaaatacacaatatatagtttctcaccaagatgctaatgtgcaggttttgaataaggttcatatggcagtgaaagggatggctcagacaataaagtacccagtagtgtggaagccatccctgtacatgtttctttccctggcgcttagtatcagcactcatgagggacagttctactggtatactagcaaggaaccacctaatcctggattttctcaggtaaatgtttttgttttttacctgcctgcttaatcctatcgctgattagcatatttgttggataaaaggcctaatccaagtccatattggaagtttgaaacaatagcacatggttttggactggaaaaccaagtttacaatgtgcccccaagtactcttctttttgctctcaacacttctacacataatacagaagtacaaaacacagggacatcataggcatacagatgttctttaaaacagcaactaccttcatttcttctcaagttcatatcatgtctttatgatgctacctttttttttctcagggtttgtttatacttgtcaataagataatacaagtgaggtgcaataggatatgttgaattggtcctacacactaatcaccaatcactttcaagcaacagaaaataacacaatcaaggtatatcaggaaggaaacctagacaaaagtgtgccctttccttcaaactgggaatctagtatgcactcacacgggttatgtccccacaatcttgcttggtccacaatgctgtcctcactgtctgtaacagatgccttatataagatagactatgttatcccaaaaatatttcttcaccttatctcagaatctaagcctggcacataacaattagtcctaatctccatgatctaagagcttataatgaatagatagtacacaatctccatgttcaagcgttacatggaaacttacaatggcattgttccttaaagcttaggcagtcaggccccatttggagagctgggttttctccagattcctagacatttatacaaatataaagtcagggcatgatgagtatgttttgtgaatagcgaaagcaaatgcataaagcatccctcacaaaggataaaagaagactgttgatcatgaaaaattcacacttgttatagggtgaatggagattagcatcagtagttcaatcccttctgatatatgaattatcttgcttaatctaaaggaatctgatctaatccctttctatcagacaagttctaaaggtattataagtgtgaattaaacaatgaaaaaagacacatgtgcaaaaaaaatatttacacacacattacaaatagtattctgggataaaaaaaaattgtggcatagtttactgcggcataatatttgttgtcatctcttcgctccctttttttttcttttttaatgaacataagctatgtacttcctagttatacagaagcattcttaaaataattgtattgatataattatctaagatcaatagatcttcctttatcttaaaaagacataaacagtttccacatatttcttttttcacttaatctaaccagtttttgttaaacaagtgctaactgctaagggcgtcataagagtaaattaaattaaacaatggaaaaggacgcatgtacaaaaaagattcttacgaacagtttacaagtagtagtttgggataagatcaattgtggtcatagtttactgctgcctaatatttgttgtcaaaatttcccaattctttttctttttaataatcataagctatgtgcatcctacttatacagaaatgttcttaacgatacgattatctaagatcaataaagctttccttcatctgaaaagatacaaacagcttacaaagatttctttttcggcttaatccaaccgcattttgttaaacaggtgctaagggtgtcaataatggattgagatcctctgacgtaaagtcagtggaacatggtgattgacatgtgggccccaccgctcttgggcccacctgtcagtgaccacatccaggggcgaagccacgtgtagggcaacttgggcttgggccccacacgtggcaaaaatttttaatggagaaacactgaaatttacgtagaatttgcacacaaaatttatagttatatggtttagccctactcttgctaaaatgctgcctccgcccctgaccacgtcagggggtaactttacgtcagaggatccgtttccgtcaataatgttgtcacaagattaaaaatagtactcatcccattgcatatgcaggaatttgttggtatggtccatgccatcggcgcagttgcatccatggtgggcgtcctggtgtaccacaagtacctcaaggactaccctttccggagcatcctcttctacgcgcagctgctgtacggcgtctccggcctcctcgacctcaccttcgtgctccggtggaacctcctcctcggcgtgcccgacgccgccttcgtcaccctggaggagtgctgcgcccgcgtcgtcggccgcgtcaggctgatgccgatgatggtgctcagcaccaagctgtgcccgccgggcgccgagggcaccttcttcgcgctgctcatgtgcatcgacagcgcc

SEQ ID NO: 69884 - DNA, 4546 bp, Oryza sativa
cctgcagccccctcaaacggcttttaagtcccagcccgtttgagatgacttctgccactgtatatatatgtctcctctcccagcgaggcccacatgaggagataaggccggccggctccctcttctccacttctcatctatctcttccacttattctctctatctctcctctctttctctgtgccatggcgaggggaggcgcggcggcgccgggccggctagggcggcggcggcccggccgccagatccggcagggatccggcaggggcgggtggggaggtgcggcggcgccgagccggcgggggcggcggcggcggcccggccgccagattcggtaggggccggaggggaggcgtggcggcgccaagccggtgggggtggcagcggcggcccggccgctagatccggcaggggcgggtggggaggcgcggcggcggtccggccgccagatccggcagagacgaggggaggcgcggtggcggacaacggatctggagccgtggcgcggtggcggccgacggcgggaggggaggcggccgaggcccgacggcagcagcggtctccacctccgccgcctctgccggggacgcctccagccgcgcctccgcctccgccctctgccagcaagtcctctttcacccatgtattttatcttgtgttgttcatattgttccaattgttgctactgtgattgatgattctgagtcctatggtgattgagattcttatgattttgttttgtgattgggacaactgtgatggaacaaagaagaattgtgacgatttttttgatttgtgaatgccaaatgcaatcggtcgaaatgaatgtgatggtaacctaggaggacggtgtttctcttttttttcccctttttttcacaccagtgacggccccaattagttgggccatttgaggtgactctaacctgtgacgggttttggttgggaccagacagaggtaactctcacctgtgacgggttttagttggggccgtttgaggtggctcttacttctgacgggtcttcacccgtcaaaggtgactcaagtcatcagtgaccactaatctctgaccgggagctgaacccgtcaaagttgagggtttgagcccgtcagtgctgacctgatccagtgtagtgaaaaatcatgatgttttgaaacttctaataggataaatcgaaggtcttttttttgcattcttgaaaagttgtccacccggcttgtaaaagaattgataaactctatgccaaatcattgaatctatgcatacaaatagttctatacacaaagatgcactctcaataatagagaatttagtaaaggtcatgtatttatcattgtcctacgtttttttagtgtgtcctcattggtgcgtgagtgttacttgcgtgtaacatggtgtgcacgagttttccacttattttagatcaaattggcgcactttcactttttaacataagtcactaggactaccataatatattggaacatagatgcgtcatgcacattttaacatacgtgagttagcaacaacgatggtttattcaacaactcatgtatctttgaatatatacttgtcttaaaaaatattaaaccaagacactgtttgatttataaagccctttttaatttgtagagaaaacatagaaaatttaggattttaatcttatagaaagccatacaaaggcattaggaaaaaatattaaatcctatctatttcttagaaattcttatgaaatggacaatcttgtactctaacagaaaagttagcaaaagcttcgatcatcgtataaaatttcttgagcctatttttttcattgtttcttccgcgtttctcatgtggtttattcaaactaccgttcctttagttttctttgtttcgtgaatcttcagtttgtacttgtgctcgtatcaaaatcttgtattctttttctatttgtttttttttttttaatcctgtgttgccttaaaccccatttgggctgcaaagctttgttggttactttgaaatataaacatgtccttataaacttaattatcgtgaaattcattagttgtttgttcccatcggaggtcgatacagcgaaaaagaagggggagggctaatgggcgggtgatcgtccacagcaatcgcccccgtccctccctctaacacgcacgttactttctttccctactgcaccgtaaatttcccaaaaaaaactagttacaaaaaaataaaaaaaatagaaaaatctaatacccttaaaaatatattcatgtgcataaactttacacttataaatatataccgtaaacttcgtacgtataaacttttatgtatagaaatattctatatagaaaatatttaaatccaaatttaaatttgaatcgggtatataaacttttaacctataaattttaggtgcgtaaactttagatgcataaactttaggtacatcttatcttaactaattaaaagattcatattttccgatcgtcacctcgtccgtgcactttttcgtccgtcccccacccccaaaaaaaaaatcccagaacacaaatacgagtctgcatcaaatttggatccaaatcctagagaaaacacaactataagaacacaagaacaagaacaacattaacacaagaacacaagaagaaaaggggagggtgtgccaccgtcgcagggacgcatgaacgctggcccgccggcggcttccctcccactggatcctgtggaggggaggacgccgccgccgggccgccactgcctcccctccccttccgccatatccgggatgccggaactggcacaccgggttgccgccgcctcctctcctgctggatccgacggaggggagggcaccgccgccgccgtgacaccgggctgccaccgcctcccctcccctcctgttggatccgggacgtcgggtcgctgccgcctcccctcccactggatcagtggaggggagggcgccgcccgtgcccgccgcctcccctcccgccgtaagggagggcgccacccaccaccgtcaagcacctgcggggtcactggtagagggagggagagcggagaaggagagaatgagagaaggcgcgctggcggaggagatagactgagagaaagagagaaaggataagagcgagcggaagaaacgaggcatgtggtgggtggaagaaacgaggcgcgcgggtcccaccgctttctcgacggacgcagatgtaaaaatcacagtgtgactttcaggccatatccaccgtccgtctcatctgacggaggatatttcccgcatgtggttcctgccttcctggcctcattattatttgcttgctgattctaatcgaggattaatgaatctaattaaacaataactagtaatcatgcacgtgcaatgcacgttttccatgtcacatctaacatcaacgttacattttatggtctccatacatatgcaggatattcattttcatttagtgatgaaataaagttatccagcttcattttatttccattctaagtcgaaatgaaaaagaaaaatacaacatattattgcattcaactaataatacaactaacagtaaataaatcactaaaacaaagaagaaattaaacctcattttatttccatacaaaatgaagattaaaaagatattcactcattacaaccaaaacacaagtgcacatggaattctaatgcggcgatgaaattaaaaaaaaaaacaccctctaaggcatattacttttttcagcgaaaccaaggacaaatcaattcattctgtgtagagagacaaaaaaaaattgtatggatacatgcaaccaataagtaataagatggttgcccaggttctaggacatttaagtcttagatgtatgaagaatacaaatattcccatcctatttgaaaaaaaaaaatcagaaaacgaaatatggatggagggagtacgaccttacaaccgagtgaaatttgaatgagactaatgagtttcgaaactaatgagaatataaaattataaatcaatgattatttcatatgactccaaacaaaagttcatcaagatcactttaaattgatcaaatgctttgaattctttagtttgaactgaatgcttcttgaacttgaacgccaattcatataaatgggacccatgtcaaacatcaatttgaaaaatccataattaaggaacttacttagatatctacaaatgcttcttgaacttgaacgccaattcatataaatgggacccatgtcaaacatcaatttgaaaaatccataattaaggaacttacttagatatctacaaatattataacttacaaaggttgaaaatagttaggaacaggaaaaattgaaatatatagcaaccacatgcttcagacctatttagcaaaacaatatgctctagcatattccactttgaatgtcctgcttcacttgggctgcagagaagtgaaaaaagtatattaaaaactattaaaaggtggtttgaccataattaaacaaatcaaaaggctaaggcatggatcaacattaatccgttcatttgagtttagcttcagtggtgttttcc

SEQ ID NO: 69885 - DNA, 7316 bp, Oryza sativa
ttccccaccgcagcaaccgccttattccgccttgccccgctgctagcactcgcctccctccgcgcccactacatgccgtggacgatgccgccgccgatgaggatggacgatgccggcgacggacggacgccggcgcggcggtggcggactgacaacagcgctacggatggaagagactgagtggcacggaacgaaaaaaattcgtactccgatggcgtattctgaaagtagcatgaatggatggcatattctgaaaattctcgttgggcctggagagaggacaaaggtttgggaaagaggaggaaaacgaggaggggtgagcatgacatggggcccaccattttaaatttagttatttggtgtaactgacatgtgagaccatgatttttattattttccaaatcaaattgccacgtaagcgctacgtcatatgacgatcaagtcaaattagtcagatagacgtgcacgtcagcgaaaactgttgtccaaaccaccatgggacccaccggttttgtcaattgagggacccgttgtatctagttttctagttgaaggatgataatcggattcattgacaagttaagggacctcagatgaacttattctgctagagagagataggggacggaaaacggacttttctggaattggcccaagaagaagaggatttaaattattcattgaaatgatattttaatttttaaaaatacttccattgcacaaataattctaaaaaatacttggatactcaatgtattcaataaaaatttatctagctcgatttgatgttcaaatttttcatagtttttattcagacacttactttaattattaaataatttctaaaattactttttcacaacaatttataatttagcaatttttagggtgtgacaagaagaatggggaagatgtaataaaatagcggaaaaatttaaaaagtaatgccatgtcgtcgagaccggtggcaacgagaatgaaaacatgggagagtgtcatttgagcatatgcaagttgggaaggtcgccgctagagacgtcattgtcatggtctcggccatgtgctcacgcacacattgcgtcaccaagaggaaggggatgatgacgagccgctcctcgatctacttcgttgtcgactccgcgagagaggaactgtggtgcggatgacagaggtcatggaggtcaccagagctgcacgctagaaggtcaagcccccgatggaaccaaccgcacgtgcgatgtccaccactgccaagatctggaagagggagctcaaggctaatatcggagcatcgatatcgtgttagagcgtctcatgtgaagcttgtcactggtcattgccacttcacctgcatgtgggccctttagctctcatcgttgctaccgagctcgagctcaacgaggtggctatctagagcttgagctggcgatacagagaagccactcgccattgtttcctttctctcgtcaatgatgcacacgcaagagctcatggtggcggccatggcaacctcgacaaatggcagctatcttggaagaagataaaaaggaaaaaaagagaaggaaaaaaaagtgggaaacgagagaagaagcaaaaggagaaaaataaagaagaaagaagaaagaaaaaaaataggtatctggtggccaaatatggtagtcaggaccgtagagttaatgatgatatcaaatcagcgcaacttaaagattctacaggatggtgataatttggtataagtgcttgtacaatagtctttattagtggtctttctattgccatgcaagtaaaattaatgacatagaagaaatagaaatatggttgttagagcaagtataataatgagctataggtgtactataagcttatgtgaactgtgaaggagagaggtagcaaaaaaattaagagtgttggctctcatgcaagagctaacttaatacaatctacaatacaaatacattcattgtataagttagagatagagagcggagaagaaaattgtagccaaccttatagctaatctattatatatattgactttaagatgggctaataataggaagtaagctatactattatccttgctcttatgcatgacaatggtttagagtcgactcttagcatttattagcacaaattttattgcatggtggcgaaagaaaggaaagaagagtaagaaaaaatattttgatacattaatgattagagatcatattgtcttcaactgttgtagaatactggtctctaaataacgtaaagctcatacctgactctacctctgtacatgccctaaaataaagtttaacaagttttgtcatccaaatttggattttaagaatataggaactttaataatagaagcgattaagtttagtgagtggttgtctgtatagtttactgtaaaaaagtttatacttgtgtttttgacaagctaagggtgcgttctaataggcgggatggtttagccgacatagctgcacgtaaatgagaaatgtgattagtatttgattaattagataatattttataaaaaagttaataaataaatttattagatttttttaagcaatttatatatataaagttttttcacaaaacatatcgtttagtagtttaaaaacatgctgacgaaaaacgaggattagctaagcggctttagctggaaaggacgcacccactaatactggaaaatattgaaaagctagtaaaaaataattactaaattaagtttgaaaatgtaaaataaaacacaaatattttcaagggaggagaaaccgtatcgtacaggaaaaaaagaacgttcatcacattttagtatttcaactactttcaggctttcagcagagttcatggaaccgatgtgtttcgacggaaccgatgcgctatcatcccatggcctaggctgtgtgcctttctttacctagcgaaactttgtcacttttacgggagatatttaactaagtgcaagtctgcgactcttacatgtagcaattgaaaatttatcaccactaaacctatatgctataggcatataaggacccatatccacatgtcatgaactgcgaatgataaattttttaaatttttaattgccacatcacaaatagttagattccctcttttatagaattctatcaaatccaacaatccaacagtttttatttatcgatctgcctttttgtcgatcaagtcgatttcacgaaccatttttaggctgctttcctttccagccgttcctaactcagcgtgtacgtttttcaaactactaaacggtgtgtttttttaaatgtttctatacaaaagttgtttaaaaaaatcatattaatctattttttaaaaaaagatagctaaaacttaattaataacatgctaaacgctgcttcgttttgcgaggggtttttaactatttaccactcttccggagtgccactatccatatgccactcttctagatttttttttatacaaacaccataaaagagatattttctccctaattaatatgctatgtcagcaagggagacttgaaatgacctttttgcccttggtttcatataatttgagagagattatatacaaacatatgttaacaaatattgattgaacaagttcaccacaatataataatagattaaacgtagccactttcatatagaatcgaaccatccatattacaatatatattggcaacctgtcatgttcacaaggccataataagacatcgcgtacaagtaatctctcatataataaagttcattgagagatgctaggccgtacatgcaggccatgaagttcggtttagtttcaaaaatatcacatcgaatctttggacgcatgcatagagtattaaatatagattttaaaaaaactaattacacagttaggggaaaaattgcgagacaaatcttttgagcttaattaatccatgattagctataagtgctatagtaaaccacatgtgctaatgacgaattaattagactcaaaagattcgtctcgcggtttccaggcgagttatgaaattagtttttttatttatatccgaaaaccccttccgacatccggtcaaacgttcgatgtgacacccaaaaattttcatttcgcgaactaaacagacccgaagtagtttgtagcaaaataagaaggcatacgatcattaggccatacacatcatatcacaacaaaaggcgccaaaggcttatcagaccattcatcatttcataagttcatcaggccacatcacatagcaaaatcagttgaatagcttgagtggtgaagcaattttgggcttgttagctagcttttttctaggagtaagcttcttggattgctagcaaaaaggtcatttcaaatctccctactgacatagcatactaattagggataaaatctctcttgtggtgtttgtgtaaaaaaatctggaaaagtggcatatggatagttgcactccagaagagtgacaaatagttaaaaaaaaaaccccgtcggccgccgcgcgtcactccctcctcacccgccggctgctgcgtgccgctgcctcctctcccgtctccctctggccgccgtgtgccgccactcctcactcgcgcctggagagaggacagaggagaggggagagagatgaaggggaattggggagggaggaggaagaagaggagggttgagaatgatatgtggagcttccatcattttaaaattaattttttgggtgtaactgacatgccggctgacaattttttattattttcgaaatcaagttgccacataaacgccacgtctttgccatgttatatgaagaccgaatcaaattagccacgtaggcgtcacgtaaaccgccatccaatctgccatgggacctatattgtattggttttgacaaatcgttatatctagtttttcagttgaaggatgaaaattggattcgttgacaagctaagacaccttttatgaatggaaaaagtatactgaagatccctcaacttgtcatcgagttacaaaatcatcctccaaccacaaaaccacgtatgtctttagttggttttaaccccgggtttgtcatacgtgacggctgagtcagcgtgggacccacatgggtcccacatgtcagtagccacgtcagcctcctatctccttcctcatctctctttcacgctttctctcagatgggtgcccccacgcgcgtcgcatccccgccacgaacgccatggtgacgagccccatcgccgcggcccccgccacagccatatgcggcgcggcgcacgcgcggccgggacggttcgcgcccagctcgttccccacccgtgttgacacgccgaagcccagcaacgacgggaacatgtactccaagggctccgggaacacgccgaatcccggctcccgtgtcgtcgccgccgtgcttcaagggcaagaagatgtgggatgacgaggaggaggtccagagccttctcaccggtcgcgaatggcgccggccgggaggttgaggtcgaacgcccgggcggcggagtggccgttgccggagctgcgggcggagtcggcagcttgacccggtggctcgtcttgtggccgccaagcgcctgataggcttgccgcagacggagcacttgaactccgcacctgccgacggccgcaccaacgccgagagcggaggcggcgcctggacacggtggtggccgccgcgggctagcatgaggaggcagagccgcaatatgtaaattgatcaactagaggcttctgttttcttaccgtgtctgtaagcaaaggagactgaggtgccaaaacaagatgtttcggttctgtacaaatatgatcatgaaatcaatctgtgtttatgttacagcgtactgtacacgaatcaatctcccaatatgatcgaatatggtctacaatatatgaccgccaaaaaactaagtgtaaaagatacaggtacagttccagtgtacaaagaaccaaggaagagctagacatagtatctgtatgactatgtatggctatgtatcactcgtttgctatgtacaaaagcaggaacaaattaaacaatagcggcacaaaacgaatcaacgaatagtttgtttcgaccgtgaatttcactccctagaccaaaaactgtttgagagatcagatccgtgcagctgctgaattacgcggtgagaaggcgagggggctctggacctcggaggaggcaggagccaagacgggagatgcgggcggagtaggcagcttgaaccggtggctcgtcttgtggccgccgagcgcctggtaggagctgaaggacctgccgcagacggagcacttgaactccgcacctaccggcgccgagagaggaggcggcgcctggacgcggtggtggccgccgagggcgagcatgagaaggcagagcgcgaggttctcctcctccgatcgctggcggcgcgacctcttccgcttcgcccacccctgcggtaggtgcccgccctcctccccgcttgtggcgctgctgctcgtcacgaccgccgcctcctccacctcgtgctgctgctcctcctccttgagcaccgcggcgtggagcgcttccgtctcgccattcgcgacctgccgccgccgcctcaccctggcggccttcgccccagccaccggccggcttgccgagaagagtgagagagagagagatgaggaagggagaggagggggaagagagagagagggtgctgacgtggccacgctgacaggtgggacctacgtgggttccacgctgactcagccgccacgtatgatgaaaccgggttcaaaaccaccaaaggacctaaaatgaatgttttttaagttggaggatactctgtatctggttttctggttgggggacgattttgtaactcgataacaagttgagggaccttctgaaccgggttcgcgacggatggccgacgttattaatcctattttatcagtgtaaaaataattgtaaatgatatcataaatctatttaatccttttaattaggctttaattggattaaatatcgtaaaattcataactaattcatgcaaactcgaaatgaagtcgttcaagtctcaaaattcatctcaaatctcatagttaaacttatttcttttcatatggacacagatttggacaaattttatttgaaattatagctcttgacgagatttataattttataggtgatttttttttcatttgaaatgttttagatacttaaattcatgtttcaagtctcaattaagtaggctcaaatgaaaacatatctatcttctaatgagatatttcatgaaatgccattgacaagcatccaaataccagaaatgccatcgacaagtgtgagt

SEQ ID NO: 69886 - DNA, 5642 bp, Oryza sativa
ggggggaaacggcgcggacgtgggcggcgaggtcccacggacaagcgcgcgcgcgcggggtggaggaggtgggcggaaacggcggcgacgttggacggctcgggcggccatggtggttgctggcccgggctggaggttgggggtgaccccgacaggtggggcccacctgtcggcggctcggggagaggagggaggatgagggaggcgaagcggacttgcgcgaaggagggggcaagccgggccgacggcccaaagagaagggaggaggggaaaaggagggcggccgggcccgagaggatggagagggagaagatcttgggccgaaagcggcccaaagacaaagaggggaaattttattttttttctttttattttaattgatgcaatgatctttgtgctattaaaattatttctcgagctccgaaaattcgcgggaaatttcagagagtattttagggcacaaagaatattacaaaatattctcagccaatgatttttaaaggaaatttttaattccctcaataattcacttgattaagttgatttaacttttatttaatttctagaaaatgcattatttaatgatttttaatcccgaacgaaaatcggggcgttacaaatctaccccccttacaggaatctcgtcccgagattctgggatggctagaaagaaaactggggctggcgggcggtctgactgatttgcacactgcactgttcctttctgattcaactgagcgattcctcaatggtccaaacctgctcgactgaactgaccggcattgaccattctgttctttcgctccaaacaactgaactgactggcctcattggattcgaccttggaggtctggcgccccacaggactgaactctgtacgagtgatctggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagagggtgaaaatggaatctggcatttgtaaatcatttaccctatgtccgcttcgactggtcccaattcaaatgacaagtaattccaggaaaacctgcttgacctgtctttcgtctgtactacaactgtcctcgctgttgcttctctaagctgaactgttgacatgcttcacaggtgtaccttagaattgaacctgtcgacctgagattggggtgactctgctaatggttcgcaactgactcctttaattactaaccaatttgctgcactgggttgaacctacaactgaaacggcaacgaggttagccaaatctcatctctgagacctaccccccttacagtgggtagtcatactttcgcctaactggaaacacttgaactgctatcattgaaaaacaaccattacttctcggatttacaaaagaccctgactttggaaactgacacttcatcgatcaatcaaaatggagcaatgacgatgcactttcatccaggtcaagacttggaacttaacccttagttgttgataggaaactcctcataaagaaattctcatttagctcctgatcttactaactcttgactacttccccatcagttctattgctggcatatctagcatgcttcaggcccgacttcggtgtcgagttgcatagttgattcctcaaaactgaactgaccgactctgctttggaactgacacaacttgaggagttgaggtgtcgctaacaaagctcttgatgtgatgacactgatgccttactgtggaacaaccctctgagaggtgccctgtcgtacatcttccatggatggttggacactttgcaaaaactgctcttgaaaaccataaccactgtaggtagcattgttactcctgggattggtggtgggttagctgtgctgatatgctgaggacttggtggcgtactatctgaggttgcgggtgcttccttctttgaaaacaaactggctttggctctgatcctgattccagcttgcatctaggcttgtacatgttgttggagacactgttgctgcatctgttgcatcggactttgcatctcccgcatcattacatccatcatctaatcttggacaccaaatgttgatcacgagcagggttcttctggcactgggataccttgtagctttcaactgaaccattgattggtgactttaatacaccgtcgttgctcttctctctaacactgactatcttctgccagggcggaagagaggaggaagagaggggttgctaaagataaggtactaagccacttgcctactgatctgttgtgagtagatttttatttttcaagttgtttaagcaagcaacctagtatggtcgcatccccaccagtgatgcaaaccatacccctacacacaagcaaacaacacacgatctagaagctaacgaaactactcttctgggacagattgggtttaggtcatctccgggaaaactccacttgatcttcgcggaacgacgactctgggctgaacttcttgctcctgctgcacgaagcttgaggcttgaattgacttccgaacagacatgaagctgacggctggtcctctaggtatgtcaactaaaagaattggagagactgggaggagaattttgaaaaaccgtttgacaaagaaatgccgaagggcgagaggagacaatttgcaaatagggtttttagaaaacttgtccttagggtttgaccatttggctcaacctacagtcgagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaaatacttacagaagaggcacttagtcctcacaccgaaacaaaagcagcagcagcggaaaaaaaaaacgatcctagcggggcttcagctccactccacaggcaaaactcaactggggtctgagccttggtcttccaactccatcttcagctcagaagcactacacttctgaaaagggggaataatagcaagactgagtacaaccaccgtactcagcaagccacaccaacgatgcggacgtgcaaagggatacaaggacggtttgtggctatttgcataaaggcagttgtaaaacattttatttagcaaacagtaaaactgttgagtaattaaagtaacattaaatctccactgatcaacgctacaccacgttgaacaggcccaaccaacccacctggactacagtgcattgggtcgatttattaggtgtgagactaatcacggtgaatctggtcgatcgcccataaccgcgggcacggctattcgaatagttttactctggccagaggtgcacagctgtacccacaagacacaacccaccgacatgtcaccgcgtcatcatgtgctcatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccctggccgacccaactccatcacgcccaccctcgccaccggtgcctaggaaagggtcgagctatacttcagatcaagcagttacccactcccgcttgtggtaagcactgtaagtcttccagggtttcccgtgaaccggtccttaattgccatgggtgcgactcgcaaaaccatgcacccacagcccaccattcagtcgcattttagttggataattacgaccataaaacatggccagatgtctcgagcacgcggctcaacaagatactagtatgtctaatactgcaattatcccatcgactgagctagtggtaattcagcatggctaagcatatagttctagctaggtcacataagtaacacgagctagtcaatttatcacccaaggttgacaaaggatagatatcaagtaaacatggcacaagcgagcagataggtaaaccctgaccccgtgtaattagcaaaacatgcatatttatttgcaaacagtaaaacatttgtaaattaggatcaacatgctcaaggggaatgtgtgacttgccttgcttcttcactttgatcttccgaactcttttccttgcgaccgcggacttccgaaacgacggattctacacgctggcacgcaaaacgaggaaaaaccctaataaaaaccaagaaaacagtacataaaaactaaacaaacatgtagagctcaattttagatgaattttgcaagttgaacggctcaattcggagttcgaatgaattagatatgaattttagaaggttttgagccattttaatggatttctagaattattaccgatttattgcgcaatttaaatcaattatgacgtcatccgacgggggagaggtagcgccggcaagcgggccccacctgtcggtgactcacgggtggcgggcgcaccgtggaccgagtccacgcacgcgctggtccgcgggcgcaccacgtggcagacacgtggcggccacgacggacggctagcggaggtggcgccgacgtggcgccacagaggcaccgacccgggcggcacgggaaggccacgtggacggcccagatcgccccgaagggggatcgggcggccacgggcgagcgggagccggctcaccggtcggccggccgggagcgacggcgcacggcccgatggtcgccggcgacgaccaccggcgcgacggcacgcgcgggaggcggcgcaaagagggaaaaggagaggagatggagggggtcctcaccgaggggcgccggcgacgggacaaccatggggaggcgaccggcggcggaaaggatggcggcggccggcacgggaggcgacgggaacggcgttccgacgacgcccgaccctggcggagccgcggccgagggccggcaagacctggggaaattattggagcggttagggagggaaataggcgaccggagcggcgagaatacacgccggagaggaatggtggggctcaccggcgaccgagagatacccgtccggtgggtttccggcgatgaacaacggtgaccgaggtgctgcccggcgctgcgaggcgagaggttaagacggagcgacacggcggcggctaaggcgacggtggcccccggctggagccggcgtatggtggaggtggctcgggatgcacggtggaagggtggttgcggtggtggaatggggaaacggagcggaggccggggtagagcttggcacggcgttgccggcggcgcaagcggcgaggtgcggcgacgactagcgcggcggcagcggccggctgaaggcggtgtgtggcggtagtggctcggcctcgcgatgggaaggtggttccggcggtggaggagggagatggagtggatgccggggtgcggtggggtggtgtgatgctataggtggtggcggcgcagcgcggcagcgacgggagcggcggtggcgggcggctggagatcgccggcgagcggcggcgatggggatcggcgtggagagctcggtagagggcgtggga

SEQ ID NO: 69887 - DNA, 732 bp, Oryza sativa
ttgaatgaaaaaggttcccaataattatctcccttgtacttgtaaaaacctcagttatgcttgaaatatgttaattccagactaaatattctcgttaccattggttcaagaattaagtggatcaaccataatacttcagggggttaattcaaccttttcctatacttttcgtggttgactacatttgtacgaagtaccttagtacttactgcaagtatattcatataaatctcaaggaagatattgtgtgttatttttgttttgtattgataattttctgtttcagtcaaactacgttactagtgttgttaatttcgatacaatgaaacatgctttctgtttcttttgagttatgttaacaaatgtgcttttcaggagtttcaattttggatagtgatagttctggtatcactatggagcttgagttgcaatgggatggcaatccaaatatagtactggacattcaaacaacacttggaatctcacttcctgtgcaggtaactcgtaatttttgtaacatgacctaaaacaatggttatatgtaaaactgctgtacaaaatatagtgtggaaacaatttttttgttatatttatttattagtgttctgttcttttgaacatcttagatagaaaaccacattcaacttcatctcctgtttgctttatgtttaactcaattaataagacagctgtttctgatattgtttttaatagtaactaaggtactgagtg

SEQ ID NO: 69888 - DNA, 25882 bp, Oryza sativa
  unsure (1)..(25882): unsure at all n locations
cagtagtccatcacgaagggagtacctgattaacaactaacagtctaacacagtgtgctaagcaaggtttcctcaagagaagccaggagacaaactacacaccgaaagtctcgatgcgagccatgttccgagatcagaaattcagaatgggccatctgcagagcagatagatgtcctcacagaggacagagagtcaagatcttagccttgattgatttcgctttatttctactgtgaaccgtacaagatctgaggtggagctgcatcaaatactagtcatctcatatgggaaaagctgacagttggctaatcactagtactcctccaataacaaatcaccatgggtgattgacaaaaaggtgttctagaagatcatcccaagtaaagatgttctagaaggcggtgcagaataacacactatcaggctctatgattgctcacaagtcaactgctcttttccaatactaataactagccgaattgatccaaaaccaagttgcatctcctatccagtagacacgtctcctatccaagtactctatcatgcccatgcatgagagcagaacaagaacagctactattatactccagtacaacacttacacagttatatgtatctatccaaatggtcgatgtatttgagtatttctaactgtttgtcaacgatgacagaattgcacacctagcaattaactagccacacacactaacatattaaaggctacagcttggaaacatctagcgaggtgggccccactgataattgacagcgtcgataccttacaaacacgagcacgtcgacatgtacttaatcacatactgcagaatgcaacagcaccacacgacgcagcttgcaagcttaggccagattatccagcgggttattatctacttaattacacaatacaatagaagaaacagtcacttaatcttgctcgcaaacctcgattaattaaaggagaatctagaagcagagcatcaaatcagggaggtcacgagcggcacagcaaacctatcagtccacgaaagaaacagtagaaacacgacgaacagtaactacaggaccaatcaagattttatcgagaggtgccgattttttctgttcggatttcgacgaagcttataaatttgccaagggacttatattcgaaaaaaataaaataaaatttgccaatggacggtcgacacgtcatcttgcgacccggtttgcaaattgcaagtccgagtcgacctgtgtgttaactgcatcgagacactgttcaggtgggtcccactacgacgtagccccacatgacagtggggcgatatttatgaggctgaccaaacggcttgtactcgtttgtacttttccaccgacgtgccacgcaaagaaaaagaaatacaaagaaaaaaaatactactactcctttttttttcccggaataatacgaggagaaatttacccaaggggggggggggtaaaaaggtggagaaagttaaccatgatgggggtggggtgattaattaacggagaattggagaatacctggaccatggcgaggacgcaggggggctcgccggaggcggcgaaggggacgaggaggcggcgggcctcgggggagggctcgaagtcggtgaacatctcgtcgccggtgaagtcggccctggcgacgacaaacagcgccccctcgccgttgcagtcgatctcgagccggccgccgggccccgccgccagccgccccgccagcgggtagaacggcaccagcgccctcgccagcgcctcccgcagcctctccggtgcgaagaacccctccgcctccgcctccgcccccgcatccgccggcggcggcgagggcgcggggtagtagtagaccagcggggtgtgcgtcttgggcacggcgaggtcgaggttggagagccacagcgcgtgctgcggcgtcgcctcgctcggcgccaccagcgtcgtctccaccacctccaccttcatctcgccctctctacctctctgtgtgtgtgtggatgccttgcttgtgacagcggcttgggtgtgaatttctgtgtgtgcagagaagggagaaagggcgtgagggggtttataggcggaaaggaaaggtggagcaggattaatgcgatgggaataacgtttattttttttattactactatattattgtttcttttgggagacaagattaattctgctaggtgatgactgtcacaactgtccaatttggacagaaactttaataccgaaaagcagcttcttgtacaagtttttcttatgaatatttttatattataagttgctcttaatcgatcaaatttgtagaaaaaatagcaacatatataataccaaattaattatattaaatacaatattgaacatatttgttttatattaaaatgttgttatattttcttataaacttgattaaacttaaaaaattttgactagaaaaaaatcatagtgacttgtaatatgaaatagagggagtactgtgtactgttaagcattaaaatctggttgaaaaaactgaataacgacagaaccaaagatctaattatcaataaaggtgtattgatacaccgagagttggcaaatggatggattttttttttcgattccgtttgtatgaaagtttggctgtgggaagtgggatttgggaacatgagaatattagagtcttggttttatctctcccaccatcccataggttatttttttcgtcctataaaaaataaaaccagtacgaaaatataatatattctaataatatgattttgtgtcgcattttgtttcgtggtattagaatatatcacatcttatacaaggattatttttatgggatatagagtattttaattgccaagcgtcctaataatattgcaatataaaggatttgtggtgagtcgacatataaagatataagagtagcattcaagtttgaaacttcgaaatttaggaaaaatgttatcatccacaaccaaataatatgaaaaaaaatgttttgggggttttctagacaaaaccattatccaaatctcctttgaagatataggtggtgtttgtagtgtttcacgtaaaataaggtggtaataacatgtgattaattaagttttaattattacaaacttaaaaaatgattaatctgatattttggaacaactttcatataaaaagtttttgcacgaaacataccgtttagtagtttgaaaagcgtgccacgaaaatccaaattttcatccacttcttacagaagaaacgaacgggaccatagaagtctttaaaatttcaatactccttccaccctcacatgcttcgatgttatttttatttcagaaagtttgtcgacaaacaactttattacaactaattttcgttgcaatttcgtactttcaaacttgttttgtgccttcaattttcaacacaaattgtcttatatatcacacattcgtttctatgtgacattacatgcttttttttagataatggaatagagcatcccggcctttgctcaaaaagttatagccaattattacaatctcacactcaaaatgagtgaagttcaaggaaacttaaaagacgaaaccaaccatcaagaagaaacaaactaaagattgccaacccaagataaagagtacacaatttattgaattctgtttgtgaatctccattcaaaattgacaaaaaattgcataaccgttgtctcaagaatacgacatgcagcttttaaaagctcactatcttcctcacacttttgtagttgtgcccaagaccggagccaatgtgttggcctgaaaactacctgcatgtatgaaataaatggtgacttgttaaaaatgacatcattcctactcaaccatagagcgcaacatataacagatgctcctatgaaaataagttttcttttttttttcacccctagaagccaattatcaaaaatatgtgatataccatgaggaaggtaaagaacaaaagaaaactgaactgctctccataaaaacttttcataatgatactccacaaatagatgttgaatagtctcatttttcatacagaaacaacatctcaagctaccattccaatttctcgtggccaaattatctttagctaatacaacccctttaagcaagtaccacataaaaattttaattttaagaggcatccaaagtttccaaataatcttgtttatctcaatataaccattgtttattaaggctaaatacatcgaccgaacagtaaattgaccattttgatgataattccatcgaaaacaatcattcagttgactcaactgaatatgcacaatagaagcacacaagttataccaatttgctaaattctgatcaaccaaagctcttctaaaagaaatattcagcggaacagatctcataacattaataattgaagaattcttccttcgaacaatggcatatagagacggacacttgtctttaaaagccacgttacctatccatttatcttcccaaaatctagtttgttcctcattattaacaatccagaaacccatatttaagaaagtatttttaactttaatgagacctgaccagaaatgagaatcccttgtttcatatcaacttgagttatagaacgattagagagatacttctttttcaataagtcctgctaaaccccttgcttatttattaacttgaacaatcatttactcaaaagacatttattttggatctccttttgtaacgttacatgctatgactcgaaaatcttagaaagctcatcaacaagcaagcgtagccgattttcattatagttttaactttatttacttgtttcattccttcatctttccacgcaaattgtcattttctatcacacatggacaaccatccatactaaccttattttgcaatacttccatgaacaacaagatgaagctaaggacgttatagagtggcaaaggagtccatgtaagttgccttttaggcatctcgacaagttttcttcttgccactagtgcatgatcatgattgcacattgcgccaagtcaatcttttagtgtagcgccccacattgatgtccttccacataataaaagtatgttaatcgcaagctaattgtgttcatttgtgcttgtagcctctgtcaaaaattttcatgacttcattgagggccggtcgagtacatacccttaaaaaaataaagtgcacaagcagtccttaaatttgtaggatgtgtcatctaagtctataaactctcaaaatacatatccaagtctcagaacttatcaaagtgtgttatcaaggtcctaaattgtcacatctcatccaggatcctacatgacgctgatttggtatgccacacagatgtgacgtggcatcaccttgactgaaaaatggaactcacttaattttttttctttttttttcttctctttttcttctacttctgtttttcttctcctccttttttttttcttctcctttctatgtgactcgagatgtggcggtggcttagagttacagtgagaggaaggagaagaaaggaaaaaaaaagagatgaaaaaaaaaaagaaaaggagaaggaaacaatgaaaaggaaaaaaattttaagtgggttccatttatcagttaaaattatgtcacgtcacacctgtgtgacatgtcacatcagcgccatgtaggattctacaagagttgtggcgatacatcctacaagtttaaagaccgctcatgcactttataaaaaaataaatttaataatgttgtcacgagttcattttcctcttcacatagaccaaagtacgaaactacattgtcatggagcatccaacacaatatcatcgtttatcttcatacgaatgcatctgttatatctctatgaaccaacactactttcggccttgtcacacagtcctcccgtcacatagccgtccatctctcacccctgatgacaacagccgtagcgtgcatcacgttctcaacataaggaagaagacgacacatagaaccaaacaaagcataaagaaaagcatttttagagagtgccaacagacagctgattacgcaccgatagaaaacttgaaaacggatggtattttttccaaatctttttcacgttagcaatagcagctttttaacacgtctgcatcgggatggtattttttggctacaattgcgaaaggtgctagtaaaaaatgacttgtcggaccacattattcaacaaagattaattatgcagtaatcaattagcctttcgctgtactactactcgctgatcacgtgcattatttactggccccaacacagggaatgtttaatcctgcatcggcgcttaattgccgggcgcccgttgaaatttgcagcctcgacgccgatggtttaaattttgcatttaaatttaaactacacccgggaaacttgtctcctgtctcgattgatcagcaccagtacctttcgtggtttgtactagctaatcttcttttcatctgcggtttccttttcatgtcccggttttttctccgttcctatccttgcgtgaggtaaggatatgcatgcggacgtgtttcgccgcttggttaattgcagcaatcgagtatcttttttctttttttttttgaacgacttgacgatgccgccaatttcatttaatagtggagacgaaaactgtaaaaaaagataaaagtatagaaaacaaaagcaatcgagtttcttgagagctgacgtgtcctgtttagacttaggtcatgcatgagatagataaaattgatggattatcttacttattatatctatgtcaaagtgtaaacgagtgatttataaaaaggttacttttagaacagtattccaagacatatagaaattgttttttttaaagaaaggaaccgcttagaaagcgtgcaaactaaaatctataaaatctagagtcataaaacaaatactagaagtttagttcacatggttaaattaagttgggtacggaatgaaaacatagttaatcttaaattttaaaaactttaaattaatttaaggcatttttgtcgttttcatcgtgtaaccatagcatatgtcttaaatcgtctaaagtgaaagtgcaaaagaaaaaaaaaatcttatttaaaagatttaataaattattttttattaaagcagtgttgatcctccctccgtcctattttgactttttgcttgcactgtttcaccatccgtcttattaaaaaaattttgaaattattatttattttttttacttactttattatcaaaagtattgtaagcacaacttttcatttttatatttgtacaatttttttaaataagacgagtgatcaaacagtgcaaacaaaatttcaaaatcccttatagtatactccagatggagtatattataagccctagaaaaaacaaacaaacaaatcactacgtttttggcgaagttttggcgtggttaattacaatatcaaggtgtggttttgttctttctcctcagttcattgatctgccatgcttgcttttattgcctggtttgtgccggtctccgtcgtccggcccatgcatcctggattaattcccggtcgacagaattgtgaagttgatacagtataactaatacagtattcactactagaaaggtagggtctttttttaggcgaacataacccttgaagccaaatgaccgcctacaaaaatataaattagggtgattttcacaggcggaccacttaagcagcgtcagcgaaaatctattttcacagatgaaccttatgtggtccgcctgtaaaaatcgtacctattctaaaaaaaatctcaagtacttatcttcttctccaccccctccccaccactcatttccctctctcaactctctctctctctccctcaacacttctccctccaccggctgggccatccccctcccctcccctcccctccctcactccaccggcggcgcggacgtagcggcggcggcagcgtggacggctcccctcccctcccagatccggccggagggaggcctggggagggcggcgccggtggctcccctcccctcccctcccagatccggccgagggaggtcggcggcggcgaggcacgtggcggtggcagtggcggcgaggcgtgtcccgcaatttttttcgttcattggattttcataggcgggctgttgccccgactattttcgtagttgttggtttgtaggcggtccttcccctatctgaaaagattacttttggccatctgcaaaaatgatttttctagtagtgattaactcaacttaaatccggtcttaatctagagctatcaaagtacattgcaagtagtagtgtgtactatatcgacaccggcgggttctattgcaatactataaaacacggatacttagcgtgcttgacttgtaatattcgacatcatcgaattgcagaaatattagtgctcaattcaactttacacagtataagtactacgtaaaatatgactcacaaggatatatgttcaataataattgaataatctactctctggagttatatgccagtgcgtacaaatcaaattaaagaagcacaacaagcaactagaacggcagccacaggtttgaaattgtcttcggtcagaactaagctagtgctcatagaaccaagctaattaaacattttcatccatctatcaatggtgccattatattcttgctttcgtgccagtgtttgcagtcatccattcgtcgcaggatcggtatcaatatctttaatcaatctgggtaatgttaattgaagcttattaaattgctaaccgatcggtgtagcctttattaatctgttagtggatgtccatcatgctatggcacatattcatcgtctatccaattggtcactgaattgttatttaattagtgaattctttctgaacttttttaggtaaggaagattcttgcttaaccactgtaattagtactctgttttgtttagtgaattgatgtacagataggttatctgctgatctttgatttttggaaattttctgttcatgtatacttggtacatcctccctatgtccatatcatcctctctcgatttcagaatatatcaatccagaatcgaatgagatatatcatagtattgtacaaatctagatacgatatctgtctatattcgtagcactacgatacatcccattcgatgttaggttattacaatatattataagacaaaagaagtatataaaagtgagattttaaaggagtttgaaatgtgcactgccactcttggtactagtctaggtctggtacactctactatacgatagtttctggtcaatggtcatgtgctcgagctcgtcgtaaatctgcatcactcaaaagataaacctgccccttccgtacaagcatacctggaacactgatttgtttagattcgtgatagaagtaaacaactgagccgtatcatctaaagttcaatgtcctcgtgttcaatccccgtgttttactcaaactgcaggtgtttctttgtgtacgcagtctcgcctctcgcgctgacggacggagaccgcaaatggtcatgaaaacttgcgagagaacgcgacgtttttctgagcacgtcgccttcgccgcctcaccgggtatacggccgaacccgcgggacacggccggccaaggcggtgcctcctctgatttcctcgccgcgtgacgtcgcagccgccgtgcgccgtgcgcggcgtggctggaaaaagaaaaatcagcgatcgatatgcacaaagtcagcgatcgatatgcacgataaatcggtaatcgagtagttatcgctaaaaaaagggaacagatttcacaaagtaaaaaacttatattcctacaggcccaaaattgcatggatgaaagttcaaagcagaaaattttggccgataacaacgcgaattttgtccatggcctgacgatttatattgacaaataggaagcacatggttcgaacttcgaactttggttgataaaaaagatgatgaacggtcggtgttatgccaaataaaaagatgaatatagcttaactggttaagttaagtttctagtgctaaaatatatccatcccggttttaattctatgttcacacgtgccctcgtatttacgtataatatatcttttttttaaaaaggaacttttcttcatcgatctaaagatatattagtcaagtatcataaaatttatgaaaagtgaaaatttaataaattgtattggttgtatcctagtctttattggttgagtcttaggccctgtttagatcccaccctaaaatttttcaccctgtcacattgaacgtttgaacacctgtataaatattaaatataggctaaaaaataactaattgcacggattgcgactaatttgcgagacgaatattttaagcctaattactctatgatttgacaatgtggtgctacattaaatatttactaatgatagattaattagaattaataaatttgtctcgcggtttactggcggattctgtaattagttttttttattagtactcaaacacccccatatgacaccctatataatacccgatgtaacacgtcaaaactttacacccctggatctaaacacccccttagttctttcaaatgcctagctccaccactatttacattccatttcctcgtttcaatgtggcttaatatgtaggggtgaaaacggagcggatttggacggacagtggtcataccatattctaaaccatattttttaagcggattcggagcgggtgtggatagtgtacggatgcggatgcggagcagattgtttcggatgtcagaaatggtgtggagttagtgcggaatcggttcggaaacggattaaatttatcggatgttacgtgtgtacgcaatcaatacaacatcgagttagcaatgcaaggaacaataatacaataatcaataaacgactcatcgtaataattatatgcttaggtgttaaacaacataaatacataatgtccataatataaaaaatacaactacacaagtgtgaaatgagacgatgaaagcttcatactaaaaaaatctaggttaattgatgaattaggccattggatggaccaacttatgttatattctatagataaagtggttacatgtgttgataatttcggattatccgacaaacagcctatcggataatctgatagaaatgtcagataatccgcatctgctggattttagatataccatattctcatctgcatccgcatcatatatactatccacatccgcatccgtatccgccgaatttcttaaaaacctataccatatccttatttcagactgattcagagcggatcagatcggatcggataatatccgatctgttttcacccctattaatatgtactcttatcaagagcaagtttaatatttatggtgtaatataactttacgagtgagcccgtaaatagtggattgttgttaaaactattatgaggaatattaaaaaagctcggatcggataatatccgatctgttttcacccctagtaatatgtactcttatcaagagcaagtttaatatttatggtgtaatataactttacgagtgagcccataaatagtggattgttgttaaaacaattatggggaatattaaaaaacctgccttgtgaataaaaaattttcagatttaactacattataattatattataacttttttttagaattacacagtacaacgcagacactcacaacgcacgcgcactcgcctagaaaattcgctcccacccaagaccttaggtgctaaggaggctcttgtaaccaatagactacatgccctttcgctataagttacataaaaactatggtttagttagctaacatcgggatcttacgcaggacatatgtgaaaatttcttttattttttccttcatgccaaatctaaaagtttttggagcaaaaatcttacgaaagttttctaacaattccgttcccattacaatatagttagaatttaacatgagatgaaaaaaaaatgcttcaattcttatttatataagacgcaccctaagctagtgctattcccaagaatacatatggctcattagtaatgcaattagtcttcagggtttttttttttcatactttgtggttgctctcaacgaatttgggaacccaatttgctcggcctagaccggacgtacgtggcggccggggtgtgtcaggcggcgatcgaacgcatgcacgcgtacgtgcaaacagcacagcggtgcggctcaccgtgcatcgacgtggagacttgtggacgcctcctgtcaactgccactgccaatcatcgccccaaagccgtggaagcggcgcgcggctcacgcgacgtgccgacgccccacacgacgcctccccccaccggaggacgtacggctgcgaggctcacgtgacgccgcgcgcgcgcggccggtccgccccgttggtttggttggttggttggttggttggtggagtcgtggagagagctggagatgcatgcatggccggatgggggtgacggcctgacgggcgaacgctggctggctgaacgagccacactgaacacaagtcactgccctgaacacccgtcactgttgatcacaatgtgacatatatactgatctctgatgctactcttaacattgacattttccctactaacgtgtctatggttcttaccattgcttatatcattaataatggttcctccaaagcaactttaaacatcctgatcacaatgtggcatatctggaaagctagaaatgatcaaaaaatttcggggggaaacaaggagccgactcaggtatacaaggcggctgaagcaatgagcaaaacatacacgaatctttcttctcatactttgttgcatgtagatcaaaacgaggagacaatcagaagatttgataaatcacctaatgcatggtccccgatgttatactgatgctacctggaacaatggccaaacaggacttggaattttcttccatataccaaccactcataatgctatcttcattaaagccacaaccttagtggcccaatctcctttgcatgctgaattgatggctcttcaacttgctatggaacttgtcaaacttcttaacattcttgcaaaaaaaaaggaactttgaagaagaaccagggcactggagtctaagaccaatatggagtcaaatctgttcaagaattccagaatgtcttttgcaggttagctgaatcccaagggagataaacaagtcagcagataggttagctaaagaagcaaaatccaagcagccttctgctcctgttttcatttgtcaaaacatatctcatctagcctatcgttatgcaaactctgtcagagacaacatcagtctcagaaaatttgtaatctagcatgttctatgcttctaagttggaataaagtgctctttagttttctttttttaaaaaaaaaaatcatgtcgcccagtacgcggggacgtggagacttgtggacgcttcgtgccattgccaagcgcaaatggtccgtcgatggatggagatgggtgaagccgtgaaggggtgaacactgacaagtgacagctcgaagaccgcccttgctaggctaaatccgtcgcttaggctgaatccgacgctgaaatatcttgaattgagtgttcttgaagtactagtgcagggccaatggattgaggcccatgcttcaagtccaacgccgcgaatcgcatatcggcatcagtatcgtcaaattaaggaaaaagtacaccgaaggtccctcaacttgtcattgagctataaaatcatcccccaaccgtaaacgcatcccccaacttacaaaaccagttttatccgacgtggcggctgagtcagcgtggaacccacgtctcaggataccatgtcgacaggccagcctctcccttcctctcctttcctcctctctctcacacacacacacactcttctctctagactgggcaggccggccagcggtagggaggaggtcgctggggcaaggaggtccgacggccggccggcgacgcggcggcggagacacgggagaaggggagggtagcggcagggcgaggcggcatcggcgggcgagcacggtggcggagaggcggcggtggttgcgacgtgggaggggaggctgccgccgacccagaagcggaagccgaaggcgatggcgtggcgagcgtggaggcagaggaaggccatggtgacagacgccacgtgcgcgaacaccctcgcggcggcgcaacacggcaaagagcttcctggggcagcgaggtcgacgatggcggccgcccacagcgacgtctccgttagacatggcaacgggaaattccccgtcggagattacaccaccagacccgcctccgcggacgagaatttcccccatcaccatcagcgtgaaatgcaacggggcaacatctttcaccatcaccttctccgtgcgggtaatttatccccgtggagcctccatccccgcgagccttcatcctcggcgtcctcggtgccgccgagagaccgagacgagcggcgccgggacttggcggcgtgatggccttgcgcgagcgtgggcgcagcgagcggcagccttgcgtggatgacggcggcgctaggacctgctgaggcggcgcggcggccctgcgcggacgacggcggcggctggacctggcggcgcagcggccctgcgcgggcgcgggcgcggcggcatggggacctgctgcggtggcgccggaccctggcggcgcaacggccctgcgcggacgacggcagcgtcgggacctgctgcggtggccctgcgtgggctctggcgcgccgctagctacctatgacggcgtggggattggggacggaagggataagggattggaatggctagggttttgtaaatgctttatatactctatattttgggcctggtttttatgggccagatgggccaaatatacataataatactacatatacactattatgtcgggcctccacggagagcggggacgggggacggttaaccaaacccgcctccaccagacccaatggagggtgtttttgctccatttaatcctccgtggagacatattttataccaccctcgcctcataataggaggattcaccgtggagaatcggaggacgggaaccattgccatctctagtcctcatggaggcggtgatggccgacgcgtggaggaagcggggcggagcccgagatgtctggatcgcgaaggatggccggtacgccggtcggtgatgggcgcaagcacccggctttagcggcgaggccctccaggttgggtgccgagggcgatgacgacgtccagtgcggcgtccagcggccaccacgctcgcccacgccgtcgccttcggcttccacttctgggtcggcgccggcctcccctcccgcgtcgcaaccgccgccgcctcttcgccaccgcgctcgctcgccgacgccgcctcgctcagtctagagagaagaatgagagagagagagaggaggaaaggagaggaagggagaggctagcctattgacgtggcatcctgacatgtggggcccgcgtgggtcccatgttgactcagccatcatgtcggacaaaaccagggtcagaaccgtcgaaggacctagtttgcactggttttgtaagttcgggggtacgttgtatccggttttgtggttgggggatgatttagtaactcgaggacaagttgagggaccttcggtgtactttttccttccagcaaaccacgccaacagcccaacagtccatgaggcaacaaccgcgcgccgtggtggttggcccgacccaccgagcagaacacgatcgcggcgcccaaccccacgcatgctcccgcccccgcgacggcttgggttgggtggcggctaggggtgaaaacggtacggaaatttccgagaattccggctaccgttttcggtttgcaccgaccgtttcaatcggtatcggtaattgtcggtatcggaaatggaaacggtaatctttttcggaaatggtagcggaaatgatatggggttttttccgaccgttttgtcggtaaccgttttttatcggtaatttccgtcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctggggcaccgccgcgccgtgttgggcgccgccaccaggtcgccgacgccggccgcaacctccttcgccccgacggcctccgtcgcagccggccacctttccctcccccatgctccaccgccggcttccgtgccaccgagccaagcgccgagcgccgcggcaccggcccagcctcctcctccccaccgatgccgcccctttctcctctctccttcccccaccgccggcctgcgccaggccgccatctccggcgcttctctcctctcgggcgcgcgtgaaggagccaaaggcagagaagagaacaagagagaaaacagagaagaaatcgagagagcaggaaaaggacccgagagaagggaggataagagagagagaaaataaaagaaagagaggaaaagaaaggctgtgggatccaccggcgggccccaccatcttgactcctctctgtgatcgacctggaaataccaaaaagtctagtttagcatgaaacttaattacaacggtagttatacagtgtcaacataaaagttcttatgcaatgtgccactgtaggacgacgatatagctatgtcaattgatgatgaaataatgaatgatatttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttgtcaatcttattgtcaacttattaatcatcatataacggtgttgtgtggcagcataatgatgcaagggtgaaattataaggttatcttcatacatagttaaatgcgggatgataccacagttcgctgtttccgacatgaattttcgacttccgtccgatatcggtatattcccgttccgacggttccgtttccgagataccgatataaccgatatccttaccgtttccgagtatacgttccgattccattttcgagaaaataaaatgaaaatggaaatggtagagggtttttccgaccgtttccgaccgttttcatccctagcggcggctgcttcggcctgcgcctgcctctcggctcgatctccggccgtcgcgagcgagtgttggctggccgctttgcgtgaccggcccaggctcccagcgatagctccagtaagagcaggtttaatagtacagctataatagctggcggtaaaaatgcttatctcagcaaaaaattgagcctgaatgtacaatagctagctattgagttggtaaacacgagtccctataaatcactttataattttctactctaatttgtgtccctacccgtccttctatcctctctacgcagtgcattgggaggtgtataacaagggctgttgcagccaacatcgatggaaaggttggctgcaatgcctcgtttcgtgtgtgtagccaggcgacaggattagcgcccgttcctttctctctcatcgtttctcacccttccagctcagattatgttgacgtggatgagtataccgcctgctgactggactttattgtatgtaacaggcaaagcagcttttacaccttttagcgggctcccggcgcaagaacggcgtgtcgctcgaggacaaccccgcgggcgggctgattctagaatcgtttcgctcttggttttgaggcttatctggctcttagctaaataaactcaatcatatactctcttcgtccaaaaaaaaaactcaacctaaaaacgaatgtgacccctcaatctaggagggaatatctaggaggggttacattctcttttagattaagttttttttggacggagggagtaagtaaatatttcgagtcaacaaaaaaaacttgctatcattcgtttggtttgcaacgaaattttgtctttgcctaattatttggtttaatttcggcataacctatgggtacaaatttagaggcaattcaaagaagctcatttgtcaaaactttagcaatggctagcagatcaccggatccattccctatcacttccacatcaatagagacatgaaaagatgtataaaaccatgtccatttgtttgctatcaagaacattacataagtaaacaatgtacatagatatatggtgggttttctctttattatcgatctattctcgagtaaaagcaatcatcaatgtctcacccttcagttgtatattcaaaaaatttacgtaattatcatttattttttttagttgttccaaataagccgtgacccttgagtcatgttgctaagcagctgatatcacaggtaggatcctatagggactggttttttaagcataacaaagatatttaaatttagattttaaatttgaattcttgtcaaatttcgcacatcaccagtcgcaggaacccatctctcctatccactcctctgttcccctcgccctctcttcccttgcgtattctaggaaatagattctaatccctcaagatctttttcttccaaattcaatgcaaacaatcataattttgtttttaaaataatgataatgtgaaatagtgacatctagcactaaggctgcattcgtttgtttgtgttctcctctcctctcctctgttttccgtgtgcacacgctttttcaaattgctaaacagtgtaatttttttaaaaatttctatagaaaagttgctttaagaaattatattaatctattttcaagttagttttagttaatacttaattaattatgtgctaatgagctggtccgttttccgtgtcgaagagggaaagttccctagcaacactaatgaaagcagcctaaattaagttcaaattcaacctgcacattaagaaaaaaacaaattcgggtatgaatagtaccactactattcatctttcgtattaatttttcttttttatatctcaactagttgggtggcccgcgcaattacacgactagcacccacacaaaattatcgtttttacacatggttttctttaaaatttgttaaatagtcatcatgttgtctcatgattttaaaagatcggatattattgccaccgtgtttttaattttatagtttttaaaattcacaccagtcttcaccccttactccttcgccatcatctattcttactcgacatgctacaacttttattcatccccctctacagtttttactgttcgttgtctcgtcaggtctagttttatagatttagaagttccatcaaaacgtcagcactatactcctctatgcacacccgctgacctcctttattgtcattaggattttaaatcaaatagtattgcagttaattcgttttaacttagttctgtcaaccatcagaaccgtgcttcttcacaccttgctgatcgcctcttctcctaattgtcatttggattctaaaaatcaaacctaatcattatttaggggttttggtttatggttttcacatatcccagtaaccgccaccaccctaccttcacagttgtctgctatccctctcctatttaatgtcatttgtctatgtcgtgtttaatgtatcatgttctttcaaaatttcttatttcttattctatctgttttatttataagctgtattcctacttaagcacttatttttattttactaattttgcaatttattttttattcatatttttagttaatcccatgttgtattctatataaactgttctttcaatatttatttttatgtcaaattttagctatttctaaatcgtgttcttactcaaattctcattcttatttttctatttcagaattcttttattgtttatttgaattgtaattgatttcttattgtgttgtacatgtactttcaacagtgattttagttatttataaattgtatttctacttgaaactcttttttataatttcaaaattcattcttttttctttcgaaatttacttaatctcgtattgtgttctacatgaactattgcttcaatattacttattttattccgaatttgaattatatctacattgtatttctacgtgaactcttttttttctaatttcagaatttattttatttttattctgaattttaattaatctctaattgtgttcttcctttactcttctttacatatttattattttttattctgaatttcagttatttctaatttgtatacttgtttgaactctttttttctttttcttcgtttaacatgggaatttgtagcatccatagtgaacgtggtgtctacttctaatgttgttttaataatatgatagatttgacagaatgactcgcacaattacgtggctagcatggatacaaatttacattatatgcaaaattatatatatctttttctacatataatcatctttatagtttaatttgcaaagtttacccaccaccgtcttcatgctcttgtgtcatcactctagttgcttgcccgtcgccacttctattcttgtccttgggaaaaaaaacccaaacatttgtgtttttaaagttgaatcttaatgttgtggaggctatatttttatagctttctaaaagttcctgtagccgccaatttctttccttcactttgatctatggcatgaccgtagccgccagtgtcattacacgaccaagccgcccagggagttcccggcaaacagcccgcaaaaaccaaccataagcaataaatacaaccgcctatgtcagcgacattgggctatgctatcagcttaatgttttcaccgttagtttctgtttagatagaatcaaatgtcgaacctgatttcttttatgttatttacttttccttctgtattcgaccatgatttattcatcaaataatccgcttatatatattagcactaccacaacttcgatacattttcaaatatacgtatcaaatatctcggctatatataatatagacccacttgatccaacggtacagatatttttgtttttcaccaattaacaattcctaagactatacggatcaagcaatgtggtgcatttttttagctatttttattggatattatttatcgatttcatattttggaaatacgaaaggtggcttgacgtgtgaaaaatcgggaacatagatttttctttaaacaacaataaaatagataacatatttgattaaatggcaataaaaatttatttttgttcttgtatatttaacttgcctttttctgttgtcatttacgttcatgtatttaattgcctttttctcagtatatgcatgatggccaacagtctataatcaccattccaagtacacgttggagagtgccgcgccagctagtttgtttgcctgttcgtatgcatcgagcagaatcttttgcttttatttttcattaataggatgtatgtttctgatcctctacgtgaatcctagagagtcatagacaaacagacatactactgatccgtttcagcaagtactcttgatcattttcgaattggagtttgattctgacacactatgtacctaattttgcacacgcgcagcagaattgtattatgtcaacaactctaatatctgttatagtccaatcaatctgcaccgctataatctaaacctgttgtgatccatcggtgtggatatttatttttttctcagattaacgtgggaatttctagtctccacagcgaacgcggtgcctcctttcaaggttgttttgataatataactagctaggtggcctgcgcaattgcgcggctagcacccatacaaaattatctattttgtaatatggttttacttaaaatttattaaatagctatcttattgacttaagacattaaaagacaaaacattatcatccttttgcttctaattttgtagtttttaaaagtgatatcagctgctacaccttactttgtcacgtcttctttgtctgcttgctcgatccaccactgtttctatttattctttctttttagaacatttaaaaatcggaccttatagtttttaaagtttatttctcattggttacatttttataaattttagaagtctcatcgaacgttgtcactatactcctctatgacccgtccgctgcctcatctctttattgtctttgagattttaaaaatcgaacaaaattattgttgggttcattttttactttctagaagtcccgccaaaccttcagcggttgtgccattgtactcctctagagctcgtccgctgcctcccctcgttattgtctttgagattttaatatcaaacatgattatcattggggtttattttttactttttagaagtcccgataaccgtcgtgaacatgttgcttaacggcatgtccgttgtctctccttttaatcatcatcgagattctacttaggattttgttaatatttttagatatctcatcaaccgtcaacactcaactgctttacaggtctcatcgaactgtcggcagcttcgttattatactcctctacgggccgcctgttgcctcccctctttttttttttgagatttaaaaactaaacatgattgtaattagggtttattttttttactttctagaagtcccaccaaccgtcgtgactatgctgcttaacggcatgctcgtcgttcctcatcttaatcgttattgggattctatttaaagttttgtttatagttcttagatgtcccatcaattagcaccactctagttctttacgagcatattgtcttccctctttattgtcatttgtcatcattgttctagaaattccatatttttcattccgatggtttttttataaacgatattcctacttgaactcttttaattacttttttgtttttggaatttattttatttgttattccgaatattagtatctgttcatatgttcttagatggtctcttatttccatagtctttattttttattacgaattttatttttattacgaattttagttatttatagattgtattcctagttgaactcttcgttttctttttctaattttagtaatttttttctaactctaggtggcctgcgcgattgcgcggctagcacccataaagaattatctattttttacatatgattttacttaaaaattttttaaatagctatctcattatcttaagactttgaaagttgtcatcccggtgtttttaaaagtcaggcccatcaataccccttagttctttgtcaccgctttatttgcttgctcgatctaccactgcttttattcattctccttgaaacctttaaaattttgaccacgtggtttttagtgtttctagttgggttttgtttttatattttttaggagtccctcaactacggttatcccattgctcttactatttattatcattaatattttaaaaatcgatcatgccagttggtgggtttcccttttataattttagaagtaacgctagccgccgttaccctattcctttgccacccctacttgccctcttaaaaatagaatttgattattgggttcaaatcatatataatttacatgacttgtgacttgtgatgcgtcactgtgtataaatacctactaaatgaaaatagctattttgagtattattttacgtggaccctttttttaagtgtatttactcctaattttgacgatttataatttgtataaagagtagcacactcctgaacgtatctaagctattattattttatttttattatgaaatttatttgctttagaattcgtattgatttgtattttaaatttaatttattcccgcattgtgtttcatttgtttttaatatgtacgatacgtacttggcggtagtaatggcggcaataatcactgtacataagttcatgtatatacatgtctatgtcttacgtcaattttaagcgctgctagggtacacaaaaagaagtgcttctatgaagaaatttattttaaccaacgctgctagggtacacttgttgagttgcctcaatcggacaataagtcctattcaaattaagctgcgttggttaggagtccaatccaagtcagatcgtatatatttctatgtttgattttataatttcggaatttattttattttttatttcaaatttaatttaatcttatattgggttcttatatagactcttcttccaatattgtttacttttaattacgaatttcagttatttttaaattatatttctatatggattctttttttctttttctttttattatttattataatgagagagtaagagataggaaattactgcatagagtccaaatgggacttctgctcacgcatgctctattattgatcatgcacctgatttgatttacggtagtatttgttgtgcccactatcttggttctactcggattgctttcccgtaaatctattaggagtatctcttatttaatttaaatttccatataaatgattgtattttatatacaactctattgatcaatctataccactataatctggatctattatgatctaacggtctattttttttcttcttttctccgattaatgtgagaatttttagcccccacagcgaacatggtgtctcctttcaaagctgtctgagtgttgtcggtgacggtgttataatagatagatagatagatgtgtgacggtgtgagtagtttatatatatgctgtatgagtgttgtcatttatttttcatacgaggggtatccccttgatggtttaaaacggtttctccatattttcatagagcaccgctacacgtactaaatttttcttactaaatttgtactaacaatcatctcaaccgtttgattcaagtagatggaagttataaaaaatctagatgcactcatagcatgacatgtcagtgttagtaaaaatttagtaagaaaaagttagtacgtatagacttttccattttcatatttccctgccatcattcctcgcaagaaaaaaaaagtgctacatctctgtaggtgcaatggtacaaatggacgcttatacaatgcgcattaaactgctaatttgtattatacatatgtatataaaatatatagatacgtatatacatgagagacttatagagggagaaacccaccgcgccctcgagagagtggttgcgtattaggcgcccccaacgtacgggcgcaagaaaacagcagcttcaatagcgtagaattgcacaatcgtcttagcaactttacatctcccttcttccaaattgcaaaaccaatatttattagaacatgagcaacactgcagctagccgagggagagaacacatcaactcccggcccaatatatagcacaccacaaggaacagagaacagcaggccggcgcaaggaggggctagccccagtaagctacagtttccatagcgacagtgatacttcgcctttaacacgaggcagatctcgcaacaacgacaggatgatcaccagccaaaatcaaaacttgcgtcctaagatgcttcagccagctgctgctgctgctgcccctcacctgcatttcacatccaggatggggacgtttcttcctccaggtcgtcactggacgcaacgacatgatatgctgcgtaccttcnnnnnnnnnnnnnnnnnnnnnnnnnnngtttcatcgtgacggtttcttcttcctcctttttccggcgatgatcagattgcatatgttcagatgccaatggaagctgaagctttcgtggcgtttttgtatatgtgtgtgtgcgctacacgatcacaacgtgtgg

SEQ ID NO: 69889 - DNA, 2555 bp, Oryza sativa
tggacatgcatgtacagcaagctctgtccagcactgctcattttttgtacaacaaaactcatatacaacagcaattggaatgaagcaccccttgacaaatgaacaccacatacatttgtgattgtaatagtcaacaatcaaatgtacatcagcaaaacgacaatgaagttcaggagattagtcaataccgaacgattgagatactacatgatttagcttttgtggcgacgcaaggaaatgaaaacaattaagcatctacaaatgtggagtgaatagaaaacttggtatgttaagccctaatcacgtatggttgtctagcgaagtggcaggctacttaattaaggccaaatttaatattatagattttcatcttagctcaaggcatggtagctaagctacatgcaggttatatcggggacaaaagtacaacctaagcatgacagtaagaccgaccgtattcagtttggaatgcaacaagttagtttagttgagtttaaattagctgaaattgctagttgcagtattgtctcgagcaaattaacaataaatgatattttagccacatgaaggactgaaaggcagtaacctttcagtgtggaatgcaacaagttagtttagttgagtttaaattagctgaaattgctagttgcagtatcgtctcgagcaagttaacaatgattgatatttagccacatgaaggactgaaaggcagtaaattatgtgtacccgcgacatgtagttatccatgagatgtatcgttgatgatcttcgacatgtgattatccgcatggtaggactcatgaaagcgcacagtcacgcaccacatgaacaccaggacataagagagaacacagtggagacagggacaccaggtcggggtgaagaacccggggcaaaataaaatgaatagttccccgtgcgatctccaccccaacaacacaaggaaaatatctttttattgtcttgtggcctgccaagcgagcgcacccaacatggcaaaggccttcctaccctaaatctagatacatcatacatagtatatagtacaacatgattatacaacatgcacatacatgtgcattagcttaccgaggtcattaccttatcttctggttgggagatatggacatacatcatctaattagcagcacatcaatcatcaaacaagaaacatcatcaccatcacgattcctagatgaaggaatgctcatggcaccattgcaaggaaggaaagcatctgtgcatagtaggaaaatcttaggagtctggctgtaggcgacattaacgaagaaatcatcgtacatggttacagctccacacccaaaagatcaattacgcacacaggccaccagttgcaaagtgagcaacacggatgaagcaaaaatctcatcatatctgcaggaacagaataacagaattagaattaggctaaaactgtgcgtgcaatagttctttctaccatgaaagaaggtatataaatctaccaatttaacagggattattcaagtcagatgagaaaaaactaacataagaaaaaggttcagaaaaataccaattttgggttcaagtcagatctagacacaactatgaggaaaaacagatctaatctataaaacctattgagacgtgataaaattcaaccaccaccaccaccaccatcctgagaaggcaaatcagatcaagaaaagccccaacacatcaggagaggtaactaccaccaccatcctgagaaggcaaatcatatcaagaaaagccccaacacatcaggagaggtaactaccaaccatagcaagatggagaagacaatattaataaggtgcggcggcttaaatcagctaaagtaacggaaatagatcctgatctatgaaatatgtatggcgcataaaaacaaaacaggacgaaaactgaaaatcaaaatctactccatcccaaaacaaacgtaatttaatcttccaatgtaatcaaccatcaacccatcttgtactcctatactaaacgttactccctccgttcacatgtaagactttttagcattgctcacatacatatatatgttaatgaatctaaacacatatgtctagattcattaacatctaaatgaatatgagctatgctaaaaaaatcttatattatgaaacagaggaagtagtaagaagggagcggaagaacgaacgaaccttacgaatcgaagaggaccccgaggagaaatcgtgacgagacgaagagagagaggaagaggggcgagggggaagaccatatataccggcgtggctgccctggttggcggtggaaaacaagtcggttcgtgcttgctatggaaaggacgggtcggtcatggatataccaccattgggtcttcttgcgtgtcgggtgcggtttagtgcgtggctttgctgctggccacgttacgtatacttccattgacctttgctgctcgtttacgtcatcccttgcgtcacatctaggatggatcgcctgtgcccatccagccgtatggccggatttataggtgtccaaacgggcggcacggcccggcccggcacgggcacgggtcc

SEQ ID NO: 69890 - DNA, 1480 bp, Oryza sativa
ggaaaaagaaaaagaaaaagaaaaaggaatttccctggaatttaaaattgcacttgctccattttaattggttaaaattatttctagagctctgaaaattccactaaaaatcctgttagtgaatttcgacatgtagaactcaagaaaaattccacatgtcaaatccgattattatttgcattgttttcttagggttttgtcctgatttcctctgcattttcttagggtcaattataaattacaattttgacttgggaggaaaactccggggtgtgacagctgtcgagcctttgtggcgagccttcggaatgtccgttggcccccaaggttccggcccaccatcaccgaaaaatacgacggaagcgtcaaccctgccgagtttctccagatctacacgactgggatcgaggccgccgggggtgacggggttggctaatgaacttgccacctgcgtcggtccactcttgggaggatttgtgccagcagttcactatgaacttccagggcacatatccgcgcccaggtgaagaagcggacttgcatgcggtacagcgaagggacgatgagtctcttcgctcgtacattcagcggttctgtcaagtccgcaacaccataccatgcatccccgcacacgcggtgatctacgcgttcaggggcggcgtgcggcacaaccgcatgctcgagaagatcgcctccaaggagccccagaccaccgcggagctttttcagctcgcggaccgtgtggctcgcaaggaggaggcctggacctggaactcctccggttccggtgtggcagcttcggctgcccccgggtccgccgctcggtcagggcgacgggacaggaggaggaagaagaggtcggcccattctgacgacgagggtcacgtcctcgccgtcgagggtgtttcgcgggccacccgaaaggggaggcctgcgagcgacaaaaagaaggaggccggcgctcccagcagggagcgcccaaccggcaagtggtgttccgtgcacaacacctccctccacgacctcgcggactgccgcgcggttaaaagtttggctgagtggacgaggaagtgggaggaggagaggaggcaggagcgccgtgagggcaaggccccggcggctcccgccggcaaccggcgaagtgaggccaaacagaaggcccccgccgaggacatcgacgatggccacgatggcctgggttccaggagcctgaggtcaccatcgccaccgtcgatgggggagcgtgcgctcacgtttctcgccggagcctcaaggccatgaagcgagagcttttggccgcagcccctacccatgaggcgacgcggcgggcgcggtggtcggaggttgccctcaccttcgaccagaccgatcacccgccgtgcgttgcccagggaggacagatcgcgatggtggtttcccccaccgtttgcaacgtgaagttggggcgtgtcctcatagacgggggtgcagccctcaacat

SEQ ID NO: 69891 - DNA, 4323 bp, Oryza sativa
ttttttttttaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagtttttaaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttagtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgagcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaataagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaattagcaatttcaagaaggttgtgcaaaattatattagcagttggataataaacttgtgacaaagttagagtacaatcataaaaagtttctagaaattagtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgtgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtattcccaactgcgtaccgtaccgtctgggtttaccataagttgctgctgccggagttgtattccttgcttcttggcacacgactccgcatggcgcttgaggtgacctgtaccaccagaagaacgagcaaataaaatttgcctacatattctacaacgggctttcgatacctcccttccgtcggggcatgtttcctttatctcgtcgaagttttgccacacaccggaggttctcgatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaagctaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtcagtgcgccgctggcccgctttcggcctgacgggccgccggcgaaacgggccgtgccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcctggcccgtttggccacctctagccggattcgcgcgtagctggtgggcgccgcgaagttggccttcgcaaaacgggaggcgggagacgagggttgtgtggcggcctccgaggccatcgcatcattggccaagccaccaccaactccttcccaaaatcaccccaaccccggcgccctcttcggccaccatgggagatggcctgctcttgccgtagccgagctcgctgtggccccacaacaaggaggaggtcgtgttgctggtctccgacggacgcagcatagtggcggtgacgtcccagaccccgagacctgtacctactaagctcggtcttgctcttcatcttcttcacctaccacggcgcctagaacctgcagagcaccatcaacacagtagtaaacagagtcattttctcaaaactgatctacatgcacgctagcttccatggcgtcaaatttcgattgagctagtgtaggacaagaacctggggttggtgtcacttggattgttgtacaccgcattctcggtggtgggctagccgttggtacggcagatagggtccaagcgggcgttcgtgcggcgaggagcagaaagggaagaccgggcggcggcgaccttcccaccctgcccccgctcgctgtcctcctccctcctcgcccggccgctgcgcgccgcccctcctcacccgccggccaccgcgcgccgcccctcctcactcgcgcctggagagaggacagaggagagggggagagacgaaggggagtgaggccaagaactttcagaatatgctatcgaattcgcactgcttcaggatatgccatctaattcgtgctacttttaaaatacaccatcagagacgaatttttttgttccgtgccactccgtctcttccgtccatagcgtcgtcgtctttcgtccgcccggcggcaccgtcgtcagtacgccagtccgccaccgcccgcgccgacgtttgtccgtcgccggcatcgtccatcctcgtcggcgtcgtcgtcgtcccggcgtggcgtgggcgcggagggaggcaag

SEQ ID NO: 69892 - DNA, 9288 bp, Oryza sativa
ggatcccgactcctcctggcgctggaagacccttcaactgagcattctccttcttcaggcgcgcttcctcgtccttcagagcgacgatcctcatgagcttcccatcgttcaaggccttggtcgccttgtgcaggtccgagtgcatcctatccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctcctgacgcctccaccgccatgttagcgaggcaagtccccacgtagccatggacctccaagcggacacggtaaggaagctcgccactgagcggtgggatggtcgtgtattccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcgcccatcaaaccccaactgactgacgaataaatcccaataattttactaaaaccctaaactgactcgttttgaaaaactcactttaaacgagcgaccaagatttttcccttgaaccacaagaacagatccccattttcccggaacaaaatccaattgcaaagaacatatgcaatgaaaaggattcagagggctcttaggtctttccatttggcttgtcctacggtcaaggtcggctctgataccaacttgtcacgcccagaaatttccgaatagaattccaagcagaatgtgtattaaaacccccgtccaggaccagccggggtacacaaacgacaatgttgacatacagatccacgtcttacaaacatcataaaagtcttacagaaatgcagcggaaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaatagaggtatgatgcagggatttaacaagggatagctaagcaggttcatttgcataaatgctggcatttataaacaggaatttaatgcgaaaacagttgtaataattaagcagtattaaacatccgctgtccaacgctaacccacgttgcgacaggcccaaccatccacctaaactatccaagttcaacaggttacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaaaatgggatcaacatgttcaagtgacaagcatgacttgccttgctctgctgctggaggtacctcggcgactatctcgaagtacaccggagcgtcggagggatcggaatctagcgacatacaaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaatccttaaataatttattgcgcaatattaaccagggctgacgtcagcgaggggcgcggcgccgacaggcgggtcccaccggtcagcgaccgggagagagagaaagggggcggcggctcgcgggcccaccggtcagcgaccgggagagagagaaagggggcggcggctcgcgggcccaccggtcagcgacccggggaaaaggatggggcggcggcgccacgtggcgaccggaccgacggccccgatctacccttgggtagatcggacggcggcgcgggacctcgcggccggggcgcgcgggcgcggcgcgagacggcggcgaccatggcgccggcggcgcggcgctcacacggcggcggcgcacatgcggcagcggcgcaaagcgacgaccggcggcgaccgtccggcggcggagagcggcggctagcggctctagggggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagagagggattagagagagagagatggaccatggcgatcgggatccatggccgaaggcggcggtagaggtggcgctcacccgtgcgcgtggagatgagggttccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggcgatgcttaaataggggatgggggaaccggacgtggccgggagcggcgggattcgacggccgacgtgggggagtggggaggagagagaggcgggattcggttttcgaatcccggccatctcgggcgcgggcgcgagcgggagagagaggggaacgggcgcggggaatgcggcgcacgcgcgggcgtggtcgacgtggcccggggaaggcggagacgtgggcgcggcgtcggttgcggcggtggcggcgcgagcgggatcggcgggaggagggagacgggtccgacaggtgggccccacctgtcggcgaccccgagaggagggaggcgggcggccggctactgggctgggcctcggcctgcggccggcccagcaaggaggaggggggggaaggaaaagggaaatgggccgacggcccatttcgcaaaaaggaggaaaaagaggggaaaaagaaaaagaaaaagaaaaaggaatttccctggaatttaaaattgcacttgctccattttaattggttaaaattatttctagagctctgaaaattccactaaaaatcctgttagtgaatttcgacatgtagaactcaagaaaaattccacatgtcaaatccgattattatttgcattgttttcttagggttttgtcctgatttcctctgcattttcttagggtcaattataaattacaattttgacttgggaggaaaactccggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaacctggtgaccttgtttctggtcctcctttcgctggtatcaagtatgcgaaccggcttctccacataggtcaggtcctcctggatatcgatgtgttccgaatcagcctgttcctcaggtacccttaagcacttctttaattgggatacgtggaacacgtcatggatgccgatcatgttggacggaagttctagctgataggcaacctctccccttcgttccaaaattttgtatggtcccacgaagcgtggtgccaacttgccttttgtctggaaacggtgtactccccggagcggggtgacacgaagatacacgtaatctcctgcctcaaaagtgagctcccttcggcggttatccgcgtagctcttctgtcgagactgagcaatcctcaacctttccctgatgattctgactttctcttctgcttccgctaatacttctgttccgaacagttgacgttcgcctgtctgatcccagaagagaggtgtgcggcacttccggccgtacaaagcttcaaacggtgccatctgtagactggcctggtagctgttgttgtacgagaattccgcatatggtaagcttttgtcccaagctccaccaaaatcaagagcgcaagctatcaacatatcctccaagatttgattgacacgctcggtctgaccatcagtttgcgggtgataggccgtgctgaagtttaaacgggtccccaattcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtgagtcggtccacgactacccagattgaatcatgtcccgatgatgtccggggcagtcccgttataaagtccattccaatctcctcccatttccattccgggatttgtagaggttggagtaaacctgcgggtctttggtgctctgctttcactcgctggcaaacatcgcagagtgcgacgaattcagctatttctctcctcatgctgacccaccaaaacttctctttgaggtcttgatacattttagtgctgcctggatgaatggagtactgggtctgatgagcttcggtgagtatcagatccttcaactccttgtcgtcgggtacacacaatctttctcccatccagattgtgccgtgctcatcctcgtggaaatctcgagcttttccaaccctcatgttctttttcagttccgctatttccgggtcatttacttgagctgctctgacttggtccacgagcgtaggccgtgcctccaaagcggctacaaacccgtgttcaacaattcccatgttgagatgttcaaactcatgccgcaattcctcacacatgccctcgatgcatagggcagtgcagtaacttttccggcttaaagcgtctgccaccacattggctttacccgggtggtagtgaatactcatgtcatagtctttgattagctccaaccatcttcgttgtcgaaggtttaggtccggttgggtgaagatgtatttcagacttttatggtccgtatatacttcgcagcggttgccgatcagatagtgcctccagatcttcaaagcatggaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattcttgagaagttttcgatgaaccgacggtaataaccagccagtcctagaaaacttcgaatctgcgacactgtcttcggtggggtccacttggtaactgactccacgttcgatggatcaactgctacaccctgagctgtaatgacatggcccagaaatttgacttccgtcaaccagaagtcacacttgctgaacttggcgtatagctggtgctccttcaacttctcgagtactagacggagatgttgttcatgttcttcctcggactttgaatagataagaatgtcgtcgatgaataccacaacaaacttgtccagaaattccatgaacactttgttcatcagattcatgaagaatgcgggtgcgttagtaagtccgaaggacataaccgtgcactcatatagcccgtaccgagtggtgaaggccgtcttcggaatatcctcttcccggattctcaactggtggtagcctgatcgcaggtctatcttagagaacactttagctcctttcagttgatcaaataaatcgtcgattcgcggcaacggatatttattcttgattgtgacctcgttaagtgcgcgataatcgacgcacatcctctttgtcttatcctttttctccacaaaaatgaccggagcgccccaaggtgaagtgcttggtcgaatgtaccctttctgcagctgctcatcaacttgcttcttgacctctgctaattcgttggccgccattctgtacggtctcttatagattggagcggttcctggtgccaaatcaatccggaattcaatctccctcttgggtggcatggtggtgaggtcttcggggaacacctctggatactcgcagactatgggtatgtcctccaattttctcaagttcttctcttcggcgtccactgggatttccgtctcaatctgattcaacgaggctcctttctttggcgaggctagagatttgtacaccacggtttctcctttctcattggtcagggtgactgtgcgattcgcacaatcgatgactcccttaaacttggtcagccaatccatcccaagaatgacatctaagtctttggattcgagaaggatgaggttggctagaaacggtgacctttgaatttctattgttatagaagggctgaattgaaccgaagtggagctattccctggggtatgaacccgcatcggtgtgctaagttcctctcttactaacccatgcatcccgacaaatttctttgagatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttggtccggcacgcctgggcttcgggcatttgtcagcgaagtggccaagctcgccacagttgaagcaggaccctggttttgctcccgtctccttcttggcttgcgctggctggcctgactgtgccggtgccattggtgggcgtggagctgcaccgcggttgggctggcctccatggtggttctggctgccactggtgccctgatggaagttgctagggttgaacgggcggtgctggcggacgatcatggtggtaggtccaccctgctgtccgggagtgaagcgcggtcggtgctgactaccttggttggaccggaactgcgccgcctttcttttcctgtccattttgttgcgctgatcctcctgacggattgccttgtcaaccagcctttcaaagtcagcgtagtccccagatatcagttggttggtcagctcgtcatccagacccgccatgaacttctcctgcttctcggcgtcggtgcggacatcctctggtgcatatcgcgcgaggcgattgaactcatgaaggtactctgtcacagtccggttgccctgatggagtgcacgaaattccctcttcttttgtgccacgaccccatctggcacttgtgccttcctgaagctacggcagaactctgcccatgtgacttcagtacccggtgggcgggtggccatgtggttgtcccaccaagctgacgcaggaccctgaagctggtgtgtggcgaaagcaaccttctcctgatcattgcactgcaggagattcagcttcttctctatcgcatggagccagtcatttgcctccatagggttggtggtgctggagaaggtgggtggcctgacacgtagaaactcaggcagcttggactgagggggagggggaccaaactgctcatgctgctgttcggcgtgctgcatcatcctctggtgcatctgctggtgctgctgctgcatctgctgcatcatggcggccatcatctgagtctgatgtgccataacttgggcaagggtcggattctcgggaagtggtggcggaccattgccagaatcaccgttggggtgcacaccatcagcgcgttcttcgccggtgctgccctcgcctgccgtgcggttgccagtcctggtgtagaccatctggagggaagagcggacggggaaaagaagaaaaacagatgctcaagaactaagctttattacaaaggaattaaaactgcaattgttctgatctgaattaaaaacacttaaaagggcaagcaaatatccttattaagacagccatatcataggcacatgacatcgaccgtcgactgaccccaaacaagcaacctaaacacacaaactaacaagcagagactagacaatcgataaactaatgggaaaacgagcctaatgctcggaacggctcctgcggtcggtggagtcgaaagcgtcctcctgctcgtcacctggtccctctgagcgactcctagagtctgacggatcagtctcgccgctgccactgggagtagcagacaaccaacctccggtaccgctggctgaacctctggcggctgatgctggagcgaaggagagagtgaac

SEQ ID NO: 69893 - DNA, 22499 bp, Oryza sativa
ctgggattttgtaacaatatcatggaaatccttgtaaacttcttcatcctctgaattgaatgtccttcctgttttgtcccttgcatttgataacatatggaacaggcaattcctatgaacagtgtctggaaaaactatggcaatagcagctttcattgccaagtcttgatcagttataatagtagcaggagccttgccacccatacaatcaaggaacgtattgaacaaccactgaaaagtctcacttgtttcatcttgtaggaatgcataaccaaataggcaattgtcaccatgactagttatccctacaaatggagcaaagggcaaatcatacctattggtcttgtacgtcgtgtcaaaactatgtcaccaaacatctcataaaattttctgttgttcccatcggaccaaaacagactcttcacaacattgttctcatcagttctgaatctaaaataaaacaatggatcctctgatcttttcttctcaaaaaaatccaaacactgcatcatgtcatttttcccactttctcttctaacacaatctctataattgctcatagccttttttgtgtaaggaactgtagacaagccacccctaacatatgacaaaacagacataatcgtccttgtgggcacattgattttgttcagagttcttatcaaaagtttctcctgatctgtcatatgtttgtgagaccttaggaattttctttcttctggtggagatagtggatgattgtgctctagattaagccttgtaatgtaccaaaagcccctcttcaatgttatcaccatctcagctttgcaatttgtgtaaaccactttgttctgttttctattttttactaatggatttgttgtgtttgtttgcagacaattctcaacttcatcaacctcaggcaggtccttctcctttggatcacttggtttcctccacctgttgcatttgaatgtgtgccttgtcacaatatcagttttcctactgtggtaattgctagctttgcatgtagagaaaccaaccatataagcataaccattgtagaagtcaaaagcttcattctcatcagcaaaaactttgttgattgacggcacatgtgcactgttagcttcctgaccacctctctgaacagctgttacactttcattctccagaaatatgtttatatcttcctcactaaaattttgatctggattttctgcacttttatcttgttctatttcctcaacttgctgaaatgtaactattgcatgatcagacaataaatcctcttttgttgcttgctcaaagtgctggtcaaaacaggcatcagcctcaatggtttgagtctgcatttcattataaatcacttctacagatgatgctttcaattgtactgttgacctgcacatctcagcttgattatcaacatcagcacttgatttctgcatttcatcatatagcatgtccagtgatgccacaagaggatgcacagctacactttgtggcaaagagttgcacatctgagaggtgtctgtttgtgcattttgcaggtcattttgttgataaccattgtgaggatcgaaaccccaaaagatgttgtcatactcaaatctattggatgtcaaatatagagcagtctgcaatggtaagaaaaaaaattctaataaagagacctttttataattctattttgatttgaacttttagccatattagctatatccacatcaatcatgaatatgtttttaatcaaataatgggatggcacagcacaaatcaaataaacaagagggaacacacctctgattcaataggagcttgcaatagctgcatgaaattgccacaagtgttttggagcaagggaagaccaccctgttttgcaaaaaaaaaaaaacagtgggggttatgactgtgcacataaagtttttagtttaaacattttcatttaatatgtgttttatttctactcactgccacctgagcaccaggaaaaattgcattaggtaagacagagacttgctggattaaatttgtataggtgatgcctccctcctgtgataacctataacatcccatagtcttcatttgattctatctctgtgccctgtacatttggatagatgaaaaaaaaatgacattacatcctttgtacaatgtaatggcattgcatgaacagagagctcccataattcaaagaatgaccacaagagaacaactacttgaaccagagcagttttaacagttagcgaatcaagatattctgagttgtgcactattagaaattcagtcaccctattgtgcataaggaaaagcagacactctgcacaagatttgctatagttgactgcagtattgcattacaaccacatgaaaaaatagaccagatcaatattgtgttgcttatgagcttttatataataaagttttgtgcagggaagcagcagaaaacgcagggacagtggaaagggaagaaaagcaaaaaaaaaagagagaaaggaagaagaggttaaactagagagagggaacacaaaacaaaaaaacctccatcaattaaatttcctccaagttcttcctgttctttcctcaacacacgttgttcttcagaggaggggagtggtggaaagggaagagaaagcaaataaaaatcaaaagatgggaggaagaggtgaaaaggagggaggtggaaacagagaacaaagagaaaaacctccatgaagtaaaaatttctcaggttcttcctgtcccccccccccgagcacacgttctttcttctttttcgtgttctttctctccctttctcctttttgcttttccaatctgagttttgatctctcctctcgtttttcttttggatctaagttttgatctgagtttctatcttggagcacaagacatttttttaagggaaccagggagtggaccatttttgtgacagaacccaaatcggagctaaaaggcccaaaacgggtatcatgtgagagcccatttgttttgttgaaaaaagcccaaatcacagctaaaaaactgaaaatccagactcactgaactataacccaaaaagacttgggcccataccttcgttggcccataacacagcacaaaaaactagggcccaaacattgggcttttgtaagtttttggacccaaaagtgtgttttaaccagttttgggctttgggctttttgttagtttttgggcccaaacatccgcaccagattgtgatcttttttgcacgtcacgttttgattttttgagctttaccgttagatacatatctaatggtgcataaagttgactgaccaaacgcaaaaattgcaatcgactgcagaataggcggtccctaaaaacaaatgcatgcacataaagattggatcgtggttgtatcatgtaaaattaaatgattgcttacactcaaaagtcagagtaaacatgatggagtaatatcaagttctttctcacatattcttcattgagaaaattgctcatgcatctcggttttcatgatatcctttcctgcccctgagtttctattttcatcccatctatgcctattatgttatctgaccgtgttctgaccattagatttccccaaatgactacattgcccttctcacaagtcacaagcatgttttagtaccttcatatcaaaatatagcaacatttggttatgaatctaaacacacagttatctaaatcaatagctaaaatggttatgttttaggatagaaggagcacttactttcttaaaaaaataataacttccaatgtgaaaagatttaatttagaataaaatcaagggggacaaaattatttgaccccacatttgaaaaaacaattccaaacaaatgtcaaaaacaatgaattttgtagaaaagtttcactgaggatttgaaaaccaaaactattttttacttgaatttaaattccaatgaaactattgtatgaatttcagcaagtttgatttgaaagttatttagaaatttcacttttctaatgtatgatcaaataagtctatcctttttttatatataaatgaatgtgttcaatttgagaactatatttattagtaatccctccattccataatataaggcacaactaaaaagatgtttcataatataatggcatgaattcatgctattaactagccattcttttgcactaaattattattttttaagttcttcatcctcaatagctttaattctattaggtgcatgcattatatttattaatgtgattcaaactatgaggtgataataattatttcttggtctttaggttaagagtgattaagccttatattttggaatggagggagtaataagctagcacataagcacgacaacatataatcgtttcaaaaaactagcaatcaattcaagatcaattaatggaatgagaatagaagggaccaaagtgaaaattcatgggatgtagggaatgaatcaaatttcaagggaatgcaatgatgcaaaaggagtaaaaacctaattagcagccgttcaaaaggaaaaaaaaaagatccactccacaggattaattacaaccaatactgcatctttgtactaaaaactgaaaacatattacaagttgggagctttgtaaaacatatcatggtcatgataataacataacatattatcataagctgataatctttttaaagcataccaaggttatccccatgcattaaaagaaataacataggtatgcatgcatgccataatgtgaaagctggataccttaaactagcacgactgatgattactcttctaatactagtatatccaaacacagtttcaatgctttgacatggtcatggtaaggctgataaaatatcgatcggcaggataagttaaagatgcgtgttatctggtcatacccatgcatgctgcgcatgcacacgcttgaacttgaccatacttagcttaatttctttgattaatttctccccgagaagaaatgcccggtggcttgcatctgactgacctgcctagcgcatctgatcacatttcacctctgcttaatcaattgagatcacaactgatcaggaaacatggtatagataaacagagagagaaaaagaatatcaccgtgaatcgtgatgtggtgatgctttcgctcgtacgtactgtcgtactctctgggtcagtgggtcgtacatctgccacgttgtgttattaaggccagagcccagagcggcgataattatgatggctgcctccttaatttgattgctgcgtgttaactttgctggtgcagtgcttactaagcatgaatgcatggtgtgtttttctaaaggggcacgggggtaatcatagtgccgcgcacgttgcttccgctctaatttattctccattgtccatccaaaagaccaaaaagtagtagcagtatcaagtaccttaagctgtgcgtgtgtacctcgtaacgctctacggctcatttctttttattaatacgattgacaaaatagataaatagtaaaaatacagttttatctaggagtgaaaacgttacggaaactttccggattccggacctattttcggaaacggaatctgtcggttgaaattttcgtaaacggaaacggattcagaaatattttctcggaaacagaatcgaaaatgacaatggcagtttccgtcgaaactcggaatcggtcggaaactttctggaaatttcctcagaattttcggaatttttcttggaatttccagaaatcacgaaatacattggattctttttttaagtactaaatagttaatactatggtgtttggctgttatttttttaaaaaatatttgttatacaaatctaaaattacataagaatattttttccctgcattaggatttatcaacacagcattactaatttattccatagattgtgttttatgatgtactgttgatacttaacaattggacttatatgattgtgttttacgatgaattgttgaccattgagacttgagaattgggtttatcggtttaagggggttttttttattccgataaattttcgttatcgtattcgcaccggttcgttttcgctccgttttcggtttcgataatattcgattctgttttagtatccagggtttccgattccgatttcgattccgaaaagatatatgaaaacgaaaacgataaaagattatttccgtccgtttccgtaccgtcttcacccctagttctatctaataaaaatgggtgaaacagataattgcaaaacgcaataaaaacacttgaacgatcgtttaatagacaaaaaaacaaagagagatagactaaaataattttttaagggattagagccattgccgatatttcttcaagatctatatgcattgagccaatacttaggaattcattgaatatgaaaaacaccaatctttgtttgaaaggaccatttaggaaaaatcatataaaatttaaatcctaaaaaaattcctctacaattgttttgtagtagaaaacttgtacttataagagcatatgttatatattagactttatggatgagtaggaatgatatgatttttgataaaataccatttgttttatatatgcagataattttcaaggcaacacattagctcatgtctttggcacaactacaaaggtgtgatgaagatgaccagcttttaaaggttgtatatcgtaatattgagacaacgattatgcaattatttaccaatttaggatagaggttcacaaacagaattcaataattgtgtactctttatcttgggttgatagtttttggtttgtttgttcttcatgatttgtcttttatttctataattctatttaaattaattgcactcattacgagtgttaggctataataattggttgcagctcgttgagcaaaggccgggatgttatattctattatcttaaaaaattgctttgttttaaagccagcctaaaactgagggcctgtttagatcctccaaaatggcaaaagttttgcttttctgaagcactttttactattttggatttaaatactagtagcaaaagttgacaatttgttatttgccatttgctagtccatagtagcaaattatgccaaaaagtgctttgggcactcactctttctctctctccaccaaaaagtgctagaatggcaaaagtttaggatgcatctaaacaccaactagtatttttgtaatgctaaaacttttaccaccaaaacttttgctatttaccatttaacatttgctattccaaatgaatctaaacatgctcctggaaaacgacagcgaattccaaatagcagtgggcgaggcatcacgcatgcgcagcgccataagccagtggtgagtggtgacccgatcagttattgccagtttgccactggaacgtgggaatctcccgtacaaacacacatctcaaactggcgaaatgttttcgcaacgaatagttgtctctctgtgatggacgggtgcgcgcgcgggagggtgcggcgtgtcgcgatcgggcggcgcgcgcggccaccatgtgcgccagagtgcgcgcactgatggaggcgtggggcggggaaacgtggcggttggagagacggcgaacgtggtcaccacgatggggccctcccggccggcctccccggctccggttctatggctccacgtacgtatggtgcgcgcctgcgcgggaaatagagagcctgacggagcaacggcaggcagaggcaggcatatgtgtgtcttcggttcagaaacatcaaaacatgcaggttccatataaaactaatcactgcctgtccagacttcaaaattaatataccaggttacccatagatgttctcatgttcagaatatgatatgactttggcaagataaaaaaagagagaaatagagtgatatttcgccaagttagaattctgcaactaactaaaaatacagcacttattaacaataaaaatgatttttatatataacttttatatgtgcgataaaagaaatatcataattaactttttaaattatgttttaaaatttaaaatttagtaatggctgataaaataaaaagcaaacggtggagccgatgtctcatgatcatgagaactgcgcatattgtgggctataacccgcatttgacttgaagcactcaccgtttcctcttaccatatgtatgtctcaaagttactctcttaattttgtaagtaaaattgatgttttaagacttgtcttcaaaaatactttcatataattgccagtaaagccttatttaaaaaaacaaaatacccttatattttaaaatgaagagaatttaggattataaaagtttgatcgccatcaattttggactctggagggtgtttgctttgatttggattcttcattgaatggactgttcttgaatgctattactagccgcctagcttactccatatcagacatcagtgtcttccagcgatgataaagattgaaaaggtcatcgtaaaataaaggggtctctaccctagagattaggtcagctaatgaagcctaccggcatcattgaccaggctttgttaaatcgtgttaattacttttaatttggtccaaggagatgagctaatccgggaagaactcgcctgctctccttttttcctatgttgttgcttccgttgaacaaatcagttatgaccatgaggtcccatatttctacctccaactacaagtctacaaaattccgattgccccatggaacataaatattgtttgtctgcaccctgcagagaggtactagcatgctattcattcatgtacccatgattcgacaataacatcctaaaaaattgatgtaaaatgcattgttatactcgtatgcgtttcacatttcggtaaccaagctacccctccatcccaaaatataagcatttttaggcttcgtcatcgtcttcgagatgctacttttaccaacaatatctataaaagtaagatattttaaataaaataagttacatattatggtagtttgtttaatgataaatctagtaatatcaattttatatgattgatcttttttatattttttctattaatagttaaagttaaaaacatttgactttgacactatgttgaaaatgtttatattttgggatggatggagtatagattggacaatttatatacgatggatcataaacataaccctcaaagtatttatagtgtttatatgattataaacataatatatttttcaagtttttaaactaatattgaattaatctcgcgctaatcctttgttttgtttttcgtgtcagacagcaagggtgcctccgaactcagtctaaacctgtagttaaccgcagagagacaggagtgttaattctctctgggtacgaagttgcgtgtgcacgagggaaaagcccaggaccacagcccccacctagccaggcccagctcctccaatcccctcatcgccctactgcacagcgcactggtgggggccggggtacacgcccggggtacacgtaccggatcccccgccccccgggtggtggtggggtttagtagtagtcctccatggcttaacaacaagagaagcgcgcaattagggaaaccgtttggtcttccttaattgcgccctcgcccccgcggcaaccgtccttctcctccatctccccttccacgccgctgccctcccctctcctctcccctcccgccgagaaatcggtaagtagtggactagtcgctgcgactccgcgagggttccccggctgcttgtccacgggatcccacgacccggcggcgttgcggcgaggaggaggagagcagtttgggggtctcgccgcgatcgctgaggtgaggttccacgtttacttggtgcagtagttacggtttggttggcgtggagagaagctgcggtgtgtttttgattgaatccgattgagctagggggggaaggaagagggggtttggagctcgtaggctaggacgatgtttggatggtgctccgcgcctccgccgcgtgggttttgacggggatggagcatcggcgagtccggattggcttcgtcgctgttctcggatgatcctggtgcgtggtttgggtttctcgcggcggattccgtggggaactagggtgttgcggcgtgagttctgaggaatctggcttggcatggtttctattggcttgttgccttgttcgttgtctgtatctagggagagttaattttatttaactgcgaaattactttttctccgtactttgagctgttattataggtgatttcggtgcttggggtagtaaacagtgcatttttaaattatgtgctagttaaaccaatttatggcgatcgagccgtacaaatcccctgttgtgaatcctaagagccagggaatatgcctccatctatgctatatgtggttgatttgctcttgctgggtgaattcttctagctaggattatctaatttagagcccaacaatgtaagcatcatgctgttgcctttgagtgtgatattgtttttgcgtttggttagtcgatttgatcgaagaaaattcccggcaacttcaagtgaactctgccaattttatttggcactatgtccactgttatattttttctctttgtctgtattggagcatacaaaatctcaatgcatgtgcatggttcataagtggtaatcattaaaaaaggtccctgtttcccatgctgcttctgatgagaaattattaaacttttttctagcaaagagattcgtctcatctcatgcatgtggattgtcctgtctgttccaaaaccatcagaatctccgcaaacagtttgtttatttgcttcgtcctttctcgaatgctgcatgatcccatgtagcagctgtgattttacccaaaatatctttttttttatgttctgtaatggatgtgcaatgtattcataaatgccaccctcctcccttgcttccaagccactattagatcacttcccatcaccaatctgccttcgatatccctgtgagaggaattgcagcaacaatcatagctgtaaatatttttggtccttgaactggtatagcagcatctcatttctgaattcagccatctgcgatatctgcattacctttttattgcttatttatttgtatatgtgagaagtttctcttgcttacttcaagttaaatagatgattgctttttgtattcgaaaccttctgattgtttggtgttcttctttggatgtttggtagatctcagtttgccaaggggttcaagtttcatgagtcatcttgacgttgttactactgtggaagttgcaattcttcatggatgtcctcaagagtgatgtgaagaagactggtattctcaatgagactctaagaccaccgctagttccatccgagaagcataatgcttctccagtaaaccgtgggagagatgttgcttccaggtacaagaatggtctgtctgctcattctgctgccaccacagcaaggagatgcacatcaccaagtcctgggcggacctccgcaaatgaatgcacaccagaaccaaaaagagctcaatcagcagacagaagaaggccctcaactccttcttctagagtgtcaacaccctccacccctgcatcaaggtctgtcacaccagttcgtaatactgttacagagggacataagagttctaggcgaataacaagcacaaggaatactgatggcttgtggccagcaatgcgaaacctatcttcctctttccagtcagaatctgtggttacccccggtaataaaaaggataaggtagtccccagtggatctttggatcaaacgaaggggcaagctagtgttatagccgagaggaagaggagtcctctgagaaggaagaacattggtgaacaatgtgagaatgctcaaccctcagaggaccaacctaggagggtaatcgaacaacaccgctggccagcaatgcagagtggccgtgtggccagcaatattttgtcaaggagtattgacatgtctgacaaagctggcagatcagtcccttcaacaaatatttctagaggtgtttcaccaaggaagacgcttgcttctgaaggcacaggcaaagggtttaataaatcattggatgaggtagcaaggagattggctattcatgcaggtggaagagatgacaaagtagactctcgctgtcatgcttattcacagtcaacagagagatgtaaatccgttagccgtccaagtagggcagttactttacctgttcctgttcttcatcgctcatcttcgccaagcaaggcctcttcagttacatcctctatttctaggtcctttcagagcccatctcggacaaggccttcaacacctagccggtcacaaagtgctggaagtattcaatcaggtgttgcgtcacctattattagctacatggttgatgcaaaaaaaggaaagaagaactccagccaaattgaaaatatccaccaattgcacctgtcttataatagatacttgcaatggatctttgtaaatgcttatgcagaagatactatgtctttccaaaaagtgacagctgaggtaaagttagcatttggtttgcatcacattgcacagtcttccttgttccctttgcagtgtcctcctttgatggataccaacataaccataggtccataagtgtgtttatgcaatgatttgcttcctgatctgataagcttttgagattacttttctttatgatcaattaaaacaagcttccagactatgaaatgtgattaagtaaaatatcagctagatctactggtggttatttgtttgacttaaaaactgacaattgattttgcactgtaaatttgaggtctgctatttcttagcattagtctcttgggtgtgtagatgtactctcctttaatatttgccattatttttttagtgatctttaattgttgaaagttctttctatgttgtcatgtaaaacagagtattatatataatgttttgaggaatacctcgaacttgcgggatgttgttaatatgagaagaatcatggttcaatgcatacaacaagagttgaagctacatggcattcttaaagagcaggtaagctcttcccactcattaatgatttttataattgtataatctaccaaggttgttctaaaatgcaagttatcacgcgttcagatataatcccaacttgtgtcaggttggcacagacttgctataatgctcataatcgaagcacggctggtgaaagtaaatataaacaatttgctatgtagtctcttctgtgaaagataaaggctggttacagagtaaaaagagtcttctgatgcaaataggataaacttaggataacttagcaatgttgaagtaaatacattgaactgcacaataaggacatagttgtgagcttgttatgtcacactttggttttctaaagatggtgagacgtgagatttgaaaagtaggggtttgcaagagatcatttatcctctattggacagcagagagaacatttaatctactccagcagatcacatgacaacactaacatcttcttctttgcaatcaaagcagtgtcaggaaaattcaaaataatgtgcttagaaagcacaaagtctaaatattgtgttgtatcagggaggcatcgctattatatatgcaaaaattaagtatgcaacacagagtaatcggtatctacaatgataagagaaaatataaattgtcaaatgcatacaacaaatttttaatctgctgttattttgattcagattgattaccttgaacaatggccagcacttgaaaaggagaacagtatttcattattccacgcaactgaagctctaaaagcaagcacattgcgtcttccagttacatcaggagcaaaggtatgctgtaaaatgttgcattactgaaatcgcaaacaatttcgtaatttcttcattattaactgctactttgtgattatggctaatggttttaattattgtgttaacaggctgatgtagttgctcttaagaatgccgtaagctctgctgttgatatcatgcaaggtttgggatcagcggttcgctgtatgcttccaaaggtcagctaacagtgcgcatacaactgaaaattttactgtccacttttatctgtctttggaaatcatttttttaaccatatgaagctgattttgttagctcattgtttagtacacatttagcacaagaattaccttttataaggaaaatattatctctggttgtgatcttccatgcccgcctgtagtcatctactcatctttgtgacagttagagatctctaattccctgaaaaaaaaagagtaaagtgtaggggcggtccttaaacttgtaggggtgtgtcatctaggtccctaaactctcaaaatgcatatccaagtcccaaaacttgtcatagtgtgtcatctaggtcccaaatcgccacaacccctttatgattttacgtggcgttaatgtggcatgccacacggacatgacgtggcattattttgactgacaaataggacccatttattttttttcttttttttcttctcggttttcccctttcttctcctttctatgtgatccgtgcagaagaaaggaaaaaaaaagaagaatgagaagaaaacgaaaaagaaaaagaaaagaagaaaaaaaagaaaaaggcacgtcacgtccatgtggcattgccacataagcgacacgtaggatcctataggggatgtgtcaatttgggacctaggtgatacactttgataagttctgtgacctggatatgcattttgagagtttagggacctatatgacataaccctacaagtttaaggaccgctaatgcactttactcaaaaaaaaaaaaaagaaggaaccctgcactggtttctgaggatgaatatacaatagattttaatttttaagtatctaataaagaacaccctccatcttctatcaagttcttttcattggttgcttagttttttttttccgctgggccagccaaaatttattaagaaggggagggttttaaaattacaaatttacagcaaactgcccaaacctggcttagtttcatactgtattatcttaccaggttgaggacaggacatatttggtatcagaactttcagttatagcaagacaagaaaaggccatgcttgatgaatgcagagaattattagctatggcagcaaaactacaggtacttccaatgtaatcccatgtaatctttcctaaatctgagcacagagcccccttgaatatcaaataatgtaatttctctgtaattgatggcaaactgcccatgatggcaacagttcatacacaaagccttacctagagctgttgtatttttaatcaggtacaggagtccagcttgcggacgcatctcacacaactgaggcctggaattgctcatatgatttgacaatctaagggaagatctgcaagtcccagaccagccttctgaacaggtacaccagtgcaagttgagcctctggcgatatgaacatattgtgcaaacatacaaggagtttgtagagatgaaataatagaccaaaagaacgttgaacatcccctggtgatcatggagtgatgctgtgcagctaacaactcatggtgcggtacagatgatagatttacttaaaaggtctcctcatgtgtaaataaattcattcaggttccccacacccacctacctctctttagtttctctaaaattatttgttagtatttctacaatgatagagctatgttctttccgattgtattttttggcatctggaaagaaaatacacagatgaaatggaagggcaaaagtaatgaaaaaagtgtatttccctttttcttctcctccaactgttgttgccagatatataggtctgtagctctactcttttcgtcagcttgaccaacttaagcgttgggtgaatgctgacatctcactcgtaccaatatatattttctttggattgcagtttactctaaacaacactgttgctgggcacatttcagtttgttgaaatgtcagaagtaccttatgcagtagttgaaatttaaaacataagagttgaattctcatgggatggccaatttgccgtatgcgttcttaggatgttctctcagatttggtatccttttggtttcacttaggctttacacctaggctaagccttgcctaacactttcttacctagatgcaagactcaaaattctagtatttgttttgtttgagtcagtttaaagcaaagctgcctgtgctgcaatctgaatatattccttgtaggaatattacttcagcccttgaccaaatcgattcatatacttttaagctacattaatgcccatggtttggtccaaattacccatatatccctagtaggagcaatgagaacacagctgcaaaaaatctaacaaacatggagtgagaataccagcccttgttgcttaacattcaaatatggccatctgtccattccctcttcaaaagtttaaaccatttctgggtcccaaaatattacagaagaacatagcacgaactcaacacgagcaatacaaaacttttacaaatcgatcttcttgctgcccccctatgcacaaatcttcagaaatcgctgacgccctctctcagcagttgatgccgcactgcctgacgtcagggcccctggccttgatggtgaagggatcaatcctgacccagagcaaggaaaagatggaggcgagcagcacggaccagatgacaacaatggtgggcgtccggttctgcctccccatgagccccttgaggaaggggtagaggtggacgatgacccagaaggcgaagaagagcttcccgaagagcgggccccacgcctcggagccgttgttgatggcgtcggagacgccggcgacgacgccgatgatgttgaggatgagcagcgtggtgggcgggatgaggagggtggtccacttgaaggcgtagagctccgcgaactcgtcgtcctcgtctccggtggccttggacgtgacggtgaagttggtgtcgatcccggccagcaccttgagcaggccctgcaccaccgcgaacaggtgcgccgacacgccgccgatgacccagaactgctcgttcctccaccactcctcgatgctcaccccgctccacctcatctccaggatgcccgtcgcgaagatggagatgaagagcgcgatgaagaacaaactcgcaaacgtgctaatctgcatcaccaagaaaaggttcagaacatttgaaacttcagttttggcgggaaaatccatggaagaagaggagcaattgatggcaggatgggatgggactgaccggaggcatgatgaacttgccggtgaggaggcagacggcgggtagggtgcagtaggcgaggagggggagagaagtgaaggggtagatggtggtgttgatgtaggagaagcgctcgagccacttgaggttgccgttcttgtagccgtagaggagcgggctgtgccggctgaagaagatctcgacggagccgagcgcccaccggagcacctggttgagacggtcagataggttgatcggcgctgaccccttgaacgccgccctcttcggcatgcagtacaccgacctccacccgcggcagtgcatcttgaaccccgttaggatgtcctccgtgatcgacccgtagatccaccccagctgcatcacacacatccatggcgttcacaccacaaactcactcaatggtaatatggcttagtgtctgataacggtggttacctcgagaccccagtcggtcttgtcctcgtagccgcagctgatgacatggatggcctccttgaggagcgcggcggggctggacgacggcgggacgccgccttcctccatcagcgtcgacgtcacgaacgccgccgactgcccgaaccgcttctcgaagttcatctgcgacatgagcatctccttgtcgctgtccatccctgatccaccacacacaaacttacattattccatcagctgaaaatcttctcacaccataatttcttcttagctctgaatttgggagctcaccgccgtcggcggcgacggcctccgggaggccgtccttgccgtgcttccgcttcttcctcccgaagcaagggcagcagtcgcaggtcaccatcttgggcctcttgggtcccttgggtgggttgtatccgtacagcgcctgccgcctgaacacgcaccctgtcccgacgtacaccgggccctggatcccatcaagccccttcatgttgatctgatgatctcaccaagaacgcaccacacaaaatttcagtcacattgctcgatcgatcgtgatttgctctggatttttcaagattgtatatattcatctagtttgtgtgggagagagctcacgtcgaagaagacggtgttgcggttggcgtatcggtcgtggacgtcgatgccgtcgaacctctgcgggaactgcacgtagcaaaccttccgtccgacctgcggatccatgaggaagcacatcgcctccctgatggccttgctgttgttgatgtagtgatcgcaatccaagttgagcatgaacggcgcgttcgtcagcacggccgacacacgaatctgccaagcaaaccagaaatttcgatcaaatcgagcagagttgtgttgttttgaagatgaaggatgtggtggcgtggcgtacgagggcgttcatggcgccggccttcttgtggtgctggaagccggggcgcttctcacgggagacgtagacgaggcgggggagctcgttgccctcggtgtcgtggccgccgctgtggccgaggaacacctggatcatgcccgggtggtcgcgggtgttgttccccggccatggcgtcccgtccttcatgatccacccttccgccggcaccttctgcgccttcgccaccagcgcgttgatcctcaccttgaactcctcgtactctctctgctcgatcaaatgccaatgcccccacaacagttagctcttcgtcaagctcctacagaatcagcaatgacgatggcgatcgatattaccttcatggcgcggcgctcctggacgaagttgggatggaccttgtccttgaggtagtcgaccttctgggagaagtagaactccggggcgcggggctcgatgctgaacttcttgcagaatggcacccacttgcgggcgaactccgccgtctccgacagcgactcgaacgtgagcatggacgcgccgtcgtcggagacgtagcaggacaccttgtcgacggggtagtcgacggcgaggatggacagcacggtgttggccgtgaccagcggcggctccttgagcggatccaccgtgctgacgaacaggtccaccgccgacagcagcgacggctccccctcgcgctcgtagcggagggagaggcggtcgaggtaggtctccctgtcgatcgggtaccacttggggaactggtcgaggatccacgacacggcgaaccagatctcgcagatgatggaggtgagccacagcgggatggcgtcgggcaccgggtggaggatgcggtaccggaggaagaagccgagcaccacgagacggaggatgatcaccatccggtacgggttcaccttgctcgacgcgatcgacaccttcctcgacagcggctgcctcgcctcgtcgttcctgcaagccacagagagttcaggcatgatcaatatactagttgtcatgcatgatcagtgtaagctgctcagctgaggattgcgtacagtgggacgtcggcgtcgtagtcgtcgggatcgggggcgccgccggcgacgatgccctgcttggatttccagtcgtccatcctctccttccagctcacctctttcttctcgtcccactttgcactccctggtcagaattcatcggtagatgattgagatgatcaatgtgtgttcatcaagaacattgattaattagtgtagtgaattcgttatactacctggctcagacaccgggtaggggtggatgcgcttgtgcagggaagaggagaactcgccatggccatggctgttcgatatcgggaactccccgctcacctgaatttttttttacaaagaacatttcgtgaacatgttgaggtgagaagagggagagaatttggtgtgagtggggtgaggtgtgttgtgtgtaccgggacggagcgagcgccggtgatgatcggcgggagcggggtgctgttgccgtcgccgtcgtcggggcccctcccgtagctcatcttgccgtgcagcatcgcctcggtgatgtggctgttctgcatgccatcctgatcctgctgcagctgcttctgcttctcgtcgtcgatgttgaactcgtgctccaggtcgtcaatgtcctcctcgtcctcgtccccgggcaccctcgggctccctgtaacaaaaccaccaccaccaccatcgccattagagatcaatcaacggaaacctcgcgatcgcggtatcaagggcgtagcgtgatgtgagtgtgtttttttacccttgaggcgcttgtagcgggtcttgcactgggggcagttctgggtgccctcgcggcgctcgtactcgtagcaggggcggcacaccgggaagccgcactcgttgcaggcgacgaagaggtcgccgtcgacggtgcggccgacctcgtcgccgcatatctcgcacacctgcccgctcagcgcccgcagcggcttgggctcctcgtgcccccggatcagcaccagctcgttccggttgtgcgacccggccaccagcccggcgctcgcctccatggccgcgcaacaacggccggcaacgagctgcggctgatcagggaggcgacgcaggaaggaggagaggaggaggaggaagggcgatcgatcgcttgctccacccgcttgtggcaggggctatatgggagggggggttttggcgggtgggagggatcgagaggtgaggggtggctgtttgttcgcgcgcgcgcgggagaggaggggtcgaggaggcgtcggcgcgtgtgggagacggtggcgggttggttgggtgcggcgtctccgttgccgccaagtgaagcgaaggggttgtgtgttgcttgcttgctttgcatggtggcgcgttggcgcgagggaggagaggagaggaggcctgcgtgcgtgcgttggctgctgctgctgctgctgcagatgcagctgctgccgttgttgtcaggctgcgttcgcggaccaacccgcgagatcagtcaccaaccgatgcttggctttcccgccatctcctcatttttctcccctttgctcttttatttaaacaaacaagaattaaaagggctagattatattggtgagtggtagtagtatagttgtagtagtaccaatattggggcatttaaaatttgatgcatggttgccgcgagtaattctacctgagcttgcttcaagattagtttggtgagtacggaagtcctctccagttgattactggagtagattagtacactggaatgactgacgcacaccgacgagattatgcgtccaaggaagtccaattttctagagtctgcacattgtttatacggaagtctagataatgcacatttgatataggacgccattgtttatacgggattactggaagctgtaagtgaaggacaaccactttttttcagttcagtgacaagattacaagaaatggattccgagttcaatagctaaaccgatcaaaactagtctttttgacaagggggatccctagagtcctgaactgatttctttctacttgcggtgcacaaatagtcgttcctatcaactcaaatccaaccgaaaattgctgttcaagtctagagtaggttggtctgtcccaagccaaacgcacgtttctgcccatcgatcgagtcacagcattgagccataagcaaacgaggcatcgatcgatcaccttttcttttcttttttttttcttggcatccccagcgattcagagaaggtgaccaggcaccttagtttggtagcatcatccatcacacaccctgccagtttgccaccaaccacacgttgtgatcgtgtagcgcacacacacatatacaaaaacgccacgaaagcttcagcttccattggcatctgaacatatgcaatctgatcatcgccggaaaaaggaggaagaagaaaccgtcacgatgaaacctgccagatgcgtcttctgctgttaccgaaggtacgcagcatatcatgtcgttgcgtccagtgacgacctggaggaagaaacgtccccatcctggatgtgaaatgcaggtgaggggcagcagcagcagcagctggctgaagcatcttaggacgcaagttttgattttggctggtgatcatcctgtcgttgttgcgagatctgcctcgtgttaaaggcgaagtatcactgtcgctatggaaactgtagcttactggggctagcccctccttgcgccggcctgctgttctctgttccttgtggtgtgctatatattgggcccggagttgatgtgttctctccctcggctagctgcagtgttgctcatgttctaataaaatattgttttgcaattggaagaagggagatgtaaagttgctaagacgattgggccattctacgctattgaagctgctgtttcttgcgccc

SEQ ID NO: 69894 - DNA, 733 bp, Oryza sativa
atcgagctccgctcctccgaccgcgacgagctcgaagaccaccttcgcgccgacgccgccgcagcggtcagcacccccaccgcctcatccactccgaccacgaccccgtcgacctccaactacaaccccctcctgcacctcctccacccgacgtctggcgccgagccctccaagtcccaccgcatcggcctccctaccaatcccaatcccaaccccaaaccctagcctctcctctccccccttcgcccgccttgatggaggtcgagatcaagctccgcctccccgacgccggcgcgcaccgacggctctactacttcctcgcgccccgctgcggcgcaccgacgcccagcgcaacctttttttcgacgccggcgcgcgccccctcgccgccgtcaccgacgcgctccgcgtccgcctctacggcctcgacgaccgcgccccctcccgcgctgtcctcgcgctcaagcgccgcccgcgcatcgacgcgggcgtcagccgcgtcgaggaggtcgaggagcctctcgaccccgccatcgccctcgcctgcgtcgacgacccggcaagcctcggcggggtcgagtccccgatcattcggctcgtctccgaagagtacggcgtcggcggggacgccgcgccgttcgtctgcctcggcgggttcagaaacacccgcgccgtgtaccagctggaggagggcgacaccctcgggctcgtcgtggagctcgacgagacgcgc

SEQ ID NO: 69895 - DNA, 34566 bp, Oryza sativa
agaccgagcgcctggccattcgcagttcgacgcggcactagggtttgcgccaccgccaccgcgcgccacccatgttcccgccgccagcgtgctcccgtcgtcgcgagccgcgtctcccggcgctggcatgctccgacgcccgtctccccattgcccgcccccacgccacccaacgccgccccaggctgcccgatggccgacggctgtctccctgtcgctcgcccggtggccgtctccccgtcgcccacccgacgccgccccacgccgcgccgaagccacctctgctcgacgctgcttgaagacacccctgctcgacgccgcccgacgctgctccgatgcctttgccactgctctagccggtttgaaaggtgaggccgaatcgcccctgcccctgctcttgtgttgatgcatgtgttgtccctagaatattacagcaaattgatttttggcctgcaaattgattgaagaaaaatttatttggttcaagaatgggtgacaaggcagattggggtgatgattttataaggcatttgtttgatgtttgcaaagaagagatagaagctgggaatatacccatgggaattttcaccactaccggttggaaaaatgttgttttcaagtttgcagaaaaatcgggtgacaagcgaaccaaaaaaaacaattgaagaggaggatagttattttgagatatggcatcattgtatgaatgctctgtttatgtggaccatatcactttgatggatgaaaaactaatatattttgatgaaaaacttatacattttttctacaaattggccttttaaatacaaaatattgaacatattaggttaggtttgtacgagtaatttgcatataaacagtcctttcttatacaacttacagtttcacagctgctctaaccaaacgggcttctgcttttcccacagtttattttacacagctgcttttccacagcccacagatcacaacagcttttccaaaagccacaactctaccaaacacacccttaggctatgtgaaaatttttgccgcgttacatcagatatacagacacatatttaaagtattaaatatagtctaataataaaataaattacagaatccgtctataaaactacgagatgaatttattaagtctaattaatccgttattaaaaaaatatttactgtagcgttatattgctaaatcatgaagcaattagacttaaaagattcgtctcgcaatttatacgtaatctaactaattaattttttctgtatatatttaatactttatatatatatatatatatatatatatatatatatatatatatatatatatatatatatatatatatatatatgtccaaatatttcactcattttatttcgtgagacagggtgaaaaaattatcagctctccgtctgcccagtgatatccgcactcgccttttctgactgctgttccctgaatgcacgtcgcatcaagtcaggagaggcattgaacaggagatagaaaagcccacaagttctcttcgagaaagagaagtattagttttggacaatttttaagttaaccttagaaatataaatcataaataacttttaaattattaagtttaaaaatataaaaattatatgaatagatttgtcttgaaaaatacttttaaaaaaatatacatatatcacttttcaataaatatttttataaaaaaagtcaaagttgtgttttgaaaaccgtatctctatccaaaacaatttcttttataagtacggagcgagtactcccgcatcatctgcagaatttttacgacggttaatttatttttcataagaacggaagtacggaacaaaacacccgcatttcacccgcatttcttaagatgatgataggtgtcgggtgaaaatctgatctgcacactagattagctactaattacacacttcgccattgtgttcggtaagactagaaattattaagaaaaataaaataaattttaccccgttaaattgagtagcttaaatcatacaagtattagttgcatacaagtataattatacaagtattaccccgttaaatggagtagatgcacagtattagttgcatacaagtataattgtacatataaaaacaaaagatcaaatttataatatgaaattcactcctaaatttaatattaatatataaagctgtatataaaattcagctcacgtaagattgcattgaaaaatcccctagtttggactttggactaacacggtagaaaacgatcatgctctttagcttatcagctgcaaccaaaatttaaattttaaatcttaattttgattattttaatcgtagttttttttcaaccattatttttataaatctcgaatcgatataaaagaaaattgaggactgctacaaaacaggatcccgttgcaacgggatagacatattaactattctcttgtacgagtatcacaggtattaggtcctaggtatcacaagtaccgggtaagaggtatcacagatatcaggtaccatgtagctggtaccaaaacaggtatcatactgtcttatagatgatatcctgttacaacatgataccgttgtttgaagaaaattacccacacattatttttctcgcaaatcatcgcttctgaagatcacacaacggaagtccggaacccacgcccaaatcaaaaagaagcggacgccccccaaaaagttcaaaactttccaaaacatcgtgtgcgcggctgcatcgccgcccacccgcctcatcgcattcacaactctcgcctaaaaggctaaaacccttcctccgccggccgaacccgtctggattcgccaatggagttcccccgccgcggccaatcctcccatcccgccgacgccgacgacgacgaccgccgccgcctccgcttccctgactccaccccgccgagcggtaaccaatcccaactcccaaaccctcggtattcccccaaattcgttgtgcgatttttttatttttatttttggctacgaatcgcattatctctgttgcaaatgatgatctggtggtagattggtagtgaatgatgctaagatttgttttcatgatgcagtagttgtaagcggggttagtgattttattttttattttttattttttattttttattttgattttgatggtgttgtgttcatgggcaaaggacgcgaagctaggccggctccggcgcagggggacgcggtgacggcggcgctggggcggcggagggaggagctgctgtgggagctccacaagacgaagatccaccgggagatgctcctgtgccagctggtcgagacggagcgcgccatggcggcgcgcctcgccgcggcccgcggccaccccgccacgccaccgctcccgtggccgcagggcgacctgctcccggcgcgggagtacgcgtggcggagcacgccgtgggaggagcaggcgaacgcgaacgcgaacgcgcacgcgcacggtgccctctcggcgccgcgctctggtgacgaggagatcaccccgtggtggcgccggagcccgtcggcagtgacacccccggtgtacccgcacgtggagcgctctccgtcgccgccgattgcgcggggatggccggccgacgatgacgagcggcaggaacgtggggagccatccgggtcgccggcgatggctcctccggtgcggcatgcacctcatgtcgaacagtccacaccagtgccgatcaagtcgcctgcggcggaggccgtttgtatgccatctgggtcaccggcgatggctcctccagtgcagcctgctcctcatgtcgagcagtccacaccattgccggccaaggagcctgcggcggtggcgaaggtggaggcagatgccattgtccagactgcggccaatgctgatgccgaccaggcgttgctcggcaagggggcgacaccaggagggcaaggttgcactggtcagaagggtgaggaaggtgatttcgccatcgacggccatggcaggcagctgttgggtgagatgaatgtaagcaagagcaccgagcagccaaaacctacagaatccatctctggaggccacaccgatgaacttgtccagaagcgttatcaagataataagccggcagatcaggagattgcaacattggacaagcagaagcgagtaggttccaatgatgaggtgattcgcttccgttactgttgttccccagtttttgctgccttttcatgtttacctatcaagaatgctgttcagattatgtttgcatgtgcccatactccatattgccatactgtgccacacttgtacagtgtacacttgcgctatatatttctttgtatcgacctttcaccagcatcttagcttgtttacaaatccataggcacttataggaatcaaggcccatttatgtgggattttagcttacaatatcaagttcaagaatgatctactagcattttacttgcagatcaggaattgtgtgtggagagctagaaaaactatatcagttttcgttgtgtttacttgtacgggcagattgaggtaagcaaccgaacaggtggaaatttaaaggtgtaggataaaatgtctattcaaaatcagcaagtttcatctttaatgttgcagtgtacaatttatagtagtattagtatatatttagttagttaaactgtaggattaccatcgttcacacatctggccttatttatcactttacctatctgagataagatatttgagatgatactgttgtgttgatgctctataacaaacttgctctggaacagcttacaccagaaaggagatcctctggtgtgaagaggcagctggcttcaggaacctcactggcaaagaagccgaggtcccaggggagctccatcacttgctccctctgcaaggtcaccatgacttctcccagggcgctggttgagcaccgggcatccctcctgcaccggtctaacctcgcgccattgcgatcggggaacaaggccaccactgaagctgcgcagcccgcggagaagaagaccgagaagccagaggcatctgaatggaacagcagtgcacaccaccaccagaatcggatgtactactgcgatatatgcgaagtgaggtgcagcagcgagaagatgatggcgtcgcatctcgccgggaagaggcacagggagcggcacaactccattttcatgtaatgatgatgggacacagtacaagcttgccgctttgccgcagacctgcagcagtgcaaaaaataccattttgtttgaaggaaagattgtttaggccatgtttgtttaggtttatacgatcggtttatgagaagtttaagtctaaacaaacaaatcaatttattggttcggcttttttaagccataagaaaaaactacatgtcacagtagttttttgggattatggaaagtgtattttttactcgaccattaaactcaggcttcgaagtcactgtcttacaaaaacatcctccattcaaaagagttggcttaaaagctagtaaacctaaacaaaggctctgtttggatccggaatcttgctatttagtagtattatacgtagattactgacaaaacccattccataacccctaggctattttgtgagacgaatctaacgaggtatattaatccatgatttgctacagtgatgctacagtaattagccgctaatcatggattaatatacataattagattcatctagcaaaatagcctaggggttatggaatcgattttgtcgttaatctatgtttaataattctaaatagcaagattccagagggatatttaatagcatagaggatccaaacaaggccaaaaagggttttaacttttaacctgatgcttataagtcatgattggtgaaaatatttggggtaaagcttctgtactttatactatagtgtattctgcttattaaaaaaacaatctttccttctattcttagtggtgcaaaagttcagattaaaaaataccaagcaatgagaaaaactctaaaaattaagttgtatgaggttgaaggataaattttgcagaactacggagattttggcatgcgggcgtacagcacgtaacctaggtattttgatgctacaattttacaaaacctcatcctaagcaaatctgtttttagataattgaatgaaatatctcggcctttgctcaagagctacatctaattattataaggttaacacaaaagcaaactcacacaaggagtatgtagtcaaagttaaaaactaaaagtagaagcaaattaataaaaaccaaacaagataaagacctcacaactactaattctatcaactattgattctattggtgaatcttcacccgaatttggcaaatagctacatgattatcgactcaagtttacgacatgcatcttttgttagcttgatatgattctaagcaaatcttagcataagttatcttagcaaaaatttatatacaaaagttgttttaaaaaaccatattaatctatttttcaaaaaaaaatagttaatacttaatttaaatgcaatagtgcttcgttttgcttgccggggaggaggggttcctcctcccgaacgcatcctctaagtatataggatttgctcaaacatttcaaatttagttacggcctctaggccatcctccaaggcaccttgctacagttttagctctttttggacaacggattattatctaggattatttgttttacacatgtaaatttatgttttctaaaaaaaacttagggaccctttaaatcgtagaattgaaaaaacgtaggaatagaaaaaaaacgtaggattttaatagaaatgtaagtataaaacagatgattgcaaaaacacaggaatgaccgtttgattggaccacaggaaaaacgcaggaattagaagagagataaagactcgacggaaagtttccatgaggttctacctcaagttagaattcctctaaaacttgcatggagtattaagcattccataggaatttcattggattttatagcatctattcatttgattcaaagggctatataggaaaaattcctatagaaatgagatcctctaaaatttatatgaatttcatttgaatgaaatgggcccttaacttttctcttttgcattgtccacatgtagactatgtagtactccttacatctacttttgatagtcattttatcttgacacacagaccaatgataaataattctacttatcattcatttaaatatgttactactcattcatcgtaaacaagcaattcattaatatttacatttttcaatgtccatatagccaatcatgtgtggaagaatggagagtcacgcattaaatccgaaaaagtcattaagggaatagtttgttggattgaaatatttctatcaaaaataaaatttttagatttaaaaatataactatcaaaaaatagatagagagagtacaaaagtttgaccggtatccccgccgcttcattgaaagcaaccacctctagttcttcccagtgtcttaattaccggccacgtattcgaagatttccaatgcggatatcgctagcactagtaatttgaccgacgctactagtgctagtactggagtagtatgaaacagtgaaccagccgtaatctccaatgtggagtattcgctttccctattacgatgagtctgaattaaacgacaattatttcctttttgcacgttaatgtgacgcttcgtttttcctttgcctctaagcaaatcattgcaaacgcgacgagtgtgtgagaaactgagaacaaatcagccattaatctctatatcattagctggtcacgcggcccaattgattcctataaaagccgccccactcaccattctgcttctgcgctctgctttttctctgctcttctcgatttctccggtgcaccgctcctctgatcggccgatggacttcgccgacgctccgtcgcacggtatgcatcgacgaagctctctagtctatcaacatcttctactgtcgtctccatggccgtttctttgctggaaaattggagcttagaaccgaacgatgtatagtaaaacgctagtaaaaacagatgaccctttccgtgtcccttggttgtttagattatcagatgcgatgcgatttgatcttacgttttttcatgccatgaatccactttgcatgcatggcagataaaaatgtcgatttcaaaacggatataccctatacaggtaattagcacagatctgcttgtgtgacagatagattctgatgcagaaaagtttcatcaaaactgtttgtttcttatttcgttacaaaaacagagaagaaacatgtccatcttggatcggcactcgatagacttctgcgtttaagccttgttagttgtagtttaggcactagacatgttgctcgtgcttaatcaatcacgaagaacatcatcatcaacaatggctggtgcatatacttgcaggagactcgctggtggtggtgagggacgcgctgctgtcgcagctccagcaggatcgcctccggaaggacatcatcgtcgccgagctcgccaagatagagcgcgccatggctctgcgcgatgtctcgcagtcgccgacgccccggcacgccgccgccgccgccgccgccggaaagactattacaactgtggtgagaaacttgtatatgccatcatgtttttgagtcatatccatgacccatcaattttgtgtctctacatgtatcagagtattgttaagaaaacaaacctgttcgatcagtctatacttcgtctttgttcttttcaatttcaaggtagtcaacacattaatgtagttctttcagactcagtaatactggggttaattagtgtgcacttgcactagctagctaatttacttgtattttcgtaattggtctcaacttcattttctaatggtttactgaaactgcatatcaagcaggctacaccggccaagaaaccatcgccttcagagaaatctgaaccggcagttcagaagtcgatgccaccctcggcatggagctgcgccgtgtgccaggttcgaacaaccagcgagcgcaacctacgtgatcactgcggaggtcagaagcaccagtccaaagtcgcagcactggagaagacaaccaaggccatggcgagaacgacggcgaaaccttctcccggtgcagcagcaagatggggctgcagcatctgcaacatcagctgcaacggcgagtgcgatttcgatacccacctgaaggggaagaagcatcaagcgaacacccaggccttactggaacaaaacaagaagagctcagtgaatccagagtcacagggaaccaaggcggcggcagcaacactgatctgcagagtttgccaagctaagttcacctgtcagtcagacttgcagagccatctcaaggtcatgaagcaccagctgaatctccgggcaccatcttcagatggctctagcttcaccagtgcaacctcggagagtttgagtttggaattgtattcttgcaaggtttgcagcgtgaagtgcaccttcgagaggatgctcgcgtaccatctcactgggaagaagcacctgaaacaggagaatttgcagttgtcctgcgagatctgcaaactgcagtgcaacagcgagaaagtgctctctgaccatcgttatgggaagaagcaccaggcgaagctcgagaaagtgcttcaggcaaagctcaatgcgacggaatgagatgcgtctgattctgattaaagatgctggcgttttgacttttgagcaacgaacatttaaattatcgacggcactgtatgattatttcagattattaatccttgattttgggacttactgctgctgcttcttttcaattgcttctatatactagtacaaaaataatctatacggtttaaaatgccactaatactacttgtgcaaatcaatactcaaatatcgactgtactcttgctcaaagacgcgagtatgtgccctcttgaattattttacaagtgaatggtaccaacaaaaacatcgatttaattatttaaacaggacacaatcacaatgtttccaaaaggacaaaaaagcacaatctgagtgacataagcctactccctttgtcctgaaaaaaacgaatataggactagatgtgatacattctagtacaataaatctgaacagagatatgtctaaattcgtagtactagcatatgtcatattcagtactaggttggttttttatgggacggagagagtagtcaaaatctgagtggatattttatcatatcacattgttacatcgaacttgccttgaggcatgtaaaaactaaatgatatgccagtttatgcaacaggggtgtaactcgatgaatgagtatccttaactcgtatctttatgctgctctccactaatagttctatggagtatcattccatacaaacaatacaaaattctcactccatgcaaaaaatataaggtgcattaattttacttttttttttggacaagactttacccatgattactttattaaagtagagccctatatatattaaagtagacaagacttcaccttatctcatctctatggttctcatggacaaactctcaatagcaagcctgcatagttcatctcaggttattagagcaagtttaatagtatagcccactactagctccaattcatctataatcgatctaatagccaattcatacgatagttgcttactatactattgatatattgttccacctgtcatatacacattgcgtcttggagtccgtgctgcaaccaactacagatctgtagcctgctgcttttctctctcactattatctcactaaaatatatttatagttggctaatagcctgctattgtacctgctcttatgcggcatatttgcaatcaaagtgaaactattatacgggtatcagaagttgtgcattgcatgattaaaagggtagtttttttctaagcatctatacttatggcctcacatttttcaaaaaaaaaaagcctcacattgttaatttagtacttacctccctccatccctagaatactactccaaaaagtattgttttgagcctaaaaaatttatcccttaaaaaatctttttagaatgaagtccagtagacatctttaatactacttcatcccctcttagtttttcgaatgatgttttagaatgcacgccccccttcttagtctaaaatttcatctcgcaaaacatatcttttaggttggggtccattaaatcttttaaatatcactccatttgttcctaaaaataaatgtagttttagagtgttccactgtaccctttttagggcccctttgaatcgtaggaatgaaaaaacagaggaatagaaaaaacacaggattctgacaggaatacaattgtaaaacagaggattgcaaaatacaggaaaaacgcaggaatgaccgtttgattagaccacaggaaaaacgcaggaatcagatgagagggatagactcagaggaaatattccaagaggttagacctcttgctaactttcctccaaaatgtgcatagaattactcattccataggaattttaaaggattggataggattcaatcctttgtttaaaatgccttcattggattttttttccatagaattaaaatcctctaaaattcctacattttttctacaaatcaaaggggacctaatattactctttttttacttccatttttagtcattgaaccaatagtactcgcccctctttcttgatttcctttcccactaagtttccctgcatcatgcgaacgtaggtccgcaggtgtgcgtgagaactgagaacaaagcagcctttttaggctgtgtttttttaggggttgggaaccccttcccttcacacagaaatggaacgatagattaacacgtgattaattaagtgctagctataaaaaaactttaaaaaataattaatatgattttttaaagcaactttcatatataaactttttttcaaaacgtgtaccgtttaacagtttgaaaaaaacgtgcacgatagagatgggttgagaacccataaaaaagaacacagcttattcaccaccattgttggttggtttcgcggcccggttagcatcgagtgccctataaaaggaataagttcactttgactatcttaattagtgatcgaatattatcgtttgatatctcgactctcaaactattaaaatcagtgtaatttgacttccccagtggttttggaggacggttttactgatatggtagtattggtgtggcgcttaggcggtattaaaattgaagatatatatatatatagacccatttgtcattcattagaaaaatgtgagggccacttttctccctctcattcggaaacttttcacactagttaagggagtaaatctgaacttattcctctactaaaaaaactactctatctcccaacgctttgctttttgcgctctgctttgctagctcgctttctccggtgacccggtcggtgcgctgctctgctccggtcctcatctgatcggccgatggagtttcccaccgccggtggtagccgcttcgccgacggtacgcatcgaagctctctttctctctgccctctctacctagccttcctaggacaggatctgtggtcgaaagggtgatccgtttcgtatctctttggttcagataatcagatcgtgttttgatgtcaagaactctccatcctgcattcattacagttagattgcaaactagatgcatcatacatgtcaaatagcacaaatctgataataggacttctcaaagactgttgtctgttcatctggaagtggatttttgtctcttaagaagacatccccttattttatgcatggcattcaaaaagtattaaaaaatttgttaagatagattaatatatgatatatcttttcgcaaatatgcgagttaaaatttaacttatacaattcgaaacaaaaataataatttgagcatgaattgctattcatagtcaaatttgttatttttgtttctatttgtataagttgaatttgaatttgcatgtttgtgaagtgatatatcacatattgatctatcctactaaattttttcaaattttttgatggcttttccccttaggggatgatttgagttttcctgttcatcttttcgttaagataaaaacaaatgaaacttgttcatcttagataggaacctgacctgacagcgattaggccttgctagttctagtttaggtgtggaataattccaatgttgcgtgtgcttgaccaccaaggacacatgaacaacaacaatggatttgtgcaagcagtagcaggagacccgttggcggtggtgagggacgcgctgctgtcgcagctccagcatgatcgtcttcgtcaggagatcatcgtcgccgagctcgccaagatagagcgcgccatggctctgcgcgatgcctcgccgtcgccgtcaccgagccccggcacgccgctggaaagactgcggcaagtcaggtgagaaacctatgtacctgtatgcttctgactaacctttttttcttcttctcacattatgatattcagatatgatcatatatattccatccattttgcgtctctctgcatttgtaaatttgttcatacttcagcatactgttaagaaagttagctccttgtaaggcagatacttgtttgctcggtcagtactttgctaattttcttttcagttgtaaggtaaagaattaaaccatatgtaaggttgatgtaaggttgatgtagttctcccaaactcaaccatatgtatgtggcattagtacggtttgatctattggactaagtaatactccaatttacttcaatttcgcagtttcctttcgtaattgtttactcaaactgcttattaaacagacatggagctgcgccgtgtgcgaggtgcaaacaagcagcgaacgcaacctacgggatcattatggagggcagaagcaccagtcgaaagtggcaggattggagttgaaggcgaagacggcgacagtgaaaacgacggcgaagccttctcctgttgcagggcagagagcacacgctgccagatggagctgcagcgtttgccaggtacactgcaatggcgaatggcatttcgatacccacctgaagggcaagaggcaccaagcaaatacccaagccctgctggaacaaagcaacaagaattcagggaattcagaatcacacgatggaaccaaggcgcaaccgagcaatgtgagccatcacgccgagaagaagaagaggaagaagaagaaggaggaggaggaggaggcgacatggatctgcagagcttgccaagctgtctgtacctgtgaatcagacttgcagaaccaccttaggggcaggaggcatcagctgaaagttcaggccttgcctgaagctgcgaaacaagagaagaacaatcctcccaagcttgcaaagaaccctaataagcaaccctcggaatgggtttgcagtctctgccaggccaaatgtaacactgaatctcagcttgagcatcaccgcagaagcacgaggcaccagcagaaggtagaatctcttggatggaatgcgaaagagagtgacctggggactctgcaaggaatgtcttcggatggctctagcagcaagagtgtaaaaatctcagcgacgatggataaacagaaggctacgtatttttgcgaggtttgcagtttgaagtgcaccagccagagaatgctggcggatcatcttagtgggaagaaacacattaaacagttggagttgcagctattcagctaaggtctgtaatttagctaaggtttgtaatttgcagtgcacacacagctagaaaatgcttgctcatcatcgtgaccaggaaaagctcaatgcaaagaaataaaatgttgcagcagatatgagagttttgaagcaatggcgttatgatcaacggtcatttaaattacgcgatggcattgtatgaatgtgaattgaattattaatcattaatttcaggacttaccgctgatgttttccttttgcttacaatacaacttgcttgatattcataattcatttcacatgttacaatatgatatacatgtcaaaatgccaggatgccagtctgctgcagttgccatttcagaagtaaatggtaacaacaaacaaaaaacattgatttgtcaccatgtttccaaaggatgcagcagaacacaatccagacaaatgcagtcaatgtgcgtcagttcaaaatctgggtggatatttcataacatcacatcatcagatcgagcttgcattaaggcatgtctaactaagactcttgtgatatacaaagcactgcaaaatatttcagaaaaaaataagcagagtgcagttaatcatctgagaaggatgttatttcatagccacatctatggaaggactagaccttcaacgctacacggtcttgccatgaaacactcctcttatcatcgcttgccggagagtttccggtatccctacaagctgataggttgacatcggcagtcataatatcttcatctactccagcctgttcagcctttttaagttccaaatggttatggtgccccgggaaatcagaaagctcatcattctgtagttacagaaaaccacaatgttagttgtcagaaatagattacgttttgtcagatatccataacactccaaaaaaaagttacataccattgcagaatcttgatttaaatctaaatctgttcttttactggtagatggcacttcagtactcgccccataaaaagctgaagcatcattgattcccacatgagatgggactcgcggagctttcttcttcagccgtacttgctgcgaatcattcttcttgaaagaatttaacttcttttgtaagaaccttacaaacaaaacagtttccatgattagttgaagaggataaaagggtcaatactactactactatttatgatagaattcacatagcttgcttcgttaacatcaattgagtagatagatgggaacatggagggacaagaaagaaacggaagtgctgtcatacttgacttcagaaagcaggacgagctttcgcttgtttatgctctctagcttcctcctcttcatctcattatcctgcatcaagaaccgctatcagattcaagtccaatgtagtgcaagtgtatatatgcagtatcaatgtgaccatgtcatcatcccatgctacaaccataaccaattcttgacagccctagtttcgcactaacatcagctatgcaatcaatcctagtttcacactaacatcagctatgcaatcaaccctagtttcgcactgacatcagctatgcaatcaacccctggactcctgcaatcaagcggagcagagtactaggagatatcatatgcaatacaaaattgcaaccgcagcgaattagtagttcagacaaggaggtgaacaaggagattcatcggcgaaaccgcgccgcaaagggcaagggaaaccagagggggcaaacccttcaccttgagcacatcgcggtagtcccgccggagctcgtccaacctgtccctctcgcccctctccgccgccggaggcggaggcggaggcggagcgagcctcttcttccccttcctcctcaccagccgcacctccccgtcgccgtagtccatctcgtgaggaggacgagggcgagaggggagggggggctaggctagatccagacgggggaggcgagggcgaggaggagggaagaccgagggccgcgtggtggtgtgaggggatcaggaattcaggagggggtcagtcaggccacggggaggggagaggttggggagaggaggagatggggatagcgaggaggaggaggagcgcgtcctccctcctctccatatccgatccaatccgatgcggtcgcggccgcgtcgtcttcgcctcggagaggtgggcgggggcgggggcggggcgaggcgctggtcgtgggtgggtggatgcgtgcgtgcgggcgggcgagagcgccacttcttttttttccgccatagatatccatgaccatccatccgttcgacgcggttgatggctgtggtctgtgcggctgtgcccccatgcgactggagttgagctgtgcttgtgttgtgcttgcgtgattggctgggggcggatgtcatgtttgtcttcctccttggtgtccatggttttggccttcgggggcatttttttttttttgacttttgcttcagcaaaatttgtttgggtttaccaaatgttccttttttactcttatatagtaatccctctgtactcataaagaaagtcgtttaggacaacgtttaagtcaaaccttgggaatataaatcataaataactctcaagctgttgagtttgaaaatataaaaattatatgtatagatttgtcttgaaaaatactttcataaaagtataaatatatcacttttcaataaatatttttatagaaacaagaagtcaaagttgtgttttgaaaaccgtgtcgctgtcctaaacgacttactttataagtatggaaggagtatatacataaaagaaaattatgatgatttttctcccttatactatgttaatatagtacatttttatctcccttatgattcatgaaaattttgcctatgctagttttgtttatatgttttccacgatatttatgatttgtccctctatgtttggggtgactttttaactacccaagttcaccatggtatatttatatattttaccgtgttgaactgtttgacatttagaatgtaaacttgcatttttactactaaaggaattgacattttaatacactggtactttgatacaccctcatcaagtattctaactcggaagagggattttacgatgtttgcgagttacaaggaggtggggcgacgtgagccgttgatctgcgaggggcaaggtatggaaagaaaatattgtaataggtggcattaatgtaaatatgatgatattagaatgacaaatgtgtcttttacacatatgaaaaggtatgagaaggtatcgaaggaattagcttgtagcctgttgcgttgcatcgttcttagatacgttctgttcgtacgtaaggtttatgtgttcttcgataagttgaaaggtggagaattgagggccagcggtggacttgtggccggaggcggtggttggagggaggggcggcggaggaagaggacccggaggaagtggtccaggactgcctatgttcgccggagctagaagcggccgcacggtctcgatctgtcagacgattggtttagttttttttcgcaaatcttcctcattgaacttgttttgttcttgttaggttcttaaatcttctcaatttgttgtcctttcgatctttgattacattcatcaaaagatggatcaccaaattgctatgtaaattaatgactaactggaaataattatcaagatcatgcgaatatgatatgtaccacgtaaatcggaccaaagtttggaaaccgacacaaacagaacgaccgaagattggaaaccgaatagaagagaatgtaatttttgtccccaccacgtaaatcatattttacgttacctttaaaaactacttacgcggtaccttgtggtaccttcaaatccacttacaccatacctttcggtacgtccatacgttgttaaacataattgccctgttatcaattaccttttaatccatagtacctttctacctctgatacctttcataaggtacctttcatcgtgagccgttagatctatgccattttaggaatgcaaacactgtaaaaggtctcaactcagaaacgggaggcctacgggaggggctaaacatactagggaggactatgccaacataagctcattatttcgcataggaaaaagtacgaattacccccctgaagtattaggtgagtacgaattacccccttaaacctgaaaaccagtcatttttcaccctcaactatcgatatcggacgaaaaacccccctaagcagctttgcaagcggttttggtctacgtggcagtccagtcagcaattattttctttttaaatcagtgggccccacatgtcagtctctcaccctcttttttacccctcacctctctgtctctctccaaaatccactctcttcttcctccctcacctcgatgatgacggcgggcagagcacgaggcgacgaagggggcgatggagctcgggacgatggcgggcggcggcgaagagggcgcccgcggaggggatgcggcaagcgcgccgagagggaggaggcgggcgcttctctcctctcccccgccgccgcgctgcgcggcactcctctccgtgaacgagctcgtgcgcgaggggcataggaaggccgagagatgaggaggccggactccctcgcgaccgccgtctctagccagatcccagcgagcaggcgtcggggaagggtagtggggcacggcggtcgtcgtcgggccagaggtggtcatcgcagcaacgagtatggctgggcttgtcgtactccggcgggagtggctcaaacgacgacgacggcggaggaggaggcgcccactcagcccgctccctggcctcctcacctctccctccctcctcagcctgctccctagcctcctcacctcttccctctacgcccaccccactattgccagcatgcttcggccgccgccgctccgcccgccccgctctgccaccgctgcttcgccccgctccttctcccgcttctagtcagcggcgaagttgccaagcagctggtgggaggtcacggagccatccatggtgaggtagagatcgtcggtgcatgccgcgagctccttctgtgtgcggtaggtgaagttgagcgcggcggtgacctccttctcgaagcgggagaaggggctcgtagtgtcgtcgagacgcagcttgcggagcttgcagaggctttccccgagctccatcatggcaccacggtggttctgtgtttgtgcacgatcatgtgtctaatcacaatttttactggtggagtaataattaatatgcatagttaaatgtggaaatgagacgatgaaaatatacttggttgaagaggtggtggaagccgacggcgcactggaggatgcgtggagcagccggcagcgtccgggtgggctcgtcggtggtgtaccagagctcctccacgacatcgtggcgcgcgtggaactcgccgccgttgaacagcgccaccgccaagtcgaagctcccacatatgatttccgacgactcccaccgaagcagcggaggaggcgcccgctgctgccggcgcgcgagccgcagccgccggcatcggcgctcgctgctgtcggcgctcgagccgcagccgccggtatctaacgggagtgagagagggggtgagagggaaaaagatagagagaagattatatctgacaggtgggccctatcctttatttaataaaaaacttactgactggactgccacatagaccaaaaccgcttataaagctgctcgagggggggtttcatccggtatcgatagttcaaggtgaaaaataactggttttcaggtttaggggggtaattcgtactcacccaatacttcagggggtaattcgtactttttcctttcgcatactagctctgttcctttttacattatttatcagattattaaaatgaatcatttgctcaatgctttaaaaactttgttcgatcgtattattttaatctcttgtttatagatatatgttaggttaattttgtttagaaaaaaatatctctataatcaagtagataattcgctcaacaaattaaccaaatggggcctagaccaaacattatagtttaaaacagtttcatatgaaaacataggtgaataatgcaaaatacatagcaagatagcaaaagagaagggactctgttgtccccatagttgatccggcatggaggagaggtggaggagagaacgaggaggattatcttgtccgcgagaagaggaagaggatccgatgatgcgaagattaggccggaatccctgtgtcccaacccaacagtgggtatacggtctaaaatttgagtagccgagaacatactactaacactttaaataaattgagtgatataaattacaaatgttctttttatgtgttattcgtaatgattggaccaacactttggggttgctccttcagcttcgacgatattactttaccttatctgtcaggcatggcctaataatctatttactccaacggccatagagaggaggggctttctgcctattgtatgggacatacaacctctgttgacgtttttgcatctatacaggatacaccaatagatggtagtagagagtgtttgctgtgttttgagtagatggtagtagagagtgtttgctatgttttgaggatatgacgagggtgtatgtgatgttactgtcctatgaccacgtttttcactattgcaatgagttagggatagtgaatttaggaaaagataatttttccactattgcagtgtgttagggatagtgaacttaggaaaagatagttcggggctaaacatactaggattgtatcattatttctcatactagacaggcattatagcttaaagcaatttcacataaaaacatagagaactgcaaaatgcatcacaagatagggaaaaaagaagggagctccactggtcagagggctagggggcttgagcccccttgccatactactaaaagtaattcattttacttctagggaataataaccgcatccgggatgattttttgtccgtcattgtcatcatctgctatgcgattttttttcttcaagcaaaacatactaaactctagggtcctcttggctcgatatgaagcagatttggtccgattattggaaaaacgagaagagaggaagataaggatagaaaccctcaatcaattttggattatctccaaggttgcattcaaattttacaaaggagaggcgttaggcagctgagggactctgtgacattgtagcgatggccctacgtgacaatgacaggagcaaggggagtccgattagacttttgattgcttgatgggccggatgtgcgattgcgggctgaggcggaggggaggagaagggaggaaagcgggccagctcgctgcagactgaggaaggaaatgggatcaaaatggtctagatagaaaggagggtttgatttttatttaaataaatattgaaatggtgtttgtattattaaaattagcaattgacctacaaaaattccgagaaaattttagagagtgtaattaatcatggataatttaataaaattaaacccaaccatgtaattttatttctcacacatactttactttacttgtaaattaatttaattctagaccttcctacttagaaatacccaagtattcccaaaacaatgtattttaattaattaaataatgtaaatgtttatcgattttttctaaattttctcgtattttcttcccgttgcaacgcatagacaatttttctagtcttttataaaatacaagattatttagagaccatgtttttacattagttgagacgaaaatgatcttactcaaaaatattcttcttattactattctttccattttttcaccctcatgcaaccatgtttccatattatataggctaagagtcgttgttgagctgttgttacccatagcaccgatgttttgtctctcatctttcgctctttcatgtcaacgaatattcctaattaacaacgccaagagtccgctattaacaaccattgtacatgccgttgcgctgatctcgctttcttgtgattctctgttatctttctgttttaagatcgtgattttctagggtaacaaactctcttttctccttaaaattcaaaggtgtctttccctttagctaaaaggaggtttgcatttctaactgaacattggtgcattttgtgaagcttgttatttatatatttgtaacagcttatgctctttgagacatgtcattgtggatgcctctgttatgatgcgtttgttgttcggcatcgaactaaataagctgttgagtgttgttcattcgtttggtgtggtattatccgtatgtggaagttgttatgatgcgtattgcttctgtataacgagcagcactcttttcatgtcatgatgactgacattacacacccttcatataaagccatatatatcttttattctccaggtgtgttgtattccttcaatacggtaaaacagatgcaaaataatccaaggtttgaaaattgtaccactgttgtgtagccacaaaatgacatgtgcctaactgctgaatttgagtggattaattgatttggaaatcctctagttatctggattagttttggcctttcaaatggcgcactatcgatataggaacctaagtttgcttgtctttttaccggtaatcctgaacttgagtgccttgtgttcctgctcggacgaccactaccatgttcatcattaacctctccatttcaacctgttcacgatcctgcttaaccaatccaaaccatccacacaaattgaaactcctacaacaaagttctcctgatgatttcggcactgaagaataattagcttttgtggccggcagtgctgcctaggaattcagggaaatgtctctctcctccacgctgcattgtcgtgtggatcttggatcgttgggagagattagccggccatacactagtacagtagtacaatgttaattacattggctaatcaaaattacagggagagattagcagtgtaccagtactgcacaacgttaattgcattggctaagtataaaaattagtagggaatcagcggaatggtggtgtgaaaaggtgcatgatgcgagagcaaatcaaggtttagttttcttccctttgaggctttcactcctctcgttataaaagcagttctctgtcgcagcggcgcgggaggaggtggcagagaaggaaggaagccaaacggcatgggctctcgtggcgccgccgccgaccatctccacggcgtcctcgaactgacggtgtacgaggccgacgacctccacaacgccatccatggccggatcatcaaggtacgattaccgtaacactcacgctcacaagtcattctagattcttttgttttttggtttccttctcctcgatcgtggcctagtggtgttcgcttgcttggctctcatggtttcttcttgcttatgagctaatggattggccgtcaaggatgcccttctctttttcagctagagatcacctactgccactaacagtctggtccatctgtttgtcccgaccgaaatgttctctcaagctgaattgctgatgcagttatgctgcacaagtgcacagtttttaaatataaatccttttgagtccgttgaaatctactgatattctagtggcagttcgaacagtgagcaaaccggaaaagtttggtggtgtttgaatctcctgataataaagatgaaaataaagattaagtgtttcacgtaaaacgaggcggtaataacgtgtgattaattaagttttaattattataaacttgaaaaatagattaatctgacacttcctccatctacttttgatagtcatatttcatcttggcacatagaacaaggataagtaattctacttatcatccatttaaatatactactagtcattcctcgtaaacaagcgattcattaatatttatatttctcgatgcctatgtagccaatcttgtgtggaggaattgagagtcacgcattaaatctgaaaaagttattaagatgataggttgttggattgaaatatgcatatcaaaaataaattttccagatttggaaatatgactatccaaagtagatggagggaacaactttcatatggaaaatttctgtacgaaatgcactgtttagcagtttaaaagcatgccacgagtatccaaaatttcatccaagagttatgtgaatagtttttgtgcgtgatggtcaagtaattaatggtggtgccacgtggttcgccggcgaacaggcggcggagagcttgaaggagtcactgggcgtgcaccgtctggcacacaggatctacgtcgacgtcgatgtcggcgcggcgagggtggcgcgcacccgcgaggtggagttccacccgaccaaccccgtctggaaccagtcgttccgcctccactgcgcctacccggcggcgcccgtggcgttcaccgtcaagagccagcacctcgtcggcgccggcgtcctcggcgccgcgcgcgtgccagccgcgcgcgtcgccacgggtgagcccgtggagggctggctcgacctccgcggcggtgagcatggccacgcgacgcacaccccgaagctccgcgtccggctgcggttcttgggcgtggagtccgacccgtggtgggacgccggcgttcgcctccccgggttcgccggcgtcacgccggcgttcttcccggagaggagcggctgccgcgtgacgctgtaccagaactcgcacctgtccggcgggttcgacccgggcgtccgcctcgccggcgggggggcgtaccggccggcgcgcctgtgggaggacatgtacgtcgccatccgcgacgcgcggcggttcgtgtacgtcgccgggtggtcggtgaacgcggatatcacgctggtgcgcgacgcgtcccggatggtccccggcgccgagggcgtcacgctgggcgagctgctgcggcggaaggccgacgagggggtggccgtgctggtgatgccgtggcaggacaagacgtccgtctccttcctcggcaacgggggcctcatgaggacacacgacgaggagacgcggcgcttcttcgagggcaccaacgtgcgctgcttcctctgcccgcgcaacgccgacgcgtcgctcaccatggtgcagagcatcgaggtcgcagcggagttcacgcaccaccagaagacggtcaccctcgacgccgccgccgcctcgccgggcgacgcggacggcagccgtcgccatatcgtcagcttcatcggcgggatagacctctgcgacggccggtacgacgacgagaaccacacgctgttccgggacctcgacaccacgtaccgccatgacttcatgcagaacaacttcaagcacgccggcctgcggcgcggcgggccgcgggagccgtggcacgacgtccactgcaggctcgagggccgcgcggcgtgggacgtgctcgccaacttcgagcagcggtggaggaagcaggcgccgccggagatggccggctgtctgctcgaccttagccaggcggagctccctgaccccggcagcttcggcgacgacgagccgtggaacgtgcaggtgttccggtccatcgacgacgcgtcggtcgtcgggttccccgccgagccggtggcggcggcggcgatgggcctgacgaacggcaaggacgtcacgatcgaccggagcatacaggccggctacgtcgaggccatccgccgggcgcggcggttcatctacgtcgagaaccagtacttcctcggcggctgcgcgtcgtgggccgaggaccgcgacgccggctgcctcaacctggtgcccgtcgagatcgcgctcaaggtcgccgccaagatccggcggggcgagcggttcgcggcgtacgtcgtgacgccgatgtggccggagggcgagccggccggcgactccgtccaggccatcctccggtggaaccggctcaccgtggagatgatgtacggcatcgtcacgaaggccatcgacgacgccgggctgcgcggccaggcgcacccctgcgactacctcaacttcttctgcctcgggaaccgggaggcgccgcgccccggcgagtactcgccgccggagacgccggacgttgacacggactactggcgcgcgcaggtgaaccgccggttccccatctacgtgcacgccaagctcatgatcggtaagccaagctctcttcaacctctgccacgggagctctcacctctgcggccgcctcaccaccgtcttcttctccgcagtggacgacgagtacgtcatggtcggctcggcgaacctcaacgagcggtcgctggccggcaaccgggacagcgagatcgcgcaggggagctaccagccggcgcacctgaacggcggcccgagcggccgcgcgcgcgggctcgtgcacgcgttccggatgtcgctgtggcacgagcacctcatgggccacgccggcggcggcggcggcgtgttcctggagccggagagcgcggagtgcgtgcgcgcggtgcggcgagcggcggaggcgacgtgggacgcgtacacgcgggacacgatggaggacctgctggggcacctgctgccgttcccgatcaccgtgtccgagttcggcgaggtggccgacctgacggccgacgggtgcttcccggacacgacggcgccggtgaaggggaggaggtcgttgaagcttcccgccattctgaccacgtgacgccctgagcttaccgtgccgtgccgcatgtacaaaactttgacgcaacgatcgtctcttcacgaagccgaacaagtgtacatgttggattggatgttgccgagtttatattgagtgaatccaagatacgtcactcgtgatagccactgagtgacaccaaaaaataatctagtttttctttgagtaaattgtagtggtggtacacaaacttattaggtgggtgcaatttaatatacaaacttataaaatgtttgtttcagtatacaaatttgtctagttcgtgcagacgaggaccaaaataacttgacaacgttaattttacgaagctgatgttgattagaatgtgacgtgcatacgtatagtgcgacatatataaggcatgtaatatttataaatttggtctctactttatccttcatcatcgaagtggtgaatttcatatatttctaactttgtatcttgcttagttttttttaatctttttctactatcactatatcttattctactttttattgaagaggtgtatgtctaatagcaaccttctcagatatatgtttacgtagtattctaatcagcccctaaataaaaaagattagccatgtagtgtcctttttgccttcctccgcaccagacaagttcatgcaccgaaatgaccattttacatgttcgtgcactagattgcacacacttgacaagttcgtgtaccggcgatgcaatttactccttattgagctgggacatgggaaaaaaaacaaaacctgaatttcacaaaggtttagggtgtgtttagttcacgccaaaatgaagtttggttgaaattggaacgatgtgacggaaaatttagaagtttattcgtgtaggaaagttttgatgtgatgaaaaagttaaaagtttgaagaaaaagtttggagctaaactcgccttagctgatctttgtgagaaatccagcaatattcgtgcgaaatctgaactccgactctgtgcaagtgtgagcgtataatgtggccttgtttggatttcagcccgttaaataagaacaccaagggccgggctcctcgaagttttgggcctcaacacgaacccgtttcagtccttcctactagtatttttcatctttctctctcctttcttctagcgggaaacccaaaatcggcatcacccacgcgaaaagtcgaaatcccccatttcgccctccgctccggccgctgaagcctccgacgggagccccgccgccgccgctgcttcccggcggcgcctcctcctcccaggacagcggaggcggaccggacggcgatggagcggatccacgtcgccgtgcgggcgcggccgctcacggcggaggacgctggaagcagcccgtggcgggtctccggcaacgccatcgcgctctccacccagccctccatccgcttcgagttcggtaaggaactcgcacccttccgccccgttgctctgctgccagcttcgattccttttggcttgagggttcgtttctcgcagataggatattcggcgaggagtgccgcaccgccgacgtctacggggcccgcaccaagcacatcgtcgactccgcagtaagaggtttcaacggtaataatctgtggtacctctgcatcctattgctgatagcggcgttttctaggggaagctagttaggtcgtgccttttagttatttgagtttttttttgtgtgtgttttagattagttgttttgggcttttggctaactataggcacagtggcttcttttctcaaccaagctatacatgcattaaaagctaaccatatgttttcacgcataacaggcacagtttttgcatatggacaaactaacagtgggaagacttatacaatgagagggtctggtaatgaacctgggataatacctcttgcagttcatgatctattcaggactatcgaagaggtaaattctagaaattcgtataatttaacagcatgcgaactatatatcatgaagtatctttcaaggtgaatctataaacatatacgttatgatgttgaactatgtaaatttgtagaaattgattttcaaagatataaatgtttggtttagcacaaaactagaatggaatgtaatttgaaactgagggagtagctgtcatatcctttgtttgcatgatggtaacaacaggagatatttatttatatattgatgtgtttggttgtgatcttctagcactttggttgctttctaaactgatcctgatgttgttttcataaagaccaaaacaatgctgatgtaacctttcctaaagaccaaaaagacttgctaagtttatatacagaggctttataaaatacccttatcccattatgtcttcgatatgggatctccttcatatgttctactcttaacctgggagtttatttttaacttaaacttttttcactattttttttagcatttggacagagaatttcttctccgcatgtcttatatggaaatttataatgaggaaataaatgatcttcttgtcccggaacatcggaaattgcagattcatgaaagcatcgaggtaaacaatccacatattataatgaaattcataagttttccattctttaataacatggcaatgctgttcttctgaagaggggcatatatgttgctggcttaagagaggaaattgttacctgtcctgaacaagtactggagtttatgtcatttggagaatgtgagctttttttatttgcttgcttgcactgcctattcatgatttatgatttttaataattatgagcaaaactgcagctcaccgtcatattggggaaacaaacatgaatgtgtacagcagtcgttctcataccatatttcgcatggtatgcttactctccactgtattatctgttgtcttacaaaacaacatcataccttgaattctcacatcactaattactcaggtaatcgagagtcgagaaaaggttgatgaaagtgaagcgggagagtcgtgtgatgctgttcgagtatctgttctggtagataactgtccaatgttaaaaaacaaaaaactaaccagcgtgtcttgtatgagatgtagtacttatttaactataggcttttgagtttttgcacactgtaatttatgctcatttgaactttcagaatctggtagatttagctggttcagaacgtgctgcaaagactggtgctgaaggtgtgagacttaaggagggctctcacattaacaaaagtcttatgacccttggtacagtcatcaagaaactaagcgaaggcatagaaggtcaggggtaagttattaacttgttaactagtggttttagttgctttgggttgtttgtggttcatctgattactaatggaatttgttatcagggggcatgttccttaccgagatagtaagttgacaaggattttgcaacctgctctgggtggaaatgccaatacagccattatatgtaatataactcttgcacaggtaccagctctcttctatccatcatgttcctgtattgttggacaatggaagtagacataaattcttctagttttctctccctcataatgaaagaagattggtggattagtttaaaaatgttgctagattgttgtgcttggtattatctattcaggttactgcttgattgatattctcaagtaatgtgtacaatatgtaaactatgcttaagcaatgtatttagtagcataatttggacaactgaagtaattttttaggtatcattgaatattatagtcttaaatccaaacattcctatttgatttaccttttagcatatgtcctcgctgtttactttattttgtgttacaggtccatgcagatgagaccaaaagcagcttacaatttgccagtagagcattacgtgttacaaattgtgcatgtgttaacgaggtattgaaatatctgttaatgccaatcattttactctttctgtgcaaagagcaaaatatataaatttgaaacgcatctttctgtaaagattttaacagatgctgcattattaaaacgccaaaggaaagaaattgaagaacttcgagcgaaactaagggtatgtattgaaaaagctctgtttaagttagtacagcttgatcatgcaaaacttatactttgtgtgatcatagaactcgcaaagtgaacattgggaggaagaaattctgaatttgcgaaacacgctactgcaggttcctttcttatttcttaagcatctctggtctctgttacttgctatgtagcgccttaaataatctgactattttgtctagagtgaactggaaaaggagagaatttctttggagctggaggaggaaaagaaagccaaagaacagcgtgataagaggttgattgagcaagcaaagaaaattgaaaaccttagttcattggtattaaattcagaaagggatgatagaactactgtttctagtaaggtaggaatgcagtttatttatcttaccagcacttgccataaaatgcacttgaacctcatgtttttttctttcttattggtgctttatttccatttagcttattgctctaccctcctttctactaaaaaatgtgaatattttttagacatttttagcaagagggcaacaatttttagacaaataaccataagaagtaatgaaagtatacctcagttacacaggggaacataatagtcttatggctttgtacttgtgctcttcaaacagaacaaaagacggttgacatggtgtcctggactactctctagacaatttgatggtcaggtatgatttatcagtgatgcttgctcacacctttgatcaacatgctgaaaatataaagtctcattgtttgtttcggataaacatggcattgttggtttgttgctcatattatttccaaattgctgtttaagatatcctcccaaaatgttcatttagattgctttgttgtgaatgatttacctttttttactacaatttctcttttgcgtgatggggtagattacatgatttcaacttttgggtactgtctattgatgcatgccatgcttttgtaaatgctcgctattaaatccttttcatgtttaatccattgcacgagtttgtcaaattacatagaacgccagatcttgttaagaatgacatatctacaaatgtccaggttttagagtctgtgcaagaagaccctccgagcagcacagttaggcatggacgtaatatggagatgccactgcattttgaagagctaatacaagaaagctgtgaaagcagtattaaacattatactgatgcttactcatctggtagtttatcctgtgaagatgattctcttccagattcacatgctttgctacatgttaccagccgaagaaagccaaatacgatggtgactgactctctatcttaattttattaatgtcaacgcatcattattgaattttatatttcttaataaaatagttatcatttttcattggtcacatttctactgactgttgaaacacgtggccttgccagaaaaaatcagatcaagaacagcttatggggttggcgagtgaacgaattattccccaagaacttaatgactggaaatacaccacacaaagtcaggaaaacatcaaagcttgtgttaatggtttatctgctcgagaatcagaagcaattcttgtcattaagcaacttgaagatcaggtgcctaattattcccctattattatcctatcacacaatgacttttccccctaccattgccctattatgcaatgacttttcatccccactattgtgctattatgcaatgactttgccataacatttccttaaaatccaaagcagataaagttgctggagttagagaagagttcttttcaaaataacttggatgatgttcttgaattagcaactcagcagaaagcttctttccatgagaagtacgaagaggtgaataatcttatcctgtttgttaaaagttcaaacatgtccagtgttgtgtatattcttgtaaatcctaaattgtgtatattctttgcttgtttacagcttcagcagaatgctctggttgcacaagaacaagctaaaattgctaatgaaaagctttccaaacaagtactttcttattctcttccagttatagcaattctcctttcctcacaaatggcatattttggacacttaatctgttttctattttgatttcatagtcgattaattaacatgaatgattcttggataaaacatttgtatgaatcccaggaagcagcatatgaattccttactggtatatttgtggagactgaaagcatagctgtgcaaatggatcaatcaacacgctcagttgacaatgctctttctttcattgaagagctcttccagaatctcttcatgatggccaaaaacttcactgtatgacagtatctccatagtctatttcccaatttcttgataatcatgccatttgttgaattagctgtctatttaaagtttaccatcgacaattaccaaccattttgctccattatatatattgacctatgctatggaccggatatgggaagggtgcgaatatcgtcgattggacactaacccttgcaccagcagggcttctccatgctgacctaaaagaggttgagaagcttaaactaactttagagcttcattgatagattgataatagagtacatcgggtacctttatatatagggaggactaacttgatatataaggaactaatatctaataagctaaaagaggttgtgaggcttagactaactttagagattcattgattgattgataatagagtacatcgggtacctttatatatagggaggactaacttgatatataaggaactaatatctaattttgtagaaaccaatctactgtctgtaatgtactaataaatcttgtctccttaccaactagataatctcctaatttattatgcctaaactgttgcattcccataaaacctatcaacccacctgaaaatgctctttgacatcaaatgcaggataaaatcttaagaagttttggctttgttctaagtttgatttaggacaaaacaaaaatatcttgtattttgaaacagagacaagtatttagtactcaaagaaattttcgtgtgtgtagtaccatcaacatttttgggtaatgagccagctacattgctataaattgttatcaacatgtcattttttaaacttccaatatgcaaa

SEQ ID NO: 69896 - DNA, 10204 bp, Oryza sativa
tttccaggttagatcattattctatcacattcattcttgcaaaatatctaccatgatatgaaaaataaagaatttctacctgatatgcttcttgtcaggaggatgaggaagcagcagatgatgcagatttttctaccccagcttggtagaatcactgaaggtgttgaatgataaggctgtacagattagcacaacaaattcttcatattggctcaactcagaaatgggatacccgcatacgttcgcgctcatggaatccggtaaactgtatgcctttgggggagggatcaaaggccagcttggtgtcaagctctctgagggtcaagaaagagctcagaacccagagcgagtcccgatcgatctctgctaatttcaaccagcattctggtgaccatttgcaatgacatattctgtgatctgtggttagcatgccctcctgaatttcataggaggaactcaaatgttagcatcgatgtaaatactaggggcacttacctttggttcttctctgaagtaacagtgtggttgttggtagttcttgcattttgaattgttggtgcagccaagtcctgaccgagtcttctgaattgttcgtgtgtggctttagcctcttgatttctagcctcattctgcatattgcacggttagcagtgagatcattgcatggttgaattcttttcaaactcatcacgtaggcagtcttatcaaaattagctatagttggaacaaaatcaagccttgaaatctttgctatacctgcaatttcagacttgcagtacataagtaagagtcagaaattatgaaatcccggagcaaccgtgggcaggaacaactgtgggtggtggccttggccgaatcgctgaagggataatgttgttgaccgacgacgatccttcttgtgcggattggtggtgtgggtttggacagggaatcgcgggcgaaagccttgccgagccatttggctggctgacaacggcgacgccgtttggcgtcgttcccctccttggaggcgttgttttagcatacccctttcctttccctaccatattctccgggtgaaaaccttgcttcggttctaaacaagcggtggcggcgatccacgtcgcatcctccttgggggcatcgctttggagaaacctcttcgtgcaaggatattgtcattggtctatgcattggcttcaaacttcagtcctaggccttgacaaggccttctagctccacattttgttttgcttttctcagtttgggtcctctcttctcttatttggtgtgttcaacttgtattgaactaacactctcttctggagtggatctttgtaataattggttgtagttctttttaagcaaaggccgggatattatattccattatctaaaaaatgaaatcccggagcaattcagaggaaagagattattactagttaaccttcatcctaaaatataaggaattttagaattttggctatgcatttatatgtatcgtcaaaattaggaaatcccaaagtgatcatgaccagttgactactaccttcatcccaaaatataaataattttggcttcatcccaaaatataagaaattttggctatgcatttatttgtatcgtcaaaatcccttatatttcatatttcggaatggagttaatactacgtaataagcatgagacatacaaagatcaaaaccaaatcaccaacaaaaaaaacaatgtcgtaatgctacaccgtcaccaacaaagattatacagcagcatgaaacatatattttgcccatgccgttcggtcatattgtttttgctgctaggctagcaaaaactgatgaacatgtggaatgtattaccgaaagagtggatctatctatgcgcctgctagatttgtacaactcataacagcgaggctactgcaggatccccctcggtccccaacgtcagttgtaccatgctgggcagtgcagctggatcgcgttgggggtgccactggtgatgtctacagaagctttgcgccgtggtttagtacatccctttgaaaacaggattcgtccggcagatgcttgcgccatactcttcatactctgcttttgtgtggcaagcctggttgggaaaactaccagaattagctttaatttctaaaatggaaaaaggaaaaagaaaccccgaatatggggatatattccaacaaaaaaatttaagctttggaaacaacttgcaaaagtaaacgctatgcactagtttcaagtgatatgagtgttcattactactgtacatagaaatagaagtttgaatacctcgtagaattcagcggtagaggcaagcacagaaccaccaaaccagacagcatatctttgaataggatggctaactacatttacttctataggttgggcctgaaataaacagaatgtagctgtagcttccaagttccaatatcacaataaagtttctggtttggccagtgttcttctgcaatcaggagagagccagagcaaacatgaaaagtttgtacctttgcatctccaccaagtcgagcattagatgcaaggactcgtgcatccactatcttttttaggtcccgctgcagcctcctgtggaaatccttaaacatagttgatcccccggacaagacaatattctgtccaataaaatgaaactcagaaccactgtgatattttgaatcataagacggcattttgataacacaaaccttataaagagcccttcttgtgtcaattggggatgattggatgcacttgtcaataactacatgcaaaggagtggtgaagtcattgttgtaaatctcagggtggaagaaaatctgcatggttcacagcaacgtggggaaattagattaaaatgatagtgcaatcaaaatgtttagttagaaaatgcatcagaactactagagatatcatgtacaaagcagttatatttatgaacataaagcctgaactcaaactggtttatccatgaattggagttaaattatgatcgcagttaagttttgaacctaaatcaaatgttacattgtagaagccacagttaatggtgaacacattaatgcaaaatcaattacctcaggccctaggaagcgttcatatccaatgtcgcaggtgtatttggcaccagtttttggtttgatgccactccagtgctttatgtacttattgggctctctgtcatgcttattaaattcctaaaaaggcaacaataaagttatattattatttttcttttcatctcttagggactctattttttgtcgtacaaataacaaagtcaatggttcaaagctgggaagaaccgagacaacatattcgatactgaaaacaatcaccagttgcaggaaaaagtgaatcagaggaaagcagatgcattgtttgacatcaagcatgctggaacagtgctttacaaaattagattccaggcagggtaagccttaaatgccaatgcctaggctgctataactgtgacagtcagtcaactgcaatgctattatgaggtaaaagcaatccttccttttgaagtaacactcatcctagaataaacgagaacatatactatccatgtttcaataattgacagttcatgtatttattgtagtagttaataccttcacaatatctgaacatgtatagcagtacatttctttcactctccttgccacatcaaaagattcttctggtggaatgtgctcacctctttcctgcaagaactaattggctcagtgacttataagtgcactgccattatgcagattcgctatataaaatatgaaaatctcaagaaaattatgaggtaaacttgttatatatttatatatcctttcttgatatatcacactcccaagtcccaagtcaatttcacatgcaggttaaatggcacaagaagagaagttgtctctctcatcacatacaggtaacgataatttcagcttgtcctctagtcttaaccatgtgtattcatttgttcagaatgatatacttgatatgcttatttgacaaccacggtgaggtgactcaaataatctcaggtgtgtttacaaaatttgccatggcgcatgattgcagctgcaggctggagttgcttgtaaaactttgagtggaatttattgtgcatcattagataaaaattgacagttactttccaccaattctacctctatttcatgcattttatccctttcattatttgtggctgttattttcatgaatctttgatttccttgtgcagttatgatggacatttggactctcaaaggcatagatccacagtaatgtaagatcagtgacatctgttgacaaatagaaggttaagtactatcttgtgacggcccacaagaaagcaatggtaactacctttaagagttgctgaataaactgggtaacatccttgcctgtaattggaattgatctgatgctgcttcctataacataaccatcagcaacaggaacaatgtgggtagccccatcacccacatcgactacaacacctgtcatttcacactgaaaacaaagcatgaaattcctcataaatatatctctcaacatagacgaaaggaaaaagaggggcaaataatgtagtacttcctccgtcccaaaatagttgtctctttagggtttaaaatttatcccacaatacttgtcacttaagagtactatatgtccaatcaatcacctcctattcaaatttctacacattctatcctcaacaacctcacaattccattcaaatgagaggcactttagtctttgattgctaaaccttaatttgtgctaaacaaaccagaaagacagtattgtgggatggaaggagtattgtagagcaaactaagcacaactacgaagctcaagagtccatgcatggctagaaataagatgccaacacaatgagctttcaaatgaaacagaaaaaccactatagaattaaaatttattggaaacgtaaatatttcaataatgtagtctctttcacctatcaaattaaggttaagcagaaatattgcatattgaaagcgtgtaataaaacagttcaactacaacataaacatggccttgagaacgaaattcatgttctcatctcaaggaattcttgctctactaacctttgtggtggtgtatcctgctgcgagggcaagaaccggctggcacgctatgtacagaccaggcacattgaaagtctcaaacatgatctccccggtgtactcgcgggtctcgggaggagtcagggggctctcggtgagcagaaaatagtgatcctccggatcacaccgcaggtaattgaaaatgcactgctgccagaacctctccatggtgtcccaattctcaacctgaatatctagcccatatcagcttgagtaaatgaagctccgcaaactaagatagcaacgcagagtgtcagaagaggaaattaacgctcgctcgcgcgcgcgcgcacaaacctggccattgtgaattggatagctgaggttgtaggtgttgctggagcgggagcgggccagggcgtcctccccgatgaagaagtcgagatcggccatgacgccggcgctgtgctgcgccatccagttccccttggtggtgttggccctggtctggccggcgaaggtgtcgttgacggcgacgacggtgggggtgatgaagcagggctccacgttcccggcgaaccccatcttcgtgtacctgcgcgcgcgcgccacccattctcatcacccgcctcagattcgccgcggcgcacgctctccgcgcgcagatctggaaagagagagagagagggaggcttacccggtgccgttgtcgatgacgacggcggggcgggaggcggcgtccatggcgtcgcgcgtggtcccaccgcaccgcggcggcgcagtcggtcagtcagccagtcagtcaccggcagcggcgaggcttcccccgtccgctttaaccaccaccggccgcggccgcaacgcggggaagaggaggcgagagcgggtcggcgtcgcggcgggcatcccacacccaccgccactagcttctgccgcccccagcagcagcagcagcagcaaccacctccacgcgcgcccgaagcggccggcaccgaccgaggaatggaagcttgtagaagaagcgaggtatcggggcggcgcggcgcggcgggaggagaagggagtgagaggggggcttggcttttgcttttctcggggtatcgtgggatttgtctcggcgtgcgtggtggtttccgtgtttggcgtcgtaggcgtaggctctcgcacgcacacgcacgcacgcaggctgcggcggccgggagtaggaggagacttgggggacgttggtattggtgttggtgttgctcctcctcggattggtgtggtggtgtggggttgtgggggtggggggcgtgcgggatgattgcgacaccgccaccgacgccaccgtgtccactctgcggtctccggcacgggtgtgggcgccactgacgtactcctacgcagggagttcccggttgagaaatgtgggtcccatgtgacagagggtgatcgtttttttttcccccgttttaatgccaaccgttttagctgatacctgaagaaaatgacccctacttggcccgatttctgcccgtcattcagcaatacggagtacttcatcttcagaaatggagtaagttaattttgtccacggatatagtaataagatatgtcacatatcatactagattaacttatcttaaaacagataaattatattttgcccatcctaaaatgccaatttctatatgtcattcggtaattcttcctcctagaccatgcagtactgagtttcaattttaagatggagatagtatgagttattttttcttttctgcggcagaaattgataataatgagtaatgaagagttatagtgatagctacttggttctgccaaaataaaacaatgcttcgttgaagaccccaaacaaaacacaatgagctttcctaatccctccccaagaaaaatgatcctccgactcctccgagtgcgtgccgtggacacgtacgaaatcaaatgccatagcgtacagagctcgcacggggagacgttgccgaggctcgtagggataaaactagctctgcagctgctcttggccccaggaaaaaaagagaatgcaaccgcgcgtaggaaaggctcgaatttttctctctctgttttttttaagctcatcgatgagctccagaaacaagagattcttctcgtaggacatcttgagaacactaatgaaattcaaccaaggcaaagagaggccaaatggtagaggtgtccaccaaaaatttcctactatctttttgacctgtctgtctactctgaaatgctctgacatgaggcatggcctatatatccattgctctagccacaactgctcagtgttacggtgcaaggtaattaatttgcagaggcaaagcaagatgaggttccttggtctcctgagcttggttgctctcatcttcctcctcagcttcaggtctctgattcatcagcaagttcttgttggtaagttttactactactactaactttctgccagcttttatgaatgctactgcctatctgaagagcattcagtgagattgctactggagggaagagtatgaaactgatcttgttctttccgtggaaggagaaggcgcagcagccagcgggttcctccatggcagcggcgacgacggaaggaggcagcatgcgagggagtgggaggaggagaggaagaagatgaggtggttcatggtcagggactacgcccacgcgcggcgccacgagccgaggaacaaccggctggatccttagcgtgatgttgatggcttgatgccttgatggcgctggatataatggctagtcctaagctcatgtttaatctgtcccctagcaagtgtgcagcaattttcacacaaattttgcaacccctgaccatagaattcccttatgattgtagaaatagttctatcttttgtgaggttttgtaaggagtattcaggttttgtagttttgaaactgttttagtatatgttgggtaaaaatacaagtcttttttatactttctagttcccttttctgcattcatctttagaggtgtttgcagattgtaaagccgctggtgaacagtagtactgatcatggataactaaactgcagcctgatggagaaatggtaagcaaagattagtgtccctatagcactgcaaatgctccttaattattttgggttttaggattttcaaagttcgaaggagaaatgaaaatgatcatgagggaacttcaatctgaatatcctcatttctggtgccaccagtgctatcctacaggatgtggcaatctgaatagtaaaaaaagtgtcattgatgttagtgaaatgcaatcacatggttcatctagggctccgtagtacttaggagtcaatgaagacttgaccaagggttgttcacacaaactctaccggtaattattcagatggttagtacggcttgttttgttagtcgtagactcgtagcttgtatatagcatttgtcggtgaagcagctaaaactgaggtctacttacagtacctgggcttgttgcaactcagcaactgatagtactacataatactgctagtactgatttacgcatgatttatgcattgatagacagaagggagtagtactttaatacggctactccgctactgatttatacattcttcaaagttaggcgtgaaaactcatggctgcacttattatgggatagaggtagtagcagttggatacacatgtactaatgactagtacgggccgaactctgcactgtacaaatgtatacaagctggttggtaaagaactggccacacaatttgattgcggtttgcaggttgcaaaatttcagcatttcctcctctcaaaaatttgcaggagcaatacaacaaaagaatgtcctcccagactgctaaatccttttttcctgaaagaagcttatacccaaaaaaaaaaaaaactatgctttgccttcctgaacttgtatcaaatctgtattttttttttccttctatctatctgaatctggctgctctactcctactgctgctgttgtactttgcccatgacttctgcactatctccggcgctggcaccggcctcttggcccatgcagacatcaccctagctctcatcaccttcttcacaaggagcttccatgtcttgtccactttccctttttccatgttagtcttgaagttgctggagcaaagggaagaacgtaaacaaatgaacggaagggttcattattagcttttgacatggcaatggcatgtggcatcaatcaatcaatctatctatctaataatatgtatctatctatctattataaaaacaactagaaaaaaagggtacaaattacttaggtagtcagagaagaaggaaaatatttgattcattagatcttggtgggtgtagattgatcgtatacaatgtacaactgtatctatagaacataaaagttaagagttgtgtgaaatatatttcatttaaatttgtggagtagaaaatacagttgtatctattgaaatggaatataatttaagtgttatatatatcaaattcagtcataccttaaaaatctagccttaaaaatctagcaccgtgtcatttgcaaggaccatcccaggttttattaggttatattataaaatagcgccgaaagaaggcatcatgtttgttgtatagacttagaaattaccacattataatagaaaaaagttagccgtaagatcttgatggaccaaattataacagtgtaaattgatagctatgcaaagtacaattgtctatatatagaaatagaagaaatgagttaaatattaaatttaatcctacttttaacatccatatagtactccagtatatagagtaggagtttagagtcgtatacgatgaatccaattcaacaaacacgtactgtaaatttgtacggggatatttcctagctgttcttcatgtgtgattatcctttatttttgtttattgtttacctgcaaaggggaactccgcaagaatcgtcgtcggacttgtcgcagacggaggagtgtagccggaggagcaggaagaagcgccggcagggcgtgcagcctccggcgactctcctgccgcagccggcgaagaagtgcctcgcgagctgcaggaggccccgccggtgcgcgcagggggaggccatcctgcagcactggccggtgcgc

SEQ ID NO: 69897 - DNA, 585 bp, Oryza sativa
ggtttgatatcaccatgaaaaatgcagcggcgggaatgcgagtgcatgtaggtaagagctttcgcagagccaatggcaatatccagccgtttcagcagcgggagagcgcaccgctctgccccatgaaggacgctctcgaggctaccattagggacgaactcgaagaccagcatagggacctccacctcgaggcaacaaccaatgaggcacaccaggttgtcgtggctgacttgaagttgcaccgtgatttccttcacgaactcatccttgccacgagtccgcgatatgctcttttcgatggagtacttgacggcgaccggctgatcgtcgtgggttcccttgtagaccacaccgaaggcgcctttccctatcttgttgcttttgttgttagttatcttgtccaattcctgctttgtaaagattttaacgctcgtcttctctagcatttggccaccattacggtcatagcaccctttaagcttccatttcttacgtaagcacacaaggaccaaaccaaatagcacaacaccggctatcactgcaaatgcaaacaaaccaattaaacatataagtaactaggtgatt

SEQ ID NO: 69898 - DNA, 674 bp, Oryza sativa
atgttcgcctcacccaaaagcctttgacctgccaggggcctaattgcaataatgccttgtccaaaaacgcattgcgaaaacaaacattagtggaacctcacttcctgaattttctgatcttcagatcatccatgtggcagacacacttgctctaatctctctctctctctctctcttttcccccattctttcatctgcttgaagaagcatcgcaacttggattccaggatcgtgccactgcgatgatgatgatgagcatgattttgcagtagcaacgtgcgtcgttgtgtggctgcaagctaggatgcgagctggtgcgtgccaacaaccacgcgaggtcactgctaccacaaataaatcagagaaaaaaagacgtggagtggacggaaattcctctctcctctctcagctgttcaggcaatcatcgccatggagcttggaccaaaccactaatctgtccacttcttttttaataaaaaggatctcccaacgaaccacctaatcagcaacacctcaactgtttccagtacgggaaattccgacccctcaacatcagccactaaccacgtttcaaaagccaaaaaaaaaaaaagaatcagaaccttcctctgttcaaagaaatcggagacgatatcgatttttcagctggttttgcacagaatctctccgaaaga

SEQ ID NO: 69899 - DNA, 553 bp, Oryza sativa
attggagtgcttggcaaatggcaatagagcatattaataacttctacaaaattaacagaacaaaataaaatccagaagcaagaaggcataaacatataaagaaaataaaacctacacagtattcaagctccctacacagaatgtaatataaccaagctccttagtacaaagaaaataaaagacatcaatcattcaacattcactcaaatatatagagcctacacagtaacactaacacagagtgacagaggtggaggttaaggaatgaggaataacacctgctggttgctcagttgctgccgctgggctgctggctactgcgaggcgaggagtcgtcggcgttggtggcggtgaggaagagtcgccagtggggcttgaggtgttatcggtggtggtggctgtcgcgtcgtcgtcggtggtggtggcggcggtgaaacggcgagacgtggcgggacggcgtcgtgagataacggggaccgagcaggccggcggaggtgcgagatggtggcggcggccagcggggaaacggcgaatagcgagggcggcgcgagat

SEQ ID NO: 69900 - DNA, 500 bp, Oryza sativa
taggtttgcagcaattagggacaagctatgaatccggtaactttttcactagttggacaacgcctcctaaacaaaagaaccgtgccaaacttttaagtgatcattctctatttgaactaattccaattcttctcaccaccctgtatatgtaacttcaatttcgggaactgagaaattgctattacactttacagggaagcaaagcctgtgggatttgcagagagataccctgctcttgtcaccggtttctttttcttcatgtggtatgcttactcacctgagcgcactttagaatttacaattgcaggtgagcgaactgagaagttgctgcctaatgtggtttagctattgccaattcacaatatgattttgtaggtattttctgaacgtgatatttaacatccttaacaagaagatcttggactacttcccctatccatagtacgtttgctttatatgtgtgcctccttttctttttcctttcatgtgacaacatgcat

SEQ ID NO: 69901 - DNA, 2118 bp, Oryza sativa
ctctcccggctgacgcaataaatgagtttttaaattaaaatttaaatgaagaaattcgtaaatatccatttaaagagcatataaacttcaaatggccataacttggccatttgaactcggaattggaccgttcaagtctctaatttttccttaagaagtcaagacccattttgtgtgctttgtcctgcgtgttatatggagtttattagagtaaaagccttttcttttccgttggtcgtgtagacgctgcagcttcggaagatccgctcttcgtggaagtagaagccgacgtttgggaaagcgagcaaggcaagtcacatcatccttgaacatattggatcccagtttgtaaaattatgttgatttaaattattgcattatcgctttatttaaattcccgcgttatcactgttttatttagccatgcctatttacctttgttatgaccatattattattgctattgttattattaccttgttcaccctagaataaataaaaccccaactagtgggtactctattcatggttccactagtatgaatttaggtagatgcttcgctgattaattaggcaacattaggtggttttataactttagactttgggaattctcatatcatttggatactatggaatgtttggcttatggtggaattggacatacccctctcttcctctttcaaagcccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcaatcctgcctacctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaggttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataattttgtgtagctctagggtcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctctatctttctcccccccttcagtaagagaagctttggagaagaagtcttaggtggagtcttggcttataccccagttgagcgcctgtgaagatggagccgtaggcccgctagtccgctgctgttaatttttgattgtcaggcttgaagcgcctttgtaataatgtaaatattatcgatgtaataaagatgtgtcttttatatcatgttggttgggtgtacccctgcttttcctgggacggggattaatacattagcgttcgggaaaatgcaattttctcggtcgcgacagccggcgatgataggtggatttggtaattggtttgtccgattctgataggtgcacctgacatggcatttccacgattaaataatatatcattctggttgttgccaccaagtctcttgctcctattaagctcagccatagtagaagtgggcagcggcactgggtggacggtctatccgccttaagtggtattaccagccattctggaggagcagttgatttagcaatttttagtcttcatctatctgatagactactgt

SEQ ID NO: 69902 - DNA, 1998 bp, Oryza sativa
caaggaattttctggtcgaaccaagcctagtcaaatcatgtggtgagcttagctttcacctctgatccaccaactaatcatatattaaaacaacacaaagaatatgtggaccaagttagcaatttggattcaaaaaagtttttttctgagtaaagtgtatggacggtccttaaatttatagcggtatgtcatctaggttcttaaactctcaaaatgcatatacaagttccagaacttgtcatagtgtgtcatctagatcccaaatcgccacagccccttcaggatcctacatggtgcttgtggtgctgatgtggcatgtcacacggacatgacgtggcataattttgactgacaaatgggacccatttaaaaattttcttttttcttttttttcttctcttgtattttcctttcttctcctttctctgtgacccgagcaaaagagaggaaaaaaagaagaatgagaagaaagcggaaaagaaaaagaagaagaagaaaaaaagacatgtcacgtccatatggcaggtcacatcagcgccacgtaggatccaagaggggatgtgtcgatttgggacctagatgatacattttgacaagttctagaacctgatatgcattttgagaatttggggatttagatgacacaccgctacaagtttaaggaccgttcgtgcacattactcttttttcttgtggaaaaagagctactcgtttgtgtcccctccttccaatctgttgctaacatggcaaccttgtaaccccggttcacaaaaaaccaacacattctggcactttgggcataactaaggggttgtttggttcttaactaacattgtcataactcactttaggcaatgttaggcaagtgtggcttgccacactttttgtggcctacaaattgtaagccacacttgtggcaaagttagacaaataattgagtctatgacatgtggggtaagatggtaagaaagtgtggcttgctatatctatggcaatgaaccaaacacaaatctaagaaggtgtgacagtctaaagtgtagtgtggcaatttgaagtagtgaaccaaacaacccctaaggtacgaccttagtatgctcaggtacgacgacaacaaaacaagcaatccactgaaactcttaactacagtctacatgcgccaaagtaatctatctcaacagtcaaacattccactggaccttacaatacatacaccaaagagagctaactccagttatacaataaatcaaacaaactatgactctatgagtcccgtcggttagcctaataaaccaaaataaaagtcaatttgaatcctcaaacttaattttaagatattttcaatataatttctttcagcgttggcttttaagttgctacaaatagatatataaaagtttcacctaaaaattaatttttattccctaagggcaagtactatgggcatccaagcacaatttcctagattccacataagctaaaatagtgaggtggaggagagaagagatgagagagataagcatccacctctcatgcaagaggcaaccgctacacaaaattcaagacaaaatgacagagggaaagagtagattgggcaaacaaacattgaggctagtgtattagaattagtatagatgtgatatattgtacatgttatctctatatttatttgttgatgatgtggtcaaaattagatacaacatccatctcttttataaaacttgccctaataagccattatggacaaccaatgaggttctattaggcttcgcaccacgtgtcctgaaagtgctagttacagctgtacaacgggcaattaagcgcacacttaaggaagagtattagagcgtgtttgtcatgatatgaaaaagtaaaagcatgggttgccatctaaaaaaaatcttcaatgtacactactttatactaagtgtttgtttataagtttagtgatcaaatcagaaaaaatatgtagtgcaaaccacatatgtagtagaaacttgg

SEQ ID NO: 69903 - DNA, 15085 bp, Oryza sativa
acatgcatgtttgcccttcttcatgtagcatcttgcctgtaatggttgggatgaagcctggtataaatctaaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactgcgctgcatgcagcgtgacacgcttgaccagactgcaataaatgtggttaggtgagcactaccgtgttcacctatcccatatatgtggcgcaaacctcctcaaggggtcggggtgcctcggccctcggggccggggcaggagtaacccgacccccctcggggaaatcaggaggagagcggacacctcaccctcgggcccgacgtccccgaaggtgccaggccacgtgggtgattgtgtctgcctcaagcctcaggtcacgatactcccggtcccatatcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaatcatgcacatcggtaatggtaatcttggctgtcaataatgggcggtctcttcaagactgccacatcacttgagcagcgcacgaatctgggcgagccgatttgcttcgcctggagatatggcaacgtcgcttcgatcggcgagcgtaattaacgcgcgcacgatacgatctgcctcgactgccacaaccgcatatccacctcatgcgccgcaagcgggcgaatgggattagtggaagcgtgggcacgagaaacaagggagcgagatagtgagaaacgagggagcgaaatagtgggcgcgagaaacgaggagccgggctcatcgatggcaagggtataaagataccgaggaaaagatttgctcccttcctttcgccattattccccttgccttcgccgcttgagccctaactctttctctgctgcaccttaccttcgccacacgcgctcgttctcaatcatcccttcctccggcgccatggcacggggttccgctctgctcgacggtagcgtacttccgccttcccgcatcgtgagcgagaggcatgccgggctgccgcgccacttcatgccggaatctgccaccggccgggagatagtgatgctgggcgagggacgcccggcaccagactacccggggcggtccgtcttcttcctccccttcgcaatggcggggctggttccgccattttcttctttctttatggatgttctggagttctacgatctccagatggcgcacctcacccccaatgcggtgatgacattggccatcttcgcgcatctgtgcgagatgttcattggggtgcgcccatctcttcggctgttccggtggttcttcaccgtgcagtcggtgtcgccgccgtcggtggttggtggctgctacttccagccgcgggggccggtgttgaaccgctacatcccctgcgccctccgcaagaagtgggacgactggaagagcgactggttctacacccccctcgccaacgaagcgcgcctccgacttccaagccagcccccggcgcaggtctccagctggcgggcgccggtagatctgggggatgattatgacgccgtcctcgaccgcctggcgggcctgcgatcccaggggctcacaggggccatggtgtacggcgactacctccgtcgccggattgcgccgcttcagcggcgcgcccggggcgcctgggagtacaccgggtctgaagactacatgcggacccaccagggagtcagatgggattgggctcccgaggacttcaagatcgtggtccaaagggtgctgaatctcagctccgtggaggcgtccctcattcctcaaggaatcctccccctctgcagcgatcccgaccgcgcctccattctgaccattatgatgggggtcggggcctcagaggaggaaactcctaagggccacgacggcgcgggcgagagccgccggggggaacaatctaccccaggagggggtcgtgcttttgggccccgcgtcgggggctcggggagcagccgccctgccgacgcctaggggaagaggaagctgggaggaacaccttccccatctcctccccgagggggcggggcggtgcgtgccagcagtcggcgcccggagggggccgcgccgacatcgcagcccgagggggagcgcaagaagaagcggctccgcaagatgggggagacggaaccatcccggggaaacctaatttcccctccaaggtggtcatttaaccgaccccctcgcaggttcgtcccactctcattgcgaccgtctttcttctatcccaaaagcaagttttctcttacccatcttgtttgtcttctggttttttcttctgcttcagcgatgtcccgtcgcgttcctcccgccatcccaaatccggccagtccgaggccgaagatccggcggccgcagaggaacggaggcgagaatctgaccggtgagaggccgcagatcgccttcgggaagctgaagaggccgcccgggaggccgctcgggttcgccatgcagaggataccgctcgggaggaggccgcccgggctcgccaagccgaagaagccgctaaggaggaggccgcccgggctcgccaggctgaggcgatggcgtcttccgaggcagcccacgagaaggctgctggcgcgtcgcttgggcccactccctcgggcgacgctcaggcgacagcctccggggcggctcgcgacgaggccgcgggcgcatcgcctaggcccacttccccgggcgacgtccaagaccaaacgggtccgggggacatccccgagcccagcgcgtcctccggcgggccgagccgcgtcgcattctctccaaggcggctcttctcctcgtcttctgtcgccccgctgagcgccgagccccttctgcaagccttgaccgccgcaaacaccgcggtgctagatgggttcaacgccaggtggaggccttgcaagcggaacgagcagagctcgaggccgcatgggcgcgtgtcgaggaggggcggcgctcggtggatgtcatggtggaggtgggccgtaaggctcaccgccgtcacgtctcggagcttgaagcccgctaagcggcactggcggagatcgcccgagaggtggaggaggagcgggaggccgccctcatcgccaccaccgcgatgatcgaggcgcaggacagcctccaccttcaacacgggagctgggaggcggagctaaagaaaaagctcgacgccgcccaaggggtccttgacaccgccgctgcccgagagcggcgggcaacggagatcgaagcggcgtcccggcggcgcgaagaggcccttgaggcccgtgccatggcgctggaagaacacgccggcgccgtggagaggagcttggcggaccgcgaggccgccgctgctatccgggaggcaacactggcggtgcacgaggccgcctgcgccgaagaggagtccgcgctccgcctccgcgaggacgcaatcgctgagcgggagcgagctctccaggaggccgaggccgcggcgcaacggctggcggacagcctgtccctccgcgaggcagcgcaggaggagcaggcgcgccgcaatctggaatgcgtccgcgccgagagagccgcactggagcagcgggctgctgacctcgaggcgcgggaaaaagagctggacgcgagggcgcgcatcggtggggcggctgcgggcgaaagcgacttagccgcccgcctcgcagctgccgaacacaccgtcgcggacatgcagcgcgccctagactcatccgccggggaagccgaggccctccgcttggcgggcgagatagggcccggcatgctttgggatgcggtctcccgtctggatcgcgccggtcggcaagcgggcctctggaaaggccagacaatgacgcactccaccaatctggaaggcctcgctccgcacctcacgaagatggcctgggctctccaacaactccccgaggagctcgagaagaccgtcaagtcatcctcgagggacctcgcccaaggagcggtcgaactcgtactagcgagttaccaggccagggaccccaacttctctccatggatggcgctggatgagttccctcccgggaccgaggacgacgcgcgcgcgcgggtccgggatgccgccgaccacatcgtccacagcttcgagggctcggcccctcggctcgcgttcgcccccaactccgacgaggagggcgacgccagcggtgcagacgacggtgacgacgaggccggcgacccgggcgcaacggaatgagcccccaggcccccgccaatctccagttttttctttttctttcttctaaggccttcatgcctcttttttgtatagatcaacttaatctgcaatcaaaaatgatgaaaaaattctttgtgtcaatttttttttgctatgcgtatgagatgaggatgatctgtgccgtggcccttttgcgtcttagcttgatttaagggctcgtgctcaagtcccagtcctcaaatggctcgggtcggggctagtgcctggggagatccacatgtcgagactggccaggccgggaacgtggtgaccgagggttatgggtgacccgattgtgggtttttgccgattccccccccccccggagttcaccacgccccggggcacggctcggttctgggccccgtttggcgattttagctgaccgaaccgagcccccgagggcaaggttgagcacgagtgaccttatttcaagtcaagattcttcaaaagaaaaaaacgacatagacacagcctttaggaaattgaaactgcttttattgaaatgctgaaataagagaaatgagaatgtgcatgtgtggtagcccccggccaaccctgcacacccgaggggggtgcggggttggcccgagcccgaaacctgacacccgacccccccctcaggggtagaagcgacgaaggtgttcgatgttccacgggttaggcagctccgtgccgtcgcccgtggccagccgtatggagcccggccgggggacaccgatcactcgatacggaccctcccacatcggtgagagcttgctcaatccagcacgcgtttggacgcggcgtaagacgaggtcgtcgacgcagagtgatcaggcccggacgtggcgctgatggtagcgccgcaggctctgctggtagcgcgcggctcggagggccgcgcgccgccttcgctcttccaagtagtcgaggtcatctctacgaagctgatcttgatcagcttcgcagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccaagaatcgccgtgcttcttgagaatattgaaggtcttggttttaaggcctttgaggatttctgcattggcgcgttccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaataaatttaagtgcagagtgcttatcgatcttgacgaccggataagcctcgggccacttagtgaacttgtcgatcgctacatacagatactcaaacccgcccggggcccgcttaaacggtcccaggatatcgagcccccagacaacaaatggccatgaaagtggtatgatctgtagggcctgggccggctgatggatttgcttggcgtgaaactgacacgctctgcatcgccggaccagatcgactgcatcattgagagctgtcggccaatagaatccttgacgaaaggccttgccaaccaaggtgcgcgaggcggaatgggctccgcactcgccttcatggatatcggcaagaagctcaacgccttgttcctgaggaatgcacttcaggaggattccgttagccgcgcgccgatagagggtcccttctaccagcacgtagcgtttggaaatgcgttggacgcgttcactcccttcgcggtccttaggtagagtcttatctgtgaggtatgcttggatctcagagatccaagcaatcaatctaagggagcttggagcgctcccttcgggtcccgaggcctggactccgacgggcctcgggggccggtcaagcgcatccgtctcccctaaggggttgggtcgcgccgacggctgggtaagcctttcttcaaaggcgcccggtggggtctgggctcgcgaggacgcgagccgtgagagttcgtcggcaatcatgttatcccgtctgggcacgtgccgaagctctatcccgtcaaaatggcgctccatgcgccgtacttggcgcacgtaggcgtccatctgcggatcagagcaccggtactccttacagacttggttaacgaccagctgggagtcgcctaataccaggaggcggcggatccccagtccagctgccactctgagtccggcaaggagtccctcgtactctgccatattattggtcgctcgaaagtcgaggcggaccaagtatctgaggacgtctccgctcggagaggtcaacgtaacccccgcaccggcgccctgaagagatagggagccgtcaaactgcatcacccagtgggctgtgtgagacagctgcgaggggtccgtgctggtctcagggatcgagacggtctcgggagccggggtccactctgccacaaagtcggcgagggcctggctcttgatagcgtggcgtggttcaaagtgcaaatcgaactcagaaagctcgattgcccatttaaccacccgtcctgtaccctctcgattatgcaagatttgaccgagggggtaagacgtaaccacggtgacccggtgcgcctggaaataatggcgcgttttctttgaggccatcagaatagcgtaaagcatcttctgggcctgagggtatcgggtcttggcgtcccggagggcctcactaacaaagtagacaggccgctgcacctttcggcggggccgatcctctttgctaggggccgtattcccggggcgttcttcgtccaagtggcctctcggggcgcactcgtcttctgtgccgatgacctcggggtcggaggatgacaggggcggccttcccacagtggcctcggggccgtcctgggggtcgggggctcctggcgtcgtcggacaagcgggcaaaaggccaactccggtcgtcaggggccttaggccaccgttcggctcgggggcctcttctccctgcttcctcccgggtcgagtcagcacagggttagcctcggggtcaaagggtgataggtgcggccttcccgcagtggcctcggggccttcctgagggtcgggggcacccagcaccgtctgacaagcgggcaaggggccgactccggtcgtcgggggccttaggccaccgttcgactcggggacctctcctccctgcttgctcccgggccaagtcagcacagggtgggggtgcgcggaatgaggattgtcctcatcgcgctccacaaccaacgctgcgctaactacttggggggtcgccgctaagtaaagtagcaggggctcatttggctccggggcgactagaaccggaggagagctgagatacgccttcaactgggcgagggcattttcagcttcttccgtccaagtaaacggcccggagcgtttgaggagcttaaataagggtagcgccttctctcccagcctagatatgaaacgacttagggcggccatgcaaccagtgacgcattgcacatccctaagtttgctgggggggcgcatccgctctatagctcgtatcttctcggggttagcctcgatgcctcgggcagagaccaagaacccgagaagcttgcccgcaggtacaccaaacacgcacttatcggggttcagttttatgcgggcggagcggagactctcaaaagtttccgctagatctgagagtaaagtctcttggttgcgcgtttttacaaccaagtcatcgacataagcctcaacattacgccctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacttcctcgcggatgaaggcttgacgttccggggcctgccgccgcactttctgccggaccggccttgcgcccggccgcacggcgagacggtgctcaatcacctccctggggaccccaggcatatccgccggtctccatgcgaagacgtcagcgtttgcccgcaggaaggagacgagcgcgtcttcctatttgccatccagaagaccaccgatccgtgtggtcttggatgggccgtcgcccagggcaacctccttgaccgggacctcgtcgcatgtgacaatccgctgcctcggggcggtgggggcggaggtgccaagcctctcgtcaccaccctcgggcttggacgcagcagcgaggtggtccgcgcgctgctccatgcaggcgagcgcgactttcaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgataatcggttgggacggctggagcaccatccccggggccttgatggcatcaaaagccgcgggggaaaggatgttgagggccgctcctccatctatgaggacacgccccaacttcacgttgcagatggtgggggaaaccaccatcgcaatctgccctccccgggcaacgcacggtgggtggtcggtctggtcaaaggtgagggcaacctccgaccaccgcgcccgacgcgtcgcctcatgagtaggggccgcggccagaagctctcgcttcatagccttgaagctccggcgagaaacgtgagcacacgctcccccatcgacggtggcaatggtggccccaggctcttggaaacctaggtcatcatcgccatcatcgatgtcctcggcgggggccttctgcttggcctcttttcgccgattgccggaaggaaccgccggagacttgccctcacggcgttcctgcctcctgtcctcctcccacttcctcgtccgctcagccaagcttttgactgcgcggcaatccgcgagatcgtggagggaggtgttgtggacggagcaccacttgccggccgggcgctccctgctgggagcaccagcctttttctctttgtcgctcgcaggcctcccctttcgggtggcccgcgaagcgccctcgacggcgaggacatgaccctcgtcgccggaatggaccgacctcttcttcctcctcctgtcacgccgccctatctgagcggtggacccgggggcggccgaagctgccacaccggaaccggaggggttccaggtccacgcttcctccttacgagccactcggtccgcgagctgaaaaagctccgcggtagtctggggctctttggaagcgatcttttcgagcatgcggttgtgccgcacaccccccctgaacgcgtagatcaccgcgtgtgcagggatgcatggtatggtattgcggacttggcagaaccgctgaatgtacgagcgaagtgactcatcatcccctcgctgtactgcgtgcaagtccgcttcttcacctgggcgcggataagtgccttgaaagttcatggtgaactgttggcacaaatcttcccaggagtggaccgacgcgggaggcaggttcattagccaaccccgcgcctgtcctttcagggccatgggaaagaaattcgccatgaccctgtcgtcacccccagcggcctcaatcccggtcgtatagacctggagaaactcggtggggttgacgctgccatcatacttctcggtgatggtgggccggaaccttgggggccaacggacattccgaagactcgccacaaaggctctacagccgacaccaccaaccgggggcacggagggctggtcctcacgtccatgtcgaggtgacactctggacgaagaggcgccctccgttgcgcggggagtacgccggctattacgccggcgctcgatgtcgaagcgggcatccggctctccatgctgatcctcccgagtcggaggcgccgacgagggagtggcagccgaatggcgtgcaacagccgccgctcgccgcgccctccgcctgacgacacggagccggtggtggcggcgccggaggtcctggtggtggcggaccgtccaccagcacccaggcgctgctgtgccgtcatgaccaagttggccacatcgtccagccatcgctgggctggagactccgggtcagggacgacgggcgggtgacgtaggagcgcgccagcagcctgaagcgcgccctgaggcgtgctgccgtcgcagtagacgagtaggcgacgctccccatctcgccgttctcctgcatcacccgcgactggtgatgctgcggatttttcgaccctctcgagcgcctccccctgcttaggactttggtgtggaggaggtgggggagtacgagctcgacggcgtgggtttggctccccgtcgtcgccgctcacactcggagagaggtcgtgcgcctttgcttgctcggccattaggctgaacaagaaaaacttggcgcacacggaagagtgcgagagctcagaaaacacacgctgagccccctacctggcgcgccagatgacggagctcgtggctcctcaccgggagaccgctctggcccccctttgccggttcggccgggggcttagggtgaaatcccaagctctctcggtatgtggaaagatcgcgagccaggaaggaacgcgagacacgggcgatgtatacaggttcaggccgcccggaagcgtaataccctactcctgtgtttttggtggatctgtgtatgaacaagttacaaagtatgaaccagcccttccccgctccaaaagtccaagatccgttttttttcccctttctaagtgggcaaggtcctccttttatatctcaaggggataccacatgcacctctccctttccaaactggacttttcttctcttcataaatggacggagatcggtacggttgctgtccgagtgcccttctgacgggacggcccatacctacccccacttccgccggaaacaggtgcgacgtgggattatggctgtctgttgatgacgcgaccagtgtctgaccggtcacaaatcagtcatccttgtccaccacgtgtcagctgggcaaacatgcatgtttgcccttcttcatgtagcatcttgcctgtaatggttgggatgaagcctggtataaatctaaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactgcgctgcatgcagcgtgacacgcttgaccagactgcaataaatgtggttaggtgagcactgccgtgttcacctatcccatatatgtggcgcaaacctcctcaaagggtcggggtgcctcggccctcggggccggggcaggagtaacccgacccccctcggggaaatcaggaggagagcggacacctcaccctcgggcccgacgtccccgaaggtgccaggccacgtgggcgattgtgtctgcctcaagcctcaggtcacgatactcccggtcccatatcactgacaaacgtaatatcttgttatgtatgctaatgtaatggtaaagtgtatatttaaaactagtagatctacgcagttaccgatatctagcaatacgcagttctagattaatacaactaaaaccctagaaaatataatgcatttattcaaacaaagttttaaaaaatacacagtagttaactcaatagtcaaaaatataatgcatctatgaatattacatgaaatcggagtctcgaaccgacagagcttcgcctcttcttctcttctcctcccccttcttttttagagtggaggtgatgggaggaatgaggagggagggctgggcggcaaggggcctccatgcaaaaaagccagcccaggccggcccctttccaccctagcagtgggcggcaagggtttaatgaaaaaaaaatttcgatccgccgtcatcgcctgtccctcccctgtttgccacgtcagcttgccatcctagtggagggcagcaaagtctatttttgtaaatttttccaacgataaattatttatgtaaatattaaaaaaaattaaaaatgaaaaaaaattcgatgaaataggcggactggcccaagagcagcagcaaactcaacgacgggtcgatggctgaaggcccaaaaatccactcgcagctacaacgtgtgtggcccaaatccgacccggacacgcgggagaggccaagtccaagtccgaggccgcagcgcgtgcgcgtgggagcccgaagcggcgtgggatcctgcggcaatccgtgccggcccacgacggatcagtgcacattgtttttgtggtcgggagtgtttgaaaggagggaaaatagaaggtggagaaatacctaaaacgatatgagtcatcaacacatgattaattaagtattaactattttaaattttaaaaataaatcaatatgattttttaaaacaactttgctatagaatttttctttctaaaaacgtaccatttagtagtttgtgaagcctgcgcgcgaaaaagaggtactgtctctctcaattaccctggaacgagagagcctcgtcgcccatgcaccactatcaactattttgaaaagtttaatattacagtcaaccgttagctctaaaattgatatatcatctgctgtcaacctaatagcatatttgtataatagttttatataaatataaattgcaccattagtacttggctcacatatgtaacgtgtttttcatttctcttctccatggatgtttatagctatttataatatgttattggacttattattagttgatggctttcttctctctcatgctttctctctcctccacttagcttttttaacgtattaaatttagaaatcaaaacaatatgaatatatttatgtttatgtatcttcaaaatcaatgttaaataaaactattagcactgttaggcggttttctcttggaaatatcttttttatgtgatatcttattattattactttatttttagtaggctggctgcatatatttaatataaatattaaattaaactaaaaaagaaaatctcgtagtattttgatactaagatgcgattcatgatcatacttagacttatgatcatactcccgccgggccaaaaggagcgacaaaatatgattgattaagtatttactaatttttttaaaaaaatgaaaatgtaatttttaatgtaactttcgtataaaatatttatataaaaaaaatattgtttagccgtttgaaaagcgtgcgagcgaaaaacaatggacacagcctaaaaaacaatgggctggtttggtttgtggcctaaataggacttactaaattttgtcagtgtcaaattttggtatgactaattttgataaggcaaagttgtgcttggattgaagccaaaataggctaagttcactattaaaatggcctattttcttaggcatgaaaaacttagcttcaaaccaaatagatattaaacactatattaaaattatcaaatattgataagtctaatttaggtctcaaaccaaaccagcctaaagatcctgataatgaccaatctggaccgtgcgtgttctggaaaggaaaaagaacattttccgctgttccgcctaatgagtctacgcgcaggcggcaggttagttccaagagaaaatgtcgatcaataacgcggattctagagtaacgcggattccagactattcctccgtggtctactttatccagcgttggaaacccgctcctacacacacacacacccactaccgctctccgcaattcagccagactgcagttgcagcaacagcaaggatggctggtggagtcggggaggcgctcgtgtccgccgtgctgaaggaggtgctgggaaagcttggctccgccgtcggggaacagatcgtgatgcgatggaacctgaagcaagatctggagagcatcaagagcaccctgggtatgcttcaagcggtgctcagggatgccgagaggcgctccgtgagtgacgaaggcgccagcctctggctgaagaggctcaagaacgcggcctacgacatctccgacatgctcgatgaattcgaagccaagttatcggaggtaaaaaagtgtcctcccgctaggatgtcgtccttcacttcagttttatgcttatctatgctcctcccgtcaaaaaagagttgacatttaggacaatatttagtagtctcagctagattccctaaggctttgttcggtttagagggga

SEQ ID NO: 69904 - DNA, 20581 bp, Oryza sativa
gccccctcccctccttccccttgcagattcgggggaggtggcacgagtcggccggtgccacacggctctcctctcctcccttgcagatccggcggagggtaaggggaccggcatgcgtcggcaaccggtgaccggatctatctctccccctcctctctttgttacatgtgttttttgtgtgtgatttgttcatgtgagatgtgttcatgtgatgtgttcttgttgatgtgtgatgtcttctcttgatgtgttctgcggcgggcgaccgcgagggcgacggcggtgatgggcgaccgcgagggtgacggcggcgggcctcggctaggcggcggcagattagggttagggttagggtttcttttttcatttttttgtttctttttttgttaatcggttttcccagacgattgggtgcatgcgggccgcccacccacaggcgaaaattggctagcccgcacggaaaaattggtgctgtagtagtgtgtgcatggtcctctacctcgacaaggtggactggccccgcacggcaaggtccaatgatcagggaggcaaaatagacttatttcagccaataagcatggcccaaagaaatgagggacacgtaatagactttttccagccatgcaagctaaatagatttattctaaggaggagcacggtgggtttttgtgcctaggccgctaatgcagcccgtgggcaggcactacccggcccagtaggttgcgccgtgccagcccgactattctcaggctcaggcctggtcatgcccaagccaggccaggccgaccggcccatttggccatctatatacacatcctcaaactcatgtcctgctatgctgccctcgagtctgcgctaggacaaagtcatggatgccataattgttgaaatgcacgcagctaagttgtaatgctctactttatttcttttacatcaatcgttcttatctttaactggttagattggcaaattttgagccttttggagagtttagttttcctagctgttagacgatcggtactcctagcggctcacccacaaggccactagacacgctccacatctaacttccgttgtcatagccttagctcctctagcgaggaggagtggcaccccttttttgggattcggccaggcagcgggtgcacggaaacaaggtgataatcgtgcagagtatagggataggctgtttagacaggttcaggccgcttcaatgttcttgctctatatgatgaagcttacaattagttcttagtgttgatataagtagtagaggatgaacccttcagtgttatgaggctagaatctaacttagctcctctcttttttaagtggcctttggtctttcctttatagttgcaaggggatatcacaatgatcggtttcttacaaatgggcctcaacataggggttaggtatatgttggtcgtggttcttcttggtgagtgggcctggtcgtcaagcctagatggaacggagaccttgccgacccgccgcgtgtcctgagcatgctagcaaagcttagagtagaagcctgaaacacggttgacgcccgtgggcccgcctatcagccacggataagagaaactgcgagatggttgtggctccagtctcgcggcatggcagtcaatcatactgcctgacagtccacccttatccacacaagggtggtgaaagcctatcgcgaggctggtgtgcattgtcttgtcacgtgtcgttctggtggcgtgccgacactagtggagaaaccgtttgtagtcccggttggtaacccctttagtcccggttgtccaaccgggactacgaatccgggactaaagatagctatctttagtcccgagtgaaataaccgggactaaagatcgatctttagtcccggttcgtgttaccaaccaggactaaagatcggtcagccacgtggccggccaaaccatctttagtcccggtttgtgttaccaaccgggactaaagatcggtgcaccatttttttttatttacatggccctgtttgctgcatggttgattatatatatacatgtatgtatatgtatatatacatgtatgtatatgtatatgtatatatacatgtatgtatatatataggtatatatacatgtatgtatatatatatatgtatatatacatgtatgtatatatatatatgtatatatacatgtatgtatatatatgtatatgtacatgtatgtatatatatgtaccacctaccttggaggcacgctaccttctccaaggcggtgcacccatctcttcgagaaagaagaacaagaaaaacaagagtagtatttctccccgaagggaacaagataggtgccatcaaacaacgaggggtttcacggtcgtgagctctattccaattcaacagattggtgaaacaacctaatatatcatggagagtttgatctgaaagtaccaactgttccaaagcattcattttgcgcattcaaagcattcaattccgagctttctcgcgctggacaaagacactcgcccaggctttatacctatatttgccctcctcagacagaagagtgaaggttcatgtggtttttagaagaccctacctacggtgtagacctcaaactcaagcccagtagatagacctcacgaaggattttgctgcgagaacgccttacccaagcgccagtgtccggttcctcgaaagaagcaagaaatctttcatacgcctattcaagagataccatccttgacgtgttgttgggtgatacgtataaccgggtacgacttacaacgtttggataccagattcagagacatttcattactgttctgaatatacaaggcaatgtttcaagactgacattcaatgggaaagaccaacatagttaagttggtaataggtcataggtaaccaaatacatagatagtacttctatatcgttcgtgcagaaaaaagagtatccttagggtactaattagataaaatatattatcccccatacttttagtagaaggttgcatttcatatccggtgagacaagaaaaggccttcggtactattatagtatagaagttcggtacccttttaataccatgctatttcaatacctgactatttaaatagctgacttttaggcttgcactatcgatcaaatgacggacgactataaaaatagaatcagaggattgcttacccttcttactttctatcggttctatctgatcttgtctttcctacgagtatacatgcagctggcttttttggtaatctgacctttccttccttcccgctagcaacaagcaaccgatttcactcacaactcttattgcagggatctcctacactactggcacttggtagcaaggcgctacgcgtacgaaaaccacccactatcagaagatggatatatagcggtactagggcggagccccctccttagattcccaatcggcatcattgatgaatcacctatccaacatccttaaacaaagattgccccccccccccgaattgggggaagccgtaggtattattgcggttcaatctattgaagagcctagcactcaactaacattaagaacttatcatacaggcggtggattcacagggggtactgctgaccttgtacgacccccccttcgaattgataaatccaattcaatgaggattggttctcccgttatgggtagcctgctttttttatgttatatagagtagtatgtaactacttagagtcaggttattttacatagcgggcagagagcctcataaaaagcttgattctagtgatcaatatcaggaatccaaattccagagattcgtgcgggaacgtccactttgcattttaaagaaagggggctatggatggcaagagaagccctcatacccactcttctctcccctccccatacccatcaactactaggttgtggagagggcctcggtatcacttcactatatacctacacctacaaaatcacgaaagagatttgctttttttcggcttgcggcccccttagaagagttcttcgagttccctatacaaaggagctccattcctcccgggattttccagaaagtaccgctccttcttgagttgaactaccccctcggcactgggagctcctgataatccttttttggaaaggaacacgtccaccgtactggctattttcgtttcgtgtataacgtatctatcggcacggcgtcggccttcataaagcaaccgaattaaatcctcctttattttgaattctgtttcaaaataagaaagaatcatttcttgttcctgcagattgcgttcaacaatgcccctagaagacgcgtaaagagaacttgtgagatttgaatagaatgattcattctggaaaaaaaggactctctattctgtcattgtacaggcgcctatgactcatttctgaaatgccattaacgaaatgatttcgctttttgaggatccttgtttatgcactccggaatagaagaaagggctgcaccgacccccgcagagttactcggggccggcggcggagtagtacctgactgggtcgagcaggcgccctcctcagggctgagtggcacaagaatcaaatcgtccaagctgcgaagggttggtggtccctgtagctccaagggctccatcggagcttttctcttgcctttagaaagctcctctttcggggactccacactccccccacttggtgctcttctccaaacggcatggcttcctctgagtaaagaatgaaaaaaagagtaaaggtggttatgagcattccaagaataaatccaataagtttggcacgttcataactaccttttggggaagaagaggttgaggactaggctctcccccctgccttcatctgccactttgtggcatgtcttgttctcggtttttcgacccgaacaaccgctgggattcttggccgttccagaatccctgttttcgtgatcgaatgacgaaaaataaaaaggtctatctaattaatctccttcgcagtttgttttaaagaagcatcaggttcaatctttctttcgttagttaatccccctttttcgttgaaggattttagtaattctggattaatagtacttagaatggctttttcatattgagaaattctgtctagtggcattcgatcacagaagccgttgacagcagcataaatcacaacaatttgtttttcaattggaagtggttcatattgtggttgtttgggcacttctgtaagccttgcacctctattgagtaatgcctgagtcgtagcatcaaggtctgacccaaatttagcgaaggcggccacttcgcgatattgtgccaattccagttttgaactaccgcagacttgtttcatagctttcaactgagcggcagacccgacgcgactgacggataagccaacgttaatagcaggtctaattccgcgataaaagagctctgtttccaaacagatttgtccatctgtaatggagatcacattggtggggatataggccgatacgcctccagcttgtgtttcaatcacgggtaacgcagtcaagctacctgcacctgtctggtccgatcgtttagcggctctttctaagagacgggaatgtaaatagaaaacatcccctgggaaagcctcacggcctggtggtcggcgtaacaataatgacatttgtcgatatgccaccgcctgtttacttagatcatcatatataattaatgcgtgcattccattatcgcggaaatattcccccatggcacaccctgaatatggggccagaaattgcagaggagcaggatccgaagcggtggctgctacaagaatggaatattccaaagcattcgcttctgaaagaatttgaactaattgtgccacagtcgagcgtttttgtccaatcgcaacatagacacaatacaatgtctcactctcatttgtgccccttgagttcatttgcttttggtttaatatagtatcaatagctattgctgtttttccagtttgtctgtccccgattataagttctcgttgaccacggtctataggaaccaggctatccactgcttttaagcctgtttgcatgggttcgtgcacagatttacgttcaataatccctggggctttcacttcgacacgtcttcgttcgtgatcgcttagagccccttttccatcaataggtattcccaaggcgtcgaccacacggcctaacatggcctttcctgcaggaacatccacaatagatccagtgcgcttgacaagatctccttctttaatagcggtatcactaccaaagacaacaatacctacattctcattctcaagattcaaggctattcctttcacaccgctggcaaattccaccatttctccagcttgaatctcgttcaatccataaacacgtgcaatcccatctccaactgagaccactcgaccgatttcatccacttgaaaattcgtgtaaaagttggtcattctactttctaatagagtcgtgagttccgcagctctgggtgagaattccatactttaacaaagacgatggatgagagaagggagaaatccgcttttcaaaaagccttagactgaacaccacacaatcactcactccactagatcataaatgccattatcgaatggggcagacactcccatgagctatttcaaccacttactaacacagggacaccaccattttaaagctgaactatgatcttctttcgtgcacatctcgctttttttttcatttatgcgaatgaattgcagaaccaaactaaaatgggttgatcggagctattctctagaatttcaaacttgagatgacttgcttgaaggaaatgcttacactgaagcctattaccctttctggcttatagggattagggagaagagaaccaattccagtgcctaggactcacattttcattttcctagtatggattcgtattacttaactagttagttatcttactagtctataaaacatgaacttcttattctaaagtaatttatccaaatatttattaatattcaagatgaaaggaaaggcacgccaacaactacaactagccagcaccctattgactcgcttgtggaaggacttataggacgaataaaagcaactagctcgtttggacccccagcaacttcaaatgaaactggatagctggcaactggcactgcaattagatggctgagaactctttctacaatagaagggaaggccttggtaatataacgagattgctaacttgcctaagatatctacttacttaaaggactacagttagctttacgggaaatcaacactttgttgaaggtggaatgtgaatacagggacagagactatccatattaccccctgccttacccttaagggctaagaactgaataggctgactctagattctaactgaaaatactcaaaattggactctgcaggctttcaagcagattgatacctactttacttgccaaaaatatttgatgagtaaaagctttcaaactcagttgcagtagagaccttcctaagggcgaagaaatgagagagcagctttgagcgaaatgcggggattagtggaaggcgggatgaaactgtttcttaatttccaacactctgatttgagcagaaactctatggagtgtgttcattgatataccaatacctcttcatttcttgatttaccagattggtcttatgagtggagcaagaaaacggatgcgcgtgctaacgctttcgcgctagtgcgctcaatccggtgcttgttggttagttggaacaactagtaggaaagctacttctacttggacagctcagcagccctatattcccttgttccagcaagcaaacaaatagaatagttggaacgaatagacaagtaggacagtgctaccagctagttaactcagttcattcttgactttcggcttgtagctttgctacacaacctcgcattcgaaattagtacttacttggacagcaggtaaagcagggacagtagtatatggtagtcagctttgaattgttctctgtgtagaatgcctattggtttttcacgaaacagtactatatgtggacagtacataggtatcaagaaagagggctagctctgtttgaatagttaccagccaagaaaagactactcaaaaatctgctacttcgtttccaagcatacttatttctttctcactcactacttttttctattttcttttgtctatcgaaacagcctaggattcaatttgatttatcctagtggtgacagcttatgcttcatttccttcgaattcttctttcgatatgagcgagcttacccaaaacctatcacttataccagtgcagatcttatttatgtgcatccctcgctgtgactactattcttgtctacaaacctaaggtggataaacctctatggtgcatatctgtttcgcctaacttgtcttagtcattcccacattgaatcgaaactctcaatgcccattgactcatcatatctcgactgagcggaaccaatccaataggataatcaatatgttctgctattccttatatacctcagcttgttcgattgagccgataccgagcccttatcttttcagaagatgtgcaaccacccttgcttttggtttattttcagtcaaccaatagtagatataggaggaggtggtattagagaacaattagttgatttgcaataccctttgctttcatttcacttcgagggaagaccttactttcattcagcattcgcttaaggataggaatagtcatatctcgctcgtagtcatatcagcctctatcgtaggagtggtattgaaggaaaaccgtaccgggccaaatagattggtttttaaaataggggttcaaatcattccgcaaatccagaaactgaaatggggtattgctgccaataaggataccactcttactagcaaggtgaaagacacatcaacccgcatacccttttaccacacctaccccttgttgggcacgtttacgcatctcttgacccatccacatgacccgcttggctaactaaaagaagcttctcggagcatctatgcatatgagaacggatgccgagtaaagggtggccagcttcgacctttgctttgaacaggggttagcattatcaaaaaccattgctcataaaagggatctctttcctaaaaggcatatctcgtacgctagggaatgtgcttcggcttcagcctagctacttttttgattggtgactaaactactaaaagaaaactttagctatcaattcttttctctatgttcagaaatcattaacggatgcagaactggatactctgcttaaagcaataagcctcccttggatagatcgaagaaagaagcactgtgcgttaccaggtgtagtggagaaagcaagggcaaaggtttcatcagaaagagatgctcgagcgataccaggatcacgatacgattaatctgatggcgcagcacgaacaggaaatagataacctagccctgggaaggaaagggaacagtttagtccctccgatccgtcaatcaacgatagggttacccagaattctaattaataggaaggttggactacctcgaatggcaacatgctcgctgattcctaccactcctatctacataactgctccagagaagggaaggcagatgtcagtgaaacgggtaataatacaccctcgactactgggtgagtgagaaaagacaacatcctcctccggttacactccctgtggtgctttcagtgggggattcgttatggaaagcgggaaactcaagtaagtactgcttttcgatagctaattcgagttgggatgaccacctggaaccaaaacaaactctataacttgtttaaaacaagctagaacagcatcaattgaattcaaggtataagcacactgataagaaatacatggggccttatgccccgctatgcactctaccacttcaattcaatgattgacttcaccgataccagacctcacttgagagagatctatcactggcatgtggtaaaccatactagtgaatgagccatatcgagctgtggtcttactctagaactcaagttcgatgagctcttagcggagttgtgcctactatctactaagtgtgtgctagggaaagaaagcagagcagttctcactctgtccggtgaccaagaaagaaagcttcaagaataccgtaaacagatcagagaaacctcataccgaatcgccacgtgaaagcggggttaaggtaaggcaggaaagactgacgccgaaagatatgttttgaagagagctccatcgggttgaagccgaattgcagagaatcaagatcttctacctttgtttgttccatcaatgcccttcggactggcctaagagttgggtccctgtctgtaattatgtggctaggtaacccatttatggcttgtggtctttctgcttatgacgtagcactattccatcttgtaaataacgccttctttaaggcgctactatttctagcggcataggtgctttatcacaatacgaaacatgtacatacgaggactacgattcctatttagagatattcctacgagcgatagacgtagtaaagaaattacgtacgccaataataataatatgactacgatttatcgcaatacgaattagcgttgattgctcctctccctctggactaggccgatccaactcaattagaagatcggggaatcgaatcctattctcggaacttcccgcatccctagtattgtcctcggctaatgcaaagaaaagataagggcacggtttcggctaagccaattgatctgctccttaacggatttgatagttgtagctggtactaagccctcctgagttcgcaatctaattataattaataatagtttcggttccggaaatcctatcgttatcttcggcttcaaagcaaagggagggatatcagtagcagtgaatatgtcttgtttcggatccgtgaatccaaagcttccgggtatatgaggccgcctatacggttcctaatctaactgcagcgtaccatgatggcaagctaaattcaatcaaaggaatctcacctaatgctagctccggcaatcctgggacgagtccatacgctagagtagagaaaagacgagcgctatccctttttttctaaaatcccaatcctagggtcaaacctatccttggtttaggcaatgccaacctttcctttcgaacaacggtacttactgcccgtaaaacagatcggcacctatcctcggtctcggctatctttacggcataccccgaagacgaatcagaattatcgactttaacagatcgatgttttgtcgttcaatcaaaagcatgattcaattaatagctcggctttcgagtcctatcctactcggcttctccccatttttcagacattttcctatcagtctcaccgtcaagatcgcagttcacaaagcacaccaactatatgtgaccccttgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcggaagaaaagaaagacaacaggagctaagccttgactaaactttgactaaactgcagtgggaacaccactccacaggcatcctcgacggcacggacgaagcctactcctcagagaaaccttcatctgacccgaactcgaactctggggttgggaaaagtagagcaagactgagtactacccactgtactcagcaagtcataccggaatagggatatgatgcagggaaatcatcaaagaagagctgaagtggttcatttgcataaagcgagcatttataaatagagattgaaagatttaaacagttgtaataattaattaatattaactatccactgtccaacgctaacccacgttgcgacaggcccaaccatccacctaaactatccaaattaaaggattacactaaggtgaaactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggaccattcgcatagccccctctaaccaagcacaccacacctcaggtttcacccccactcctcgcaaggcagcgggcagtcccctctcgtgcctaggtgaatccggaagccgcataggccatcgcaggacccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgattcattttaattaaccaacaccagagcggtggtactaatccaacattatcataagaaccaacagtctaaacattaatatgattttccccatggtgaactagttgaactaagcatggctaagcaattcctagtccaaactctaatcatgctataaccgggaccacgcgggtgatccaccgccggtccacgggatcgacggcccggatcggcccggggccgatcggacggtgcggcggcggccaggctaggctcggctcggcacaaagccggccgagcggtcacggtgacggcgcgcgcacgcgcacgcgcgttgccgacgacggcaaacgccggcggagacggcggcgcaaggcgccgaagggcggtgatgctaaagcgacgactaacgggcggcggcgctaaagcggcggctaggagggagagggaggggaaaaaaaaagggagggggtgcctcaccgagggtggccggcgcggaggaagacgatggcgaacggcgacggcaagccacgggaggacgacgtcggcgggcggacgagcttcggggtgccctaaggaaggagaagagagggattagagagagggagatggaccacggcgaccggaaaccatggccgaaggcggcggtggaggtggtgctcacccgaatgcgagggaacgagggctccggcgaagaacctcgacggaggaggggtggacggggtggatctcggccacgcgaacccgacggcggcgacggcgcggcctggcggcgaccctaacggcggctagcggcggccggagtagcggaaaaggcggcggcaaggggttgcacggtgcgggagcgatgggaggctcgagagagtgcggcgaaatggggaaaaagtgagaggggacgacggcgatgcttaaatagggggagagggaaccggacgtggccgagagaggcgggaatcgccggccgacgtggggagtgggggaggagagagaggcgggattcgaaaatcgaatcccggccatctcgggcgcggacgcgagcgggagagggagaggagtgggcgcgggagacgcggcgcacgcgcgggcgtggtcgacgtggcccggaggaggtggagacgagggcgcggcggcggttgcgggcgcgacggcgcgagcgagatcagcgggaggtgggggaaggacccgacaggtgggccccacctgtcggcgaccccgagagaggaggcggcggggcggcctggctgggccttggcctgcggccggcccagcaaggaggaggggaggaaggagggaatgggccggcggcccattcgaaaaaaaaggaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcctgatttcacctgcattttcttagggtcatttataaaaattacaattttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtgaccttgtttctggttctcctttcgctggtatcaagtatacgaaccggcttctccacatatgttaggtcctcctggatatcaatgtgttccgaatcagcctgttcttcaggtacccttaagcacttctttagttgggacacgtggaacacgtcatggatgccgatcatgttggatggaagttctagctgataagcaacttctccccttcgttccaagattttgtatggtcccacgaagcgtggtgccaacttgcctttcgtctgaaaccggtgtactccccggagcggagtgacacgaagatacacgtaatctcctacctcaaaagtgagctcccttcgacggttatccgcgtagctcttctgtcgagactgggcaattctcaacctttccctgatgatcctgactttctcttctgcttccgctaatacctctgttccgaacagttgacgctcgcctgtctgatcccagaagagaggtgtgcggcacttccggccgtataaagcttcaaacggtgccatctgtagactggcctggtagttgttgttgtacgagaattccgcatatggcaagcttttgtcccaagctccaccaaaatcaagagcgcaagctctcaacatatcttccaagatttgattgactcgctcggtctgaccatcagtttgcgggtgataggccgtgctgaaatttaaacgggtccccatttcttcctgcagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagatcgaatcgtgacccgacgatgtccggggcagtcccgttataaagtaaattccaatctcctcccatttccattccgggatttgaagaggttggagtaaacctgctggtctttggtgctctgccttcactcgttggcaaacatcacagagtgcgacgaattcagctatttctctcctcatgctgacccaccaaaacttttctttgaggtcttgatacattttagtgctgcctggatgaatggagtactgggtctgatgagcctcagtgagtatcagatccttcagttccttgtcgtcaggtacacataatctttctcccaaccagattgtgccgtgttcatcttcgtggaaatcccgggctttcccgactctcatattctttttcagctctgctatttcagaatcatttacttgagctactctgacttgatccacgagcgtaggccgtgcctccagagcggctacgaacccgtgttcaacaattcccacgttgagatgctcaaactcctgccgcaattcctcacacatgccctcgatgcatagggcagtgcagtaacttttccggcttaatgcgtctgccaccacattggctttacccgggtggtagtgaatactcatgtcatagtctttgattagttccaaccatcttcgttgtcggagatttaggtccggttgggtgaagatgtatttcagactcttatggtccgtatatacttcgcagcggttgccaattagatagtgcctccagatcttcaaagcatgaaccactgctgccaattctaggtcatgagttggataattcccttcgtgtggacgcaactgccgtgaggcatacgcaaccactctgccctcttgcattaggacacatccaagtccgtgacgggatgcatcgcaatagacttggaagtctttcatctggtcgggcaaaatcaaaaccggtgcggatactaatttcttcttgagctcctcaaaactcttatcgcactcagctgtccacttaaacttctcatctttcttaagcaactgagtcatgggtcgggcgattctggagaagttttcgatgaatcggcggtaataacctgccagtcctagaaaacttcgaatctgcgacacggtcttcggtgggatccacttggtgactgactctacgtttgacggatcaactgccacaccctgggctgtaatgacatggcccagaaatttgacttccgtcaaccagaagtcacacttgctgaacttggcgtatagctggtgctccttcaacttctcgagtaccagacggagatgttgctcatgttcttcctcggattttgagtagataagtatgtcgtcgatgaataccacaacaaacttgtccagaaattccatgaacactttgttcatcagattcatgaagaatgcaggtgcgttagtaggtccgaaggacataaccgtgcactcatatagcccgtaccgagtggtgaaggccgtcttcggaatatcctcttcccgaattctcaactggtggtagcctgatcgcaggtctatcttagaaaacactttagctcctttcagttgatcaaataaatcgtcgatccgcggcaagggatatttgttcttgattgtgacctcattgagtgcgcgataatcaacgcacatcctcttcgtcttatcctttttctccacaaaaatgaccggagcaccccaaggtgaagtacttggtcgaatgtaccctttctgcagctgctcatcaacttgcttcttgacctctgctagttcgttggctgccatcctgtacggtctcttgtaaattggggcggttcccggtgccaagtcaatccggaattcaatctctctcttgggtggcatggtagtgaggtcttcggggaacacttccggatactcgcagactatgggtatatattccattttcctcaagttcttctccacggtgtccactgggatttctgcttcaatctgattcaaagagaccccttgctttggtgagactagtgatttgtacgccacggtttctcccttctcgttggtcagggtgactgtgcgattcgcacaatcgatgactcccttgaacttggtcagccaatccatcccaagaatgacgtctaggtctttggattcaagaagaatgaggttggctagaaatggtgatctttggatttctattagcactgaagggctaaaactgactgaggttgaactatttcccggggtatgaactctcattggtgtgctaagctcttctttccttaacccatacctccccacgaatttctttgaaatgaaagaatgcgttgcaccagaatcaaaaagtactgttgcagggattgagttaacaggaaacgtacccagtacaacctctggtgctgcttgtgcctcctccgcagatgcgtggttgacacgagcctggataaaccttggcccggcacgcctgggcttcgggcatttgtcagcgaagtggccaagctcgccacagttgaagcaggaccctgtttttgctccagtctccttcttggcttgcgcgggcgggcctgactgtgccggtgccattggtggacgtggagctgcaccgcggttggactgacctccatggtggttctgactgccactggcgccctgaggaaagttgctaggattgaacgggcggtactggcggacgatcatggtggtaggtccaccctgctgcccgggagtgaagcgcggcctctggcgacttccctgaggtgccctgaactgtgcggccttcctcttcctgtccatcttgttgcgttggtcctcctgacgaattgccttgtcaactagcctctcaaagtcggcgtagtccccagatatcagttggttggtcagctcgtcatccagacctgccatgaacttttcctgcttctcggcgtcggtgcggacatcctctggtgcatatcgtgcgaggcgattaaactcatggaggtactccgtcacagtcctgttgccctgatggagtgcacgaaattccctcttcttttgtgccacgaccccatctggcacctgtgccttcctgaagctacggcagaactctgcccatgtgacttcagtacccggtgggcgggtggccatgtgattgtcccaccaagccgacgcaggcccttgaagctggtgtgtggcaaaagcgaccttctcctgatcattgcactgcaggagattcagcttcttctctattgcatggagccagtcatttgcctccatagggttggtggtgctggagaaggtgggtggcctgacacgtaggaactcaggcaacttggactgagggggagggggaccaaactgctggtgctgctgttcggcgtgctgcatcatcctctggtgcatctgctggtgctgctgctgcatctgctgcatcatggctgccatcatctgagtctgatgtgccataacttgggcaagggtcggattctcgggaagtggtggcagaccattgccggaatcactgctggggtgcacaccatcagcacgttcttcgccgttgctgccctcgcctatcgtgcgggtgccagtcctggtgtagaccatctagagggaaaagcagacgggggaaaagaagaaaaacagatgctcaggaactaagctttattacaaaggaatttaaactgcaattgttctgatctgaattaaaacacttaaaagagcaagcaaaaatccttattaagacagccatatcataggcacatgatatcgaccgtcgactgaccccaaacaagcaacctaaacacacaaactaacaagcagaagctagacagtcgataaactaatgggaaaaaaacgagcctaatgctcggaacggctcctgcggtcggtggagtcgaaggcgtcctcctgctcgtcaccaggtccctctgagcgactcctggagcctggcagatacgtctcgccgctgcctgactgtgagccactggagctgttgctgctgagatcgcggctgccactgggagtagcagacaaccaacctccggtgccactggctggacctctggcggctgatgctggagcgaaggagagagcggacgcgggagctggagctggagctgcaggaactgcgggcggaactggaggtgctgcgggagctgctgctggaggcgggttcctgggcgcaagctggatgcgcacgggtgccgtcatagtcttgcggggcgtagtgcggatccggactcctcctggcgctggaagaccctttagctgagcgttctccctcttcaggcgcgctatctcgtccttcagagcgacgatcctcatgagcttcccatcgttcaaggccttggtcgccttgtgcaggtccgagtgcatcctatccagtcccctcatcacagcacacatgtgaccaaaggtggtgtcgttctcgccggctgtcggacggaaggaactgacatcatcaccgttggctcgacgggggtggaagcggtacgccgtgtcatggaagatgtagttgtggcgctcccgcagtctggccatcatcaagtaggctgcctcctgacaggcgtgatctgctgtgcctcctgacgcctcaactgccatgttagcgaggcaagtccccacgtagccatggacctccaagctgacacggtgaggaagctcgccactgagcggtggaatagtcgtgtactccggcgcgttggggtagcccaccaccagtgtcatgcgtgccaactctgccacaaagtcgatcatgccttctccgcggtggttgggtgggtgaccggccatctagagaagacaagtgagtaggatcaatgcatgctcaaatccaaatttaaacaaagcaataaagactcaaataagggaatcgaataagagcgaaattttatgcatagatcagtttgcataagagcgaataaataagacagactcacataacgataaaataatgagaaattagatacatactaataataacaaacaaagcataaataccttgcaacccatgttactgagctaggacctaatgcatttcacccatcaaatcccaactgactgacgaataaatcccaatagttttactaaaaccctagactgactcgttttggcaaatcccacttaaatgagcgacaagatttttcccttgaaccacaagaacagatcccaattttcccggaacaaatccaattgcaaagaacatatgcaatgaaaaggattcagagggctcttaggtttttttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcggaagaaaagaaagacaacaggagctaagccttgactaaactttgactaaactgcagcgggaacaccactccacaggcatcctcgacggcacggacgaagcctact

SEQ ID NO: 69905 - DNA, 7470 bp, Oryza sativa
  unsure (1)..(7470): unsure at all n locations
gccaagatgcaatcttagtggccatgtcagcagaaacccaatcatatatctctagattgtaatgcgccaccttatgcaattcgtgaaggttttcagctacagtgttgtgcaatggatgcaatttgttgagttcatgctgattgcagtgagggcggtgtgtttggattggaaacatctgtttattatctaggccacataaaaaagcatcactccagaatagctcattgctggttatgattgtattgttgaggcttgaattcgtgtgttttctatttgtcttaattcgttttaggccgctgtaaaagatacccctctactagtatcacagtaggtcagtagctacttgttcttgggcatactcatcaatctactaagatcacaataaggaattgatgcagcataaaactttagttttgacttacacttgcctataataacgctataaagctcctgacactgttgatgagtatggcaagcccattgacaactgctctttctttgctgtctttgttcaggagttgcccaaatcgcttccaatcacttgtcggcaaaaaggaaggtatgaccggaacgtcgtaatcctcaaggatcccatgaggaggctatggccggtcttctaccatgacaaaccggtcttcgtaggcttcaccgcgggctggaaaccttttgctgcagcaaacaacctccaggctggggatgtctgcaagtttgtgaaagagatggacgaagatgagcttgcgttccaggtttatatcacaagaaagtgatggcaagtgctctagctgggtgcaccatcttcagtagaacatggctgctctgctccctctgtaaatataatcttaggttggtttgcttttatgcaatgttcttgctgccatatttttcgttttatccatcagggaaattcttgcagctcacatgttcacatgactctgtgcaggcatcaggaactatggcttttcttttggttgcaacgacaacaatgtgctggctggccaccaggttgtgtgaaagccgcggttctaggcgccctccactactgacgagatgatggttctttttgggttggctgttgtgctgcatacttgtcctgaccaattggtgtaatgtatatatatagccttgccgtccaagacgacaagctgacaatattgtggacttcaacaatgcaaaggtcaaggcattgaacttgtgttgaatacttgaataagatgttggcactttggaaccagactcccttccctttttttacctgtagacaagacaccacggtctaataactggctggtctaactgagtccacggtctcgcaaccaaggttcaccaaaccattttgggtggggttatcatcacactacagtttagcagttatcgtggtaaccgcgttgttaccgtgaaaaccgtgtgattaacacgaggtattccgtagttttaaaaaccgagaaaattaccgcacaagataactacgagaactgcacgaaaaccgtacggtaaacccctcgcaacgttaggcgttggccgatgccgtattgccgtcggatcggtgttcgggtcgtcgaaccaccgatggcggcgacggacgcagcgatcgatcggcacaggcgagagcccgagagctcccgttctcccggcgccgcggcagctagtgacacccgtatctcatgggatgggattactggcgtgcttcgcgcacgcaggtggcaacccgggaaaagttggcttccccggtgggggttcgctcgctcgatcggtcggggcagtcaagtgctggcggaataaaggaggattggtttgttagatggatctccctccccttgagcccaacggctcaagggggccttgacccgcgccctgatcgggggcgcccagcccaatggctggtgggccccgtcacactgtgccatataaagaggggtggaggacngnacngcataacnacacaaggaacgaggntcgnnngccgcgccgccactccaccccanaaaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaataggaaacactaacaatggtatcagagccatcctagcgtttatttttggttcggggatagacatccacagagaagaaagaaatccaaagcaaagaaaagcaaacgatccaacgtatcgaaaagatcgaaaccctaaccctaatcttacctcgtcgccggccgtcgttgacgccggccacggagggggagaggggcaaagaggcaccgccgaggagccactcgacagccgcgcgcgcacccgcgggtgaacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaagaaggagggggcgccgcggcacaaccgctcgacggcagcgcactcaccctcgagtgagtgcgcgcaccggcgatggggagtgcgacggcgccgccgtgtcgccgtgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccgggccgaaagcggcccaagtggggagcgcgcggcggcggctttcccggcccaggcccaggttgcggcctgggggaggggagggggcgctcgcccgcgcgcaaggtggccatgggccgaccggcaaaggccggaaaagttcactttaggtccctccgaaggaagcattttcaatatgtttaatgattgtgcttatttctaagcaatttgaaccaacgtgaaaattgtttagagaatagataaatgtgagaaatgcttctgaacatgtattttgtatattttcatgcaaattacaaaagaattttgaattgtttttacatgttttacctctgtttaaatttgaaccaacgggagaatttttacagagagtaaacaacagagttttgttattgtttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatgacaaaagagagagagggacaatgcttccctcatcatgtcgtatgacattgagcatgcgaaatggtccttagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaatcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcgtcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactacgcaaagaagtgaaagatccattagagttgccaatggagttgaagcaaaagttgaggctgttggagatcttcgcctagaactcgcgaatggcttcacacttttacttccagacgtttttatgtcccttctttgcaaagaaacttgataataagtgtatccaaattggattctgatatatttgaaatggcaaatgtgaactatggtataataatgaatgtattggtcttgtgttgcaagatcagctttatttgttatctctttctgagaatgtgaatgttgtgtcctcgttgacaaaagaaaagaaagcgaactcttgatgtctcatcgaaattatggcactgttgtttaggccatatttcgagggggagaattgagagactggttaagaatgtaattcttcctccattggagttctcagttttagaacaatgcatacaatgtatagattgcatcggtgcccaaaacaccatatgagctatggatcctccatgtgtgggggagtcctgcaaaggataaagtatttaacccaaaacagtaagctgccattttattggctattctgaaagatcaaaaggtcatcatttctactgtccaaacagttatacaaagtttgtagaaacgagacacgccgtcttcttggaagacgaaatgattagggggagctcggtagttcgagaaattgatcttgaggagaggcgggtgtctgtacccgctccgttgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagctgaaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaatcaaatatgactccagagggaatatagaaaagtttaaagtgcgacttgtggcaacagttttcacgcaaagaaaagagattacaatgagacattttctccagtctcttgtaaagattccttcatgattataatggcactagtggcacattatgatttggaattacatcagatggatgtaaaaacggaatttctaaatggtgatttgaagaaaaaaagtatacatggcacaaccgaaaggtttcgtcatgaaatgaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatatagaaaatgtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcaactgtaggaagcctacagtacgcgcaagtgtgcacacgacctgacttggcatttgttaccgggttatttggcagatttcaaagtaatccaggcctagagcactggaaattggtatagaaagtcttgcgtgattgcaaggaacaaaaggcctcatgatgtcttacagaaaagcagaatcgctccacatagtggggtattcgaattctgactttgcaaaagataatacaaagttaacatcgggatacatgtttaccctgacagtaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaacggctcaagggggccttgacccgcgccctgatcgggggcgcccagcccaatggctggtgggccccgtcacactgtgccatataaagagggg

SEQ ID NO: 69906 - DNA, 21749 bp, Oryza sativa
accactggaaggtttctctgaaaggcagcaggctcaagtaccacatcgtcgccagaagcatacacaactctcggagtgaaaagtacttagttgacaaaggtcgaaaggtgatcaaggtcaaaggtgtaaaggaatacgttgaatgctaactgaggacaacatgaagagaatagtgggaagtaaactgaatgtaaagaaagtgaatccgagttgcttgttcatgggagctattcccagttatgaaccaagtgatatgttcgaagatagtttacagaggtcagattaaaatcacatgtaacagcgaagcttcagatttggcagggtaacgatcaaaccataacaagtccagcagtaaagtcatctggaaaggcgtcaaagcatgtcaagtgggataagttgactctgttgagaaacataattgaaaggcgaaaattatcgaccctcgcatcgaatagcagaagtagctagcacccggagaccaggaaagctaatatgaggcagtttgtggcaacttagaagtaaatgacaagcatgatattctcataatgacaagcatggtatcctagtaatgacgagctgatctcgacgcataacgtgaaatgggtaacttctatgaggttgacgccaaaaatatgaactatacgaagttctggaactgaagccccatcttcaagtgccgcaacccagacgaagtcagctaaaggttcaaccagggacaagtcaggtgaagagaagattccatctgcaacaggagatcgagacaagcagtacagagtggagaagttttgctaggcaagtttgttatagaagacgcgacggaagaagtcagataagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtcaaaaaggagccctcaaattttacttgaattttcagagcaccggaaataattattaagcaacaaaaacaattatcaaagtttattaaaaagaaaaacctaaaaataaatcctcttcctcctttgggccaagcccagcccaaagtctccctctcctccctctctttctctccctctccttctctccctcctcctcttgggcctcctcccctcccggcccactccctcctccctctctctcccgggctccctcgccctcctctcctcctgggccgcctctcggcccaagccgttccgccccctcccacctgggccgcctccgggcccaacccgagcggcgccccccctgcctgagccagccgcgtgcgcacgcgcgccgcacgcgcgctgacgccgcgcgcccgcgtggggcccacgcgccaggccggccgtcgtcttcttcctcctcccgctcagcctcctctccctctccgggaaaacctagagccgttcctcctccaaatccgcgcaaatcaaaccatggattccaaaattaattggggggttttaaatcccattgattcctcttcaattccccccaatttcccccttggatcgtgcccccaatcgccgggaacgcccgcgttttctccggccgctttccatggccgccggccgccattcccgtcgccgttccgccctctcccgtgctcggctcgcttccctccgctataaaatgctaccccctcgctccgttctatcgttttagccccctcccgcgatctcccgtggtccctagccctctccccgccgtcctcctctctctcccgtgccgccggccgcctccagccgcctctccctcctcgccggagcgccgtccggtcgcgccgtcgcctcctccagcatcgcagtggcctccccttccccggcttgccctccgtttcccgcggagaccaccggagctgcgttcccgccgtcgcccttccctttcctccgcgccggccgcctccagccgcctctgtctccctgcctgagcgccggtcgacgtcgccaccacctccctcggctccacgacgccgctctcatcaacggcatcacctcctcctcgcccgaatttcgccggaacaccgtcgcccgcgccggcctcaccttcctcctcgtcgacgtctcctccggcaacccctttcgccatgcccgtgcgtcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcacccgtgcaccggtcggccgcacctccaccaccttcggcatcgcagccgcgacgccaccctcggcctcgcctccccttcgaccgaaccccgccggtgttcgtcgtcatcgtcatcgttcctcctcgccggctcgtcatctcgcggcgccgcctccgtcgtcggcattgcagcggcgtggaacacgccgtcctcgtctccgtgcagccgctgccggctgccctcgtcgcctcctcgccggctccggtcgtcgtcgtcgtcgtcctctcgtcgttcctggtttcgctcgttgtggcgttcgtccctctgtcaagccgttcttgtccgtcgtccgcgtccgtcaagtgtgccgctgcagccccatcgtcgtcttcgtcctcgcctccgcgtcgtcaagcctcgtgccggccgcgtctcaccttcgtccaaggatcgccgctgaagtcgttcccttgccgtctgtctccgccgcgcccgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgtcggtagtcattcgcttgtgcgtgtggtgaccgtgttagtgtgcccgctcggtagccgcgtggtttccacgtgtgcagcccgtgtggtgtctagtggactccgtttgtcggccactcgcctcggttgacacacgggatccgcttccatcgacccgtggaccgtctctgtgtactcggtctaccgcggtcctttttgttgacatgtggggtccgcatgtcaacggcgcagccttcctgtcttttccaggctagcgcttacacatgttttatagttgcaaagcttaattataataatccgcaaatctccatatgacagcattaaacttcggatgaccatgtcttggtcatacgagctccgaatcgacccgttcaagtctcttaatgtttgttataacctaaagaaccctgtgctttctttttatgtattgttattgcttctttataggcttgtagctttgcttgtgtgcttcgcgtagtcttcgtcgttctggaggttcccgaagcgtggttcgtggtcgtcgccgaaggttcggaagtccgttctctctgagcaaggcaagtcacatcatccttgaacatattgaatcccagtttataaaattattctgatttaaattattgcgttatcgctctatttaaattcccgcgttatcactgttttatttagccatgcctatttacctttgttatgaccttattattattgctattgttattattaccttgttcaccctaggttaaacaaaaccccaactagtgggtactctattaatggttccactagtatgaatttaggtagatgcttcgctgattaattaggcaatattaggtggttttataactttagactttgggaattctcatatcatctggacagtatggaatggttggcttatgttggaattggacccacacctccccctctattcaaaacccccaaaatggttttaggctgggctcgaggtgcgtggtttggtttggttagtcgtacctcgggtactataaggtttaagctcgggcctctgttgcaaagcactaccgtacttccacatgtctagtgggtaaggcttagtttgtggctcagtctggttataaacaaaagtacacggattagagatggacgaagtcgggggtcgatggacatctctagggcaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcattgtaggccttgggttaaggcaggttcatgagggttcacggccttgattaataatactgtgtagctctaggatcgtctttataaaatggctttgggcaactaagtgacttttaaatgctgtttactgcaaaacttaacccctatattattatccccttgtactcccttgcattaattacgcatctccggtgtggcttgctgagtactgtggttgtactcattcttgctctatctttctcccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtagatattatcgatataataaagatgtgtcttttatatcatggttgtatggtgtaccccggcttttcctgggacggggattaatacactagcgttcgggaaaatgaaattttcccagtcgcgacaagctggtatcagagccatctcgactgtaggataagccaagtggataaaacctaaggacatattttataaatgaaactatttgcgaaagttcctttttcctcctttcccctatgctatttgcaaaatgtttactctttctttcttcttcaaatttcaactagtacgagatggttagttttgcgaagaagaagatgtcgccaattgtttgccgaagctccggaagaccgcagggtccgctagcgaagtggaggaagcagtgaagccagctgtgaagccggagtgaagatcttggagaacccgtcgcagaacctaagccaccctctagggtagagtcgttagtcgtgtgctcctttgcttgtgtgtgtagcgcgtggtttgcatcggtgggttgtgatgtaaccatgctaggttgtttgcttaatcaacttgcagaataagtaaaacaaacagcacatcaacgagaagagttagttcctttaaggtcctgtctttagttctggtctattctttcctggcttgtttccactctcacctcaatccctgtaacagatgtttaacagagaaaaaggaaagaatgtcagcgggtatgcctcaagtaactcaagttttcaactcaatccaccactggcctcaagagagttaacaagggcacacccttggtccattccgagtatgctgcttagttcacagctaccattggttcgaagtcaagaccagaatcagtgtgtgtttgatcgagcatttgccacccaggtcaatgagcctccaatgccaaaagagcatgtccccttttgtcatgattgtagagagcaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaaatgctttcctcctagcctttcgtaccacgtggggtcacgtactaagcaagccaaaggcaagaagagtaagaatcagaagagaaaagcgtcgatgcgaactgaagaagaagtacgtaagatggctattagcagcaccgaatggcctcccgcagggataactattcctagacgtcaaagaggaaataccttccgaggtgcacgacagttgacccagcacctcctaagccatggtggcagagtatctgatagtgaagggtcagatcaagtctcctcggatgatgaagatgagtctccccgacatctcggtgaggaagagatggaatcaaaggcatgcacccgttgtggagaaattggacacattgctagcaggtgtctcacactctgccctcgttgtgaagaagaccatccaccaggggagtgtcccacccgcaaggtcacatgttttctgtgcgaaggtacaaaccatgtgcccaaggattgccaactcagtgtgttgttgaccaagaccgcagaaatccaacgaacaaccctacgattgtctcgtcagctagtcagctccaacagcaacatcgacgatatcatccacagcaccaatgctcctcctgctgcgcctgactctgcaataaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgggagtttgcagcaatcatgtaataaataaatacattcatgattataaacaatgagtttgttatgtttatggatgattcatgttgaggatgcaatgtaccgatgttaagcaccttcccttcttgtttaaggcaaggccttgtattcatgtaataagggagacatgtgtaataaaaacaagttctatgaggattatttcggaagatgctgatatgggattatgtgtataattgtttactgtcaaaggagacctagggcctcatttcagaggaactatgttctaacctcgagttaataaccaacctgatgatggaaaagaaaatcaagcgattaaccaaagagacatttgtttggactaagagtttcagatgtgtcttttttggatcaaaggcaacaaccgccagtctagcttttgacgaaccacttgaaggtttctctgaaaggcagcaggctcaagtaccacatcgtcaccagaagcatccacaactctcggagtgaaaagtacttagttgacaaaggtcgaaaggtgatcaaggtcaaaggtgtaaaggaatacgttgaatgctaactgaggacaacatgaagagaatagtgggaagtaaactgaatgtaaagaaagtgaatccgagttgcttgttcatgggagctattcccagttatgaaccaagtgatatgttcgaagatagtttacagaggtcagattaaaatcacatgtaacagcgaacccgtcgcagaacctaagccaccctctagggtagagtcgttagtcgtgtgctcctttgcttgtgtgtgtagcgcgtggtttgcatcggtgggttgtgatgtaaccatgctaggttgtttgcttaatcaacttgcagaataagtaaaacaaacagcacatcaacgagaagagttagttcctttaaggtcctgtctttagttctggtctattctttcctggcttgtttccactctcacctcaatccctgtaacagatgtttaacagagaaaaaggaaagaatgtcagcgggtatgcctcaagtaactcaagttttcaactcaatccaccactggcctcaagagagttaacaagggcacacccttggtccattccgagtatgctgcttagttcacagctaccattggttcgaagtcaagaccagaatcagtgtgtgtttgatcgagcatttgccacccaggtcaatgagcctccaatgccaaaagagcatgtccccttttgtcatgattgtagagagcaaggacactatgccctgaattgtccatgggtatatgccaaagaagccccttcctttggtttaacagggcagaaatctagatgagatcaaacaaccagcaaatgaaacgatattttagaaaaaaaaaaccagtcaccagataaatctagaaatactaaatggagtgtttttttcattggtaagtgaacacgagtttttagtggtataaaagtaaacatgtaacaaatttgatattatagaatcatatttttcctttttcccaatgtgatgcattttcatggaactttagaagtaaaaccacaaacagcaaattgaaaaggacatcttcgaaagtcaaaaccaattaattaataagtagaccttttttggtatagctgttacaccaaatcgaatcgattaatatttcctttagcttcataacaaattttcacgtgattttcacaggaccagtactcttacggcaaaatggtggtagagattacagaagtagagcaagcctcaaagagagggataccactgctagttcctgttccacccgtgaaaacatgacttgttcttgtggttttgtaacttagggaagtttgagtcgtgtccaatgtggaaaagtttgtactacgggtataaatacatgcctagagtcgtgtattaaaaaacaacaatcgttaaatatactctcggcgcatcgcaaccttttacttatctactttttcgatgagtttttgcttcgaatcagggcatcgagtacaattttctgacaagaggcatgacttgtctcagcggtttaagttggcagattagggcctcgctttagatgttctaatttatcttatacaaccgctggttaccatatatcttagctaatctaactggattattcgatttagttatatcggtgttaacagcaaaatttggcaagatactcagggtcgaggaacaaatcgaggcggatttggcatgggaaggagttgtttccaaatctggttgcgcatcggctaaaggctatcactggtggagaaaccatctttcgtcggttggccgaattccacaatagtcccgaatgcaataaaaactggggctaaagatgatctttagtcccggttcaaaagggtaacgggcatatttgatctttagtcccggttggtggactaaagatgatctttagtcccggttcaaatgctgtcagggcatgtcaggcccccctgggatcaccaaccgggactaaagatcgtaactttagtcccagttggtaataccaaccgggactaaagatcccggggatctttagcctcggttggtaacaccaaccgggactaaagtcccaccccctatatatatgtcttcctcctcctccagctgcccgagcaagcttcaaaatttcttcaaaaaagaggagaggtcatgccaaaatttctagtgaatttattttggtgattacatacaaatcggaggtgcctaaaaggtttgcaacttcatcctccaatgttttttttttgtcatattacatttgcagcaatattttgcacacttttttgtctccaaaatttagttgtaagttgatgagagagaaaatttgtgtggggaagaaagaatatatagaaatttagttcatttgctaaagaaggttttataaaatagttgagaaggaaaactctagtgaaaattaatcttaaataatagaaaacaaattaaaatgaaaattaaaagaagtaaaacacattaaaattagtttaaaactttagaaatagtaaataagaattattttgtgtaatattttatgatttttgtatgaataaagatatgtcattattgtatgactgttgaaacagtttgtaattatcttataattattgtatgactgtcattattgtaggaataattatttgcgtacggttttttttgactcatgtagatggatcgacaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatacaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccaaggaggtctgcgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgacaaggcatttggcgatttattgaaactcgtcaagaacattcttccggagggaaacaaattgcccgagacaacgtacgaggctaagaagatagtctgcctgctaggactggaagttcagaagattcacgcatgtccgaatgattgtatcctatatcgcggtgaggagtatgagaacctagaagcatgccatgtttgcaaagcactacgatacaagattagacgagacgatccaggaaaagttgacgggtagctaacaaagaagagaattcctgctatggtgatgtggtatttcccaataataccacagctaaggcgtttgttcaggaacaaggggaatgctagaatgatgcggtggcacactgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggttatgcatgaagaggaagtacataatgatgtcgattattattcaaggccccaagcaacctggtaacgacatcgatgtgtacctaagaccactggtcgaagatcttaaactgttgtggaagaaggaaggtgtccccgtgtgggacgaggacaaacaggaggagtttaacctatgagcactgctgttcgtaaccatcaacgattggcctgcactcactgcatggatgaaacagaaagtacgtatcttaagcactgtaggaaggttgtatacatgggtcatcgtcgattccttgcagcaaaccacccagtacggaagaaaggcaagcacttcgaacataaggccgaccaccgtacgaagcctaaacatcgcagcgggaaaacagtgttcggaaaggggcctggaagccagcctatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcaaaagatacactggaagcacgtaatgatctaaagcatatggaacaacgaggcgaccttcacccggaaccaaaggagaaaggaagtcattacttgagtgcagccagctacactcttagcaaggcagagaaggaaagtatgtttggatgcttggagagcataaaggtaccatctggatactccacgaatatcaagcgaataataagcacgaaggagaagaagttcacaaacctaaagtctcatgactatcacgtgttgatgacacaactgctaccagttgtaataaggggtatacttccagacaatgtccgggcaacaataacaaagctatgtgcattcatgaacgcaatttcacagaaggtcatcgatccggatagattagaagcccttcaaaatgaagtggtgcaatgtctcgtcagttttgagttgatatttccaccttcatttttcaatatagtgacgcatctgctttgtcaccttgtgaaagagatcagtattctcgggcctgtgtatctacacaacatgtttcctttcgagaggtacatgggcgttctgaagaagtatgttcgtaaccatgctcgtccagaggcaagcatcgccaagggttatggaacagaggaggccatcgaattttgcatagaatttatcgaagaccttcgcccaatcggggtacctgaatcacgccatgaggggagactacggggaaagggaactctcggaaggaaagcaataatgacggtagacaacaatttattccgcaaagcccatttcactattctgcaacactcttcattggtagctccttacaacgaggagcacttggctctagttcgcgccaggaacatcggtaagtccgatgcatggattacacggcatcacattgatactttccccgcgtggctacgacaatatctcatgggcaacgagtcgatcaaccaacaacttgccttcctggcgaggggaccgtctgggtcgatcgcaacattctagggatatcagatcaatgggtacatattctacacgagagcccaagacatgaagagcacgaaccaaaacagcgctgttcgtgtcgatgccatgggacacgatggaacaactgccacgtattacggtgctatcgaggacatatgggaatttgactatggtcctctcaaggttcctctgttccggtgccaatgggttaggttgactggtggaggcgtaatgattgatgacagtgggatggcaactgttgaccttaacaaggttggatactcggacgaaccttttgtccttgccaatgatgtaacgcaagtctttttcgtgaaggacatgtctagcaaaggaaagaagggcagagggcctgacgagcctaagcgtcaagtggttctcccaggcaaaagaaaaatcgtcggagttgaggacaacactgacgaggattacgatcagttggatgggcaaccccctttcacggtgacgattgaccctagcatcctcctatcaattgaagacaccccttactcatatagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggttttaacaagtttaaatcatgtatatgctagttatatgtgatacttacaatttttaaaagttttaaatcacgcaggtggcaatttcatatatatgttcattagagtttttaacatttaatttactatcattcatatgctaattataattgactagagaatttttaaaagttttaaatcacgcaagtggcaatttcatatgttaattagagtttttaacatttaatttactatcattcatatgctaattataattgactagagaatttttaaaagttttaaatcattcatgtggcatttacagatgttaattagagtttttcacaatttaatttactatcattcatatgctaattatatatgactattcgaatttttaaaagttttaaatcatgccaggcatttacatatgttaattagagtttttaacatttaatttaatataattcctatgctaagtatatatgatgattacaatttttattaattttaaatcatgcagtatgtacatacatatgttaattagagtttttaccaatttaataatatcattcatatgctaagtatatatgattattggaatttttattaattttaagtcatatatttgcttattaagatttatccacttaatttattacagacaaaaataatttttctaagtaattgtcattaatctttgtactttaaataattgtaatgcattatcttctattttagaaacacatatgtaagggaaataatatgcagtgctataatcagtagtcccggttcttaaccctaaccgggtttaaaaagaatttggaaatagcgggaaaagatcattagtcccggttaatgagaacaaccgggagtaaagatctctttagtcccggttgttactcccggttgttgagaacaatcgggagtaaagatctttcctttagtcccggttgttctcaacaaccgggactaaagatatctttagtcccggttgttctcatcaaccaggactaaagatccgggggtatatatattcccggtgggccctcgtcttctccaccaacacttagacgttttcggccgatcgatctctctcggcctctctccttcgccgccactgcctagggcatccccgcgccaacgccgccgtatctcgccatcgtctcgagctcgtcgtcctcgccaacgcctccgcctcctccgccgccgccgcatctctggggtgagagccgccgccgccgcctcccttcatctcgctctctccgatctcgatctctctccgtatgtcacgccgcccgccacgagacgccgtgccacgagacgccgcgccacgacgacgccgcgccacgacgacgccgcgccacgagaagccacgacgccgccgcggcatggcaccgtcggggcgccgccacgccgccgcggtgccacgccgccgccttcggcgccgcgcaacgccgtcgccgcaacgccacgccgccgcgccacgcgccggcctgatgccgtcacaccgccgttaacgaacacgtgaacgagaacgaacacgtcaacgtgaccgagaacgtgaacgggaacgagaacgatcgaacgaacgtgaacgagaaggagaacgagcgaacgaacgtgaacgtgaatgagaatgagcgaacaaatgtgaacgagaacgtgaacgagtgaacgaacttgaacgcgaacgagcgaacaagaacgagggaacgaacgtgaacgtgaaccagaacgagggaacgaacgtgaatgagaacgatcgaatgaagacaaacgagaacgagggaacgaacgtgaatgagggaacgtgaacgagcgaacgaacgagaaggagcgaacgaacgtgaatgagaacaaacgaacgaacgtgaatgagaacgagcgaacgaacgtgaacgagggaacgtgaacgagcgaatgaacgtgaacgaacgtgaacgtgaaatgcaatatatatatgttacttcgcgtttatcctaatacatctttttgtatcttgcagaaaagacgtgttgtcggagtcgtccctcaagccggagtggaagagctagccctagaaggaattcgtgcaggcaagtgacgtaataatataaatgattgttatatttgtaatgcaattaagattattatatttgtaattagacttagcatataagattgtgtagtgttctaatattatttgagttttaatataagattattttatttgtaattagacttagtatataattattgactatgaattggtgcgactcctagcaattgactattttagtgttaattagacttagcatatacgacagttacacttagcatacatgactattttagtcttagcatgtaatattatttgagttttaatataagattattttatttgtagttagacttagtatataattattgactacggaattggcttgtgcgactcctagcaattgactattttagtcttaattagacttagcatatacgaaagttacactgagcatacatgactattttagtcttagcatgtaatattatttgagttttaatataagattattttatttgtaattagacttagtatataattattgactagctagggtcgtataatatacgtcacctagacttagcttatatcatgatttgtaattagacttagcacgtaaggttgtgtagggttctaatgtacgacagttacacttagcatacatgacttagattgttaaaacataaatgtctcatgacttagcagatgtttcttgtatcaacagatggctgaccgcgatgagtaacagatattatacggtacaatcgcgaagggaagcagccagtactagaatgaagaagagtggaacgaggatccaaaccagtacttgaatgaggaagggaacgtggagagggatgcggaggggaaccagcaggggcacgtggaaagggatgtggaggggaaccaggaggaggaggctagtggaagtcaaccctccgttggacagaagagggcacgcgggcaacgaggtgcagcgaagaagcttgagggtcggcacatcataacggaagtggaagaagatggacgtcctagtgccccggccgaagctgccaagaactatgtacgtcacagcggttgggttgtgcgggataacgtgcctatcagtacggtgtactggcgaagaacaagggcacgcggagatcatgagagctttgtcctagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatcctgaaggggcagacaccgaacttcgacacattcccaaagctaagggatcactgggacgagttcgttgtatataagacaggtgaacaagggcaggtgatgatggaaagaaacaaagaaaatgccgccaagaagaagtaccatcaccacttggggtcaggaggctatagcgtcgcgatgccgaagtgggaggagatggaggctagcttgcttgagaggggtatcgaaccggcaactgctaattggccgaaacgatcgaagttctggtactatgctcacggtggaacgctcaacccagctgatggctcactggtcttcggcgatcagatacgagaggctgcgcgacgactaacagatgtagtggaagcctcctcacagggcacattccaaccggacagagatagggacgagctgacactcgccctacagactccagagcatctaggacgaacacgagggaaaggggtgattccttggaagattggtttcaaggaggacatccagacgtacaggagtcggatgaggagcaagagagataccgaggcgaagattgcagatttagagtcctgggtatcgagctatgagctcaacatgcaagaggaggtggcaaggaaggttgatgaacgcatggccgcacatcggtcccatgatccccagccgaccattcctcctgcaatgttgagcccgtcaggaaaccatagcagctacgcctcaacggggcaagtaggatcacagagcatggacgccatgcaaacccaggatgaatcgacctgtcctgttgatgacatcactcagcggacaccatgtgagctgtatattcctttcaagaacttatcaataaaggtaagctcgtagtttatatattttagatttggccattccgctagttgctgcttatatatgttgattactaataaataatctctcacgacatgaaggtggcgtcgggcatggccatcccaacggacccttcaggtacttaccactgcaggccgattccagcaggatactcgaaggtcgaagttgagttggtcgaaggagcgtacgaggacctcgagctagattaccctggaggagacggtgagacgcatctacgagacacaagccatgccattattctatggcacaggcggtacatcatcctccctgggcgacaagcggcgtctcatggaccatctcctccggctccgccatctcctcctcaggatcctgcaccgtctcctcctcatgctccgccagcaccgtctccacttcaggctccagcaccgactgctcctcaggctcctgcaccgactcctcctcgggctcctacacctactcctccgcaagctcctcttccggcaccttcaaagtcaagggccccctccagctccaccgcctgcccacacaagggcaacaaagaaggcgaaagttgacgccgccaagaacaaggacccggggtacgattgcacgcaagaggagcttgacgtttacgtggcatcagaagtcaagagacaattcaagcctcgaagtccagaaaagaagattcctatagacccgagtgtcaggaacttcttcaggggtatgtctgcacctgtcaaggaggccatcaagctatcggactatgagcgaacgctgaagaaagcatcttctggaaagtccaaaccagtccctcagcttggagagcaaccaaaccatgatatcgagccgttggtgaccggggaagacatgacgatagaagaatttattactgacaccggtctaactacggatcaattgctaggagtcgaaccaatagaaaaggcggaagtgaaatacatgtacaaactcggcaaaccgcttgtcaagcccgagctggtgcagtccctacccacacaaatgtacaagttccatcagctgtacatggagatgagcgccaccggtagagagatgatcggagcgaggatcagggacccggacttcttgcaaggagatgacattctctggatcaatttcaagggaatctacgaactataccagctggacgccctcgacgtctctattatgagttgctggattttgtaagtatatcgttcagttagatttcttaattactacgtctcctttaattaattaggtccttgtatataagtagactatataaaataaaatactcccttttatcgttgtagaatggagattcaaagggcctgacggcggagggttttcgatactggattcatcgaccctcggaaagtaaacgtcgcaatgctcgaccaatatccgcaagacatagaggacaatctcgtccatctccttcaggcgcagcattacaagacgttcatactgttgccgtacaacacagagttagtttaattttactatcttcctatataccaaatttcattcctgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcgaacttatagacaggtactgttataagttcctctgttaattaagaaattcttgttatgttaattgctactatgaatcatatctttaaactccatgtagggcttggtatcagttccgtcatttggtccgcggcaactggagagaaagacttaagcggaagttcaaatttcctgtgggtaaacatgctctacatttatatttctccgattcaaattaatacatacaagtgtatattaattagatctcacgccgttaatttgtcatttatttgtagtgcgcaaagcaaaagcagggaactaacttgtgcggctactacgtgtgcgagtattgccactgccttgtagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattttactacgacggaaacacaattcataggtccttagcttctgagctagtgactactactacgtcgaaatcgtagctagctaggacatataatggattgtaattaatacatgactacatatgtttctatatatatgtgtaaacattttctataatgtaaatatatatagtatatatatatatatatatatatacatatgcatttgcataacatatatatatgtataaatacatatatattatgcatgtacatatgtactgaaacatatatacatataataatatatatatatatatatatatatatatatgcatatatatgtattgaaacatatatatgcatggtttatatatatatatatataaaccatgcagcaacagggccatgcaaaaaaaaaaaggccagctctatctttagtcccggttggtaacaccaaccgggactaaagatggctcagccggccacgtggctgagccattaccaaccggaactaaagatcgatctttagtcccggatatttcacccaggactaaagatagcgatctttagtcccggattggtagtcccggtttagaaaccgggactaaagggggttacaaaccgggactactacaaagggtttctccaccagtgtatactggcctaaacagaatcggattcagccagccgatacaagtaggttaggcgatacatatatttttgagtttaagttgggttcgtatggaagacttggaaataattgccatacaaggatagatccattacaggtatttgtatatattaattaggaatatttatgagtcatgttagttagagattttggtaagggcccgccataggggattgtccaagtgttttgtaacttagggaattttgagtcgtgttcaatatgaacaagtttgtactacaagtataaatacatgcctagggtcttatagaaaaaaacaacaatagctcaatatactctcggcacatgccaactttttttacttttctactttttcgatgagtttttgctttaagttgggcatcggcttcgatcttccagcgagaggtatggcttttcccagcggcatgcatagtccggatataggacgtcttattaaatctcttactacatcatcacaaatcatatgtatgtgacagctcaattgatttaaggggcaattgcacctatgccccactttcacagccaattgctgttttaccctcagtttttagggtttacagttttacccccactttttgaatctgaatcagccgtgtagcccactcctaacagccggttttaacggtgttagttgtaaaaaaaggacatttaaacccttggtggttattgcatttttgccctttttttcagctttgtgtgattttgccactattttgtgatttccgcttgtgtgatgagcatttcgaccaaatatttgcatctcttctgatgtttttgtacatgagcatgcgttggtgaggaactgcagcggcggcgcgaggtagtcgaggcggaggcgcatccacccggcataggaggcgacgaagagacagtcaacggcgaggagcaatgccacctcctcgaggtgccaccattggaggtaggcggcgacctcgacggcgagtagcagcaagggacaggacaaggaacacccgatgcagccgtaggagcgcacccgcagcgccgtgctctccctcgccagccctcgacgcggccaccgccgcctccgcacgcacccgcagccgcctcgcccacccgcgcgcatccgtagccgccgcctcgccctcccgcggcctcctcctccgtgcgcgcccgca

SEQ ID NO: 69907 - DNA, 637 bp, Oryza sativa
actatagggcgaattcgagctcggtaccctcatgggaggccgcggtagcgcggatccggccagcgcggctgagctgagacgtcgaccaagcagatctagcagctgagcagccagatcgggcatggtggcggggtggtcctgtgagaggcggcgaagtgcgggaaaggcagcgccgggtgcagggagacagcggcgtcgggcgcaaggagacaacggtgtggagcgagggccgagacgatggtgcttgatcgggattacgttatttttgtgttggtgagatttgagaccgagagaaaaagttgtcaccttcctctagggtcggcctcccattttattttgcactgaggggaatcgggggctttccaaaaacataaggttttgggcgctaccaatcaatgcacgtgattgcataattatggtaataatcatgagttaaaacatgttaatcacgcggcaatgggtggaaaacggcagtgcgcaattgcctcaaagttttcatgccgagagtcaattttcccaacaatggtaattgattgttcggttcttcctatgtgcagcctatacttaatatactaattaccgtttgtttatatttggcagcaaaatgacaaaatattgacttatcttaatcgaattg

SEQ ID NO: 69908 - DNA, 600 bp, Oryza sativa
tgcgcgacggatcgctcgctcgatgtggttctcgttcttggtgatgaggcggcggcgagcgggtgtgtatataggcggcgggggcggtggaggaggagtggagaggagtctggaaagggggagaaggtggcaggaggtggaaggcgacattctagatgaagccaggatagagcccgccacgtcacgtcacgtgcatgtgcctgtgtgcccgtggttcgaaatttccgaaatttggcccctaccggtatgctcaaatctcgtccattttttttggtttttttaatttgatcaaattttattcaaaatcaatcaaaatttcaaataatttttgccagaaattaccgaaattttcaaaattttgataatttcggtaaccctggcataaaattcaatttcgaaattttaaaccctgcccgtggaacgggcacgggcgaggtgtctttggatgcccaaagcgtctccatgaaatacgtcgtcggaattccatatctttagtttcaactcggagaataatatttgcagtagaaatataaatgggttaattcatgaataatttactattaaaagtttgatatctgtattatttacgcctttagaagt

SEQ ID NO: 69909 - DNA, 1220 bp, Oryza sativa
acccctctgtcttccttttcaaaatgtttccactaaccataaaatcttcccttacaaccacccaagctcaaatttgaacagaggtggttaattaatatgtgttccttatcccgagtctaccagcaatggtgtatggtctgagagttctctactcagtgtttgactgtagctagtggattcttcaactcccattcagtactaactaacaccctgtccaacttctcataagttggaatttgtaggttgttagcccaagtaaacttgcgaaccgagagttcaatctctctcaaatttagactgtctatgacagcattaaacaagaagggccatttgtcgttatatctatcgttattcttttcttgtgggtttcttatgatattaaaatcccctcctattaccataggtaaagaatccctactacaagcattcacaagttctgtaagaaaagactccttatattcttcttgagctgccccatttaccgccactatgcaccattgcacatcatctgtcttatttctcacatggaatttaatataaaattccccctcatcaatactagctatatcgaaaaagtccaaattaattcccaacaaaatacctccagctcttcctcttggtcttgtccagtgccataggaagtccctacctcgacatatttttttaagccacgagtctgaaaagttgttcttacccgtttccaatagagcgataaaatctagcttttgctccttagaaatttctgagaggaatcttgatttagccaagtctttaagacctctgctattccaaaataatcctttcatggtgaacctcttttatttttagactttctccccaccttaactcgccttcatttatttttctttctccatttcttaacattatgtttcctcataagcatgtcggagtcacaacttaggtgacaatcatcctcattcatcaactcttccactaagccaccacataagtgatcaagaacctggttgtctaactcctcgttttcagaaaaaacactctcctcgacccccccccccttctaatacaacagacttctcaagatttgcactattgaatctaacaaactcagactttttaaaattatcaacagattctatcattaaatctctagtggcacctaggttcactcctatgtttcttaagtcatcaactacatgcgaatgagaaaaagaaaggaacgaatatttaaactcgttacc

SEQ ID NO: 69910 - DNA, 3406 bp, Oryza sativa
tcatcccatcctaggtgctatattttgaggcggagggagtaagttctaagttctaactggtactatcctgtttgaatgggattccgttctaagttttaagcaccgtcatcatgtatcaagcctacagttggtacttgggccggcacgtcccataatgggtctagaatcttggcacgacgggcggcctggcctggcccagcctggtaaatgggccattcttgtgccagctcggtacgctgataaaccaatagcatgtgaatggctcgatagcccaacaaacacaaggcctaggctgcgaggtcaccccggccagctcaccacagcggtgtcgtgcgctcgtccgtcggccaccgcggcacactgtgtcttctctcgagacatcgacattgaaggtgctcggcggctagcggcgatggagaaataggcggtggcggtggcagcacaaggtatagcgacgacgttagcctttctttaagcaataaaatcaacaatcaatacaaaatcataggtaagtgcaaaaccattattttatggtgcagtacagagtctagtggagtgcgagtatatactccatccgtggacttgtgggcccattaccacccctagccgtgagagacggcgacctggagaagggtggtgagctagcattggaggccggctaaagcgagcttgttgttaggacgtggtgtggatggtggtggatccaactgcagggagccgttcaagatgaggaaaacggtgaggctggtgcacctcactaccaactactaaaagatgagttggggggaggggggaggggaggtccaccaagggcgcataccaacggattaaaagatgaggagagaggggaggggagggggtggaggaggagaaggtcagccaaaggggcctcgttggcgctattgacgtcttcatactaatcgatggggtcgggcaatgacgcattggtgcagaggaggcatggttgagctgatgtcatgtgatgccatggagggaagagaaaaagaacaggagggttatggtttggagggatttacacgaatcttaaagcaacccgatgatctaaaatctacaagattgtaggggctcccaaaatttaactccaattaatcttggattagggccgaaacaattgatgatacttgttcatgctgatgttgctgaaacaatgtttctttgtagaaatgaatttacatcttatgttgcttgcttcatagagtagtgcgaaagagatgcgcacgatctcgcttcaatctgatcgcattgttgtccttggaaacaagacaacgctactagaacagggaaccaactcatttacctggcgaagtatgcaaggcgacaattaatggaggggatacactgaccaggattgggcatgcagaaatatgtgttcagagcacttcgggagatgccttagcctttatggccatccagttcccaggctcccagctttgcgattggatcaggggagtgcaaatgcagtcatgtggggccctggggtcagagaggagcctgaagaacctgcatcactggctcactggctcactgcatgacaacacaatacaacgaccgcgaacatagttacacaatccacaagtactcagcaaatatgcaaaagcaggatatggtgttacactattgccttacgccagtaatctacgaagacttcattgttcccacaagagagattactagtttggcaacaagcgtacaacagattatataagacagcacatgtccagagtaacatttacttcgaataaattacaggctcgccctcaatacaggcgtacaacaaattgcatcgcatctaatctatagtattcgtacatggcatttatacattaaaattggtggcttaaaaagggagaccttgggggcgcaatccaagacatttcttcagggcgattctggccttctctgccatcatataaccgtgcaggttgctccatttggacagtatgaaatgtcttgctgcacacatagagcattatctggcaacagccattgctaaccgcggtgacaaacttggccagtgtgcagtgccacatcgccatgctgatctggtgtctgatcctcacgtgaacaactctttagatagaagctgttgcgcaaggtactggccttctggttcctcaaggtaaaccttgtcagtcagataattctgtagattacttgcagcctcagcctgaattcgtgagccttgttccttcaaagcgggtaagaagcaccgcaatattacatctagaagtttcatgaactgtgatccgtatttcttgtgaagtgcaaaaccagcaacctgaacagaaacagaatccaagttggctacaacaaacctgctacaagcacacacgcataggaggggatgggggtcttgaagcatatttttaccttgaggaaagcatgaagggcacaagcagttgctgtggtggccgggagagtattaaggaacatggcaagccatttccacccctcagctaagccatgtggatgccgcacgcccctaatttcggtctgtagaaaaaaattgcggttgtatttcaattctaaataaaacatcaatttgttgaacagaagtctgctgctcaaataaaacgatcatatgaaacggtattaacactggatgaacttatggaactgtgatagtgaattcaattaatgtgcaaagcaacacatgttacactcagagtcagtgcactgaaaagagttatctgatcactgagagtcgtatgcacaatgcactgtgctagttggagccattttggcaaactgtctttcacgttggttgtaatggtttttctgtgagctcgtcacctctgtggtggcccatgtctaaataatatcccaggaaagaaaaactgacaaattgcaattaaagagaaataataagccctttttgcaacaaccaacaagacaagaaagcaccatattagtagagagggaaccaacaaaacactcaaaaccattaaatgcatacccatttctaacaattaataaccctaacagctatttttaccacactagtaatattagaaaacaggccatacacacctgaatcattgcagcatacagcttgacgtatgcggcaacatatgtcaaataactttcagtgctctcgagttgtccattttcttcctggtagccaatcagtctgtaataatctctattccgtacttgtgcctaaacaattacaagtaaaatcaggaaaaaaaatacatgagctaaacacaaaaataattatgtgaataaaacatcattataattgttcaaaacacctaaatagaacacctcacttgttttttccattgctgctcatatataagcaagaatataaacaagctgcaaagatattgaggagtttagtggcatgaagacttacgtttaaagcatgcagatgctttggaac

SEQ ID NO: 69911 - DNA, 4388 bp, Oryza sativa
tgatataccagtgttttggcaaaaaaaaataaatttagatgttttcatatggaaaaaaactcaaaaagagtccatttcactcatccaaactattttaggttcattgagcattaagatatcacattggaattattaatattgagaaggcgttcttaatggatgaaaatttgatgatatactagtgttttggcaaaaaataaatttagatgtttttcatatgaaaaaaaaatcatttcgctcctccaaactattttgccacagcatttaacctcctaacaattcctcagcttagtttacaccctgaactattgaaaacagttcaacttactctctaataatattcctcaagtactgctgtactcctacttccgaagagatgacatgcatgagcgcaagagcaggacagccatccgtcgatcgaactcgaacacgaccaagtctgcactgtgttgatcatatcagctcagctcagctagctggtggccagctccgtctcttgattgcctagtgctgcaattatatcgacccagttctagctagctttgctcaagttgtccaagcagatcgatgctttgaaacaacagcctgccgaaaataggcaatcgattcttacttaccacgatgagagtaattatcctatgaaatggcatatgatcattgaaacttggtagcagtttcgccacgacacaccgcaaaaatcctttttttaaaagtactacctttaatttaaaatatctgacgatgttgattttgaacataacagctgaaagtttattttattttaaatttatcattaaatatactttaagtataataaattttaaagtttcactaaattttgacaaatgatcaaacgcatataactatataagttaacggtacgtacatttaaaatgagtacagtacaatggacatcggctcacacaacacaaccacacccatatcatcacaaacagctctatttttttccttctaacttttacatgatactcactctgtttcacaatataagtcattctagcatttcccatattcatatcgatgctaacgaatctaaacatatatatcaatctagattcaaacatcaatatgaatgtgaaaaatattagaatgacttacattgtgaaacggaggaagtactttcggcagaggactaggagtgaggtaggagtgaggtgggagaggtggggaatcgtgtgagatgccctagtgccctaggacacatttcctctcatatctgatatgttggtctagttgattaaagccaatgtttaaccccagctagttggtaacgataatgtattgagatccaatgcagttgtcactatgactgcacaatagcaactgcacacaatttgagcccacacaatttgagcccttcttgatccaatggtccaaatctattgatacagtaaaaatcaaaattttactatttgtcagagcaaatcgctgcagtatttagatgcgtctggaattctgaatcatgtgttttaaatctggtggtgctcgtgtgactgcttaacttgtggccacactagccactgcacctcaagcggatccaacggctattcatcttaaaataagtttatttttcacctattccacacatagtaattcaaaactaaaaagactataatactcatactttatcaaatctcaatacaactatttccactttatctactctcaatacaattatttcgtacttccacaaatttcaatgcaatgattattctacaaatgaacttattttgatacaaataaaatgagctaaaaatgaacttactaggagacgtaggaagtatgctattagttcttataaaacaattaatttatgatataccagttagacatgagccctagctatatttctatttaaataatagaggggaaaatgttattaataggaaaacgagtaaatttcggaaaagcacaactattttcgttaaaactactagtttgcgacaacttcacctggttttcttacaaagtggaatggaacaatagttgatgattttctgcaactttttttttgtcttattggttttggcctatatgtcagacatacatataaatatataatacttatactgttgcaagttgggtccacatgtcagacactcataccagttaaagttgtggggttttggtaaaattgttcacaatcgttgtagttttgttagatgtcctgctatagttacagctaactgataagctaactgataatttgcagttttacgaaatccactctaggaaatactactccctccgtttcaaaatgtttgacaccgttgacttttcagtacgtgtttgatcattcgtcttattcaaaaaatttaagtaattatttattctttttatatcatttgattcattgttaaatatactttcatgtacacatatagttttacatattttacaattttttttaataagacgaacggttaaacatgtgttaaaaagtcaacggtgagtattagggtatgcagagtccaggagcaaacggtcaaatttctcatttttagaacgcccagcagatggggtcaaatttatcatcaaggagtactactcaattgttgcaaaacccagtgtcatatatatgatcatcctcggtgtatctggtaatgttgcttgatggcatgatagcaacagcatgccggcattgacatggtaaaaacaaaaataactaataattaaaagaggacacacacttcatgtggggtcatgtggctcttaacaccggttaagagttacaagaaacatcattttgtttgacttgcctctatcgattagtgtgaaaatacagagaagacgtttggcttatcaactggcgtttagatgtcatgagactatgagagtgataggaggagagtggcaggtcaggaagaatgatcgacaccgggacagatcatacttaattatataatgtcgacatgattgttgagggaatgatacgtttttaggccttgtttggggcaaattcttgtgctggctgtcattgactaggagttgtgttcttcgccctggaatttaatctttcttgggtattgcttccttatcatttgatcacctatcttattaaaaattacaattatcatttactccctccgtctcaaaatataagcatttttagtatagtgacaagtcaaacatttttaacttttaccattaatagcaaaaaaataaaaaagattaatcatgtaaaattgatgttactagatttatcattaaacaaactatcataatatcataatatgtaactctttttatttaaaacatcttacttttatagatattgttagtcaaagtagcatattagagaccgtgttagggtctaaaaatgctatattttaggaactaccatttgtaaagaactaccattaatttccttgaaacttgatagcaatgatccaggcctgtttgggaacaataaatttgaccaaattgtatacgaaagaaagagattcctacggaaattctacctcccaaacgagatgaaacctagtaacctacaggctacagccataaattcaaaacatggaaagcttgatttttcccccatacatgtacaatgggcttacattacggagccgcaacaactcacagccggaggtgctcgaaaagcttggacgtcacaagagcagtttgctcatagaccgatattcgttagcgagattgcagttcttgaagcagagggccaatcctttgagcgccaagaaataatgcgtcgacaagcacgagtgctccaacctgttgttccaggaaggaacatataaaagcatttccattggagaaaagaattgatgtgtgcctctcttgaattcagagaattaccaaacggcctgtgaagatcagacggtagcccagcccttctttcacagcctgcgctcgttgctgatccgtccagctgaaatgaagtcgttgtcagtacacaaagcttaaagatttgtaatcagatggagtgctctggagtatggaggagcgatagtgcatgcttctgtggaagtctgaaacatatttctaataagaaaatcccattataatgctcatctgcctgtgtagacacaatctgaagttttaagttgttggcgagttctagcttgcctatctcattatcacattattctgttcttgtactcaaacaactgctttgattttaatacatgacttgtgtatgtagattggacagataataatagggataataaaccactaggaggggagaatagctggggtcttgaaacctacccgaaaaattccgaaaccccaccaataccagcaagcttgaaaggctggggaccttctcgctcaaagtcctgaaggggtaaaattataaaccataattcagtaaaaagaagtactccctccatcccctaatataagggatt

SEQ ID NO: 69912 - DNA, 45309 bp, Oryza sativa
  unsure (1)..(45309): unsure at all n locations
gccgccccctcccccggatatgcaaggggaaggaggggagggggcaggcgccgccagatccgccacccccaagcccccccccttcgccggatctgcacgggaacggaggggagggggcgcgcgccgccgccgctgtcacccgtggccgccgcgtgctctcctcccgccatgtgccgcccgatccaccgccccctcccccggatctgcaaggggaaggaggggagggggcgagcgccgccggatccactgcccccaacccccctccgctggatctgcacgtatgggcgacagcctggagcctgtcccctatttttccttgcggtttcacttacgatccgtatgggaaaaggggggggggcgtccaggaaaatctattctgtagtagtgacaacccaatggttgggtcgggcctgcacaggactgacccagttaagccgtgttgtactagggctgggccgtccggccccaggccttttggcattctatggatgtgtacattgtccgattggggcagtatcggatgtacgggagcaatgagccgggaggggagtacaatctgagcatacaggatccggactcccgaacggacgcgcccgcgaggagcgacacgctgtagcagtcgacggataaattttggcaatttgaccttttaaaaaacttatttgaagaatagaccatgtcaaaaatttattacaaaaatatatcaaaacctcagcgctaatgggtttagcgctgagttataatatctcagcgccacatattttggcgctaaaaacctatccgagtagccactatacatcatatcattggatctgagcgccaataccacaggcgctaaggttttggtctatttttgcaatatgtttttgacatggcctattcttgaaataaattttctaaaaggatcaaatcactactggagaactaatttttgttgggtcaaccaaaaatcacaatagtcccggttacaaaaagaaccaggactaaaaatcatctttaccctggttgaaaagcccataaccattttatgatctttagtcccggttgataacatcaactgggactacatatcattttcagtcccggttgaaaaagtgtccgccctcctacccgttttattcccgtttggaaacaccaaccgggacttaaaattggcggataatatataatcccgagcacttatcctccaaccacctctacccttatcctcgtccactcttttcttatcttctccctttcctctcgctcttttcctctaacttatcctctcaagtgagcgagcaggcgggcacgcaagggagctagcgaggccggcgacagagggaggcgcggcgggcggcgacgtgcgcggtggtggccggtggccaacggcctacgcctcggttggatctgagttattttttttagaatttgtgattccaatgcagatttgatttgtgattaatctatgatgtatttgatttgtgtgcgatgtgaatatgtgatgtatttgtgatgatatttttagaacttgtgatgtaatttttttttatgaatttgtgatgtgtgtgtggagatgatcgatttgaggatttggagatgatccttttgttctgtgatttgtgaggatcgatttgggatttcacaatttggggatgattttgggatggagtgaaatcaattttcaatgttaaaaacaatgaaagaaaagaaaaaaactggcaaccggacctggcttggctccatctttagtctcgattggtaacactaaccggaactaaaaatgaatttttaatcccggttatttcacctcccggattcatggtgccggttgcataccgggaatattgggggttaccaaccgggagtaaaaccccctttctctagcagtgaactgtcaaaattttggcaaaaactttacggatattttaagtaggtatctaatccgtaaagataaagataaagaataaaataaacataaaaataaatttgatcatcgacttgtggcaaacataaaattcctttatttaggatggagccattgatggactggacatatccgtctcaacaaatgacttaccatcatacatctatagtgcaggtgataacattttgagcttgcatatcttgcagagctactgtacgattatttaaaccaccctagttctattattcgacgcactagggagttttatatccttgaactggagcctatagcttcgtcgaatgcagaagacgcgcatgcatgcacgcacgcatcgacgcatggtgcgtcatgcatcatggctcggcatagagatggtccggcagcctgggcttgacaacggcgaggagagggatcttccgcggcatggtgagcccgaagatctcttccatgctcagctcgccggcagcgatgccgtcggggaggttccaggagaaggcgtgcagcaggttggcgagggcgagctggatgaccttgagaccgaggctgtacccggggcacatccgccggcccgtgccgaacggcagaagctcgaagtctcgccccttgacgtcgatctcgcttcccacgaaccgctccggccggaactcctccggcgagtcccacagcgacgggtcgcggctgatggtccacgtgttgacgagcacgcgcgtgccggcggggacgtcgtagccggcgacggtggcgtcctcgcgagacatccggggtatcagcagcggcgccaccgggtgcatccgcatcgtctccttcatgatggcgtcgacgtaggggaggtgcgggatgtcgctctctgtcaccaagcggccactgccgacgacgttgtctagctccttggtggccttggcgaggatcgccggattcttcaggacctctgacatggcccattccacggtcactgcactggtgtccgcgccaccggcgacaaggttctgcacaaggcatatatgccaaacggtgcactgtatcaaaatgtcgtcctaatagttatatcaaaaaataggataaaaattagacaatacaaaattactatatttattagaaagaaaagttaaattcgacttgcacagagggaaaatttcaagctgtgaacactattatttttttttcacgtgactacgacgagaccgtacgctggattgttactattagtctacgacgaaaccgtacgctggattgttactattagtctagtacacccaaaagtgcatgcattttttttttgttcttatagaattttctcttaaattactcatccgatttacgatccgatttcatgattatattttttatgaaaaaatacaaattacttttataatttatctaaattacttttagattttattaaattgcttcttagtcataaaagtaaattcactgaagcctgaaagtaatttacatatactatataagtaacttaaaagaaaaggaaagtaacttgttatcgcattaaaagtaaatatgttgtggggtaaaaacataagtctatctagaaattagatttaattgatgtgttaccccacaactgatttacttctaatgccgtgagaagttattttctttttcttaagttactgctataatatatataaattgcttttaggccttattaaatttacttttatatatctaagatgtagtttagtaaaatctaaaattaatttgtatttttttattaaaatataatcatgtaagatcttgttgtaaagatttaattgttacggacacaatagtgtattcggatcgtagttcggataagtaaattaagagaaaattttatttgaagcaaaggtggtaggaacatatttgatacttacttgatagacaagtagtatatttggacaacatctgatgatgtcacttgttagcactaaaacgagatgtctctcgatttagattttgctggttttttttcacacgttagttcaactagaaaggtagcccgcgcattcgcgcgggcatataagatacgcttttgtaaggtgtaatatcgaccgggtgacacaccactcttgaaaaaatacaatttcttataaattttcttcatctacattgctcagatatttttttacaagatatctgtaaggtttaaactatataatatttaattcactactataagctgcaattatcagtaattcttcattttctagaaaaaaagcgtcaataaatacataggagatatacatattgtacagctcgcttccctattatatatgtgatctttagtgttttttctaaaaacatacctagtcaacatgagtcctaaacttaaagttaatagtagcatatagataactttttaaccaactatatgttttatatatgtaataattcgttgaaaaactcataatgacatgatataagatagatggatggtcattaacatctaagcacttaaacatggttatggcgatggaacatataatggttgttccaatttgtgaaaagtaataactattttttacaaatttattatattctgcccaattgatttaattcaatccctattggaatttttctatttttctaatttactttatacaactcttattttatgttcaaaatgcataatggatcatgaattgttgtttaattatttaatagagcaacaattagattagaaattagatgtatagcttaaaatatgggtttttcaatattattcatagtttgtctttaaatttgatagctaaaaagtaggaatagggaggagtggagtgcgaagagcctaagctaaaggggaagggggcgtttggtgttgtgtgcatgttatggggacggtgaggaattggagactttattttcctgctttttcctgaataatttaagtaaaaccgatgatcatatgattctccctgcatgtagatttgaattagtgtaatatatttgtcaagcgatatttgacaccaagttgatcctttttatcatgtgaaattatttaaaaaaatttcatgtcatcaattattatatgatggcattaagtgtcatatgtcggcaccatgtatttagcactacaatataacttttatatgtgattaatattttatttaaataaaggaatacaatagattataagttagatatatatttcataaataatttaaaatatgaacatttaaatgtttttcataattttttttataattgtttgaatgtacgcaaaagtgtaagaatataaaccaaaatcaaacatatttatttcaaaagtttgaatattgtgaatatgtgtctttaactttagttataaataatataacaaaaataagtcgatcaaaaattcactatatgctttggatgatactgttctctatttttttaataataaattatgatttctaagtaatgtatcatgagaataggaggaaaagagaggtatggtgtgtttgagggtgtgggcagtggggtggatgaatgagtaagcgcccatgtacggggccgtggtggaggttggtatatgggttctattttttaaaagaaaacgatggatctaatggtcataaatatgtcttgagaaactaatagttagtccataggtagggttttattttgtccacgttacatgtcaactcagctattatcattcttacttgtttttattatccttaaagcgggatgcattttaaataaatggatctgcatctataccactaaaataagcccaatatattattaatacataaaacatttatatctactacaaacataaatgtttatgtcaacccttgtttctaaatctatgaataaatattctataattattgttcctaatggttaataagataacactgttaaaatcaaatatgaatgccccctttaacaggtaataaagccgaccgtagtcgccgaggctttatttctccactgcgatatatttatcgagggatatttgacaccaagttgatccattttatcatgtgaaattatttaaaaaattatcatgacattatgacattaattattatatgttggctaaattatttaaaaataattatgacattaagtattatatgacggcaccatgtatttagcactacaatataactattatatgtgatcaatattttatttaattgaaggaatataatagattataagttacatatatatatttcataaataatttaaaagatgaacatttaaagacagttgatttgatactttatattaatcttgtttaaactgtgcatatacatggatatatgcggagtaataaattttattttataatatagaaaattctactttaaaaccgccgttctatcagcatacagcatagtatgttttttttctggctttatagctgtagatacgtatgtttgtttggttttttgaagtgaacaatacatatgggtaatatccaattatagtgtacgttaacttttctcgtgaaaatttctcttctatatatcggacattaagaagcagctgtgattagataatgggcctacccggacattaagatgaaccagggattttaaaatagatccaatctaacggtctaaaataatgggcctaccagtttaagtgaaaatcgacggttagattagaaagtgctacgtggcgatttaggagcgtttgtaggaacgccacgtggcagcttaggagcgtttctagggagtttaatggacttttagtatataatagatagaagatagatagatagatagatagatataagcttattttgatataatatttttttcacgttattcaactccagtgtaactgtctttcactgtagctagccataatatatttgttctaacttgtacaaactctaatacagtaattacttaaaatataagcttattttgatataatattttttagagagaaggctcttggctctgcttttataaaaagtagatagattttttttagagaaatgtattttttacccagcatctatgtccaaccagatatttgtaacattttaaatcagaacttgaaccgacaaacaacctcatttaaattgggaacgtagcctcgcaaataactcaataagaaattcgctcgtataaaaatttaaactcatgattatcatagaatgctactcaagtcactgcgacgctgactcctcccagacagctctctctagggaaccaaaattagctcgtctgaacgttaggtagctcaggccatttttcaatttccctgcaaccatgactttctgttggttacagatctcataccaaccgaattaaatttaaaaatatactgttcatataaatacttcctctattttatttcgtattataagactttctagcattgcccacattcatataggtgttaatgaatctagacatgaaacagagggagtatttagcatgcatgtcacaaatataccatcaatctcactagactattgagcgaaaaagatgacgcaagccatatcgcgctgggacaggcaagaccgcacggtctcgcaaaataggacaacaagactgatcggtctcgcatatagaatcagcgacagcgaacgtccatgtaattagggattaattaccctgattagcaactaattaatcaaataattaattagcagcctctccgcacgacactgcacggtctcacgccgtgatcgtgcgagacattatatttctatcaaataaattacattctgaatattcttaagaaaagaacaaacgaacaatatattttcaaatttaattctctacctaaccaaacatcttccccgagaaatgtgtttacctgatcctaatttccattcagcccctaggacaaatcatattctgatacttaaaatccctctccaaaagtgtgaagcaccagcttcatttgcctggaacaccccactatctccaacgtacgtatttgtttctcaagatatctaagcataaactcttttccctatatatctaagcataaatttgatataactaggaaggtagtccgtgcattcgcgcgggcaagcatcgtgcgctgcatttgaaaacggatcatattaatcagatagcctctgccatgttctggaagtgcatttcctcagcaaatattcatcgttgcatcactttaataatttctctatgctatatactatatagtttttaattaatatgtataagcaattatatataatcttcatcattatctaaaaaggagttagacctaatttgtttagaaaacatgtttattaaattaaaagcaagttgtattttttctttttttgttgaatgctttgggccctgtgtgatgaaaatgtaagacctagctaaattcattgttccttttcccccgctatatggctttatgcagctcctagacactgtgttgagatgtggttattgcacctacggaggttgccttgtgattcatccttgttgtgatcacatttttggtcaagcttagttactcctatttccatgtcttgttatatcgtaaaatctaaatgaactccaaagttaatcatttaagtatatatatatatatatatatatatatatatatacatacatatacaataaaaatatatttgcagacgattaatgttcatatatagggatgattcaccttttgaatggtctacgcacaaagaaaataaacggagttacccgaaatgcttagaaggcgctagaacaacacgcttgaacatatatcaatgatatactaaaagtgcattaagctccatctaaagtcaattagatagtaacatagtttaaagcagatatacgatagatcatttagcttgcttggattattttagcatattttttttaaaaaaaatcatgaagtaataatcggattttctctaactaaagccattggattttctatgcattgggtggtttggacttcatattttagttagttgtatttgcttagataatgtatatctaatttagctatgcatgtctgacaaacaacatatatatgatgatgcaacctgtattggattatttcgtaattcttttacagcaattcaaatgacatgtaaaagggcaggggtgttcttccttaataaaaaaatgtttcatagttcaatttgtaatttttgtttggataactattgatttgatttagctatacatgtttgcagaatgatgtatagtgatgtaatatgtgcagccaatttgtttaaggtatttcaatcatatttggatggtatgcaaagcacgcaggctgaatgtggtcgaatgtcatattttgtatataggaaaatataaggatacggatcttaaattcctagtttaattataaacagagcaacaattatattagaaattagacatgtagcttaaaaattctggttgttttaacatattgattatttctcttttattttagtcctacccaaaaatagggatgggattggcagtggtctgcgcgcatgtgaagggggcgaggcggtagatgtgatttatttttataacttctccaaataatgtaacttaaaatcaatgatgacaggtttaattttttctcaaaatttctaagattatttatgattttcaggacatgacacgtggcggcgtaagattttttttgtaaattaaatctaatggttgaaaataacgggtctatcgatttaattgaaatattttataatttaaaatgtgacatatggtgacttaagtgtgctctaaaggtgtttaattggtttttattgcgtagattgtttaatatgaaaaatacatgttttcattctgttataatttttcattttcattcagttgccctgcgaaggagtattttaatttttatatagtaaaatacaactataatggatattgaattatttaattaactgtaaataaaacaatagttaaaacaaattaaaaaccaaatataattttagaaattataagccatttagctttttttttaatattaggttgttagttaaaaaatataaggcgagaggatcagaggaggtatatgtacagcaggacgagagatggatatatttttttctgagacatattccaacggatcctagtctttagttatctatttttaaaatatatatataattatagacctattagaaaatgtgttgggtgttgtatttactaatataagctaaatgttgccattcatatggtttaaaaatctatgtgatttttctaaatatgtatcgagtgaccaataggtagtctctagcattatatgacccaaagaaatacatttattttacttttaaaatgtagttaatttaggtattgaattctaaattttattgtaaataatctcatcctgtgcacggataaaaaatagctatttatatgatatagttgtttaaaataatttattacaaagtacgttttctaatattaattaagaaaatgtttgaaaataggagggcatgttgccctcatgtattagggtgagggcagggattatgaaacgtaactacgtatatatacctaatgtaacataatggatggcagcggtggggtgtgggcctttctttttttttctttaagtaaaatccgaggatagaaaatatgggtgcaccgtatattagtgaaaatcgacggctagatattttggtttttttttataatttgctagagtgacacatggtgagatgcgagtgtttgtagaaagctgtacaacggtttgagagcgttttaaggatgtttaatggcgttttagtatataatagattataaaaaaaacaaactattatatatcagccccatgtgtcgtgatatatttaggaccaccatataatttttataatttaattaaaggaaaataacggaatcacaaattagatatataatttaaaaataatttagaagatggttcaaggaacattgattggatattttatattattattatagatcttagtttaactatatatattcatatttgtgatgtaatatattttagaaaaccatattttatataaagatcatggatttttatgatgtattttttgtcgtcttttttatgcatatgcgtatggttttttcttttctttccagcgaacagtacgtaaactattgttttgtttttgtacgtacgtacgtacgggagaagacatcgtataaaccaatagtagaagcgcttaaatcatataaagagaaagttaatttttttcaataatagatctaatccaatggtataaaatgatgggtccaccaatttaaatgaaaatcgatggtgagatttgataatgccacgtggcagcctaggagtgtttgtacgacgccacgtggcggtttaggagcgtttgtaggaagtttaacggagttttagtagatagtaatagatttagatgttaaaaaataaagttgttttgggggcgaagagagtacgtatttgggggggggggggtggttaggaattaagttagcaatggattctcatcgctatggggacagtaatacacaaacaattttcgtgtataagcatgttgcagacgaatcataagtatctgcgtcaggaaaaattcgttgtcctattttcgatatgactccttaagagacccacacgtgaaaatatattttcgcagactgccctcttagggagccgtataaaaactagagctatttccatacaggccacataagcagccgcacgaaaaaatatattttaacaagcggaccgtccagaagtctgagttacctcttctgtccctctttagtgtacgcttcaaattttttcaagtcatcccttctatctctccttatctcattcttatctcctctcctctcctcgtactcctcactctctcaaactctcctggttgggagattggcggtggctggcatgagcgtggtgaaggcgacattgggcgcgcggtgttgggcgtgtggcgacggccgtcctccacacatatccagtggcggtggctgtccccctcctagatccgacggcggtggcaggaggagccgtatgtgacaacggaaggagcacggtggcggtatggttggagggaagatgccttataagttggtttcacccttactaaactaacaatatggtactaaatatgcgtacactgctctcagggaccatataggcctcactgatttggccgggatgtcacatacacacccgctcaaaggacccgactccccgtcggttcaactcaccccctcttagcacacgttcgtacgtccagtgctggtgctatatgtcatgccatgtacctcacacaaagcccacatgcgccatgcgccatatgaccgtacactgacccttacgtacaaccacgagggtcggctctaatactatttgaaacagccctaccttcaggatcgcatagcccagcccaaccgatcggcagacccacttacacataccactccacttacacttttgtcatcgcttcatataaaagagttaactcaagagtgatatcgttaaagggaagaagccttataagttggtttcagctttgctaaactagtaaaatggtactaaacatgcgcacaaagctccacacatgtctcatcctaattgggccggaatgtcacacgcggcggcgtaaggagcccggcggcggcagcggcggacggcagcagcaaattgcggcggcacactactacagaaagcgtttttgcatacgggcggaatcgatcttcacatgcggttggccggcccgcatgcgcgaaatggtctgcaaagatcaccatttgcgcatgcggccgtcgcagccgcatgcgaagattgatcttcgcatgcggtcacttaagacggccgcatgcgaaaatagatcttcgcatgcggtccatataagaagccgcatgcgaagatatattttcccatgcggtcgacctaagaagaccgcatgcgaagatctattttcgcatgcgggcgtcttaagtagaccgcatgcgaaattcaatttccgaatagctaaaataatatttattctagcattttggtgattcgtaattaatattaaattattgagggatttattatcgtatttcggagtagtaagcatataagataagacaagtgccgcagtaacaaacatgtaatacataaccattaattcaattgtaatttacatacaaatatataatacaagtggcacagttttttcatcatatgtataagtagtgtacatgttattgcatatgttctttctcccactctctgagaggtttaaatttgtcgtccattgcgagttcactctggttgtcgtagaagagacctcttgcgttgcagacatcgcgacggatgaatcggcagaggtcagcggccacgttcaagatagtagtgtggttgaatcgttgtgcaatatatgggatttcggggatctgcacacagaaaggaaaataaaacggtactcagtgagaagtgtgtgcgagatgggtttctttgtagagaagagttcgatgacctactcggttactggttgttttgtacctcccatttactctgagcatctcgcacacgtaataagcacacaagttggttcctggtggttgtttgtagcactgcgatataattatggggaccgatctcagtagatatatttagtatatatgtactattcgataattagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtccaatgatatgatcaattggtctttcggatatacaaggaataatatgtagtggtctctacatataagataggcttattggagacagaaaattccgaagaagataaattaattaaacaaaaagaagagagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagcttcgtggaattgcatactgtacaatgaataaagaagaaatgagatttggtttatttgtttcgaatgaaacgtgcaacatgtaataaagagtttagacttacagacagaaagccgcaacgagattaacgtccattttatctagcttgtagagggcgtaaaggtcttggaaagagataaaaaatatcccattaggaccactcatgaaagcgccttccgggacggcgacgcttatgaaaccgagacctttcctagatgccttcatataccattcgtgcattaccctcatttcccatggtagcttgttcataagataagttggcaagaatggcttgccatactcataagtttcaggcacatcggcagataaccaggattgcacttcatcttgggccgctagtactgacttctgggagtctgacaagacgtgagatactgacttctgggagtctgacaagacgtgagcaagttcttttctcttctcagaattcctgaaagctgaaaacatgaacttctccttatccttgtcaatctcctttgggtcgtatgtcgatatcaactttggaattatacgacgaggttccaaagtattagactttggttcggatgtagtaccatctggtatgtgcacttcttctaccagagcagattggggtgtaggtggagaggtttgaactgagggcggagccgggggagcatgctgtttagttggggaggtgggagaggcttgaactggttgcggggtcgggagaggcggttgttgagaaggggagggtggtggtgtaggttggcgaggcggtgacctaagcggtggtggtgacggcggatgtcgaggtgacggtggttcaggaggcgacggtggtgcaggagcggcagcagtcattgcctgcgatgaggatggggttgaagatcctgctgcaagaacggccgcgctcaggaatatgtctctgcggtgccacaagataaactgattcactgcatcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcagggaataaccttggaaatgctgtcgggttttcagctgccaacgagtagaagtgttccttcacttgcgcatagatcttgtccgatagttgttctttgtatttgtctctcttcttataacttggtgcgtcttgtggaaacccgaccttccaacttgtctttgaggacaaaccccttacacgtccagagtgttcagccgtccccaacgccgcagtaagctgatctctctccctccgtgggacgaactgtcctgatctttctttctcgactatctgctgcaaattagtagtcacttcttctatgtctggagtctcgaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatttgttcttcttcgcgagctcggacatttttttcctcaaagccaatgcttcagctgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctaacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgatgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcatcacttacggcctgttcgataggtatgtagtccggatcatcatcgcggggggcgacttgtgttatttccattggaaacgggtcacttggtgtgcgccacgtttcttcactagaagcgcctggatgcttattgctaccggaattttgaggagcgttaccttcttgaggcgctattggtgcgttcgatggaaccttttcgttcgacatcttccaacttgacgtaaaaaaatttgacataagtcccaatttaacgcaatttgacataagtctcaatttgacataagtcccaatttaacataagtccgaattatacataaatctcaatttaacataagtcccaattatacataaatctcaaattaacataggtcccattttagcataagtcacaattaaacagaaatctccatttgacataggtgccaatttaacataagtcacaattatacataaatctcagtttaacaaaaatcacaattatacataaatcccaatataacataagtctcaacttaaacataagtcacattttaacatagctgccaatttaacaaaagtcccaattatacataaatctcaatttaacaaagtcccaattatacataaatcccaatttaacataagtcccaatttaaacataagtcccaatttaaacataaatctccatttaacaatccacaattaaacattctcaaaattatacaatccacaattgcacatatcacaatccacgatgcacaattaaacaatccacaatccacaattgcacatttcacatttctttttttaaaagtaaatgttaccgagcgacggcggggacgacctggcggcggcgacgacctggcggcggcgatggcaacggcgaggggggagaggtccgtgcggcggcgacggcgacctggcggcggcgacggcgacggcgaggggggagaggtcctggcagtggcgtcggcgacggcgaggggcggggcgacttcggggaggagccggcggtagcggggacgacttggcggcggggacgacctggcggcggcgatggcaacggcgaggggggagagttccgtgcggtggcgacggcgacctgccggcggcgacggcgacggcgaggggggagaggtcctggcggcagcgacggcaacggcgaggggggagaggtcctggcggcggcgacggcaacggcgaggggggagaggtcctgacggcggcggcggcggcggcgtggggcggggcgactttggggaggagccggcggtggcggggacgacggcgatggcgacttgggaaattttggcagcctggcggctagggtttcgcgggagccgggacttagaaaattttggctccccgcgctccctatatataggcacagatcatcgcatgcgggcggctttagggaccgcatggaaaaatatctttccatgcggtcgacataagccggccgcatgcgaaaaagatctttccatgcgggctgttaagccggccgcatgcgaaaaagatctttccatgcgggctgttaagccggccgcatgcgaaaaagatctttccatgcgggctgttaagccagccgcatagaaagatctttttaccaaaaaaactcatatttttttttctctataagtaaactgtccatatatatttttttcccaatatttcgccacaattatacattccaaatgtttttggcactaagaaaactcatgaaaattgctcaaaactcgtaatcaaatgttacatgctaatgattacaacataagggggacctaaattcatgcacgtacatttgctaatgattacaacataagggggacctaaattcatgcacgtacatttggaatacaatgagaactaaaggttacgaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacctgagccacacgctctgctaaaacccatggatcatccttgtggcctgttttactgtgatcgactatcgttagcccgtagtcatcaacggaaacccctattgtgtctttaacccattcacaacggagcacatggatctggatgtttaggccatagtccagttcccatatttcttgaatggtcccataatacgacctcttttctccactcgtgtcaatcgcttcgacacggatcccactgttttgtgatgtgcttttcatgtccttcgtagtcgtactcaaggtaaatccattgatgtcgtaaccttgccatgaattgacaatacttgaaggcccacatgccaatctttgtaaagtaagttcctccacagaatcaccaactggcaggtttagatctttcaaccacagaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccaaaggatcaaatactttttgcgaaattcgattgaaaaagtagcacaactttgttataaccacctttgtatggactggtttgactgcccttatagcaattggtaggaacactgttagcaacctatgacagtcatgcgcattgtatcccgaaatggacaaatcctttattgatactagcttcctgatgttcgatgcgaaaccagtaggcactctaaccccttgtaaacatttacagaaggcttttttctcatcaagtgtcaacgagtaacaagcaggaggaatctcggtcttcccatttggcagcagtactgggtgaaggtcatgccgtatggacaaatctacaaggtcgttacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtaccgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatatcagacatccagtcttccctttaatctgcccagataatgaaaagtttgcaggtaggtcattgatggtaacgaatatgattgcacgtagattgaagtgctcccgcttaaactcatcccatagttgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcgagcgtcggcgggatgtcgaatcataccatctattttccggctctcttgatgccatctcatcaactcagcatcagtcgggtttgagtacagacgcttcaggcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcttgccaattctccaatcctcgtgacctgcccgctagcacctctggttcaacatggcgtagcatatcctctaaatcaaaaccaccatcgaaatcatcactatcggtggaaacatcgacaatcattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaagttacagataaaaaaatagaccgcaggtatttcatacaaaagtttaaatgcatttgtctcccaaaaaaaatacaacaatacatgtaactagtatgtacaattgattacatgcaaaatttgcccatcaaaacatatattttgaagctagattttgcaaaaaatagttggaacaaaccttgtcaaaatattaaaaaaactccactttccaccaacgaaatataacaaaaatggagccaaatgaagcaagatagagagttcttcacctttcgtatagagttcaagtaaaaatttcgagttgaaaacctccccccctaattggtgcttgctttaggagagagaaagcttcgttttcaaatggtcaagctcgggcctggaggagcatatatggcggatcatcgcatgcggctaatcaacccgccccggggggggcggtttttgcaggcgccgccacaagcggcccgcatggaacctaccgaccccctcgtacagaaaaacgatttttgtagtagtggcagttgcgggaggaccccggcggcggacgacagcggcagacacgctcgatttttgtggttttttttggatttttgttttcgcgtgcggtcgaaatatgcaccgcacatttttcgcgagtggatacgccacccacatggaaaaattggattttcgcagacccttccgagcagacaggccgaaggtccgcacacgaaaaccttttttggcccgtctagaaaaaatatttttctactgatcggatatcccctcgtatatatttttcttccaaattccaaccaaatactttaaaagataccatttgaaaaaaaaatgtcgtcgatatataatgggagaagggttacacgcatggtccatccgtcgatggagacgtacgtacgtaggaggacaggaagctagggcatcaccatcgctggccagctgccagctgcggcgcatcatgcatgatcaacatgcttggccttatatatttcctttgcattttcctcatggacacagtacactagtagtcattaagccgtgaaacaatacttatgcacgggataaatgctactccattatttgacgtacaggtacaaaagcaagacttcaagggcatgcccgatgattcccctaggatccctttttaaatcaactgagctgtgacatacatatgtaaagtaagagatttactaagaaaaaccaaaataactagatcatgtatgagatttggttttacacagcacataagacatcatgagagatgattggtgttaaatagctttagaaaaatgtcattactattcacgatatcagctgagtgccactgaaattttgcaaaattaaaaccgtgccattactgtcatattttccaccccttccatcttccttcttctccccatcaagcggtcgtctacaaagaggccaagccgtgagctccggtggagcgggcgaggctggcggcgccaaagcccatggagcgagagaggtcagaggccgaccagcgagctccgacgaaataggcgaggccgccagcgccaaagcctaaggagcgaggaaagtcaatgacagagaaggatggcgcggtgaggatggcgtcggggacggcggagcaacaagcgatgacggcaataactggcacccgtgaagatcacgaaggcagagcagcaagtgacgacaacggagaccaccatcacctctccaaccacagtaaggagtaggaggtgaagatggcagcagcgcctggattcggctgatgacggtggaggctagatgcggcctcctcgaagctagcacgaggagaaggtgattatgcgacgcttggatccagcctccccagagctcgtgcaaggaggaggtggtgaagatggcggtgatgtcggccggggagcacgcgcgcctgaatctggcctccctggagctcacacgaggaggaggaggtgaagagaatatgacggtgacgcttggatatggcttccctagagctcgtgcaaggagcaggtggtgcagatggcactggcaatgatgccggccagggagcacgcacgcctggattcggcctccccggagctcgcatgaggaggagttgaagatggtgacggcatcggccggtgagcgcaccagggcagtggggggaggagcagtaggcgtggcagccgttcatcgaggaccagcaggcatgaccgaactatagggaggagaagagacgaagagaaggcaggagaggagaagagaaggaagaaggaagaagtcggaaggatttaaaatgtgacggtgatggcacggtttcaattttgaaaaatttcagtggcatctaaccgatatcgcgaatagtaatgatatttatctattatattattataatagctttgaaaggaggtatcacgttcacttgggggctagaaatttccacattaatcagagaaaaatgaaagaagaatccaagtaggaatacaatttaaaaataattgaaatttggaattaaaaataagcaatattgaaagaagagtccatataagaacccaatacaagattaattaaaattcagaataaaaataaaataaaataagaaattagaaaaatgaaaaaagttaaagtagaaataaaatttaaaaataacttagatttggaatttaaaataagagtccagataataattaacccaatatgaaattaattaaaattcggaataaaaaaataactaaaatacgaaattagaaaaaaataacgaagagttcatgtacgaatataatttaaaaataacggtaattcagaattataaataaccaacattgaaagaagagtccatagaagaaaccaatacgagattaattagaattcagaataaaaaataaaataaaatctgaaattagaaaaattaaaagtagagttcaagtaggaataccattttgaaacaacataaagtggaaaagaaaataagaaatataaaaataatagtccgtataaaacacagtacgagatcaagtaaaattcgaaataaaaaacaaattgaaattagaaaaagaaaaataacattttaactaggaatacaatttataaataaataaattgctaatagaaaaataaagactattgaaagaagagaccatctagaacccacgatgagattaattaaaattctgaataaaaataaaaaaattcaaaaaatataaaaacaattataaaagttcaagtaggaatataatttataaaaaaaatatatcggaataaaaaatacaaaattttgaagaaaaatatttatttagaacacaacgatgccaaatgacaataaagatggaagaagcaacatgcctctaaaggagtagagtggtgacagatgacgtgacatctacaaactattaacaaaatcccaaatagaattccaataacgattaataggagggacggcggacagaccgttaagtagcacaatcacatcggttggcgggactttcaaaaggtaaaaaactaaccccaatgataatcgtatccagtattaaaatctcaatgacaataaataggggaggcagcggacgagcagtagagaagtacaattgcaaagccaatgatggtttggcgggacttctagaaagtaaaagatgaatccaaatgataattatgtttgatttttaaaatcctgatgacaataaagagatgaggcaacagacgagttgtagaggagtgcagtgttagtgtttggcgggacttccaagcaacatgcatgaaaaagattagagtggtgacggttgatggcacatctaaaaactattaacaaaaccataaataaaattctaatgatgattaaaaggagggatgacggataggccattaagcagcatggtctcagcggttggcgggacttctaaaaagtaaaaaataaaccccaatgatagtcatgttcaattttacaatctcaatgatagtaaaaagaggaggcaacgggtgagctgtagagaagtacagtggcaaatcagctgacggtttggcgggacatcaagaaagtaaaaattgaatccaaatgataattctgtttgatttttaaaatcctgatgacaataaagggaagaggtaatgggtgggctatggaggagtatagtggcagtgcttgatgagacttctatacgttataaaaattgaaacccaatgagacaataaactctaaaaactataaggttcatctttcaaaggttcgaaggagaatgaatagaagtagtggtagatcgagcaagcaaataaagatgaggtaacaaagaaggggcagcaacttgtgtgacttttaaaacctataaaattagaaacacgaggatgataaaggtttggtctttcatagtattaagacaaagagataaccatcccaaaagtgaaaacctcactcttgtggtaactgattttgaggccagccatctcttcaaagcagtacaagatgaattttgttgccacaatttcggttgtcatcattggcaatgaacaggactgtatcatcaacatattgaactccttcactcttggaagtgtcaaacattgcactaaggcaacactaacaagattagaaatgagagggaacaggggggtctccctatctaagacccaagtcctaaagaagtcagttctttccccattaatatttatgcaaactttccctcccatcacacaggttttaatccagctaatccacttgtttggaaagccccttctcaccattacctctatcagaaagtcgcagtttaccttgtcataagctttctcaaagtctattttcattataatccctttcagcttttgggttcacttttcatggagcacctcatgtattatcacacacccctccatgataaacgtcccaaggatgaaggcaatttgtgtagattttttaattagttaagataagataagatagatagataaagataaacataaagataaattttataatcgaacttatggcaaacatagaattccttttatttagcagggtggagggactggatatgtccatctcaacataagacataccatcatacatccatagtgctggtgacaacattttgagtttgcatcttgcagtgctacaatacgaaaccattctagtgatattattcgcaaatcatcgcaactacgcactagggagttatatatatccttgaattggagcctatagcttcctggaattaatgcagaagacgcaatgacctcgatcaaactaagcaccaacagacgcacatccatgcatgcacgcaacgcatggcccgtcataatggctcggcatagagattgtccggcagcctggtcttgacgatggggaggagagggatcttccgtggcgtggtgagcccgatgatctcctccatgctcagctcgccagcagccactccatcggggaggctccaggagaaggcgtgcagcaggttggcgagggtgagctggatgactttgagaccgaggctgtacccggggcacatctgccagccggagccaaatggcagcagctcgaagtcccaccccttgacgtcaatcccgctccccatgaactataagattgagctcaacacgaatgtcacccctgaccagcgaagatataatgtgcctacaacatctctagttgctgctatttggctagaaggggatgatccggtgagaacttttgataagcatgtgatggtgtgtgccaaaggagagaaacctactatatcaaagcataccatggttgcaatgacctattggcatatcctttatataaccctaacggcgaaaccagatggaatctcaaaatgccgtacgaaacacccaccaatattcctgacggtatggacattgatgcaccaagtgttgcaccaatgggtggtaacgtgcacttcagtgaagaaaacacttttgtcgagcctcctggtaagtacacacctagcttgtatgagaccttgtcaatgcctatatacttttattccattggaattaagtagatttcttgattttgttgcagagaatgatgacgttggtgatactttatacgatgaagacactaatgaggtggagaacaggtcatgcaagcgaagaaagatagatttgtcactgcaagagagtactattgctttaggctataggttaggaggggacttttcaacattattttatttggaggtcgtctctttcagcaatgggccgttgacatgtatgtaaagatagagtctatgcgccttgattggtattctaaccctaagaaccaaaacaagatacgagctgagctgtactaggtgaatgaaataaaattcatattcaataatattaaaccatatcccattcaaaaagcgatgcttacaatgtatgctcattttaccgatactaattttgtagggtgtagtcgatgtgatcaattctggagagacaaggggttcagagataggaacgaggattgtgctacctcggtcttttcctggtggcaatcgcgacatgcaacagcggtttcttaatgcaatggttcttgtccaacattttgggagaccagactacttcatcacgatgacctgtaatccaaactggaaggagataacagaaaatctttatcgtagccaacagccgcaagatcgaccggaccttgttgcaagggtatttagggccaagctacgatacatgttagacttgttcaccaagaaaaagtatttcagtgaggttcaggcatatgctcatgttactgagtttcagaagcggggcctcctacatgaacatatcctgttaaccatgaatccatgcagtaagttaacaaacccagatggttatgataaagttatctgtgcagagataccagataaggaaaaataccctgtgctacatcatctggtcataaagcatatgttgcacatcccgtgaggtgagctaaacaaaaagtgcgcctgcatggtggacagagagtgtcgcttcagctttcctcgaccgttctgtcaagcaacacaacaagggaaggacttgtatccttcatacaggaggagagatgatgggtggcgtgtaaaaattagaggtgcagtgttggacaataggtgggtggtcccatacaatcctggcttgctcatgaggtataattgccacatcaatgttgaagcttgcgccagcatcaaatctgtgaagtacctatataaatatgtataaaaaggccatgactgtgtgtcgttctcagtcgatccatctagagaaatcaacgagatacgccaatatagagatgccagatatgtttcaccgccagaggctatatataggattcttggttttccactattcggtatatatccgacggttttgcagctacaacttcatttgccaaacatgcaatatgtcacctatgatgattctggtaatcttgaggatgtcgtcaactaaccatctaataaaaagacaacacttacagaattttttgaaatgaatcgcaaagacccggaggcaagaaagttactgtacaaggagtttccggagcactatagatgggttgcagggaaaaatgtatggcagaaaagaaaaaccaagacttgccaggttggacagattgtgtatgcgcaccccgcggtgggagaaagatactatcttagggtgcatctgaaccatgttagaggtccaaccttgcatgagaatctaagaacagtatgtggaatcacttacttcacttgtagagaagcatgcgagaagagtgggcttgttgagacagacaggtcacatgacgactgcttgatcgaagcggcatctttccaaatgccatttgcactccgtcgcttgtttgcgattatacttgccttttgtgaggttactgataaatgtgctttgtgcgacaaacataaggagtcaatgtctgaagattatgcccgagataatcgcaacccgatgttagtagagcagatggtgcttagagacatacgggatatacttcatttcatgggaaaggatatctcagactatggtcttcctaagttgactgatataggtaatattttagaggagtgtgttctataatgttgaccttaattgtctttatttttatcatcaatgaattcgtgacgcatgttatgctttcgtcaaccagatgttttttccaatgacacaccgattgaagtcaaagaggagcagtctgtgccaatagacccagagcatctagatatatacaaatatctgaatgatgagcaacgtgcagggtttgatgacatcacacaacatgtattaagaagaagagctaggttttcttcgttcatggtccaggtggcactgggaaaacattcctttacaaggcacttcttgctagggtgcgatctgatgggttaatagccattgcaactacgacatctagtatcgcagcgtcaatattgcccggatgatgtactgctcactcgaggtttaaaatcccaatcaagcttgctcataatagcatgtgtaacttcacaaagcagagtggcaccgcagacctacttcgcagggcatctttgattatttgggatgaagctgaaatgacaaagcgtcaggcagttgagacccttattatggacatttattgccatttggaggaaaggtcattgatttggtggtgatttcagataagttcttcccgtggtgacatgtgggacaagggcacagataattgatgctgaattgtagagatcttatttatggaagaatataaggaagatatgcctttcgcgtaatatgagggcacaatctgacccttggttttcggattatctacttaggattggaaacgggactgaaaacacgatcgcagatgatgacgtccgtctgcctgatgaaattgtcattggttattcggacaatgaagattcagtgaacacattgattgaatatgtgttcccctcgcttgatgacgagagaaatacgacctccgtggaatatatgagcacacgggccatcctctcaacaaaaaatgatttcgtggataagctgaacacgaagatgattgataggtttcctggaaaggaaaagatttacctcagctttgattcagtcgatgatgatccccaaaatagctactctttggactttctgaacacgatcactccaaatggcctccctccacatgagcttaaagtgaaggtcaattgcccttggtcctaacaatggactatgcaacagaacaagactaatggtcaaggcaattcaagacaatgcaattgatgctgagattgttggtggacagcacgccaacaaaagggtattcatcccatgatcccactgtctccctctgatgacatatctcttcctttcaaatttaagaggaagcaattttcaatacgtctcagttttgcaataaccataaataaatcacaaggacaaaccatcccaaatgttgggatctatcttctagaacccgtattttcacaaggtcaattatacgtcgcattgtcaaggggtgtgtgttgatgcgaaaaacacacactcgcctggaagatctgcttaacttcagtgcaggtccaaaaatcttgcctttaggttcgtgagcgtgccagttgatttgatcctgcaaccaacaagaaataaagataggaaaatagcggttaaatccataaatgatagccgatcagccagtcgccgatgacgtatcatttatctttgagccgatgtcatatttgaatcgatcggcagttataaataggcaagaaagaactgcagatatcaatggtatataatactttcgtcgatatatacttaaatcaagtggttaggatagatcggtcgccatgccgagacagtataaatcacttagatcgaaatatatattaacaaggagattataagcaatcacagcatagccaatcagatagatctagcatgtatcgggtaatactccgataccactctatattaagatattaaagcaagcaaaatatatcaaacagaaagcttaatatacctaaatgcaacaagatcttaacataaagggcagatttaacatatcaatcaagcatgtaagatataaggtagttaaatcaggtaagaacggctgaaaccccgataaaaccctaatcggcaaccaaaaagcaggctagagattgagattctaatcatgacttataaggtcaaattcaactgatgcagctataagtatgaaaagaaggaaaatatctagacaatcaagccgttggatgtttcataggatggtggatatcctatataatctaagtcaatattggtatttaacctaatcggctaccttcaacgatagatgttagccgattgaaggttaaataacaatattgtcagagattatatacgatatatgataactcgacgaattacataaacaagattagagtgtcgtaaagatggaagcactaatcccgagaacgcatgccgccataacaagctttacctctagttgaagatcgaaaccgatgcagctcaacccgaaagcaagaactcgtcgaaaataaacaaaagtaaaagggtggcgatacgctgagattgtattgaatgtctgtttttttattacatgggttcgggctctatttatacccgtgatacaagatatgtccgtgccggacacgacatctatctctaacaaactctaaaataccgtaagtctttgcggcagacttttgtccaaacatatctccaaggaaattacatgaaatatcctaattaatagatacaattacctatccgagaactttatctccatcgcggcaatcctcgtgaagcaccttgatcgattctagaagcatcttcgaaatcatcatcatcggaatcggctgcaccacctctaccggctgtatcagctgtcctctgtccgatccatctcagctgacgcagactccagccgatgccttcgcagccgatgcatactctgttcttcgaatcaatctcgttatcgaatccgcttcgatcccaatgtcgaacctggtttataatttaccaaatttggttgtcaacagtgtgtcgtgacaaacaacaaggattttggctaagcctgagaaagaagttgaccctgcagggaagagcaccaagaatatcatctataaagacgttcttgactggtgagcaaaggtaggttcgcaagatcaaaattaatttgaaaacataatccagaagatagtaaattagtaatcagaatgttactcaccattgtcttcttgttttgtacagtacgccatcatctgccagatgtgttcccaactcctccagcaaaggaacacgatctcaatatactgggaaaatatttgaagccgagtagatatgaagaaaaaatatagacaaattttttgtatacattaatagatgcatgcttattaattttttgttctatatcttctgtatggttcatccatacaacttaaatgaatatatatttattttattcacggtataatataaatataggatgtatagaccgtataaaatatcaacaacgtgcaggcattataatgtcgcccatagatataaccatgcgcatgccactcacaaaaaaaggacgtgcatgagatgaataaatattttatatcaaaaccgttgagaaatgaaatgtgtcacaatgaaataaaaaactcacagttcattccattaaaaaatataggtgcatgataatttatataactacgtgtatctaaatgcattacactaatacgtataaaaaatatatctacaagtagtgatctgaaaatatagagaaaaaatattataaacgaaagtagaattattttctttttcttctgtctctcccacatgcttctaatgggaacatactctggctgggcggttgggctgaattcggtccggttggaaaaggttggaaaatgttgatgggctgaatcggcgttgttgaggctcgtgttgctggcgatggggtcaacgccagttaagggcgagcccgtcctctgtcgccttcccgtcgctcgcggaagcaacattaggatttttttagataatggatgtacacagcctcaacaaacttacaagactacatagactcacacccttacataagatttaacaccatctcaagcaactagacccgagcacttaggctctagcacttaggctctagcaacagcaattcttagaaagttaatacaaagtttcaaccataccatacaagaaaacaagagagtattagtctcccaatatttttcttaagttccaccccttcattgcgaaaaagccataaactcttttctctagaatcaagcaaccttctctcactttttggccatcttcctccttaagtagcaaagactattgtgcattaagataactagcgtgtatcgcaaatgagtgcgaaagcaacattagctacatgggtatacaatgagtgcgaaagcaacattagcacggaagcaacattagcaacattagtatacaatgagtgcgaaatcaacattcctagcggcgtacaagattttcttcagtgtatcgcaaatgcaaaacattaggatagttatttatctatggggtgtattctatatatgtaacaaatgctttattttgtgcccgcaacaaataatggaaaaactctatacttctttaacatattttatgcgtatattgcccttttatattgtatacttaagtgattatatataattaagtcttctagagttttactatgcccacgtaatatcatagtactgtactttacatgaaatatatttaacgtacgatatgaatttaattaaagttcaaatacacagatcatataaaaatattttttggaaacatgaaattttttttaaaaatgcagacaaatagaattgcaccgtagtgtttagcacgggtatattactagtacctccctaaatctgattttcaaagggcatgtacctaccgaattaaatttaaaaatatactattcatttatctttttcacataaatattgagaaagcaatttgtttggcaaaaatataccatcaatctcactagactattgagcgaaaatgatgacacaagtgatatagcgctgggacaggcgagaccgcgtggtctcgcagaacaggacaacaagactgatcggtctcgcatatcgaatcagcgacagcgaacgtccatttaattagggattaattaccctgattagtgaataatgaattgaatggaaacggccgtatgacatggactgtctagcagcctctccgtgcgacactgcacggtctcacgctgtgatagtgcgagaccgtccatgtggtcattttcacgtcacggttacgcgggatcaatagtatatttctattgaacaaattacattccgcatattcttgagaaaagatgaacaatatattttcaaatttaattcccgagtaaatcacattggatggacataaactcgttaggtgggtgcaatttaatatataaacttgtaaaacgcttgttttgttgcatggtcttatctaattcgtgcaaactaggaccaaaatgtcttagcaagattaattttaccaagttgatgttgattagtatgtgacgttcaaatatgcagtgagtgcataacacatgctatatttataaacttggtctctactttccttcatcattgaaataatgaatttcatatcttcctatccttgtatcatagctcgattttcatatgttcatcgacaatcactgcctcattctatcttttaattgaactaaatgtatgtttaaattgcaacctttctcagatttatatttacgtctagtatcctaatcagcacctaaattatcaagattaacaatgtaatgtcattttagccctagttcgcacacacttgataagttcgtgcaccaaaataagcgttctacaagttcatgcactagattacactcacctcacaagtttatatacccccaatgcaatttactcttaattccctacctaaccaaatatcttccccgaaggaaatgtgcttacctgatcctaatttccattcagcccctaggacaaatcattttctgatacttaaaatccatcgccaaaagtgtgaagcaccagcttcatttgcctggaacaccccactatctccaacatacctacttgtttctcaagatatctaagcataaactcttttccctagatatctaagcataagtttgttataatttagatgttaaaaaatgaagttgtttttgggcgaagagagtaagtatttagtggggataggaattaagttagcaatggattctcatcactaaggggacactactacacaaataattttcatgtataagcacctcaataagttgcagacagatcacaagtatccgcgtcaggaaaagtcgttctcctattttagctacgacttcttaagagacccacccgcgaaaatctttttcatagactgccctcttagggagcagtataaaaaatagagctatttttctagacgggcctcataagcggccgcacgaaaaaatatattttcacaagcgggccttttaatggcccgtccagaagcctgagttacctcctccgttcctctttaacatacacttcaatttttttcaacttatcccttctatctctccttatctcctctcctctgctcgtactcctaactctctcaaactctcctggtcgggaaagtggcggtggccggcatgagcgcggtaagcacatgggcgtcgatgttggcagtgcgacgccgtcccttttnnccccccccaaaaaccaattagatccaaaagcgggcggttggggctgtccccctcctggatccggtggcagtggcgggagatgaacggttgcggctacggcgtgaggagcccggcggcgggaggagcacaacggctgctgtggcgggaagagcccagtggcagaaggagcaaggcagcggcagcacccggcggcagtgtgtatcagccctccctccagaaccgcgcagcccagccctaccaacgggtgggcccacttacacatgccactccacttatatttttgtccttgcttcatgtaagaggttaacccgggagtgatatggttggagggaataggccttataagttggtttcacccttgctaaactaaaaatttggtacttaacatacgtacactgctctcatggaccatacaggccttatcctaaattggccgggatgtcacacacacacctcctcaaaggacccaacgtcctcgtcggtccaactcacccatatagccaaaaaggcataaaggcaaatgtctaggtacacaccccatcttagcgcatgtctatacatccagtgctggtgccatatgatatgccatttacctcacacaaagcccacatgcgccatgcgccatatgcccgcacaatgactcgtacgagggttggctgtgataccatttgtaatagccctccctccaggatcgtgtagcccagcccactcgacaggcagacctacttacactttcgtcctcgattcgtgtaaaagagttgacctgagagtgatatagatagagggaagaagccttataaattggtttcagctttgggccggaatgtcacacgcggcggcgtgaggagcccagtggcagcagcggcggacggcagcagcaggtggcagcagcgggaggcggattgcggcggcagttgcgggaggaccccggcggcggacgacagcggtagacacgctcgatttttgtggtttttttcggatttttgttttcgcgtgcggtcgaaatatgcaccgcacatttttcgcgagtggatacgccacccgcatggaaaaattggattttcgcagacccttccgagcagacaggccaaaggtccgtacacgaaaaccttttttggcccgtctagaaaaaatatgtttctactgatcggatgtccccttgtatatatttttcttccaaattcaaaccaaatactttaaaagataccatttgaaaaaaaaatgtcgtcgatatataatgggagaggggttacacgcatggtccatccgtcgatggagacgtacgtacgtaggaggacaggaagctagggcatcaccatcgctggccagctgccagctgcggcacatcatgcatgatcaacatgcttggccttatatatttcatttgcattttcctcatggacacagtacactagtagtcattaagccgtgaaacaatacttatgcacgggataaatgctactccattatttgacgtacaggtacaaaagcaagacttcaagggcatgcccgatgattcccctaggatccctttttaaatcaactgagctgtgacatacatatgatttgtgataatgtaaagtatgacggcgatgacacggtttcaattttgaaaaatttcaatggcatccagccaatatcgtgaatagtaatgatatttatcgattatatattattaaaacagctttgaatggaggtatcatgttctctgtggggctagaaatttccacattaatcgaagaaaaataaaagaaaaatccaagtaggaatacaattcaaaaataattgaaatttggaattaaaagtaagcaatattgaaagaagagttcatataagaacccaatacgagattaattaaaattcaaaataaaaataaaataaaatacaaaattagaaaaaagaaaaaagttaaagtagaaataaaatttaaaaataacttagattcggaatttaaaacaagagtccacataataacccaatacgagattatttaaaattcagaataaaaataaaataatataaaatacgaaattagaaaaaaaataaagaagagttcaagtacgaatacaatttaaaaataactgtaatttggaataaaaaatagaataaaatctgaaattagaaatataaaaaatagagttcaagtaggaataccattttgaaacaacagaaaccggagaagaaaataagaaatataaaaagaatagtccatatagaacacagtacgagatcaattaaaatctgaaataaaaaaaattctgaaattagaatatgaaaaataagattttaaataggaatacaatttatagataaataaattgctaatagaaaattaaagactattgaaagaagagaccatctagaacccatgacgagattagttaaaattctgaataaaaataaaataaattccaaaaatagaaaaacaatgataagagttcaactaggaatataatttataaaaaaaatatatcagaataaaaaatatggaattttggaaaaaaaatattcatttggaacacatatggaagtagcaacatacctctaaaggagtagagtggtgatggatgacgagatatcaaaaaactattaacaaaataactaatagaattccaataacgattaattggagggacgacggacagactgttaagcaatacgatctcatcggttggcaggacttccaaaaggtaaaaaattatccccgatgatagtcgcattcaattttaaaatctcaataacaataaataggggaggcagcggacgagccatggagaagtacaattgcaaagccgatgatggtttggcggaacttctagaaagtaaaagatgaatccaaatgataattatgtttgatttttaaattcctgatgacaataaagagatgaggcagtggatgggttgtagaggattatagtggtagcatttcacgggacttccaagcaacatgcctgaaaaagagtagagtggtaataattgatggcacatctaaaaactattaacaaaaccctaaataaaattgtaatgatagttaaaaggagggatgacggatagaccattaagcagcatggtctcggcggctggcgagacttctaaaaagtaaaaaataaaccccaacgatagtcatgttcaattttacaatctcagtgacaataaagagaggaggtagcgggcgagccgtagagaagtatagtggcaaagcagctgacggtttagcgagacatctagaaagtaaaaattgaacccaaacgataattctgttcgatttttaaaatcccgatgacaataaagggaagaggtagcgggtgggctttagagtagtatagtgacagtgtttgatgagacttctatgcattataaaaatgaaacccaatgagacaataaaccctaaaaacaataaggtccaacttttaaaggttccaaggagaatgaatagaagcagtggtaggtcgaacacgggaatgtaaaggtttggtctttcaaagtattaagacaacgagataaccatcccaaaagtgaaaacccggtaattgattttgaagccagccatctcttcaaagcagtacaagatgaattttgttgccacaattttggttgtcatcattggcaatgaagaggactgtatcatcaacatattgaactccttcactcctggaagtgccaatgcagaaggcatcactaacaaggttacaaatgagaggggagagacccaagtcctaaataagtcagttctttcccccattaatatttatgcaaactttccctcccatcacacatgttttaatccagctaatccacttgtttggaaaacccattctcaccattacctgtatcagaaagtcccagttcaccttgtcataagctttctcaaagtctattttcattataatccctttcagctttttggttctcttttcgtggagcacctcatgtattatcacacacccctccatgatgaacctcctagggataaaggcagtttatgtagattttttaattagttaacataagataagataagataagataagatagatagatagatagatagaatagatagataaagataaacataaagatagattttatcatcaaacttatggcaaacatagaatcccttttatttagcagggtggagggactggatatgtccgtcccaacataggacatactatcatacatccatagcgctggtgacaacattttaagcttgcatcttgcagtactacaatacgaaaccattctagtgctattattcgtaaatcatcgcaactatgcactagggagttatatatatccttgaaatggagcctatagcttccaggaattaatgcagaagacgcaatgacctcgatcaaactagacaccaacagacgtacatccatgcatgcaacgcatggcgcgtcattaaggctcggcatagagatggtctggcagcctgggcttgacgacggcgaggagagggatcttccgtggcatggtgagcccgaagatctcctccatgctcagctcgccggcggtgacgccgtcggggaggcaccaggagaaggcgtgcagcaggttggcgagggtgagctggatgaccttgagaccgaggttgtacccggggcacatcctccggcctgagctgaacggcaacagctcgaagtcgcgccccttgacgtcgataccgctccccacgaaccgctccggccggaactgctcaggcgagtcccacaccgacgggtcgcggccgatggtccacgtgttgacgagcacgcgcgtgccagcggggacgtcgtagccggcgacggaggcatcctcacgggacatccggggtaccagcagcggcaccaccgggtgcatacgcatcgtctccttcatgatggcgtggatgtaggggaggtgtggtatgtcaccctccgtcaccaagcggccgacgccgacgatggtgtctagctcctcggtggccttggcgaggatcgccggattcttcaggacctccgacatggcccattccacggtcaccgtactggtgtccgcaccaccagtgacaaggtcctgcgcaaggcatatgccaaatggtgcactgtatgaaaatgtcgtcctaatacttatatgaaaaaatagaataaaaattagacaatctaaatttactatatttatcagaaagaaaagtcaaattcgacatgcacatgaacaaaaaaaatatacctgtgaacacgactatgtttttttttcgtttcaattgtttttctacgcattagttgaatctatagaatccttatccagattagtagtgctgagatatatcgaaaaaattcaaatcgggcgcccgattgattcttaaaaaatttgacagccaagcgtttcagactttcagtttaccatggaaacatggagttataatggtgaaaaaatttcagccactaaaacatttaacttttttgtgaaaaacaatgcagacacgttgaaatatgatgctatcgcgtatgaaacattccatgttaacatattgaaacatatttttctattagaatataaacatgcgatatcttgttgtaaaaatttaattgcaaggaataaaatgttgggatcggatcgtagattagataactagtttagtagaaaaatcgttttgaatgtcactaaatgcatgcaagcgcttgcatggatggagcggagagagtacatacagttagctgcgtgaattttatttaacacagtgaacacacgttgagccatgtctctatcacgtatggaacattaagttctaatggtttcaaagacaagtttttcttttatcagaatataatttatgatatcttaaagatttaattacaacgaatacaacagagcgattggattatagatcggataagtaatttagaagaaaaaagtacttaaaagagagaagaaaggaaggagataaattagctagctgttgtctgttctgccagagagcgtccgattcttatcccgtgaatcgagtggccaattataagtattctcgagatatatcgtatcatgtattagattaacttattacaaaatagaagttacaaaatagaaggaatgcacaaaattttacttcccaagacataaaatggtgagaaaacctcgatatatatcaaattgaattacctgggtaatacccttgataccattcctggtaagctgaacgtcgaggttagggtcatcggcgagctgcaagagaatgtccaccatgtccctggccacaaagccatccccctgtagccgccgtcgctcgtcgtgctcgtcgaggacacggtccaggaaccggtgtatcaacctgttcacattcttcatcctcctgatgtacccctgcaggtccagccaatccagccatgggatgaagtcgccgatgttgagcacgccgttcatcaggaacagctcctccagcatccacttgaactcctccggcgtcgtcatcgccgctccgcctcctgccggctgcttctcgacgtacttctttccgagcaccatgcgcgagatcacgccgagcgccgccattgacaggtggtctctgagctgcacggcgttccccgccgcgccggagccgtgcagctcgcgcagcagcgcgcgcacctcctcgtggcggatgtgctcgagcgactcgagccgcctggcgctgaagagctcggcggcgcacatcttgcgcgcctggcgccagtaggcgccgtagggcgaccaggtgatgtcggtgcagtcgtaggcggtgtacttgccggcggcggtcctggggcggtcggcgaacaccgcgtcgttggtctggaggaagagcttggccatctcgacggaggagccgacgacgacggggcaggagccgaaccagagctgcacgatggggccatggcgcttggatatctcgtggatggagcggtgcggcagcgagctgatgaggttcaggttgccgatgatcggccatggctttggtcctggtggcagcttgtaagctcggcggcggcggagcagaacggcccggaggaggaagacgacggtggcaagcacgacggcaaagaaagtagcccatgatgattgtagttccattacttattggtgattgctgttaatgggtatatagatcgatgttaggcagcgcaatgaaaatataaaagggttagaagaaaacatatcacacaaacttcacgtgcacacttcgtgcacagttgcacaataactagcaaatgccacgaaaaattctataaaaaattgaatatttactcataatagtattacacatatatgcaaagtctcatattcaataattatgttttaaccgtaacaaaaaaattgaaaactttgacaggtaatagtaaaattctatcaggattatatcctttttaaggcaaaaatataatggattcgaaaataagatttcacatgtaggtgtaatattatttgaagtatgtttataatattatctaaattttttacgacatttgctagttggtgtgcacagagtttgcacggaaaacttgtgtgcatataatatattccttggttagaaagggttgtagtacctccgtcttaaaataacttcatttttcattgatttcacacactctaataaaaaacatatgccttttcacttaatcaaactccaatgtaaatgtccactttatctagccataatatatttgttcttaacctttatgaaatccaatacgtacaatagttgcttaaaatataagcttattttgatataatttactccctctgtcccgttttaagtgcagccatgatttttcgtgcccaactttgatcgtccgtcttatttaaaaaaattttgaaaaaaattaaaaacatatgtcatgcataaagtattatttataatttatcatctcataacaataaaaatactaattataaaaaaaatgtaaataagataagcatttaaagttggacacggaaactcctggtttcatttaaaatgagacggatggggtagatgctaaaaatggagttgttttgtgatggagagagtaagtatttagggggataggaattaagttggggatggattttaatccctaaggggatgtcccctcgtatatatttttcttccaaattccaaccaaatactttaaagaaaaccatttgaaaaaaaaaatgacgtcgatgtataatgggaaagggggtacacgcttggtccatccgtccatggagacgtacgtagggggacacgaagctagggcatcaccatcactggccagctgccagctgccagctgcatgcggcacatcctgaccaacatggcttggccttatatatttcccttgtgttttcctcatgtacacagtacattactagtcattaagccgtgaaacagtactttccattatttggcgtactggtagaaaaacaaggcttccatggcatgcccgatgattcccctatacgatccttttttaaatcaaggaaaaattgcatctattcccccactttaaaaaccaattgctgttttaccctcattttttagggattgtagttttaccctcacttttaaatctgaaccaaccgtctaccctcacttgtgataaccgtttggtaggtcccacgttttgtgttaaagaattgcaaaggaaataaaaaaaggttttagaaaataagaaattacctttgtaccctgagggaatggataaggcatgggtgagtctatcctcccaccccctacgtgcgcgcgaggcggcgagggcgaggcgatggccgcgggcgcgcgcgggcgggcgaggcggcggcggcagctgcggtcgcgcgcggaggcagcagccgcatcgcgtgcgggcaggtgaggcggcaagggcgcgcgggcgggcgaggcggcaagggccccgggtgggcgaggcggctgcgggcgcgcacggaggaggagtccgcgggagggcgaggcggcggctacggatgcgcggggtgggccaggcgctgcgggtgcgtgcggaggcggcggtgg

SEQ ID NO: 69913 - DNA, 18257 bp, Oryza sativa
  unsure (1)..(18257): unsure at all n locations
aggggcggggctagccgccgctctgcctgagagccgaggggagcggccggccggcgcggctcgccaccagcgacgccggcggctgccgcggcgacgccctgtcgacgtggcgcctcgtgtcgggctcgacgatgcacgtggccgtcaacgcgacgacgacgacgacgccatctcgggacggcggcggcgggctgctgtgcctggacgtcggcgacgacggccggagcgtggtgacgaacccgtgcaggtgcctcgacgacgccgccgccggcgagtgcgacccagagacccagtggttcaagctcgtcaccagcacgaggtccccggccaccggcgccgccgcggcggccaccgtggcgcgagggctaattgctgcgtgaaaatcgaccgatcaatcgatcgtgtccgtgcattcgtcatcagagaatcgaaatcttatttaaaatccgcgaacacaacactatactagctgctagctgacttgcattgatcttggatggaagttagagagttcgtgtcacgcacgtggcgcgcgccaagctgcagttcatgtgtggtcgatgtatccatgtactgttactgaacagtgcgcttgagctgaaccattgaacggatcaagaactaattaaatactccctccatactggtaaaggaagtcgtttaggacaatgtttaagttaaactttaaaaatataaatcataaataactctcaagttgttgagtttgaaaatgttaaaattatatgaatagatttgtcttgaaaaataccttcataaaagtatacatatatcactttttaataaatatttctatagaaacaagaagttaaaagttaaagttatgttttgaagaccgtgtcgctatctaaaacgactttctttagtagtacggagggagtatttaattagttcttgatccgttcaatggttcagctcaaaaaagttaaagttgtacacaccagaggtcaccagctatattattactcgtatggtttaagagaacacacaccatattaagttttttttgcatgggttcgtgctggtcccacatgttcactgcaggaacgaccattgggagggtgttaattcgattagcgcgttaattaatttgggaacagtagccactagccacgcacgaacatgagatcgttgcacggtaggcattgccgcacacacgatcgacgacctaacaagcggctagacaagtcgaagaaagagctcgagatcacttttccggaaagtgttttcacatttaagggacactattcattttcttaaaaatacgcacaattgagtcatgaaatcctttttaaaaaagattaataatgttggtataatgactggctgtttgctgcatgcggctgcgctgcacagacgaacagaagaaatgctagttgggttcctgtagcagatggctgtggcgcaccgaacaagccctatagtaataaaacattccgactgagtttttacgttaataaaaaagatataggcataggttagtgtggagattatgggtatcccatatctacacggcgacggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcacctctaggggcatatgctgatttttcccgaatcatacaattaataatacactcggcggattcatccccggacaggagtagggtattacttcttttataagaaggcctgaacctgtataaatcctttgtctccaaacccatacactttccgagcttgatagccacccccttttattattgccgaaatctagtttcgacagttggcgcgccaggtagggggagcgtcaagcttttcgccgatcagtgcaatgggttccgtctccggcatcgacgacctcgtcttcccacccgggcagacgtttcggttcggcagcctcgacttcatcaccaacaacttcggcaagatttctctcctcgactcggaatcagaccagtcgggagagaaccggctttcggtcccgtttggattcccgaacgcggctgaaagctacttcaagaccatctcaaccgagtcggcttcaaaccactcggccgagatcgcatcttctacaacgacaccagatcaagatgatggggcttacccaccggtcctgatgaagctccccgacgatttagcggccgtcttcaccatgacagcgtcttcatcccgtaggcctaggcggaagtcggcttcaacaccgctttcgcctagcttcagggaagtcggcgtcatcctccaaccactcggcacggtttcgacggatcagctggatgactacaacagctctcccaccgtcgactcacgtcctactgacatcgtggagtacgacgaattcagttctcgctacgacgacttcgacgacttcgacggaagcctagatgacaattacacccctctctactttggcgttttcatggccaataatgagacggaggagcaacgccaagcccgggagactgaagaacgtcgccgactggaggaggagcatcaagtacaagaacaagaacggctacggcgtgagcagcaggaccgtgagcggatcgccaaggaggctgaagatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcgttccgaccacgtcgtcaacatcttgaaccagacgaagaccatgatcgcagcatcggtcccagttaactccgaaagcgtccacacgccgactggcagccgggtcccccacttccgatctcatgactaccgtcatccaagccccagcatcactggagcaggatccaatcgcaggagcaggggccacgacgagcggtctgttcactcgcctcccgaacttcatagggagcgccgagtggaacggcctcgctcaccacctcgtcgccgccccatcgatcttcgcgacacaatcatacagcgccgagcagctcgaggctaccatcactcgccggatcggcacaagttatctcctctatgggaagggccatttattatctctgaagttacccgaccaggttcatatcgactcaagcgcgaagacggcactctcgtcgacaactcttggaacattgaacatcttcgtcgtttctacgcttaactttatcattgtatctccctattttgactgtcaacatcaagttttcttcttgccgttgtcagtcgggggctattatcacaataatggagtgtgattttttatcaattcagtttgcttacttggtttatcattgccttgtttggtttttctacttagtttgagaggactgaaagtttttaatagcttctttgggttttaggctcaacaaagcttagcaaaaacttttaagaaatcaaaaactttgcaagaatcatcaagcacagcataaatacaccagtattgtacaaattgagcctccatgtattacatccaaactcagtcagagtcagtcctttcatcatcagagtcatcattactcggctggaggtcgttgttgcgaaattgctccacaacatcactcgctattttgtcagccgcagtttgcgcactactgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatacacttccggagcaacactcagcttgtcaaatatttcggttgcgtcgagtgcactcggaccaccattattgaggaacatggcttagatgattggagcagcagcattggcgacatcatctcttgctccttctagcctcttgatcttaccaaccaggacgtcgaattgagcttgagacttgatcttgcggtctacaaaacatatttatggtgagaatctgctgcattaaaaagagacaagttcaggccaatagctggcagtaccttcaacttccttcaaggccgagtccctctgcgcagccagttctacattgtctctctccagggcttcaacttgctttttcatttgttccattctggcggcttgcgctgtttgagatccagatggttgaggatacagttatgttggcctaaatcaatggaacagatctggatgattaccttttgatgaaccacttagttcgaagtttgcatcctggagctgagcgattcgatcccttaactccttctccgtcttcttggcgtgctccttggcctcatgtagctggtccctaaccgcttcaagagttcccaaatgaggaaccagcttttccaaagttgtggtcttggcttcattgcgaagatggattctctgcatgatggatcatagttcagttctgctaaaaagaaaaacaaagttaccgaaggctgtcgctcggaagacttacatttacaatacgagtggcctctccaagcgctttcttcagctggcacacttcttcatcttctttttgacggtttatgactataccggcggcttgtgagttctcgtcccaccatttgatcaagataggaggacgagagtcgtcggtcgcctttatgcgagggatttcttctccgtcatcacctgatggtcctgatgtgtttccaggacattagacggatacactgaggttatttaaatcaccgttgtatgagaagacaactaacctgaagatgtacctagctgagcgtgaggtgatctttgttctttgcctggagatccagttatcgagtcattaccagcttctggcccttgggaagctgtcgtctgcgcttctacttcagggatttcttgatcagggcttgcgtccaactggtttccagtcgggggctcttgagttgttgctgcttcagttgttgccgactggtttccagtcggcggctggtcactcggattggcctggtcacccgaagcatgggcgccggtcggctggcttttggcagtcggctggctttcggcagttggctcggggtctttggatatattttgctctgccatggctggatcggggtcttttccagatggatctatatcagatggtttcctgcaaagtattctttcagaatttagcatcattttcatgagagagcttaccaaagtgaaatcataccgagaggtcttatacctggaagatgttctaatttttagcattgcgcggccggccagttttttcctgggcatggtgcgctttgggggtttattaggcgagcccttatccccagatttatcatcgtcgccttcatcgtcatcaagcaccagtttcctcttgcgaggacccgtctgaccagttgatttggaggtctgaggttgcggatctggtctgatcgttggccctccacctccctgagcagtgtgttggcgaggagaccggcgctgagtgactggtggatctgatttcatcagtgcatattcctgaacaagatgcttccatagttagtcaattcagcatgaagacaaaattatgttctgatcatggtttgaagatttccgatacatacctgcggaggcggattgaatgcattatatggcacgactggcagctggtgtgagtagctgacgacgattgcatttgagaagattttatacatcctctccttcatgattctgaaatccagagagtctgattcttcacggttaggatcatacttgccgtcgaactcgaatgccgtgcgagatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttgatacactggaggaagacaagagtacccgggaagagcaggttcaggattctgaacatagaaccagtttgcatgccatcctttgttcgaagtcttgaagggcattgagaaatatttttggctcagagttccccttagttggaatcctgcccccccgactacacacggtttgttcttgtttggttggggcttgaggaagaagattcggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcctccgttacatcggatgacgcccattggccttcgaagctttctctctcttccgccatcggtttcactcaaatgtgctgatttgattcgagggatggcttgggagaggtgagggattgaggcggtggatcacgggaaggattttaatgcacttttcggaggtggatttggccggagtcgtgaaccctagttcgccggcgcagctttgcactgtagcagggaatggggaaaatggcggggaagacgaagcgtcgcttggatataggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcatggcctaggctatttgacttatttattaccataatctttatgatacttgatgggtaatctttagagtttgtatattcggatgcctgtcaagtgtgttcattcgtgaactttttagaatgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatattcttcatcttttcgccctttacagtccactcggcaggttttggcttgaagagtttgaagtactcgggttatcaactttgagaaggctacgatggtcgactgcaaaggactcgggggctactgtggagattatgggtatcccatatctacacggcgacggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttcccgaatcatacaattaataatacactcggcggattcatccccggacaggagtagggtattacttcttttataagaaggcctgaacctgtataaatcctttgtctccaaacccatacactttccgagcttgatagccacccccttttattattgccgaaatctagtttcgacagttaggtacttaattaggtgggttgtattactatgaatgttgatcgaattaagaatccatgtataccatgctcgatctcttttaattacagttgttctgaaatttaataattttgaaattcagaatcaacaaatgtgagatgtactcttagtttattaatactcatgaattcaattctaaaaatctacaataaataattagcacgatgtaattgacatggacgtactcttctattaatctaagctcttatatttcagaaaaataataatcgatgtgttcatcatgattaacattttaatatttgtaacatcaataacaatagtttgtgtaagacatgattggtgactagcacatacatataatatcctagtagaacatttgaagtctaagtttgaccaacacatcaaagaaaatccaaactgcaaacagtatgtgcactgtgttaattaccaccgtatttaattaatttttcttctcactttatatacatgtcaagcttagactaggatttttgtggtgtactagtagataccaatgtactgtttttttactaattccttacaagtatttgaattatattttaaaactaaaatatacacattcagttcgttgattatggccttgttccatttgttttggtcccttatccatggaaccgattaatgttggtataaaaaaccttcaaaatcatttatatttcatcgttggacccaaaaaatggtggtttttggtacattgccccctgttgcatcttactgacaaatcaaaaataaaaacaatatctacgagatggaagatatagaaaatagataaggatgacattatttatgttctattatttgcttatacgtttctctatctttctattgtttactatcgttgattaattgatgacattattgttgtctttacgtagacgtggacgtaaaaaaaattgcaacagatgacacatgaatgattttgagaaccaattgtaaaagatggaccaaaacaattgctgatggacaaaattaaactatgcttttttctttggaaataaaggtacatacacgggcagacatcctctttgagaggtagaatacacttgtttagtatcacaatatttagtatccatccgctctaaaataaactatcttcgtactagcatacgaatttagatatagagtccacttatttcgggacggatggggtacaccagagatgaacacacatacacagtcacacaggcaagaaaaatatacggagtagtaagcagaaatgtctgatgatttgatcgatcgcgtctttttccgccacactgtagtccagcgcgagacggcaccagctgctcttcactcttgagctgtttcacagtacagcgatcagtccagtcctcgagattacgattttctaatgacaattagcgcgggaaagcaatgtgtgtgagtagtttgttaattagcaatgcggagtaacgacagagactgtttggttggttagagatggttactgttgcagcttccgacagcaacgtggcgaccggctgcaacgtcgtcgtcgtcgtcgtcgtcggcgacgacgtggcgcggcggcggcgacggtggcggcggcgacctcctcctgaagcgcaccatgaggccgttcttcatgtacagcgtcgtggtcagcttcggcttcacctcctgcccgggcaccacctcgacggcgaacctggacagcaccgccgccgccgcggtcttcatctgcgtgtaggcgaaccgcttcccgatgcacagcctcgggccggcgttgaacaccgcgtacttgaacgggctctcgccgccggcgaacgcgccgccgcgcatccaccgctcgggccggaacgcggccgcgtcgtcgccccacgacgccgggtcgcgcccgatcgcgtaggtgtagtagatcacgcgctgccgcgctcgcaccggcgtgccgtccgggagcacgtcgtcggcgagggcctccttgaagtcgacgggcaccggcgggtacagccgcatcgcctccgtgagcgccgcgtggaggtagtccatcctcttgatgtcgccgcccgcggcgaggacgtcgccgacgacgcgggactcgacgtcggggtggccggcgagcagccagaagaaccaggcgagccccacggagctcgtgtcgcggcccgcgaggatgaagctgatgcagaagtcgcggaggaactcgttggagtagtcggcgcccggcgccgatgacatgagccgcgacaggaggtcgcaccggccgcgcaggctcccgaccttgcgcatctcgttccggcggtcggcgaccgcccgctcggcgaactcgcggacggcgcgcgtggcctcgacgagccgccgctcgctgccggcgcggaggagccgcttggccttccagatgaagggcggggtgacgaaccgcaggagcgagagctccgtggcgagctcgaacgcgcgcgcgaacggcacgtcggggaggccgtcggcgaggcacccggcgtccaccccgaacgccacggcgcannnnnnnnnnnnnnnnnnnnngagcagcacctcctggaggtcgacggcggcgccgccgccactcagccgctcggccagcggcacgaggcgcccgtacaccagctgctcgatgctcctcaccgagaactccacgaaccgcgacgagtgcatctcggcggtgtccgcccggcgctgggcgcgccacgcctcgccgtcggcgttgaagataccgccgccgagcagctcgacgaagcgctcccggtagtagggccccttggggtagttgccgaagttggccctgagcacgtgctcgacgttggccggcgcggaggttatgacgccggaggagcccccgccccacgtgccgcggtacgggaacacgccgccggcgcgcagcagcgcggcggagccccactcgtagatgtcgtcgcggtggacgaacagcgtgggcacgatgcccactagcggccacagcaccggcgccccgcggcgccgcgcccgcaccgcgctcacggcggcgctgaacgcgaacagcaccgcgccggccaccgccaggtcgctcgcccgcacgtgctcccgcaccgcgccgacgatcgcggcggcggcggcggcggccatggacgcgatcgccatcgatcgtgtcgtgtctctctccggcgccggcgaagctgcgagactcagtgacccgtttcgatcgatggcgcgagagaccgcgagagactgagctaagcagctgggagtggagcgtatttatagctagggtgcatggcagcatgggggtggtgtcgcaatatgttgtttaattaatccattaattaattgacaaaaaaatagttggaggttggatttattaagtaagctagtgttgattatctttaaagaaaaaggaagagcgagcaattaatctactgtagaaatgatattgaaggttcaattctaggccccgcgcatttatacagtagctaggtaatttaagaagtgatcaacccatggatttaagaatgttaattttgtatagccgcatcgacgacgcctcacgaatctagcatgctagcattggagagaataatatcattaatttcgacggatctgcacacacactgcaacgctcatcgacatgcattggtttttcttacgacagataggtccatgagcaatccgttcgtgctgaaagagcttgtgtcaccgcaccggaaatcatcgggagacgatcgaaacgcgtctggcgtgttgggagcggattttttttttggtgtacaggccaggggcgatctcactgggcggatatataagaagtggttcttgtctctcgagactgacatcccctcatttcatacatatcgtttaaaaagttaccaatttttttaaaaaaaattattatgatagatcaatatataatatatcttttcgcaaacatgcgaattaaaattcgacttatacaattcgaaacaaaaataacaaatttgaccgtgaattacgcattatattcatagtcaaatttattgtttttgtttctatttgtataagtggaatttaaatttgcatgtttgtgaagtagcatatcacatattgttctatcctactaaattattttgatgactttttaagtgacatataaaaataataggatatccgcttaagggatgattcagtactctgggagaggaatatttttgtgtttttcttaaacatatatttctcttccatgtgataattaagacttgtgttgaatcttggtttgcatgcagtgtctcctgtgtatgcatatggcaaaccatgcattctcccaggaagaaggcctccatgccatgctgcagtaccacccggagatggatccagcataggggcgttggggtcttctgacgtaaagactgtaagaatcatcccactattttttttttaccatatccgtcaccggtaccaccggtacgatcgacatggtgcatgcaccggccggcaactcgatcatcctgggagtgtgcatgtatatatagtcggtctccatgcatgtatcgatccaccggcacgatggccagtcccagtacggccaaaattaatcgagccgcacgtgaggtgaaaaaaaaaaacacttaaattcatggctcaaatcggtttggatccttgagcgtcgtgatctcccttgggccattgtcgtcgtgcctctttcttctctctgataggactctccaggtgaaaatcagttatacgagtcattggatgaatagcgacggtactttcggtgtcacgttattcttacgagcgtcgttttaagaatattctgtttctatcctatgtcaccactaattagtaaggtcttcgacaaagctcttgggaatcgtctttgggtttgaagtttgaacgagggatgagtgaattttcttctctctcacactctccctcggtaaatccatctttgtggggatgaccacgagtgcgttggtggcttttctatttggagatgtgatagtacggtgcgtttatgccatcttggggctggcggcagccagcttggcgctagtctttttttttttctcaggaatgtgtgttacgagctatcaacatgtgatgatttgcctttgtttttttctttttgtggttgtcttctaggttataatctagtattttttttcttactacatactccctccgttacttaatataaggaatattgacattttgcttgtactgtttgaccattcgtcttattaaaaaaaatggaattattattttttttgacttactttattatccaaagtaattttaagtacaacttttcgttttcttatatttgcacaaattttttttgaataagacgagtggtcaaacaatgcaaataaaatgtcaaaatcccttataataggagacggagggagtatatttaagaaaattagtttgaatcaaatcgaacttataattgtaacgaactgagcggagccaaagttttaactcatttgcaaggctacttgcgagctactagttttactcattagtaaaagaaatatgtctattctaactaatatgtacttcctccgttcctaaaaaaaatcaactttgaatactattcttagttagtgtttattttctgttgtcgacgcatggcatatatcacatttttaaagctgatataattgggataaaactgattaacgaatctaactaggttgacaaagtcagctcacgaacctagccaaggcatggttttttggtttttttggggctgtttggaaaacagggatttgtcatgttacatccgatgtttggacactaatttagagtattaaacatagattaaatacaaaacacatttcataaccttggactaattcgcgagacgaatcttttgaacataattacaccatgatttaacaatgtgatgctaaagtaaacttttaataatcatagattaattagtcttaaaaaattcgtctcacggattaactcttatttatgaaattaattttttattagtctatattcaatactccaaattaacgttaaacatccgatgtgacagggacttaaaaagtttccccatctaaagagcgccttagcttgctagagttaatgaggctcgactggctcgttattccctcttagccgcatggacgcaagtggtcggcgcaaaccatgggagctcaccgtggatcgataaggaagtttcgcggagcccagccggcggccggtggccaagtggccggcgagtgaattccaccttccacacgagggaacggagaggcgcgcggatggggcggccgtcgagattgtgagaaattaagagcatgcccaagagatgcccaatactactcccaatcctaaaattttgaagttttatggaaaattttagctccaacagaactccaatcaagatcccaaaaaattggaaatcccaaccccgtcattctcgatctccacatgttgggaagaccgatggactcccaatccaccgatcgcacgaattcgcgcgcgctggtgaaatgtcctagccatcatgagctcgtctaccaccgccggcagcccccgagctcctccgtcgccggctcgttgcgagcttgtctggtgccgctggccctagagctcgtccgccatagcgtcaattcgcactgccgccagactcagagctcgtgtgccgtaggtctgtcgcttgttcctccgccgacttaattcgcgtagccgccggaccactattcgcgtcgccggcagccacagcaagcttgttcgccacaaacctgtcactagttcctcctcctccgacttgattcgcgtcgatgccgaacctcgaatcacatcgccgatagccgtcgcgagctcgtccgccacaagctcgattcacgctcccaatggagccctgattcgcacccacggccgagtcactccctcgtccacccatggctcgatttctattcgcacctcccggagctccgatttgcaccgcggccgcctgttgctagcttgtcggttgtcagtttgatttgtgtcaccggccaccgggatcctcctaccccagatacccccgttttatgccgccggcggtggtcgcgagctcatcggcctgcggattgattagcaacgccatcggacgtcgcgagctcacccaccaccaaaccccgatttgcgtcgccactggctgtcgcaagctcgtccgctatcggccccgattcatgccaccaccagctcgtcgtgcagccgtgcaggaggagagaacagagagaagatgaggaagaggaagaaaaggcacagctaggtgggcccacctgtctatataggaaggggaacggttgatagttttttaggtggtcccactttttattatacagaaccatgtttacatagtttgttggaagagaggatattttagatcctcaaatcctagttacaaatccctaaaaggtcattttgggagttgatttattggttatttgttggtgatgctctaagcgcgcgcccggcaaccgcctggcggggagggggggggggggggtggggtcagcattgagcctattgcctaagcattcatcaccggtcaagggccttggtgttttgttgtcgttggtggtggtgtctccatcccgcggtttactttaccgccaaactttttgctcgtttcggctgcaccgcttgcttcctcgctgccttgcaaacgttttccgagatgtccaagatgtcctcttgaagatgatggttttgtagctagaaaatggaaaaggatttgttggcctcaacaaccaggggacaaaaaccatcagaaaaagtaggctgcaggctgttgtgatgatactgtagaatagggcccggagcgatgcgatgcgatgcaaccgacgctgccggatttggtagcctttgtcgttgggctgcattttcgtccaggactcgagatcagtcaatactgcaagcagtgtgcgtgatataatatatcagtcaactaatgcacacaggagggtgcaagcagtagtagacaacatcaaaggtgaggaactaggggaagggggaaaaacaaacttacaagtacagcagcaaacatttgcacaggtgtcaatcaagagacaaaaaaacttaagctaaacgtaggcaggcttgaagcactgtgaatttgtgatagaaaagacccggctgtacttttcaaagaatgactcgaggcaatattctgttcactcattgggactattaaacagacaaaaagcaatccaactttccaagaattgataactgaaaatttgaagcaaacatatttagatgctgtacacattaaaattctgagacaacttgcgggtgtggtattacaatgaaatggcagataatttacaactcctgcagatttggcaacctggaggtccctatccaactcagttccatccccctatgcaggtaggggttcttccaaaactgtgatatcataaagtatcataaaaagaacagaaaaaaattgcataatgcacattaaatgtccatagaaacaaaaataccttttgttttttctgcagcttctggtctctctggtgccttagtgggtacatcaggaagctcaataacctcgtcaatgtcttctgcagcctcagtgacagcaggtgtttctgatttctcctcaggccgtacttcagtaactggagcatctggtagagactcaacggcaagctgcaacagacagtcatgatcaacaatagaagagataaaccgtttatggctcatgaaagttcagaattaaagcattttcatgttggtagtttgctcaaaatggaaaatgcataaaagctcctgaaaatcaataaaaacctgtgcttccaagttctcaaattcagccataacagcctcctcatcctcagcagatagctgctcacccagagcagcatttatctcctgcaatcaatattggtcgataagtaaacaatataaggaggtccatgcaattgtagttggagcaccaacacaacagaaggtaaggcaagtgcatagaccatcaatagaaaagaaaaacgatagcgctgtttgtgtaatctgacacgtcgatcacaaactcgcaaatctacaaatgttatgcaggtcagatccattcattcttaagctgttaactacatagaccaatgttacactcatgcacaactgtttccaattaaatccaattataggcacacaaatagagcacatcctatacaaaatcaggagacaactcatacattcaagaagcatatgggtgtaaacaataatgccgccattccagaaccaagactgctataatctttcagaaaacctacagagtctatttagtctggcataagttgatcaaaacagcttttataggaacccgatgtgataccaaaggtgtaactgaggatacagtaaaacaatttgagaccatgacttccagacaactaaggggataaaacaactgtaaatgtagtaacaagcaagagtgtagagtttattcaacttacatcttggtaagccttggcctcagctgtgtcgtccatcaacttttggacatcatcaatatttatctcattctggatagacttaagagcagcatttccagcttttaggctgtcaaatacagccttctgtttacttgctagttcaatgtctgacagctacaacaagcaaacaaaaagaggatgtcaatcatgcatcttaactgaacgtttcactgattatcaattccgattgtaagtaacagatattacccagtcaaattattttgaattcataaggagacagaatatgtccaatagactacgaacctgttgttcgacattcatttgccatgtgtcaacttgtttcagcagctcttcctgtgctttcttcttcttcagtgcaatcaaagctctgtctttcttcttttgttgaactagctgccgtgcagcttccttttctgcttcaatcaccttctcaagctggaagagggcaaaacaaaaaaaaaagaaaccatcataagcaaaactcattaggacctccatgattgttggtacaaaagaattgaactgatttaatgcgacatatgtgcactagcgcagtcaataatcatgcatagtcctattgtactacacacagcagatgcaacctgaagctatttcatgaacagaaaaatattctctgcggcagtgccacactacacagccagtgcaacaccgcgcagaatagtgacacgtgtttgatctcctgctacaggccaagccctctttggtgtcgagctgagcccatctcttgctgccgctgattggagtcaagctggggtgcag

SEQ ID NO: 69914 - DNA, 644 bp, Oryza sativa
caaaccagtcgatcggctatcattgaaggactcatttcgttttctttctatatttcttattggtggcaggatcaaaccaatgggcatgcctagaacccgaaagcaatatttaggacctgcactagagttaagcaaatctctcaggccaatgtgtgtttttttgcatcaacacgcttttggcatgccaggtgggaccatttcttgaagaatttgctagatggtggacacaaagacatctgatgttagtccagacaatgtcattccaataacaatggacaaattaacaccagagcaaaaggcagaatatgaagatctgatgaataagctctaaaatcaatacttgcattcccttgttcagaccagatcaggaacagtaattcagaggtataaagtaaatcttctaagcaatgaagacctagagtcaagttctgggaaggacaaggaagtcaagcaggaagaaactcctgaagaattcaagagtttacaagacaggattgattatgctgtacacaatgctttgatcaatcaatcaggagtgcttgtcaatactttgactaatatgaccaagtctgtagttgatggtactattgctgaacatcatgccaaggggccaatattcttgccagagggagtttttccacaat

SEQ ID NO: 69915 - DNA, 1380 bp, Oryza sativa
  unsure (1)..(1380): unsure at all n locations
cgagaagacataccttctagtgtgaaaacttaactgaattaagacatagaagcaccatagtaaagatgtgtacaccaataattacagttacatttcagttatcttatccattaagcacaacgcacatgtctctgttttccacatgtggtgcataagttggcttgtccttgccctgaagcacaacagctatttgggacgccaaccgtccaaggacctatcacacaaacaaaggcttggtaaaaaaccattacccatgaatatttgcttaacaactggaaccactagaaaaatggtaacctggccctttgcgtcaaatacacaccatctcaaaccatctaaattgattcttctcaagtctgcaagtgctttttgctcagttcaaacaacagcactatcagtaccagtacttcaaatttagtaggttgaaactcaaaaatcttattaatgtaattccaaactaagagaccgaaacaatagggtagatgtagaacaggattcatattggctagctatctagatatttcaattatagagttcattccttttcaagaaaaacaaatgtatacagcttacttcgctcagtacaatataaacacagataggctgcttgctgcaataatgaaataatcagaaaaacttaatttttgaccatgcaatcagcatgtcagtgcagattctgtatgccctctaattttttgggtatcatgaggaatcattggcaggatgaatacactagccgaatcacaattcatagcaaaggcatataatctactgttgtataattgtatttgccagtcaatacgccatcttaatccatcacacaccactgtttattagttattataactgtagaatttcacaactcatgaagttagccctcatcaaggactgctgtgaatctctatatactaaacctaactggcctaactggctctaccgtgaacggatgtactacacgtttgcaaaaagctaacagctcgtccactgcccgtggtgtccaacccgctacaaatgacctcctgcaggccatgctatctctaggatcagactctcatttcatcagtatcaaccgctaaaccctaaaggcaagacaaacactgaaacacgcatgtcgctctggtatctgacggattcaaccagctgcagtatgcacattctcaatccgcagacaaccaaacagaccctatctcggagatcacccactccgactgtggctacaccacaccggtacaccacatgtgaatgaaagctcacgcccacgaggagaacctgatgggcgacggcttccccttccaaccncccccccctcccaaaattcaaaacacaacacatcccttaacccactttgctgggagcacaaacacacaagcttctatttca

SEQ ID NO: 69916 - DNA, 669 bp, Oryza sativa
aatggcggcgaggagtggctcgttgtaagtccacgaccttgaaagcgagggcgaaggggatctgatcctcgggggtggactccacaacagcgcagacgcgttcgaccagcacctcgtcgaccatagcatcggcggcgaagatgtcatcggcgtccccggcgtcctcccagagcgaggccaggttatcctccccggcttcggtgggatcagaggcgaggctatcctccccatcatcggtgggatcagaagatgtggaagcagcgccgccggcagcatccggcaggggctccggggaggaggagaggaagcgggagagggggcgcggaggtggtagagtctagttaaggctcgaagtggagatggcggcggtggcgggagaggcctgtggatggaagactggaggaggaggagagcacaagctcccgaacgcccgccacatctcctcctcgtcggcgacagcggtggcggcggcagcgtggtagctgtaatgtgtggaggcggacgagtcactggtcgagtcgaggtggtgggcggaatgtttctttcttgctttctagggtttaaggccttgatggcctatttggagtgggcctgataatttttgggcccctatgaaacttttctcttttttttcccaaacggagcaagagatgagcgtatgattaataa

SEQ ID NO: 69917 - DNA, 1879 bp, Oryza sativa
aaggactcaagtactaacccgagtaaggaagtgacgcaccgtcagtatagttttggatttgcaactgccgctgcagttaggccaggggcttcaaatttatgatttgacccagtcctgtgtaactttaccatactatgattttatattaattgcggcgtgatatggtttctatggatggatcaggctccctttggctgtgtttggctgtgtggtgtggcgcattttccatccacatctgagaggctccctttggccgtgttacatcaaaattgaaagtttggttgaaattagaacgatgtgatggaaaagttaaaagtttatgtatgtaggaaagttttgatgtgatggaaaaattggaagtttgaagaattattttggaactaaacacggtgtttatcggttttggaggttgaccgttgggtccatcgacagtttgggacgaagacttcagctaccctactccacatgtcagttgataggtgaatccgtcacatccgacttgctagcttagtggaacatcgacaagacctatcttataagttggcccccacctttgtatgtatgcatgggtactatggacgtactcctattagcatatcttatatcctataacctatatatcgggaaaatatgtatatatctatacgagtgatccatctaaacttttcgtaccgcccggtacctactatctagaccatccatcacgctaaatccaacgggtgacaatgctcagtactgccaggtaccaaaatcccctcaatggtacctccccttcgtatgcacgcgttaaacaagtggaagggcaaaattgggttttcgcatggtctattctccctgagtccaagccgctcctccctgacgcctatgcctgcgagccgtttctcccgatcccctccccttgaggcgcctcctctgcatctgtcctccatgcgcggccaagctcgccggccatccgagctagctggacacctccgccaccatccctgccccatcctaactcaactcccctgtcaggattgagaggaattctgagatttcagaaatattctaagtctgaaaacctgaagatgcagtttgaagtctgaagatgatgtgcgaacgggaggaagcagagttatgaagatccaacggtctgcagtgattccgaagaggtatcgcaggatcctaaccattcacatgttgtcgggggaccacttgagtggtaaaatggctgttttctctgaattggtgtgtgtgtgttcagtggcaaagaccactttggaatccttatgtactcctattaaaactattggcttgtggccaggagggagataagaaaaacctcattatcatttgttcttaggagtagggtaaagtagatctgggagaaacgagttcttgcggcgaccacctattttcttcccgatttactctgtttcgagcgaacaaaggagagagagaggcgtccatttccaggtgttttcagctctgatcctgacaaaggtatcagagcaaggttcaatccttggctctggaatccatcgggtgagggttggtggaaggcggcggcgagatccattgtaaaatccctaagccttggtggattttatccggtagcggaaggaaaacacagattactggagcgagggtttgtgaaccacctttcggtgtgttcctgtaaaatctccggagctcgtgatctgggttaggcggcggtagacagttctacttaggcacaaaggggagggagtcagatcctaaaccgacctaagcagtggtgtgaatggtgactactaggtacggaggagctcaacgaattccgggttgatatggcggcactgaagaaggaggtggccgatctcaaaggtctgaagggggaagtaaaagagattaaaggatt

SEQ ID NO: 69918 - DNA, 1047 bp, Oryza sativa
gttcctgtaaaatctccggagctcgtgatctgggttagccgtcggtaaacagttctacttaggcacaaaagggaggtagtcagatcttaaaccgacataagcagtggtgtgaatggtgactactaggtacgtaggagctcaacgaattccgggttgatatggcggcactgaaaaagcaggtggccgatctcaaaggtctgaagggggaagtaaaagagattaaaggattgttactggaattgtgcaagagaaaagaggctgaataagaagaagaagcggctgctactgcaaaggcaagcaaggcagtagcttcgcaaggaggagtagacgcggctgggacaagttctcaggcgcaaggtaacccacctgtgactgaatcccaattccatattgaagctaatactgtgaacccctcgatgcctatgaatatgcattcagttgcacctacgatgcctatgatgacagtacaagggcatcccacacagccagggcatgagaatcagtttgctgctaatcgaaccaatgagatgtttacctcctctatagtaactgctactcgaccacagctcgcatttgaaatacccgggggcacattccagcttttcagcctaatgggaatagggttggtggacatgcagactttgtccaaaatcgtgcaggagtgaggatgttggaccaacagaggaacatttatctgggtcaggcaggagaagggaatcagtacgctgaggctgtcctcaaggggccaagattagaaatccctctgttcagtggagaagatccaatagattggcttaagcagtgtgagaagttttttgagattacgggtacccctctggatcaatgggtgaatttagcggtggctcatttgaatggcagggcattgaaatggttcggaggaattggtctgccatggcaagtgatagcttggccacaatggtgcagcatggtctgtactcgattttctgctgcgagtgaacatgaggcaattgagttgttccaaaatgtgaaacaatttggaacaacagtggagcaatatattgacaa

SEQ ID NO: 69919 - DNA, 638 bp, Oryza sativa
  unsure (1)..(638): unsure at all n locations
ttacaaaaaaaaaaaaaatgcatcggtagcttttgctgttcaaagcgaaatcgacaataacaaacaagatgagatacagcaggcacctagattgttataaatcttacagctcatttatttctcggaggcaatacagatcgatcaaagcagctacccaactatatccacagattcaactccttatgcctcttcatttgctgcatcaatcacaagaacaagatggaaccagctcaaagatcaattaggcgcacaaactcaaactggactagcatgtcatgtatgctcacccactcaggcaatggagtttcacttagaagatcaagatataagctaaggtcgttcgaattgtctattgaatgatgtttttttccaaaccccaaaacaggacgtgcacatatatccatattaatttcatttacccttcaagtgatgtttatttgtacccccaaaagatgatagtggaaactcttggtccttctttttttacattttgtgctttcatgctgggctgtataagcaaccaaagtatcttctgattcttgccatgttgaaaaaangttacnaaanttccaannacaaacccaaaattttcagggtgcttcaaatgtgtgtactaatggtaagttattgtactttca

SEQ ID NO: 69920 - DNA, 7442 bp, Oryza sativa
aactgtgtatcccttcaagttttgcatggttcctggatcccactacaatggattttaattatatttcaaatattgctgttaggagtaggttgtctcagtaccacaacctttgtgctaattaaggaaacatggtaaagttctaggggctgaacatgggttttgcatagttgaagatcagttaggggtgattatccttctgacatgttataatacttttacatgatatatatggcccttcatgagcctaagcccacagtctaaataagtaaatatacaagaaaaatgagaaggttaatccttaaatttacgttttagattaatatccaccatttgatgttcataagcattaagctgtgataatggctgcctgacttagtatgaaaactagtttttaagaaatatgtatatagacacaacctgattctactaagcatatcaatcagcagatcttcagaatagctccataaaacattgcgatataaacttataatggttctgtaaaagcaagaaatacctggtaattcagatttaatttcactcttgtttgccctcattgttcctgcaacgttgttctgagaattttggctggatttggaaacctcagctgctgctttctgagcttctgctgcttcctttgcagcagcctcagctgctgctttctgtgcttccactgctaactttgcagctgccttctgtctggcctgcatcatagttcatgaaatttctggtaaactggttatgcatttaagcgactaccagtgaagtaaagaaaattaggtttctgaactacgtaggttgtaaagaagttcagtgaagaagtaacatgaataacaaggtattagatataactgaactagatggaactcaatggactaagtattatgataaataccagagccaaaagaaataacaatgaattaagtctcacatattgacatatatcaaaagaaatatatcagtttatgttaacaaaaacacaccaagtgaccagcacatctaggcaaacaaacctctgcttcttgtttggctctttcctgccttattttttcgtccttcatggcttgctcctttcttttagcttcttcaagagcagcatcatctcttattctacgttccacaatttgcgatttctgttcatgatccctttggaccatagacaaatgtttatcaagtacttctgcactgcaaaaaggcaacaattataacaaggtacagaatccaacaaaagatcatcagaaaatccaagtataacttataacgaaagatcatcagagtatatgtcctttatcctgtgagaactactacaaaggaaaacaaatacaaacgctaacatgcaaagtttctgaaaaaatatttacagtgctaatgattgaactggaacataaagttactacacaaagaagtacaaaaactatataattgtgtcacagatagttaattccttatataacacaaatagagcatttaaaaaatagtcaacccttagtctcagtcgctaatcatttgaccaaacaccacaggtataagtatggaatatttgtacgttaaacccacacgatttaatcagttgtgaatagaatatataaattgctgcaaaatgtaaagagctgaaaccttgggcttggaatttctcattgatcatttaagtagcaaatttaaccaaataacgatgaggataatagcaaatggtggaggaaacattaaggatcttagtattagtccacaatcacccaataaacctttatattggaatttgtgcatataggagatgattgttttctcttcaaaactatgtgcactagaaataatccatgataaactgtgtagctactagcaaggtccgtcagccttcatgaatatataccttttccactcaggagtaataaactatattggaatgaaaaacttagcactttgtaagccctctttacaataaaataaattgagttatgacaaataaaaatggcataactttacaaagcaaccaccaataaaaattcagtcttgacaaactagtacaagaatatcttgatatgtgccacagaaaatcctccagtaacaaaagagaacaaactagtacagaagttaaccctagtcccagaaaattgcatcaccaaagaccttgtaaaacatacagtttcctcaaaatttgaaaaatcaacagtaatcatgaaatgtagatttaaaaagacacaggagaaacaattcaacaacaaaaacatacatttttctctggaagtggacatctagccttctgtctatctcttttcttgattctgcgtatttctgtagtcgagcaaatgcagaaactgttcgctggatttcactttggtggcatacctccaatgcagatagtttacttctgacttcctcctgaagaaaaaaaatcatatgaagaaaatgaacaaaaaggattcagcagatttaataaatccatcatggtaaaaaataaaggcatgcaacatcagccaaaaagataattagtactatgatacccaatacttagaaatttagtcatatgacatccctgttggctttctatgttaaacttcttggatcacaatatccaatttgaagtaaatgcagtattgtatttgaaaaatcttcttcaagtagcaactaacagaagtgatgtattgtttttcttgaaatttcatcatgtcattatccaaccatatcagtgtggcactacactaaccttaaagggaacaaacaaaagcttcattcaggaattcatatacagtataaccttagaaagatgaaagataatggaagcatccacatgcctggatagcttaaaatacctacataaaggtgaggaaaaagatataaagttgatccgtaaagtgtaacctaatgccatggtaaccctaaactagaatgaggattaatggtaatgaaaataattcaatggtctattgccaacacatcaaagaaaaatcagcccataagtactgcattcagtaagaaagatataacagtatagattgatgaatacacacttgaactttcagatgatgctcacgttccagctcaagcagaatgctcttctctaggctccgtttctccatcaggtgatatggtgcaatcctgccatccatttcatcctctgattcttcagcatcactaggaagaaaacaaaagaaggggatatctcacacaatacgccattcatttaaacttaattgcagataatgtaccgtacttcaaagcaaataaattgcaattgcagtggccaaatttcagcatcaaatcttcacctggattcaagatcattgcatgagaaccttgctccagtggccttggccacaagagcccgggactccccatcactgtcgtaatcgtcctcatccgtgtcatcttcctcttcaacccgcatcacaaaggccttctccctcacgctgccactgctagccctaaatgaaccaaaaaaaaatcatatagaagcaatgtagagggaaacgattgcagcttatcggcgaaaccataagcaagggagcgcaagggattggagaatagagataccactccggcggctgcttgaggggcgtgggctgcgcggtgcggcgagtggcctctagcgcgtcgagctcggtgaggacgtcgccgagggtccagctcgggcgggggtcgagggccctagggcaccgcagctccacgcgcgcgaagcccctgcgaggaggaggaggaagacgtagagatcagcctgcctgccattaacgaacaccaagcggtgacgagcggaaacggcgatggggggctcacatggcggccgtcgaccggcgaggtccgccccggagcggattggagccgcgccggcgcatcaaaaccccctaagttgcgggaggcggcggcggcggtggcggagaggcggtggacgctagttgggtctcccggctccagtcccacctccagccgctaatggagccgtgcagacaagacgcggtctcccttgctgccgcgcccggttggcttcctcgccgtcgccgctgcgccctgccctcccgtgccgcggtgccgctccgcctcagactggccgccgccgccggagcgcgaggccgggatgcgccgccgccggacgtagaggagagatgggccttgggccgaacactggttccggaggtttcgcttgcttattttggaagtacggttttctgagagcaaacggcaattcgaaataaaaccccagaacggaactacgataaaaaaccaaaacggagaacgaaaccgaaaagcaaagaaaaacggtagaaattcgattcggtggaccgacttggatcggcgatgcgaggaggtcggcggcgcggatagacagcggagcagatcgacgccggaatgggacggggaggcagccgtctaggccatggctgggccaatctggcgggctggggaagacgaagatgacgccaaggctgggccaacctgagcttaaaatgtcagaataagtctgtttcacctctctctctctctctctcttctttttctttttctttttctttttgcccttggtcgcatcgcatcccttaaccgtaaaaccgagtctaacattccaacttcaaaaacgggtttagattgactccttagatggttttggaagcggcttttgctgacatggcaatttgactttggtttaggtatgctgacgtggtagcccggtcatcaaaacaattgaaaatagaaatttgtcctatatgtaagtgataagaatgaaaataaaaaaatttgggacccaattgtcagctccattcctcccttcttcaatttgtatgtgcttcaagccgcactatgacacgtcaaagtgcggcggtgtggcttgcggtgtgtacagattgaagaaggaggagtggggctgacaactaccccttcccctgtttttgtttattttcatccttaccacttacatgtgagacccatttatatttttaattcttttaatgactgagataccaccttaaccaagccaaattgctacatcagcaagaaccgctttcaaaaccaccgacggaatgaaaaactggtttttgaagttgggggaggtgttatatcctgttttgtggtttaaggatgtcatttgaccaacagcaagggatgagtgaggtgaaaatagacttattcctaaatgtatgatcggacttggatgtcccattaaagaaacatttcgggcctattcagattgtagccaaaataaaccttaccaattttttttcaatttggcaatattgccaaattttgatatgatatcttatgtatttatcagagtttggtaaaaattaaattgatgcacatatttaacaactttaccaaaaaaaatggtatgatttgaaatggcatcaatcttaacaacccattcatatgatcaattgatcatgttattacaagaagcaaaacaacttaaattttgtttaaaaacacataattatatattatcccaacaaataaaacgaaagaaaaattatttttcagagataacaaaactgaagagaaaaataataatgttacgtaacatggttaatcaacaagtctcggagatcgattagccactgcatccgaagttccgaacatccgtctcgcaaagtgcatgctcccagactgacagaagaaaaattattgtatgtttagttaacatcaaaattgaaagtttggttaaaattagaacgatgtgatggaaaagttgaaagtttgtgtgtaggaaagttttaatgtgattgaaaagttgaaagtttgaaatttttttttgcaacttatcacggcgtaaggcgcaagaagtatagttaaccaacaccagtaatatcgtacagtactactccaacatgtcaccaaacttctctcggcgcgcccggggtgaactccaatctacccgggatcctaactcgccaccaaacctcctcgtcgttcttcttttaccgcggccggacacggagcaggagcacgcacgcacgtacggcgcgcgctcgcctcactgcatttctatcccggccatcggtccggccgtcacgatgcgccgccgcgtcgctctgtgcctcgtgcttttcgccttcgccggcctgcacgcggcggcggtggaggccgtgacgctgtcgacgtcgtcgcggtggatcgtggacgacgaggccggcgggcggcgggtgaagctggcgtgcgtcaactggccgtcgcacctggagccggtggtgacggaggggctcgggatgcagcccgtggacgccatctccaagaaggtggcgtcgctcgggttcaactgcgtcaggctgacgtaccccatcgcgctggccaccaacgcgtcgctgtcgtcgctcaccgtgcggcgctcgctcctcgcccacggcctcgccggcgcggtcgccggcgtcgaggccaacaaccccgggctcctcgacctcacgctgatcgagtcgttcagggccgtggtcgacagcctcggggagagcggcgtcatggtgatcctggacaaccacgtgagccggcccggctggtgctgcgccgacgacgacggcaatggcttcttcggcgaccggcacttcgaccccgacgcctgggtgcgcgggctcggcgccatggccgcgctgttcgccggcgtccccaacgtcgtcggcatgagcctccgcaacgagctgcgtgggccgaggcagaacgccgacgactggtacaggtacatgcagatgggggcggagcggtgcacgcggcgaacccggcggcgctggtgatcatgggcgggctcgggtacgacaccgacctgtcgttcctcgccgcgaggcccgtggacgtgagcttcgcggcggcggagcgggggaagctggtgttcgagctgcactggtacagcttcgccgacgcgcgcgcctgggagtccgaggacgccaacgaggtggtgcgggccgcgtggtcgcggggggcgtcgcgcggcgtgggcgaggttccttgctcgacgccgaggttcccagctctttcctcgagcgagttcgggcgccgacacatcgcggcgtgctcgcgcaaggacgaccggtacctcccctgcgccgccgccgtcgccgccgagctcgacctcgactgggcgctctgggcgctgcaggggagctacgcgctgcggcagggcgtcgccggggccgacgaggtgtacggcgtcctcgactggtcgtggagcaagccccgcaacgcgaccgcgctctcgaggatccagtcgctgcagcgcccgctccgaggtcagttcgctgtcaacggcgtcgctcgctcgcgccatcatcgccggtgcaacgtttctaattgaccgaagggttcgccggcgatgcgatgcgtgcagggcctggctacgacgaggcgaggccgtacaccgtgctgttccacccgctgacggggcgctgcgtggtgaggcgcgcggcggatgacccggcggcggcggcggcgacgctggagctgggccggtgccaggacacggactcgtgggccta

SEQ ID NO: 69921 - DNA, 636 bp, Oryza sativa
tgcggaagttcctggcgcggccgcagcacgagggcgtcggcgccgtcgttcgccggagcatcgggaggtttgagctgaggtacttcgatccgttcctcgtcctggacgagttctcaggtgagtgaattgcttctggctcggttttgatcatctggtttagagtgatagagatttgcattttttgatcgtcttcttgatcgaatcctgtgcagtgtctgctccggctgggttccctgaccatccacacagaggtttcgagaccgtcacttacatgctcgaggtaggcagagtcttttaccacagttcacattctgttcgtcggtagtagaacatccaactgcatatagagcggccatgaaaattccttgcttaatccccagtgatacgtacagacagcagcgtcttttgacaaccacatcacacggatcagcagaaacgaattaaacgcgtttcatttgtcaacaacgcaaacctgataggctgatacggagtagtagtttttagcaaattcagaacgtttctttccgtcaaattgaagaatctaacccatccaaacgggccctgttgccttgctctgcctttggttggtagccttcctacgtcaaccacctcgcgtcgcatatacttttccgcgct

SEQ ID NO: 69922 - DNA, 652 bp, Oryza sativa
tgtattatctcatgagacctacaaaagcaacatctaagctaccctttccacctcctttaagctaaattttccttggtaaaaatgacccctttttttaaataccacaagaagatctttattttcaacagaagtcttagcttccaaataaaagattgccttggtatcacatttccaaacatgagttttttatacatcgagttgactgtgaaagttccatttttactagcatcccaagtaaacctatccttttgccctctaaggtttatatcaaccacgttagctacaatctcatgccatgctttcaaattatctcctattatggctctcctaaaggagacgttcaaaggaaccctctccaacactttagccaccaccacattcttatttcttacaagattgtacaacgatgggtatcttttctctaaagattggtttccaagccaacagtcttcccaaaatctgatttgtaaaccatcctgaagtttaaacgagccaaaagagctaaaggtatgaaccagttttgcacccaaagaggagagcatactctctttcaacctctatggctttgccaaaacacaacaattcgctcttatgaaaattaatcttcaagccagataaccttttgaaagcacttagtacaagtttaagattt

SEQ ID NO: 69923 - DNA, 677 bp, Oryza sativa
aaatgcagctgatctggcgatacaagtccatgactatggtgctcaaccaaggaagctatcgtgtacttgttatcagaacatagcttcacgtaaatgtgtgcatcacatccacatctagtttctttcaatttaatcttttttttcttcgatggatcaacaatctccttatcattcacatgtttccatccttgccttgagcacacaaagtgcttgcactgaaccacgccatccaacttcttttgctgcccaatacgcactgagaacccaacttggtgtgcatatgacttgtaaaatttttcaacagaggcaatatcttcaaatgtcatccctaccgcaggccttatcttatcatcacactctggtgtaaaaacggagcactgcaaaatcacatatacattgcaataagcattttaaagcacctcagtcataatttttaaattgccagtgtacttacattgagtggaattcttgatattttttttggtgtactggtgttgtcatcctctattactggagaagttatatcatcatttgaataaatatctgagttatctcgcacatccaatctatttattgcctccatctgcaaaaaaaaaaacagatagcaaacacctgagattaaaccttcaattcccttgagtgaacaattatgttggagccacctaccttaatatgca

SEQ ID NO: 69924 - DNA, 4577 bp, Oryza sativa
  unsure (1)..(4577): unsure at all n locations
cacactggcgccgtgcccgtgccaccgtggcactagggctgtcgtggaggtgctgactgggcagaaagggggcgccaaccacactggcgccgcccctcataccacggcgccagcatagctggcgcgcccctcctctgtgggccgacccttaaaccccgtgggccccaccacctttctcctccccactcccattttcgccattcccagcccgagcagcgagctgctgttcttctccctctctctccccctcacctctccacctcaaatccactcaatttgaagccgtttttcgcgggattttttgtggaaatcgaagagaaaggtagactccttcattctcccctcttttttttcgtttttattggttgaatttgtagatcggtgggtaaccctagaaccccttttttacccaaatttgtgatttttagcatttgttcttaggattggcttgttgtagtgctacatgtttgcattgtactcattggtgtcatgatttttttaaccatatatgtggtaatgttaatttttggatggtttggttggatggatggatgaaaaattatggttgaggcatgacggaggtttgggttgtatgatggagtatttgtaatatttcgatgtgtaatgcagtagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtagatggatagacttgttagtgtttactacggtggtagagtggtgaaaccttatgttggtggacatgttgagtttgaggatatgtcattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaanagagtctcagtttagatctctagaggtgtttgcatcanagttagttcgtaccgtagaaaatttggatctaaacaattctcccttcttatcattacgttgagaagaattttgtgacatattattctcgtcgtggagggggtgcaagtaagagtgagttggtacgagaagacttggagggggaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatatgaatccagatgattactttgatgtcgaattgagtggtggtcacgattctgtctcagtagaagtcaatagagatgatgttgacgaggaggcaagtgttgagcaatatgatgttgaatttgctgaagactctgatgatgaccgtccattccctccacttactaataatgacaagttagcattagaggaatgtcgtgcgtttgagaaggtgtttgggaggaagccggacattcctgagtttagagacctaacacatgcccatggtgcactactagatggcggtatcaacctagatcagttgccagaaccattccaggtggatggtctcagaaagggtttagagttcccatccatggtcgcattgaagctatggctccaggagtacgccatcgtgcaccatcgtccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcagctgacatcaaagttcatagcaaataggttatgcaatgccataaaactgcaacctacactctctgcttctgcattagctttgtatatatttaaggttttccagtatagggtgaagtatggcaaggcttggagggcacgagaggaggctatgaagctcatttacggtgaatagggtgaagcgtatgtccgtttgcccaccttgctgcaagccattaagcagaggaatcccagtatggtctaccacgtcgatactcatcctgatagggttgtcaacgttgatggagtgaccaagaaaatttttatgcgtgcattctggtgctttggtccttccattgaggcttttaagcattgtaggccagtactagctatagatgcaaccttcctaactgggaaatacggtggtgccttgatgactgcattatcagctgatgcagaggaccaacttgtacctttagcttttgccttggtggagaaagagaattcacgagactggtgctggtttatcgatcttgtccgacgggttgttgttgggccgcatagggaggtttgtattatctcagatcgacatgctggtataatgaatgccatgatgactcctgttccaggattgccatcggtttaccaccggtggtgcatgaggcacttcagtgctaatttccacaaggccggtgcggacaagcatcagacaaaagagctcctaaggatatgtcagattgacgagaagtagatatttgagagggatgttgaggcactaaagcagcgtattcccgaaggtcctcgtaaatggcttgaagatgagttgttggataaagataagtggtctcgtgcatacgatagaaatggccgccggtggggttacatgacaaccaacatggccgaacagttcaatagcgtgctagttggtgttcgtaagcttccagtgacagccatcgtatcatttacgttcatgaatgcaatgactactctgtgaacagacatgatgaagctttgaagcgagtccagttagggcagcgttggtccaccaaggttgacagtaagatgaaggtgcaaaaaagtaaggcgaacaaagcttcaatgagccggttggaaggcctaagtggagacaaagcttcactccttggccctacaatgagccagacatggagaagacagtggcctacctttttgagagtactgccactgcacatgctcaccgggatgtggcatacaagcattatgtcaatgagatggactgcttgcagcctcaacatgtaagtacttccaatatcacttctagttagacatttacttctttaattgagatactaaccaacgacatctcttcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcggaaagaaacaagattggccggttgaggacatctcaattggagttgaattacacaagtaaatatttcttatctttgtttgctttcattgtcaatgttcaattttgtaccatttaacccttgtcgatgctcactattgtttcatcaccttctacttgtctaggtatgacagggtgagaacaaagaaggtgaaagactgggggctagagcataatagatacattgatgaatggagaacagccggaaggaacgataggtacatcgagactatacaccaaaatcatcttttctcagagtaccttcgttggctgtataggacatatagactgttcctccgccctacttggacggaagccgacatagaggatgaccgcgactccgatgaggggcggaatccctatgatgtccggactagagttggatatcaaatggagcacgtcccacttagagacagagtcgtaagttttcttgcatttgtcaaagttacttccatttgcaccctagaccctaacatatatcttctcacgctttcagtcgagagagctcctcaggagtgtgaatgaaatggggcatgccctccaagctccgaggggtggtgaggacacggagaacacgctccgcaatgttttagaggtaaaatttatttagcactttgcattacttgagttatgcctaacaaacttcttttttttttgaaatgcagaaagttcgtcaaaggtgccggaaacttgcagcaagattaggttgcaggtcggttggattggacgacgtgtaccaaccggggagactaccaccaccactacctcaatccgcgcgtccaagtactgctcgacactccatcagaatagaagagcgtgaaggagttggtggctcgtcgtcgtcacgcattaagcaagggaggggaaaggggaaggcgccggctccacctagcgacgacgatgacgacgaggacgaggaggatgaggactacgtcgcaccagacgccgaggagatagacatgtcacagcttcccgacgcgccctcaggggacgcaacccacgcaatacaacttgcg

SEQ ID NO: 69925 - DNA, 1099 bp, Oryza sativa
acgataaacagggggaactagatttatagaagtaattagtaacaggaaattgctaggatagttaaaaatatttgcatagattaaaaaggtagtccaaaggtttttccgtgcaattttaatgcaaaatgatggatagaaatcggtattctaggatacagttattttaggacatatagtttccacttttctgttattcacatgcggaaatatctatggtattattcatcatctttccccaaatttcccctgtatttctttagtcttctctgtgctccatttatctctaatcggttgattcgatgtgtgtcctcttccagaaggtacagcgtcgtcctctcaggaagatgtagcagcttgtggctgccgatggcagcaggctactgccagcagagtgaaagaccggatgctcctcctgagaggcgaccttgaagaagtcgcagcgtacctcgccgatctgtcggagctggagaacccccccttgacagcgaaacactggatgagagagtttcccaagcgatatccggcgcagcgctgggtggaggaggataaggctgacgacctcgactggggcctctttggcgacgccaatgaccgctgcggcgagctctgcgttttggtggtatcacataatatgtttacatatttataatacgttgttttttgaaataaataattcattattggttaatgaatatgtgtttcattcatgaaactctttatgttgtatgttgttatttctaaaggatccctgatgaaatatcatatgtggagcaaatatggtttagtgatcaacatatgtattgattgatgatcattgtcagggttacggataaggcataccctctattctaggagtcatgagatatatggttggacactgtatatcttcaagtatacgggaccttttggataagaaaattaatgtgttcttaaggaaataatctttgtgaatagaaggtgttagagttgaattcggaggagataacgataccgtacggggtccgttgtctccgagttctacttggagactaaggggatctgcggtatacagagatcccttcagggggtatagggcatcaaatcttagtgcataacaccg

SEQ ID NO: 69926 - DNA, 12351 bp, Oryza sativa
cccacctgtctcatcagaaaaaagggcgccgacaactccagctcctaggaaaacacctaaagcgaccgaaccctagctacccgcagggaatcagatgccgacaaggaaagtttcctacacatacagcaccttatgcttcatccataagacgtctaatcactcttttatgaactgcaaggtggtgctacaagtgaaggctgaactcgatgcatgtagagatcgagagatccagcgcacttccccgtttaagagttggtgtccaattcataaatcaaaaggacactctctttcaggctgcaaggtttttcttgatgctaccaaatctatgacccgacctccatgctgctagatccatcaacacgaaaaccaatctcaatgtgtgtcaaaggacgattgcacggaagaaccccttgatcgcttcgtgggggtcatcgacatcgacccccacgattcaacgaacccgccaccatagaagcaatccggaggacttgaagccaattcaccgatatatctcgtcgagactctctcgacaaggatctcgtcggtaatccggagttccgttgttctctattatactatgtgattttctctataatcccatataaactaattagggctattaccttacgaggggtctgaacctataatccttgtctttttgtgggcatgatgtcgtatcgtgtagatccttgtaccaatgtaccccaataccctcaaactacggttcgtgggtatcccccgtcgataatcatgtctcatgcataccaaattaataacatggacacatattggggaacatgttggatagacccaatatgagacactacaagagctatatgtgatatgtcatcagcgatctcatttagtgttggtgtagaatccttacacctgagattatcatggttcccaacatatgtagtagcttatttagggctgccaaacgctactatgtgagtgggtaattataaaagtaatctttggtatgctataaaacatgtagtgggatataaataatcaagatgggatttacccctcctatggagagatatctctggacccctcgatgttatagattatggaagtgcatggccatgcaaaaagtaattgaggagttaattacaagttaaataatctatcactagatcaagtaaatgattgagctattaaagaatggcacatatctagccttgagcttaatcgataacgtgagacaggaggattcatacaagtgtatactagagatgcaaccgatataaccttatgtatgtccggtgggtcaatttgttttgttaggagccgctcttttcgggttacaatcgagtgtacatgaacctacggggtcacacacttaataggccggaataaggggattggatggagatccaataggtgctcaattaggatgggatccgagtaggactcttatgggcctcggaggcccaattattgatcctatgtattcttcaggtgatgtgactggtgtcccgtgagaaaccctagccgccactcctctccaagccaaaccctagtcgcacgcgggtgctagcacgtccgcgtggcatttcgtctctggacgtgtgcataccggtagaggcaccgctggtttgcagtgctgatcggcctaggagcatggcgaggcaaatgcacgaggaggagaaagtcgggctgctgcgattgactactcctctacatcgacgcgcgctacatcgctaacattccttcggcttcttaacacctacctccgttccacaacacgtcgagtggtaatgattcatgatctcatacttgcattggttcctggtttatgcggtagaaaaattttgatttatgcaatcatagcttttacgcgtatcccaacactgcgagccgtcgtgccgcctcctaatagtgacagaggggataagaaagaagatgtttcacttacacctggatttcacgtgggttttttttcttcctatgccacatcagcgtcatgttattcaaaccaccttaaatactgccatacgactacatttgtaccggttttgaaaattgaaggatggttatatccagttttacgatttagggattttattcaagctcggtgataaattgaggaacatcatgtgaacttattcctacttaaaaaaaggaaagccgggctaaaaagctagggccgaaaatggaagctaggcttgatcgctcgcacaccctcacgcgtgactattcactgattagtgatttcggagtcttctgagtggagaagtgcttcgtaaacgcccaaccagatggtccgtaatgtgaaatcattgtcatgattaatatttgtgatgaacaattggctatgcaaatgatttaatcagtgaattggtttggaaagatgtgtggatgttggtgtgagtgcgtgtgactaatgtgggtcaggttgtgatatctgtgcccaggaatggttgttttgtctgattgtgtgcaggtgacttgaggtcaaccttggtcaatggtgaggatcgggactatgttcagagaggaacataggtccagtgcggtcgggataccatgtgagaaggtgactagagtcaggattcttggaggtcaacttcggtcaacggtggggaccgggactaaactcagggaggagttgaggtccagacggtcaaggataccgggtgacaaagttgaatacgagatggcacacagtggatggacaccgtgtgggagatatcttcgcaacgggcttcacgaggtgtgcgtgcaagcgtcagtgttcgcgaaggagatcggaagaaattggagaggagtatatatggtgctacagtgattcgggttacagtagcatgcatatatgtatgtttactggtgtgcagtaggcatgtgatcgatacatgcatgatgttgcatgcatgtgtgttggcgtcggtatggttggcttgctgctgccaggtaggtcaggagcagcagcaggacgtgcaggccggcaagagcaggcggctcggctcggccaggaagttggtccacaggagcgagaccgagtttgatttggtgaatttgctgtgtccggttgtggggctgcaggtttaggagattgtaatctggatagagtcctagtgtgtttaggagtggtactcctattttgagtagagggttttttgtgatataaatagagagggagcgtgaggctttccggtatcgcttttgagagcaattgagttgatagtttagttagggtttcgagtttagtcgagatttttgtaaggagtgctgttgttgcactttgtaaacacagagagaagcaataaagttgtcatctactttgagagttcttcaattcgtgtttcttcgggttccggcggcatgtgagcaatccgaccggcggcgacaggactacgtcgagatttccatcgatttgagggtaacttttatttccgctaaaagtttttgggtttttggttttccctaccattcaccccttctctggtaggcttggtttcttgtgttcaatcctaaacgtaatatatgggttacaacgtattcgattcggacatatatttttctggtccgtaatttgtttcgttttaccaaatggaccgtataatctgattagggaggggttagttgcgtcctagctagccagttccaagcccatacggccaacatgcatagctgtaaggaataagtgaccctcaaagcttatcgaaatctaatccgtgaccctaaaccataaaatcggatatcttgactctcaaactcttaaaaccggtgcaatttgacttccttgacggttttggagagcggttttgctgacgtggcgcttaagtggtggtattgacctggtctcctttacacgtgtcgttgatatggcgtttaggtggtatttagaattaaaaatatatataggacccatttatcattgacacagaaaagaaattatgggaccaggtatcccttctctctcccctccctccaattacttctccctcctctttctctctcccgcggcgggcagcgagggccagagcggcggcgggcggccgcccgtccatcggctccgtcttcaccaccgccgcgtgttcgtcttcgccgccggcgccgccttcgtgccgcgttcgcttccggccgatggagacgccgaagagcttctcgcgctcatcatttcctcttcgttgtttgatacgggcggcaccgccggggcaggaaggcatgaggtcgaggacggcagggagcgagagcggcgtggccgcctcggcggattcgccgaagcagttgttgttcccggcggtggaggaggagttggcggcgttgagcttctgcgtggaggtgtacttggacatgaggaggaggatgttgttgccatcatctggctgtgctcccgcgcgagctgcgcgttctctcgccgcagccgctcgttctcatcccccgctggacgcgacgccgccggagccggagccggagccggatggcgtctgcgacagcatgagcaggggctcgggggacgagctggacgatatgatctgctcctcaccggacagaacctgggaaccatcccgcgtcgtcactggcaacgccatcgggatcgtggccgcgaccgtgaccgcccccgtcgtcgtcgttgctggcgtcggtggcgtcaccttccatcggtgtatctcgcagagcagccgccgttcccctcgccggaagcgtcgttggcgaactcccacctgtccgggacaatattcccaaatccctgtataatccaatccattccggcgaggccgagacaaaaattagtggaggtgttcgaaatcgaacgggacaaagagaaaacaaaaacacggcggcgaggcgtacgtaggtgttgagctggcggacgaagctggagaagttattgcgcttgaagtacttgggggaggaggtcgcgggcgaactcggcggggcgccagacgacgaaggtggagccgtcgtcgttccatgagatgatgtcgtcgccggagaagaccccggcgttcgacgacaccagctcctcaccgccgccttcagaagaggaggagagcagaacaactcctcgcaaaggggacccggcccgcgcccgccctcccgccaccgtcgccagcccccgtcccacgctcgcggctcaccgaagggaatagaaagagagggggaggatgatttttgtgggccccacctgtcagcgggtcccacccatatttttggtgaataacaaatgggtcccacatatattttttatttccaatgccacgtggtaagaagatcgagtcaatactgctatgtaggcgtcacgttagcgaaaccgacatccaaaaccgccgagggagtcaaattgcaccgattttaagagttggggggtcgagatatccggttttgtggtttagggtcatagattagatttcgatcacttttgagggtcactaagtgaacttattcctagctgtaatgactaatgaataagtctatttttcttcccttatctcttgcccttatcgaatcacatcccttaaccacaaaattaggtataacatcttcctcaaccttcaaaaactggtgtaaatctactcctaaggcagtattgaacctggttttagcctacgtggcgtatggattaggattttatcctacttggcatctgtatggcgctcacggtaaaaaaagaggtgggatccatgtgggcccacctatcttccatcttcttcccccagccgccgccttctccatctctccctctcttcctcgtgctctccacatctctaggccagcagccgcgtgggagaggagctgtggctgcagcggtggctcctctttacagagtagcgcgagcggcgatgcctcgttgtgcggtggtagacgcatctggagtcactcccggccactcctaccctcgctcccctgcaagcttgccgaggtctgtctccccgcgactcgagctcgagatccttagctaacgttttcggccgtcactcctaccttcaccccagctcgctcaccaaggtctcccgacatctgcctccctgcaactcgagctcaagatccatagctcacatctgtggctaacgctcgggaaagaggagaagttgcagctgaagagatcgtggagggcgacgcgttcagtggtggccggggtttgaggaggtggatggtggggtcgggtaggagacggcgagctggaaggtggcgttgggggacctgcggcggtggaaggcatctgcggagtgtgcttcggtgtcagtggacgagctggagcggcggtccagtgtcgtggtgaggcaagtgtaggaggagctcgtcaggtggcttcgcgtaggaggaggagtttgtcggccgaccgcgatgcgtgcagtgcggagatcagcagttgatggcaacagcgtggtgaggcgccactcctcactcctccatggtggcagctatgttgggtgccgcacatgcctgacatcgcaggtcatggacagccagtggcggcgcacgacatagacaaccggcggtggcgcagaaagttatcatcaccgccggcggtatttgtgcaattggccttgggggaaagatggttgtggccatcgtcgtcatagcattgtgtgtctcaccgtcggcccgttcgagattgagaggggagggatgataagtgggcactacctttttcacttacatgtgggactcacttttatttttaattcctttgatgaccgggctgccacatcagcgtacttggaccaagtcaacgtgctacgtcagcaatgccacttcccaaaaccaccaaaggagttgatttgcaccggttttagaaattgggggaggtgttatacgtggttttgtcattgagagatgcgattcaatcgaggacaagagataaggaacacataatagacttatccctagctataaagaaaggtcatgagctcgcacgcgctggcaccggtgataacatatccttcttttgggcgtaatgtttttccttttaccactgtctgtttctttttttctttttgagaattatacaacgctcacagcacacgcacactcacccctatgaatgcatgtaaacaaaccctaccccctatgagcatcttcaaagaatgggccggcaaatcttgcagattgacgaagtcatcatagacacctcactgtcgacgggtacgtcacctaccactgaaagcaaaataacgctaaattctgcaaaagggtttgaacgagaatggttagacgtttatatatccgcgatgctataaccgcctgaagaaccagtaagccataattaattcttcagtgttactcattcatttgatatttctgtaccaacccgtaatcgaggtggaaaagacgtatagtttactagtcgcggtgtgcgcgcgcaccagctgctatgtcagccaatttttgttcatctcgtttcgcttatatacttataagctaaattttattttttaaaattgattttagttttctatagtttattttataatatttacttttgaatcgctaaatacatatctagatttacccataaattatttttagttgatattaaaccattcgaatatgtactatcgaaaaaaaaaccattcgaatatgtatgtgcataagccaaaagatggatctccgtttgtattgtctggcctagctgctgtgttggccccgcgcgcgccacatcgctatctgcctttgatttccataggcatggagctatgtaaaccgtatcccatgctccggtgcgataccaactgttgccaaaccctctaaagctctactttgtccagaccgatcagttctccgtttccctttggtgctttccaagcacatgccaatgtaaccaatgacccaatgaccagtgatgacagatcataagtgacaagatttatccatttattttcattatcccaaacaagtgattcactcagtgcgaggttttatttaccaccatatacaagtacaggaactaagatagttattactgtccctgtacgagaccaagctcatcatgggcagaagacgatctggtagtcggtgccggcggggcaggtgaaggtggtgccttggccgtcccgggcgtaggtgaccgtctccgggcacagcttcttgaagaactccgtgtccttggtcggcccgcacgtgctgttccccctgcacgggttgctgcacccggccttggcgcgcagctcgccggggcactgcagcgtgatctccgccgcgcaccgaggcccgccgcgggggcaccgtcgcccgcccgccgccgccggcacgatggccattggcgcgttgaacccatccacgagcgagatgtcgaagtagtcgtccttgctcgcctggcccagcgagaactcggccaccgtgacgggcggcgcgccgacggccgcgcaccgcagcgtgccgccgcagtcgcccgtctggcactgccctaggctgccgccggagatgaagccgcagcccgtgcgcccccacacgcgcgcgcccttggtgcccgccggcacgtacacggcccagctctgccccgggtcgagctgattgccgtcgcccgacggcagcgccgccggccacacggtgtacccgcacttgttgacgatggtgaacgtcaccgcatcggcggcggcggcgagcaccacgacgaggaggaggaggtggacagaagagttggcgagggacgccattattggtgacgtgttagtgtttctgttgctcaaattgagctgagcaagaatgcaagctaggggtgtggatttttatagcggtccggctaatggataatgtggaataatggaattcaacttttgcagctttgcgtgtgcgaatttcgttacgaaatcccaagagagtttggtggggaaaccagctgatggtttgataggagtccagctggttgtattaatttggcagaatcgtctagaaatggatgtgaatgatttggtcaaatatcgtgccaagattttgcgtgataatataaagttgtactatcttaatttatatctgaattgtcaattgatcttgacttggatgatacaaaatccaaaaatatggtagggacaaattttactctatatattatccatcgctattatcctgaagatataaaatacagagctctgccaagaacaaagaccgttcaacccaggataagaaaggagctaggtcgatgaatcgtcgatcacattctgggttcaaaaatcctcgatcacagttcacaagcacggttcataaggtttggaacgaatagagaacgtgtcatccacgcatacaaaaaacgttgttcagttctcacttgtacatcgtagtgatgctaaagtgctaaactacccgtcaaacccccctggaaaaaataatagaatttgaacggattcgttcatgcctgtgtaattaaccaaactacaagtgaaaaaccacttcagttttgaatggtttactttattacagagtaacttttctcttcatgattctgatacaaactcgcataaaaagtatgcatgcttgtttattgtgtatacatctaaccaagatcacatcgatcagatgccagctaacaagtcatcgtccctcatgggcagaagacgacctggtagttggtgccggccgggcaagtgaaggtgctcgtctggtcgtccttggggtagctgtaggcgtccgggcagagccccttgaagaactgcgagtagttggtcgggccgcagttgttcgccgccgagccggtgcagcagtactggtcctgcttgaacaccgtgcacgcgttgttgcacccgccgggcgccctcagctcgctcgggcactgccccgccacgtccgcctcgcaccgcggcccgcccttggcgcacccggcgccgtcgccggcggggaggaagtccatgggcacgttgaatccgtcgatgagggagatgtcgaagaagtcgaggttgctgaactggttcagcgcgaactccgccagcgtgttgggcggctgcccgtacgccgcgcaccgcagcacgccgccgcagtcgcccgtctggcaccgcccgttgccgctgccgtcgaagctgcagcccgtgcgcgcccacacgcgcccgcccgtcgtgccggccggcacgtcgatcacccactgctgccccgggtccagctgctgcccgccgccggacggcacggctgccgcccacacggtgatctggcacttgttggtgatggtgaacgtggcggcgttcgcggcggcggcgaggaggagaagagggaggaggcggaggatggcgggagctgccattgtgttagcctgtagtggagtgcgtggttgtggtgactgatcgatcgatgcagatatttatagtctggataacgtggaattccggtgcttccatgcgcaaatttctcacagaaattccacaagtttggcgcggaaactagggatgttctggcggtcggtctcggcttaatggtctgattactgagaaaatagaaacgtacaaatggcacatataatggggccgacgggtttatgccctctataaaacgggggaaacttttacggaattgctagaaaacttatgtaagtttttttagtccaaaaactttcaaatttgtgattattggatcaccttaagatttgtgcatgaaaaaaaattgctagaaaaaacttttacacatgtcacacgtaaagattccagtgctaaccaaccaaaccataattgaatataagttttatataagttatatcataggtacagtatagttacaattagaagcatctattatatactaaaagtccattaaactttctataaacgctctcaaaccgtcaagtggcaccctaataaataagagaaatttaaccatttatttttatttaaattggtggacctattgttttggatggttagatctattcggtaaaagcaaaaatcacatccgaaaccaacgacgtacaaaccaaaaaaataaaatcaatagaggcgtcatatatactaacgaataaaagtacgtactatatgaacgtaggtactgtacgtacttcccttcttttccttcctatgttactttctatttcatgagaaattaaaattaaaattatttttacatgcaaaaaaatcacaaatagatcaattgctatgtctagcagctctccctccgtcacagatttaaacatcctacgaactatcctaagtcgctacgtggtgcaaataaattagagaaagtactaaaaattcttaaaaatacataacaaccaaccatcgatttctacttaaattgatgattacatttaggtggttaatttttaataaaaaaatcccaaatctctctccctccctccctacccccgtgtggtgttaaagtccattaaatattttttaaacgcctctatgacagtcttaaattaaagaaaatcttaaaaaatttagaaaaataactattatatattaaaagtccattaaacatcgtacagatactccgatcctaagtcgctaagtgacaccttacaaatgcttctatgtcgccaagtcatactctaatccgatcatcgattttcatttaaatcggtgtatcttttattttattttagaaggttagctttttataaaaaaacacgcacacatccagaacttccccatcacgtacgtatgaacaagctatcttcatgagaaattaaaatcaaaattatttttacattaaaaataccacaaaatagatcttcctctgctaggtctaaccgctctcgctctgtcacactaaagatcctatgatcgcttctaaaatgctacgaggtgctattaaattagagaaaatacgagaaaatctttaaaaagaaacaaagcatctagctatcgatttgtcaggtttttgtaataagaaaaacccaaacttctctatgtccctccccacacccgtgcaacgttaaaatccattaaatatcttataaacgcttctaagctgctatatgaaaatcttaaattagagaaaaatcttagaaatttcgggggaaaaaaatccaaccatcgaatttgacataaatcgatggacacataattttcaatcgattaacatattattttaggtcattagatctataacttttttaaagaacaccccaaacctctttctctccctccttctttgcggcatacggtattaaaagtccattacacatcttataaatactccaaagatattatatcgttctcttaaatcgaagaaaatacactcttgagatattacgttgttatcttaaatcagagaaaatcctaaaaattttgacaagaaaacaaaacattcaactaagttgttagattaatcatttagaaaaaaagtcccaaacctccctccctcctgcccatttaccgcgtgccccattcttttctctctattttttttatctcctaatcaacggaagttaaaattatctatatgggcaaaaaaaaaaaaggaccgggggatcca

SEQ ID NO: 69927 - DNA, 656 bp, Oryza sativa
ttgctcatctatatctgaattttctttttaattgtgaattcatttgtgttcaggaaactagaaaagaacatgagaagattatgccagtggtgatggtgccactggaatggcatcctcgacatgtccttcgtcaacgttcgtcgccggcagccaacacaaagggtcagcccaggacgaccacaccacaattgatgacaggcttcggtggcaggcgatgcgatgccctctggattgtgctttttttttgggtaccgggtgtatatgtgtttgtaacgatgatggcacgatcaattgtaaaaacaaagtccattatacccgtattcgtgcagtaaaatatttactaccttatatatcaggcccaatcaactactaagtaacttttttactccctccatgattggataatcccaatacatatcaataattttttttattccatgaatatgttgcttcttatctattagtaaatcatttactcatgggcgagtctctattagtaacgcatgtactcattgccaatatgagatgtggctagcaaacgatattcttatctgttagtaactcattgtgggccaagtctctgttagtaatgcatttactcatgggccaataagggaagtgccaaacaaatgttactcttatctgttagtaactca

SEQ ID NO: 69928 - DNA, 1134 bp, Oryza sativa
gtttaccaagagaataagggattcggccagtaaaccctagagttatatgataggtagtagccactgcagttcagttgcattgcccaatgaatcagggatatgacctcccaacatgttaccacccaagtaaagttgctgaaggttaggaatgaagttgccaaggtcagatggcaatggaccatgcagcatattaagtggtagtgctatttcttggatgtgtgacagattgaagagcacctccgggatcctgcctgacagccgatttccacctagcaacaagtaggacatgttggacagcttcccaagctcctcaggaatggatccctcgagcatgttgccttgaagaatgacagtattgagcgaagtgatgttccctatttctggtgggatgatcccagtgaggttgttggagtgaagccgcatatttcgcaggttggagaggagggctatgttgggagtgatatcaccaactagatggttccttgaaacgtccaacgtcctcaatctggtgcagtttatgagtgcctccggaataataccctgcaacgagttgccactcaggtcaagaaacaccagcttccgcaggttgccaagctgaggtggcactcggccggagagcaagttgtcggggaggctcagagaagtgaggtacgacatgtttccaagggaatgggagatctgcccggtcaatgtttgcccaacgaggtccagtgccacgacgcgatgcgcccgctggtcgcatgtgacgcccttccaccggcacaagtgtgtgttggtgttccacgagctcatggctccgaaaggatcgttcgtgatcgctcgcttgaaatctaggagcgaggccaagtccgtgccattgacgtccccatcttgcgttgatgcgccgcccttgatgcctccagctccatatgacagtaataacaacaccaaggtgcacggtataaacatacccagttccatgtgctgcttgcttgtacccttatgagggatctttgctagctgaaagaactaagggcctgttcactttgctgccaaaaaaaaccttaccaaattttggcattgccaaaattttggcaactatgccaaaattttggtaacttgccaaaattttggcaggatttcttatatagttac

SEQ ID NO: 69929 - DNA, 1001 bp, Oryza sativa
ataaagctccattgatatgaaccatgcaatgtaatgattagtttttggctgttgcagcttggccaggtttgaggagctttgtgagcaggattgaaatttgagtagcatgttgttacatgctactcgtggaatgaccttctggtaatcagtttatcctttgctctggtctttatgttgtatggtccgattcatgcaacaaacaaatgttgaattaatcttctgttctccacaaggctcatccgccgtttggcatccttgtcagggtggccgctgcaaaatggaggtgcaatcagcttgattatcttctcttgatttactagtatacctttagccctacttttctgggcctaatttcatgttgcttatgagttacatgaaccattagcagtgaaatactcattctcctgtctcgccttaaaactgattgatcattttcatacgtgaacactagcctgccccttgaaacgaatgaaattatcctgtacatgttactttctaactgaactctcctgctacatcaatacatataaggcatttcttgcctaagttttcaaaacaagaaaaagaaaagaaaagaaaatgaatgaacgaatgaatgttacttcactagctagtagcctagtacgaagtactatttatttaactagcgtgcatatactagttactttgatagattgctacaattcgatagagaaaatgtgaaacttcttaattgatttgagagagaaacaataattttgtagtgttctatgtagtgcagcttggtgagcctaacgtattggactggaccagcgctagagctgctacataaatgtcatttcatattggccaagttttatagtcgtatctggctaactaacccgtacgttggtttcgccgtggtgtgcggctaactgttcctactatatgcgccgtgacaagtgactcaaatatgtttcttttattccatttgcaggcccggattgacttggtcagtcaggtacttcgtgcgatagacaatg

SEQ ID NO: 69930 - DNA, 1214 bp, Oryza sativa
ctattactgcacctgcatgtccattcaaaactctattagtgaaagctttgtatctacaataattcattccaacacaacacatacgctcgttccgcgcatgcgcaagcgcaaccaccgctacccaaccgcctccatagcctccttctgagtgctggccgaggcgcaacacaaaggggcacgttttttctgagtctcttcttcttcttcttcttcttctcccacacccacgccaagaaaagccaggaaccacaccatgcacaaaacccacgacgaacacaccccaccgcctccgccaactcaagctctccgatcgatcgatcttccaaccatatatataacccagccgccgcccgcttcctcgatcgatcccagcgctcggagcaaaaaaaagaacggaattgcttagatcaagagcgagctgaacagagccgcgtttgcttgcttgctttggaaggaaatcatatcgatcgatcaggagatgtcgtcgcggtacgtggagatgctggacatgggggtgcgcatcgcggcgaggttccactcccactgcccgcacacggcgcgcatgtactacaagccgccgcagaccacggcggatcacggcggcgctgcagcaggcaagcaggtggcggccggcttcaggttcgaggcggtgacgtcgtcgtccgccggcgccatggcggtggcggcggcggcggcatgggaggaccgcggcttcggcgccaccgcgccgtcggggttcgacttcgagtttgacaccgcgcaggccgtcgtcgtctacgaccacgtcgccgtcgtgtgaggaggagtttcgatcgatcgtatatatagtagctttggccggagaggatttgattttctcccggaaacaattttgacacaaagggattgaatttgattatgtgaatgtaatgtacctatgtacactccgttttattgttatttttgagatttgatagctgaaattaatggaagaaacattggttgatgcttctccgattttgacgtatacaactactgtctcatacttaccagcatatttgcgttggcatctacgattgtatagaaatgacgtggattttgataaatctcaaaaaaaaaatcttatatgaagatactccctctgttcgggaaagccagtcgttttaaggttggccggataaattaaccggaagtaaaatttaccatattgctcctatttagtggttgcatttgtc

SEQ ID NO: 69931 - DNA, 1564 bp, Oryza sativa
tagctagtttccttgctcgacctaatttatgtcttgatggggttacatttagttccttttgaactaccttagagaaactcttgagtgtcatcctatcattatccctaaagctttcaacatatctatttgcaagatacctagcagttacataattcaactcccactccttctgacatttgtggccatctatatatctttttaccataagacaattcgtcctgctgtcctcagctacatccaacatccatgagcactcttctttacatttagcctcaatttttttcttggtatttcttgtaaatttaattgcgactctattcttcacactgtattgttttattgcttgcctaacttcaatagcatcagagaacaacatcccaaccttaaagattggtgactccatgtccacagcagccacaaagttcttaaatttcaacttaatgccttcattatcttcatcagatgactctggaagcaacaagccttcatcatcagagtcatgttcaggaagcttaacaaccatcttgctgctagccacttcttctatctcaacacagttgtcaaaaacatcatcatcccccttgttagcctcataatcactgtcaacaaagtcaggatctacatcgatgtcatcgtcatcgtcaatgtcatgaccttctataggtataacacctgaatctttttgattcattgtaaacctctcacggctagccacgataggtatagaagcaggggtagaaagagcaacatcatcccaattgatggattcaagaatgtcttgggtgatccacatacaaaagcaatgtcctaaacctgggggctaatacaaccatgctgttagtgcttgcatcaaagttaattctccttagcccatcactgaatgtcttcccaggcaataaccaataaaccttggccttctcagacatatcatatcctagttgctcaataaaatcatcaagccataatgaagaccatgtgtcactgtcacaataatcaaaccaatccaccttttcattcaaataaattttgctactaccaactccagagaaaaaaccaccatgatgtagttcagttgtgaactgttcatcctcgcagcctatattacaagacaaaccattctgatgtgtcaaatcgtaaataattatctgatctattatacacaaaaagattatacagagtacatattcatgcttagagcaaaaattatttctaatcacaaactattcgtgaaggattacttatatgacacctagccttataaaacaccaaagcagtggcggaggcagcgccgggccaccataggcaattgcccaggctccatgcatacaacaacactgccccaatgcatatacaacatattactcattaatcatatacttaatcactttgtctcataggttataatggagattaattagatgaataaatagaaacgaggaagcaaggaccaaaccatcaaactgtagctacagagaccaaactatacaatcacaagattcaagaaaaaacagagaaacatgcaattaccggtacaaatcaatgacccctaactttatcaacaaca

SEQ ID NO: 69932 - DNA, 553 bp, Oryza sativa
ttgttttgctactaatgagtcaagttggtgatagcttggtctcggaatatggtttttttgtttgtttcatgtgtaggtgactcgatgcctcgagagagtatttgcactgatggaccgggagtcggcttggtggtaagacaatgtccgtggtggtcagatatcatgcgggatactaaggctagagttgatgcacgtggttgatggagattccatatggcatacgatggaggtattgtgtgcgtatgggatacggagtcgaatttggaaggagtccaaatttggtatgattggttatgtagagtttgtttcttgtactaagaggtttcctatggggattaggactcttagtatgagtttggttcgtggctttaggttgcttacctcatgtataaatagagggggagcgtgaggcttcccggtatctttttggtatcgcttttcatagcgttgtgttttagggtttcgagtttagtcgagatttttgtaaggagtgctggtgttgcacgttgtaaacatagagagaagtaataaagttgtcatctacttttgagag

SEQ ID NO: 69933 - DNA, 3370 bp, Oryza sativa
tataagaaaggagagatgtgggcctatatttattttctcactcacatgttgatcccccatattttttttctcactcacatgttgatccccttttttttctaattatgatgctacgccaatgaaattagagatctacgctgctatgggatctaaattacacggttttgtatggtttaagggtcaagatttctagtattggggattagggatgtcatacaaactcaatgtaaagttgagggatgaacggagaacttattcctcgtacaaacacagtaccagtacgggcaaagggccgaccgagcgcacattctcctcgtactacatggccgatttagatgcaacatccgtggaccggaaaacagaaggcgcctttgcccgtgctggctggcccgtttgcccgcgtgcccaaagccccaaagccccaaagcctggcctgccgggcgctcgtacgttatcagacatccgcgcgcgtgatagaccaaaatccaaccaaacgggccggccacacgcatgacgcatatgcctaggcacacaccacgcaccagtgtatcatgacgccccatcataacaacagccgatcctgcagctcgatcggctacaccatccatcatccatgcagcctgcctgcagttagctgcaggaattccctcgatcacctcccacccggtcgatcgatcgatccggtccctggacggagggggggacacgccatcatacgcctcttacgtaggtacacgcatggcatgtcccatcaatcgatccccacacacccctcctcctcggcctcctttccccgatccatgatgcgcaccgtttctcacgctctctctcccttcgcgcgcgcgttcgatcgatcgatcgatcgatcggcatgcatacgcccatgcgtggtgcacggccggtgcactcgctccgtgcctccgcgcgcggcacgcgcattgcgaaactactcgtaacacacgagatctcgatcgccatcataagtgcacctttttacgtggaactacgcgctcgctgctgcctgtgcatatgctgctgcctgtgaatgcctgatcgatcgactagagctcgtcaatcatgccccgcccggtctccccacgaatcaaccgtttgatgtgatcaccccgtccatccggcacagccgcagcacaagtgggaaaaggagggagctcttccgcgtgcagcttatcgatcgctagcggtaacttttatgcgtgatacagtacgcctttggagtaactgagtagtgacactagtactactgcctttgcgggtctctctccggtcgccgtcatctctggtccagccattgccacctgcgagacctgccctgatgccctgatgggcgcgcatagctgacctgacctccgttctctagcaccctagggccagggctgcgacatgcgtatatatgcatatggcggactcgaactcggttggcacgatgcgtaagtataagctggtatggtagtactgtgctgtactgcccgatggtgccgtgcatggaaaactatactacctagaaaacgacccgagagaccgtgagcgtacggtgccctgccatgcatggtttgaccttgggacaaagcagcagtgaacaatcaaacaaacagagaggtcactgcttgcgcatgcatatcagcagataaatattctcatcacctgcatgcctactgacggccgccggcgccagcgatgtgttctgaccatatcacccgtcaaaacatacgtactaccttaaccataggagtatctctcttacatgtgggggagtgaattttaaactcgagagagacatcccctcattatttacatatcatttaaatagttaaaaaatcaataatacagattaatatatgataaatcacttcacaaagatataagttaaaatttaacttttacaagttgcaacaaaaaataaattgaactatggttagttaatgtatatccgcagttaaatttgcttttttcgttgcggcacgtagaaattgaatttaagttgcatatttgtagagtaatttatcacatattaatctatcttgttgattttttttaaaaaatatataattatttagatgacacgtaaataataaggtatgtaccctctagagtttaaaatagctttttcttacatgtgtcttgtagtgtagtgtagagtgtagtggttgtactatgtcgatctgctcggtgtttgctatccaggtcggtccatccaattgaggccggagaggggccggtggggttaaacctggctggctgcctctgctgggtcttctcttctgtgaaaattttgaacggtagctgttgggttttaccttctgcagctgtctagacacagtgaaaaaaccacgcgaactgcttatggctgctggctgggtggcccagaccttggtgagaaccgagggaatatgtggaatggaatggaaacaacccgttagggagggaacaaaagttacacagctagcaggagtagtactacgactactacaggcccgttagtgggcgattatagatgtcatctcaggttgccacaaggacacaaggtaaaaaaaaattactaatgagtagtgaaagtgtcttgctttctctagactagatagtatataggaaactcaaatcatcccttaaaaggatatctccttatcgttgcatgtgacttgaaaagtcataaaaaaaattaaaaattttcgtaggatagattaatatgtgatatgttattttacaaacgtgcaaattcaaattcaacttatacaactagaaacaaaaataataaatttgactatgaataaaacgtgtaattcacagtcaaatttgttatttttgtttcgaattgtataagtcaaattttaactcgcatgtttgcgaaaaatatatcatatattgatctatctcgacaaatttttttataactttttaaatgctatgtataaaacgaggggatgtctcctctatggacaaaaatccacttccgtagtatatatatgtagtagccatatgcatcatcacattacgttatcagatagtagattaattacgagtagagtggtagtgttacaagcatgcgtgataattaactcccggccgtcccaaagattgtaccggggactttcccaacattaacatgtttcttgttaatttagcattgctggtatagctacggtgcagtactggtgcatagacgataaatcgagatgcttggtttgtaaatatgcttggttttcactattcgaagattgctcctttctccatctagctcacctatatatattcctggttttattgagaaaagtaaatttcacaaaactacatgttttatagtttaagttgcataaaaccacacacactttgatacttggcacttaagtacata

SEQ ID NO: 69934 - DNA, 11095 bp, Oryza sativa
aatatatgtacttaagtgccaagtgtcaaaatgtatgtagttttctgcaacttgaatcataaaacatgtagttttgtgaaatttactctattgagaaataataatgagaatattccgtggccttaatttgtgataagaatacatgatcacccagctagatagcacaagatatatatgatgcgcaccacacagtcatgcatgtacggaatatatgcatggttcccatcatccagcaaactagcatgcaactagtttgctagcagtctactgcattcagcatgcatgtatggtccttgttaacccttacattgttttctgctagatcagaaataaaggcagatttaaagggtatatatacatccactgcgctgtgcatggatatgttcaagatgcatacctacacaatctatggctatatatatacttactccgtttcaaaatatttgacgccattgatttttttaaatatatttgaccgttagtcttattcaaaaaatttaagtaattattaattcttttcatatcatttgattcattgttaaatatatttttatgtagacatataattttacatatttcacaaaatttttttaataagacgaacggttaaacatgtgctaaaaagtcaacggtgtcaaatatttcgaaacgaagggggtatatcgacactggtcatatataggttttctacttgcaaaagcgttcgtgatatacaagttacttggtagtggatatttgcttatgtgacagtaacacagatattatccatacatctcctatgacttattctatggcccctaacgaatcccgtacagaactttaactcttgtgttgattcgattcgattcgatcgatcacaaagtcatcgaggaaaaaaaaagtgacttactccctccgttccctccgtcccataatataagtgattttgagtttttgattgcaatgtttgatcactcgtcttattcaaattcttttttcaaatataaaaaacgaaaagttgtgcttaaaatactatagataataaagtaaatcacaaataaaataaataataattttaaaaaaaatttaataagacgagtgatcaaacgttgtaaggaaaaactcaaaatatcttatattataggacggagggagtatattagctagctagagacatcgcaagtggacaagaactaacgtgtactcctgtcttggtcagcttggccagatattcttccgtttttcacagtggtgatatgatcatctggccatataatccacactgcaactctgcaaggcctttcaccaagttagtgatggtgatcactgatcagtgatccactttactcgcgctaatcagctcaacagtttggtaacctaaaacatccacatctcttgaatcatccaccacgcgcgcgcatcatatcatacagtagtacgtacagtctccatgacacgcacacgccgagctccaagaccaaaatccagaccgattggcgctgtcgatcgacgaacggacggcccagatcccagtcgagatcatgtcccggcacacacctctcactggacccggtctcagcgacaagacacctccaaaatcattgccgccctgtggccatggagtgcttagagagggtggaatcatcatgtgcttattgaaaaaaaaactatagaattaagctgaggttgacaccggagtcaagatcgagtgtggtacgtgcgtgcgggccggcagaacagcggatcagctgggcgatcaacacacagctgactgatgaggcgacaatcacatggtgtggaattaatgggattaatgaatggtgatgactgatgagatgatctatctatctcgttcgagttgggatacagcgttgtgcgcagatcgatcggccgatggaccggccggttccctgtccaacaatcatgtggaggtgtggtaagcagagcatgcatgcagggtggaatgtctgtgtgatgcctgagctgtttagactatgtaaattattacaatgaattatcgatttgattatcaagatactttaaagatttaaataaatatacttaacttatagctttaaacaagtgggttaaagtagaagaatcttttttaaaaaaaggtatttccaaacgtggagtaaataatgtgttctaataattggatggataatctgagaaagaaaatgaccttagactatttatctggcaggggcaagatcatctacgtatggagatagcacatatcaatcaccttaactgcaagatactgatctttactggatcatacaaaattcacattagtcccggttcaaaaacccgacggcacttttaaaccgggacaaaagatatttttgagtcccagttaaaaaaatagcaggtggtgtcagacccctccactatctttagtctcggttgtttaacaaccgggaccaaaataaaaaaaacaatctggactaaaattaaaatttttttgcaaagttgtgccgagccgccttgtcctccccacaagttacagtccttatctccatctcctcctcccttcctctccctcattcctctcccccgatctcctcctcccctctcctcctccggccccctcccctctcctccccctcccctctgcgaagccgacgacggtgacggcgggcggcggcgccctctcctctgccggatccggcaggaggggagacagcgggggcggcaatgacatcccctttcctccccctcctcccggccccttcccctatgcgaaactggcaacggcgaccgcaggcgacagcgatgattcttagattttttgtttaagtcgatttgttgtggatgaatttgttgttgatgatttttttaatgaatttatgatgattttgttgtggatgatttgagtatgatatgtgaatttgtggatgaatttgctaacagtagtatattggatgatttgtgaatttgtggagcaacttgacgtggggaatgcaaacatcaaaaaacaatgaaaaaaaagaaaaccatgactaaagatgtagcagcgtcatgtggcgccatctttaatcctagattcgaggtttcggtttgcaacccgaaactaaagggattgtaaatcaggactaaaagatgctttctccagcactgtttgttggcggactgagaggtgaaaaaggagatgtttcaaatgttcctctgtctgtggcggtcgtacatcgcctgcggggtgagggtcatcaggtcaggctcatctcgttgtcgagttaatcttgtagttttctctcttttcccttttccttgtgcaactcgaagtggtggtcagtgtacatcatcttcgtcttggtggcgaccggccatcaccggagcagctagaggtttctctggcttccatcgagcggctgaagctaagcttagtgattctaagtggttattcatcgtaaaatttagtgattctaagtggttatttacgtgtaaactactaaactgtcaagcatagaaatatgtatatgataagcttccttcagacatgataaatggattatgttggattaatccaagaaaagcatgtactgcattactacatcatacctgctttaggatttctcctttttaacgaattaaagtgccgaggtcttcaagtacgtaatcactattttgtgcccgtattgctattggaatactggatcaccatatatatgcaagccacgtatgagacgtcaattctgatcagagctttcactttaccaagttcgtcaatgcatattattttgtattagtactagctttcagagtatatcaagtggagtctacaaaagcatgcgaccgattaaatgtggagctaaggcaaataggatgccgacctggctccttttacgcttttaatcattagattacgagaagtttatgtaaagcgttaagcgattttgcgccgctctgcttcccaacttcccctgctttacccagcaaattaatatactccccctgctttagccagcaaaatatgagtacacgacggcttttgcaagcaagattacgtgctaattgcatgtagtgtaagctcagatcaatgtggtggttaatccttaatccatttccaagttgaggtcagccgacacatgactgtgtgtttagttcacgtcaaaattaaaggtttggttaaaatttaaacgatgtgatggaaaagttgaaaatttatgtatataagaaagttttgatgcgatagaaaagttgaaagtttgaagaaattttaaaactaaacacggcctgatgtggatgtctcgttcagacaatctaatcttgtttttgatagcactctggcagcacagagctttcatttacttgccctggccctacagttgcttatattgttcgcaacatgccacatcgacttgcacacgctttgacacttgtcaccattggtaactcaataactattttactctacaacctcagggtctgttcactttgatgctattttcaaccatactattttttaataaagttgtaaaaagaatctacatttagtttgttaccaaatttggttaatgcataaaaaaaattctgccaaaattttagcaatattgctatgttgctaaaattttagtattgccaaaacttgataaggtttattttggctataatctgattagacccgaatgtctcagcagccatgactacagctctcatggaattgcaaggaccagatagtagcagcagcatgtacatgttctgaaacagtttgcttgtgaacaaaatgaaacagttctgaaacttcccctgcgccagaaacagaaagcaagtggtagacataacgagtcactcaggcacagtttgaccatagagggacgacacatctgaccattttccatccatgacacacacctgaaccacttactgtcaccagcgagtagtggcacgaacacaaaaagacctatcccaacagtgcatctccacaatattgctcgaccgatcgatcattccgtggacttcaacggaatggaggaccggatcgagtcagttgatgcgcggatcaaatcaaagcgcaacgcaaggaggcgcaccgaggattaattgaatcgatcacaattcacatgtacgtgcgttcttttgatggtccaagatgttccttaaccgtgtaacactggtatgcccccaaaaagcgctcgagccattaaggtacagccagcccagctcctgggggccccctctctcatagttagtggaagcttcactaagtacgcgacacatttatatatgtagatggagcatataagtgcgtacatatgtgtgccttgatcgatctgttgttatatactattaggagtattggcgttgttgtagcccccagctgttagctcgaggtgaccagtctatctgtcgttgtttatcgatccagcccggggtgcccgggctccattatggattgttcattgttgttgcggttgcatatacagatgcagtgcagggccctggcacgcggtccccttgcccggtgttgagctgctgctttagccgcgcgctagctcatctcgatcatatctaggagtatcatgcaaaggccttcgcgtcgcgcggttgattgggtcgggtcgcgtcccccacgcaacgcatctaagctaagccaagctcgctggccggccaccaaaaggagggcatcatttgtttggctcgtgccaaagctgcccgcccctggcccggccggccgcgcccgggtcatgatgagaaaattgcaatagtaggactgtaaatatgagggtttcactgttttgacattctgagtggatgacaaataggtccatctgtgtagaaatatggatccagtgttattataacaaatgttaatgtttgcagtgttataattgcaaatccccacatgcggccagcgcgatcgatcgattcgcccgtttattctagtagccgcgcgcgccgacgccgacacgctcgtttcgcgaggacgacgaggagggcagcatgtaccagtgccacggcgcgccgccggccgcacgccgccattgaccagcacgtacgcccgcgacggacgacgtgggcgcgttcgcgattcgcggagaggtgcccggccgcccgttttcgcgggagaaaagggggggctagcatgcgccactacttgtgccggtgtttgtaccgcgttttaattagcgaaggaccatgcttttaatttgccgtgcaacggattaatttagtcgaccaaccgaacgcccatatgcacaccaggaccgttcgatcgcgtgcgtgtatactggatgcgatcctgagcactgttccattggcacggtatagtgcacggtccagtccgatccgatccaggccagggcagagggatcgggctgtactccagcagctaaacacgggcactgtggcagtagggtttggcaggggcagagctgactcgtaaggctggggcagcgatgttacggctctcgacccccaccttttcatcctgtcgccgaaaccctcggcacggcggccagctgcgcggtggccggccggccggccctccggccagcgcgttgtgtttatgtgtgcgctctcgagcgtagcttcgcctacggctttagcccacagctttgtattctaggatgtcgatgcatctcgaacatgttgtctgaatctctgatgaacagatgcagcactaacatcgcctacctgatcgatttcagtagcctagctagtattgccgaaagatcgattcttgcgattcccaaaaacgcatacacctctatctttctgctactactagtagctctaatctccaggaaagcacggattttttttttacaggtttatattacttcctatgcatccaacgaacttcgatgggattggatttggaaggctaatgtttgggaaagtaaatcattcaggcgccacaaagtgaggatctttcgattcttttcaataacatttggatacatttatttatatatgggtgtggcgaggcctatgacaacgaaagcaacaactggagtcggcactatggtggtacttgtgcagttgtgcgcccatgcatatgattcactactactccattcatcatttctcgaaaaaagctaaactgcgtattgattttttttcccaaaagggagagggagacccaccagagaaaaaagattcagattatattactcaaagccaaaaaaaaactacctccatttaatttttttaatgttggttagcttaaaattaagagcaaagtgtacggacggtgcttaaacttgtaggggtgtgtcatctaggtccttaaactcttaagatgcatatccaagtcccagaacttgtcatagtgtgttatttaggtcccaaatcgccacaacctcttcaagatcctacatggtattgatgtggcatgccacgtggacatgacgtggcattaatttgactgacaaatggaacccatttattttttttcctttttctttttttcttctctttctccccgtgattcttctttctctgtgacccaagcagaagaaaggaaaaaaacaagaatgagaagaaaacgaaaaagaaaaggaaaaataaaagaagaaaaaaaaaagaaaaggacacgtcacgtccatgtggcatgccacatcatcgccacgtaggatcctaaagtggatgtgtcgatttgggacctagatgatacacttcgataagttctgggacccggatatgcaatttgagagtttagggacctatatgacacaaccttacaggattaaggaccgccaatgcactttactctaaaattaaagggtaatttggaaccatgccattataattttgtaaagtttgagatatgtcattggtaaccaatgtcaaatacttggaaaataaggtatttgactggattgaattatatgtccatgttttgagacggcatttcttgcttttatcgagccatggatgcttggattctgaatttgttgagatccagctgaggctgtgtttagttccacgtaaaaattaaaagtttaaagaaattggaacgatatgacggaaaagttaaaagtttgtgtgtgttgaaaagtttgatgtgatagaaaagttaaaagtttgaaaaaaaatgttggaatctaaacaggacctgacagtggtaacagagaagaaatgccccaaaaggaaaggttcaaaaattactgatgaaaacgaatgcgcaacagaaagcttagcacacatgctcgacgatattgcgcaggcgctactattactgggagcataatcaacaaaataattggcattgattagacataaatacgcatgcataattatttcatatatatgctcgtggtagtcgttccatccactcgtgcaattgcgatgtggacgtaaggtggatatattatcaatcaagattttaatttgctatcgctgtatgataccagatggcatgcagatggggctacataaacacacggccggatttgcagacgtggtgaacatgccaccatctgtatgtatacattacaccatgaagaaaaggtcatattatacatggaccatctaagaataatgagtttcaaaaaacaatatagaaaatcaagaaaacaaaatgtctattcctcatgtgccagggaatctggtattaattaggccacaattatgaatgatctctaggggcttgatgaagtggccgtgtgatgcaccacaaatttcgtgaagggaagggaacagagtgagctgcacagatggtaagtaaacaacgtgatgtggcgtacatgtacgcaggggacagctgcgatggcatgggtctccgagctacctacacgagtagtaacacggtacagatacaaacacgcacgcacgcacagctgcacaggcacactgcacagtatggttgatactacgcgcggtgtgcggtgtatattgccttgcctggtcgatctcttgggttggttgtcgcagcagaggagatgtcgatgaagaagaggaagatatgctatgattcggcagcatgcagcgtgcgtacgtataggtacaggacgtactgggtgtgtcaacggcagcggggcagcggggcaggagggattgggcagcagattggtgactgatgataaataacgcggcggcagggtggagtggcgagccctgcgcgctgccgcacggcgcgggcacagggacaaaagcgcgtacagtggcgcgcgctgctctcggattgtctcggagatggcaagggccaagggagggaaggatcggagtgtgccggtgtggtgtgtgcgggtgtacttcggaggtcattgccgcgtgggcccaaagacgccggtcacgggaccacgcgtgtcatgtgcgtccgaccgaaggagtactggatttcttggagtacgcgtacatgctcggaccgagatgtgcaacgtgctactccttcggttaataatacttgtcgttttagataaggacacgatctgaaaaaacaaatttaaccattattttttattataatatatataaaagtgttaacaaatactctctccgtacttgtataagaaatcgttttgaacaacgatatggtttccaaaacacaactttaacttattgtttctataatatttaaatgatatatgtatacttttatgaaagtattttttaatacaaatctatttatataatttttatattttcaaacttaataacttaagagttatttatgatttatattctcaaggtttgacttaaacattatcataattgactttctttacgagtacggagggagtatatgattttattgaaatacgttttaagactattctatacatgtagtaaccatatttgaaagataaatattttaaaaatgcttcataatcaaagattttaaagtttaactttactcttgtctaaaacgacaagtattatcagcctggaggggtattatcagcccgaagggagtagtagagtgcgtagctagtcacgccccgtgctgctgctcttcttttagcgtgtgagaggagtatgtttgtagggtgatttcacggttattcaaaacgtattaggatgtatcacattttttatataaaatttggtacttgtcaatatcttcaatgttagcaggtacggaaatttatttattgaaatatctcaagaataataaaatttctcatgtgtgtaaacggaatgcacgctgaggtctttgtgattttctttatttcgatttgcaacgaagatgtagggtgcatgatcgaacataaaatgcaataacgagctttgacacaaaacactcaggccccatgtagttcccacgcaaaaacttttcaccatatcatatcaaatatttggacacatgtatagagtattaaatatagaaaaaaactaattacacaaattacgtgtaaattacgagacgaatattttaagcctaattgcatcatcatttgataatgtggtgctaccataaacatttgctaatgacggattaattatgcttaaaaaaataatctcgcagttttcaggtgaaatctataatttgtttcgttattagactacgtttaatacttcaaatgtgtgtccgtatatccgatgtgatacgctaaaacttttcaccgctgaaataaacagaacctcaattagatcgagtttgagggaaattcatgaatctctgatagatattgtctcgaagtgatcgaattagtggttccctgcttttcaataccactggacttaaaataaaaaaccaatcttcaggtacgttattcagatgcatggaaaaaaatatatgctatgttcgttcctcagggttcccaactccacacactcattttccacgcgtacgcttttcaaactactaaacaatgtgtttttttaaaaagtttctatacgaaagttgcttaaaaaaatcatattaatctttttttaaaaaaatagctaatatttaattaatcacgcgttaatgcgaacatcgttttacgtgccgagaggaggggttgggagagcttaatacatatcaaaatggaggtagtatttatattggaacagacaacataaataggttctcatcgataggatatcaactagccgtgtagtagtaatctgatgagtgatgacctagccatatataggctgtgttttgtgtttagtttccttcaaatttccaaaaatttcgtcatatcaaatatttgacatatgcattgagcattaaatgtggaca

SEQ ID NO: 69935 - DNA, 3313 bp, Oryza sativa
acggtacttagatctactcatttccacgcgaggtatgcatttttttaagcttttagaccttaatttgtgatgcatttatgcatccaaaattttgaaggaagagagcaccatgtttttaaattttatttcgtgccatatgagaaagaacccgccgccggcccccctattttttcgtacggttccacttacggaccgcatggaaacaaaaggaggcggtgtccaaaaaaaatctatcgtgtagtagtgcctccttcttcctccacccaaccatctctcctaccccacgtcctgctcggcctcaccccgccctcgctgttgtgtcggtggtgccttaggggccgcagggcgtattcgcctccaccttaaagtgaggcccactatatttttttaattttttaacttagtactcattgatatgtgggtcccttttttatatgtcgcgtaaacgtcacgtcagctaaaacagttatcgatgcagtcttagaacaaattttacactagtttagaagttgaaagacacattatatctactatttcgatttagggactaacttataacttattattccattaatttgcatataaaattcggcttcgtccctcccggtcccggcccacaagagcacgtttaatacctgccccacctctcctccggcgaccgatcggtctgttttccttccccggatttgttcgacgcgcagccgtggcacgcacgtgtacatacgctcgcttcccacggacgtcgcggacccaatcggtcggcggtgcactggtgcagccgtgcaggcaaagataacgcgctgctgagcgcacacactcgacacaccgtcgtttcatcggtgacagtgctgcatacgagtacgacgctcccctgcctcgtaccgtcgagaacacgaaaatgatacgatggcgcgcttgtcgatctccgacccgtcttgcgcgctgggcacgttgatagatctcgcctgggtgacttctcagttgtcaacaacagctagttagcctaccactgcattcttcaggtgtactactggcaactacttcctccgttgttcatctgaggcctctcatattgcaagctatggggcccatacccctagctcaaaaagttggcctaaagacacccaccccacagtacaagcattcatatatgtgtggcttaattggatggagacacttatgaaggaaacgaagttcacagttggcgtgaccccaggcttttggacacggtagcggagcaaaatttattcctcacataccccactctccaacccagcacgcaacggacgcctcgaccgcttcgctctctccaacccctcatggcggcgggaccgtccccggcggcggtggctggcgtggcggcgggaggcgtcctcggcgggagtggctggcgcggcgacggcgggaggcgtcccaggcggcacgacctcgcccctcgcatcttcatggctgatgccgctcacccgccgcgtcaccggagtccgccgcttgcccgccgtgctgatgccgcttcaccgcgtcgcagctgcagcggctcggcgtcggcggagccacaggcgcctgtggaggagccgcacggcaccggccgccgcggcgagcgcggctgtcgccgccaccgccgctaggaggaggagcgggtgggccgggccggcagcgccggcggcgcggaggaggtgcgcgtgcagatgcaagtgcaggtgcaggtgcgaaatttcttggacaaggagaaatttccgcttcttttctcaactttcatctttgtgtgcatatactagttcggattgtttctcggagaaggagaaatttcttgtctaggtgagttgggatttgatctttgggactgaatgaaattggtatcttgtttgggattttgttttgttttgattgagtcgtggccaatgacgacgacgacgatgccggcagcagcaagaacgtcggcgccgggtggatttttggagggcgaatccgggatttctccgagcgtctacggcgcgaggacacgctgcgtcgaagaaccgaagcccacagcgcaggcgacgccggttttcctggccgcgcatggactcgtcaaagcgtggtaccgcgtcactatgtttgggggcgaggggccaagcttggtcgccattcctggctccacctaagcgaaatcctccgtggcgcaggtaaggcacgagccagctcaccgcactgtaagaggcctaacaaatttatctctaggccctgtttagatctcaccctaaaacttttcacctcgtcacatcgaacgtttgaacacatgtatgaagtattaaatataggctaaaaaataactaattacacagattgcgattaatttgcgagacgaatcttttaagcctaattgctccatgatttgacaatgtagtgctacactaaacatttgctaatgatggattaattaggtttaataaattcgtctcgcggtttactgacagattctgtaattagtttttttattaatgcctgaacaccctataaaacaccctatataatattcgaagtaacccgccaaaactttacacttctcgatctagacacccctagctcattttatttgtcccaaataaattattcttagagcaactattgtatcggactttgtgaaagtaaaaaataattatattgagagtggataaaataaagaataattgtattagagatttaataaaatagaggtatgctattggtatgtatgggatggtgaaagaaaaaacttatttttggacgggatagtagcctactagctttgccctgctttctgcattgcacatttgcgcattctatgtaacgctaactactagcttgtggagggtattgtggctttgtgggatatagtagcaacatgccaagttgccaacatgcgagagccaaggacgacagtaagtcaaccatgaattaacaacttattactgtagatgttgtgtgctgatgaggatgaggggtctccgtcttatatatatgatcatgtttcagggcttcaggtttaggtagggattgcccgttttcacggcggaagtttcacatgatatctgtatttctgcataatctaattcgatgggatatgccatctttgggtcaggagacgtttttaccatctgtaatatattttatcagagatatcttggcactataatctattttgagtaaagtgtattggtggtccttaaacttatagggttatgtcatataggtccataaactcttaaaatggatatctaggctccataacttgtcaaagtgtatcatctaggtcctaaatcgacacatcccctctaggatcctacgtggcgctgat

SEQ ID NO: 69936 - DNA, 16377 bp, Oryza sativa
tgatacaaaatgtccaccgtgtctgtaagtctgaacatcgttttagagttattcacactgaaagtgagctatactattgtgtacttgctacattcacggtgaattcttgtttatcatgcctgaaaaaacgtcagccatcgatatttctctgctcgtttctgcttataacatacaaatgggcgaaccaatggatgtgcaagtaccccgatctcctgaaacggtgcgaacttttaaaaacacttactatactaaatttcttggaatattacattaaatttactttttaaaaacttatactccctcgaaaaaaaagcagcaaaagacaaattaacatagacgagaaaaaatgatatatacgcttctcattaaataacagcttgtttggttggagggagtttgagagtgggaatgggagtttaggagattgagcattttaatctctagtttggtcagagggcttgggaatttcagagggactgggatggggaattaatctatctaactcccactgatcccatccctgggggaccctgttaattcacgagacttgatgggaatcaactgtaatctctaatataaaccaaacaaggcatagggaataaaaatccaactcccatgactaatcccactttaaactccctcctctaactcccattccccttccctgctcttaccaaacaggcagtaaggaatgattaaattgagtaaattctatgtgtatccctaaaaactcactcaatccctttcatacttgataaaacctgagttccactcgacactcaaggctgttgttggcccgatctttcggtgagttgaagataactacgatttgggagaaatgttgacgacccgactacaactatactagacgttgttgtgttgcgccttagcgatcgatacacctctccgttgattgttgatcttgccggtgcagatgaaccttattcctgcaagcaaattgaagaaacaagtaagaacaagataaaagcaatctgatattgcagataggaattgaatacaaatgataagttgggattccgtaacgagtaaaccggcgatctaaccgatcacgggattgcacggcaaagtagtaaagctaaactttaatctaaacaaaacacaagaaaccctgaaggggtaccaagctatttatggagatgggaggatcctaagtcatcctccacctggtttggggcgcaccccacatgggccccacttgggctggggtcccagacgaagttacaagcccataggcccattacaggtgacgtagcaccttgttccatcaattgcgcatgactgagaaggaatttggcagtgaggttggatctgttggaatgacgactccgaatgctttccatcaagtactcacggacccaaaacggagctcgtatgcacatttggcggccatttgaattcatcacagtagcaggtggccgaattggattccagaatttggacggcctgatcttgaagtgttcttcttgatccatgatgtgagcaactgttgtatccatggtagccatggtcacatcatcctcccattcttcacggaaaaccgtcctcggtttttctatatggtgctcttcacatagtccattcaaaataacctgtttcatccaatcaaaactagagaaactcgaaatagtgtgattagcaacaacatgtttctctaaatacgaacaaatgaaaactctatgcaccaaatatattcctctatcattatattcgccaaagatatgaaaaatagcattagctggacatggcaaatcagatttagcaaataatttctcctccaaattatcgagctcacaaaaatcatcaaactgaacatagcccaaagtatttaaagaagttatcaatttgcattcctcaacatcattagcaatgtgaacaacatgcttaaaatcagcacacaatgaaacactagaaatagcattctcattcactagttgtggcatggatataagtgaagtattattacacaactcttctttatcacaaggaacaataattaaatcaacttgtgacaaaggcatctcagcaattggttccactaatggttgctctagtatagcatgaaaagtggaaatgtgtagctcaccttgagtatactcaccttcatttgtctcagcaccatttaatttaccttgcaaactattttcagatatcgcgggtgcttcatgcttctcccttttcttctcaatgacatcattatactccgtttgttgaatgttctgaactccctgcaaaacgttagcaacaggagacacaaaagattgctcctcgtttgtttgcgcatcatcattgtacaaggatataggagattcaaaaacatgagataaatcacattgttcatgctttctcgcatttgacatgatcttactgtcaatgctgcgagcaagcatgaataggtgcccaatataattatatgtcacattagcaagcataacctgaattttagaattaagcccattgaaaaatctacgtattgtgttttcattgcactcttttagaccattgtagatgatacaaactttaaattcatgaatatactccctaacagttctatcatcttatttcagatgttctaatttctcccgaagagtacatttgtaataagaactcacaaagcgttttctcatcatggttttgcattcatcccaagtttcaggtttattactaacaaaactctaccaaaagagagcagaagaggtaaacttattactagcagccttaatcatttgagcatcagaaaaatcatgtatatcaaattcattgtctactgctagctcccaatcaatataagcaacagaatcatacttcccatcatagaatggtaacttagattcaacttgtgcaaaattatagtcatgtacctcatatgcattgcgtggagaagttgtcatatcttgtcgacggtgaagaagccgatgttctcatattcccatgtgcaatcctgcatggttagtagaaaacaagaaacatacacaagaatatgcacgctcctatcaactactaggtagtggaagctctaatatcacacacactcaagctttttaccaagctcttacaagttcttaccgaagcaagcggaatggtgacgtacaccgactcaaccaagcatcccaatggagtttgaatgtatcaatgccttggcaaacacttgctgtacggttgcaatcaaatctgtggagctctgggtaggcttaaatatgtagcaaaggaatagcaaatgctcaaatcagagattacaaagttgaatgatcgttcaaagtcaagtaccgtgctggtcctaaactagaacatattagagacggtgctagtcctaggttagaacgtattagagacacgagcctagacacaaacgatacaataagataacaccagaaacaactcaagcacactctgatatatgaaaccaaactcaaagatacaactgatattttctctctttgccttctttctttcactttcttttttctttctttcctttattttttcttggtacggcttttttctctcttcttttttacgcacctttctgccttttttttcttttctatttttttaacaaaaaccgactcaaggacctcaatgtaagattacatggactcaaatgtaaataaaaaattacagggattgaagtgtaaaagtctgaacccaaaaattgaaattatacaaaaacggaatattgaatttataccggttccgtttttccaaacagatctcgaaaccgacacaaaacaaatttttaccaaggtgttacagaagtgggagcgggacgtgactacaagcagaaatcggactcggccacaaagggcgacaacaggaaggatgcggcaggcgtccggatttggtgagagaaacggccacaaagggcgacaacaggaaggatgcggcaggcgtccggatttggtgagagaaaaaaaaaagaaactgattttcaatcaatctgatctatttctttccagattaaactctcatacttccaaaaacagatttggaaattttttttctcctcactcgcgcacaacaggacaacaagagcacgggaaccatacaaccgaaaccctagatgcaaccccacaactccaaaaatgaccgaccacaactccaaaaatgaccgacagaaacttctgaaaactagaaaaatagaaccgtggcagcgagccaattccatttccgtaggtcccaaagacaacaagaacacgacggcggcgataacagtggtactagacgtgacaagaactcgaaactctaaccgtactacacactaagactagcagcatgactcgacaatgcaacataaaactcaacaacgcaaaaactgaaaagaacaatgtaatagcataatatggctaggtaaatgatacaattttttttgtctagctattttctagttatgggtagaaaaaaaactcaccgagcaacgaaagctctgataccacctgatgaaccctgaattccactcgacactcaaggctgttgttggcccgatctttcggtgagttgaagataactatgatttgggagaaacgttgacgactcgactacaaccgtactagacgttgttgtgttgcgccttagcgatcgatacacctctccgttggttgttgatcttgccggtgtagatcaaccttattcctgcaagcaaattgaagaaacaagcaagaagaagataaaagcaatctgatattgcagataggaattgaatacaaatgataagttggggttccgtaacgagtaaaccggcgatctaaccgatcacgggattacatggcaaagtagtaaagctaaactttaatctaaacaaaacccaagaaaccttgaaggggtaccaagctatttatggagatgggaggatcctaggtcatcctccacctggtttggggtgcaccccacatgggccccacttgggccggtgtcccagacgaagttacaagcccataggcccattacaggtgatgtagcaccttgctccatcaattgcgcatgactgagaaggaatctggcaatgaggttggatccgttggaatgacgacttcgagagctttccatcaagtactcacagacccaaaacagagctcgtatgcacatttggcggccatttgaattcagcacagtagcaggtgcccgaattggatttcagaatttggacggcctgatcttgaagtgttcttcttgattaatgatgtgagcaacggttatatccatggtcgccatggtcacatcaataaccctaaaatttactcgatcctttctatacccctaaaattttaacttgatccctttcatgcccctaccgttacattttccttcattccactattatgtttgtttgcaaatgtatttttttacccttgatgctttaggtttgaatataagcgtgaaaaacgattgaaaattttatttgagtgcacagtacgtgcattttatgaaactaatgagactaaataattagtgcagaaaattttgacataaattttaaaaataacacaaatgtaataaattaaagtttttatttgaaattttaattggacaatggattttttttgtcaggagcattcataaaaaaaatatattgtgagcattggtcgttctatctttataggaatgctcctcttttttatgacttttttaaaaaaataaatacatattttttatttcattatctaaaaataaattttttgataaataatgcatagcacaacaaactcataactataatagtctcatgcgacaaacttttacatttttaataatataattaataatttctatgttcatccaaatggtaaaataatcatttttatagaaattagactgtcaactaacggtcaactgacggcaggggcatggaagggatcaaaatcaaattttggggtatacaatgaaataagcaaaattcaggggccttgataggattagcttaaaattcaggggtatacaagagattttctcaaagaaatttgtatgagaaatgatttgaggggaagtagtactcatatataattttattctgataaactttaaatgctagaagtgttctttttcataactgtttcttcaaaatatatatacatttaaagtttaaagtcctttaaatgatacgaaaactttaaatgaaaggttagttggaaagcaagtattatatgatgcaggtggtctatcgaactcctaaggtcccacctgcatgcacacacatcccaagttcttaatattttgaactctgtcgaatgtttgtctaataactgttgtttaatagagtactaaatttacgatttcagaccatcaacacatttttataaattgtcattaaatttgtattatttccaaaaaaaatccattgttgatggcactctttttttgcagagaccagataagcagtaattgggtggtggtccgagaccatacagcggcggtgctgcctgttttcatggaagttcgtcagacatttcgcaactgcagaggaggtagagttactagctagagcgccgagaggggctggcactaaagcgcggaatggattcataaaccatgtattctggagtcggattgtattttcgcggtgactcaattgcaagatataaaagaggataatgatggccttcaggcgaccgggcgggggaggaaaaatcggtcgctccccccgcccccgcccccgcacacacgctggtgtcgctggccctatcacattacctacaatacatgcccccacctgcaacaaatcaaccacatattttaaaaatcatctattaaggaaatttggtttatttcttgttccaccaagaatgtttcacgaatgtttcacctagtgtactcacaatgtttcactatatatggatctaattaatatgttgcacccttttgtcgtaaaaaaattgcaactttatcttgctttgtttattattttcagcttgttaatccatatatggactattatgcatgtaattatattttcttgctcgtaagaattttcaacaaaacatatttttttagttttatgttagaacattattttctttaaaaaaatagatgtgtgaattgttaatattgatctagtgttgaaaaagtgattcataaatgtaagaaaaaaaacgctcaactaaccaattagatggccccacactatattaaaattcatgtggcgtcgcattcacaaggtaggagtaacaaatatggcgtaaacatattaattagatgataaaacataaaatataactaattttttttaattttttcataaaatttttaaaaaagacggacagtcaaacgttggacatgataacacggatatatttattttgagatggagatagtgatagagatgtgtacacacttcactaggaacctcgtaagtatatctcaaatcaaaccagacacgaatatattggaaacatggccaccagatttaattaccagagatattaaaatatactccctccgtcccataatataaaggattttgagtttttgcttgcaacgtttgaccactagtcttattcaaatttttttgaaattattatttattttatttgtgacttcctttattatctatagtattttaagcataacttttcgttttttatatataaaaaaattgaataagacgagtggtcaaacgttgcaatcaaaaactcaaaatctcttatatctcttatattgtgtaacagagggaatagtaaattacatcaaaaccaaagtacgatcgcggtcggtggggtcgtttttttctttttttgtaagactataatcaacggggtcaatttggagtaaacccagcaccgctgacaatgaggcttcaatacagaataagcaacgaggtgcaactgaaacaagaatatctggaaccggatgcatacggcgcatctggtgtacatcgttcacgtggtaaactggtaccggtgtcttgtttatttgatcggtatctttatattcgtgttcgtggtgattggtaagtggtaacacctcctatcgtaaataagatttttttttgcaactaaaaagatcatcaaggcactattaattactacccgtatcccataataattgtatttctaagatttaaacttgtcctaaaataattatcatagtagagtactaattgtcccatcaatcacttctcatttaaatttcttccaattctaccctttatcactcttacaatcttacctatacaccatttaataagggggcaccataatctttcttctcaaaccttaatacatgctaaacaatttagaattacaattatattggaactaagctcgtaattattaatcattacatacaaaatgagcggaaaaagatatgtgtattagacacattttctttcccagggatatttattactacaaagttcactaaatgtgaaatgttaaatgattctaatttaaagccaacaaaatgtagaaaattataacatttgtaaaccattttgaagaaaagattaactacattgttttttaaagataaataaaaaaatatttcaagaaaaaataatataaaagtttaaacacattaattaagcattctaactactaaatttctgaccaaagggagtatccgttattacaaagctcacgacttagtaattaacaagtttctaatcaaaaggggatatcaattatggctacatcgaatatgtaggattttcaaaacacaagggtagagaaaaaaaaaagtaggattcgagtgccttgatatctttaatcctatatatatatatatatatatatatatatatatatatatatatatatatatatatatatatatatatatatatatatatatatacataagaaaaaacatagaaaaattacataaaataatatttgggttgaacacacgaaaaatatatgaatcagaagatagatatatataaagagttttttttataagaggttgaaccttatatatattgaaaattctccaaaatttgtatgatttaagataactgaagaaatttcaacgaaatatggtagcagttaaaataaaatattttatatactgtacagtcaattattctatattaaggtcctacaacatattaatattttatatcaaactgtagctctccttagtccgatgctcaagaatctctagaaagttgtttaatacagtcacttggaatcaccaccaaattaattgtgtttagattccttcacgtgcggccttccacttgtggaggttccttctaacaggtttcccaatttggttatgccatatttgtcgatactccctccgttccaaaatataataaattaaaattagatgagatattttctaatacaatatatctggatagattttctatccagatacattatactaggaaacatctcatccaatcctagattcttgtaatttaggacggaggtagtagaaaattagagtgaaaaccccggtcaaaaaaattagagtgaaaacttatgatttttataccgtcagatgcactttgagattcgtgatgggaaacttgtcacgcgaggagacgaggaagcgaactggtgatgacacaaccacatctgtagccaacggaatatttaactatttatcattcttaaatatggccttaagcatttgctatctgaacatattagggacaaatggttaaatgtcatatctaaaattagcaaatagttaaatgttccatagccaatggtaccacgtgttctttttttaatagtatacattactgttgtaattataatataattatattacaatttacgtttaaaagttttctaaaaaaatggaatgttgtactgctagtcccctcccaaatatgccacaattgaaccaaattttcctaactgcttatttcatcaatttaaactcttaattgttggcttcatcgacttttgatgataaacatgttaggctattccaacccaagacactagacatagtatccataaacctcacatcatcaagaaactagtactagacactactcttccaatgcaaacaccactattccatacttaattaaatttaatgctacttatctcacatgatgtcttggatattgtgtagaaaccatgtctcatgcaagatatggtttctttctctttacttatttattcacttgctacatcattttttatcttaggtggcagcttatttaatattatggacgccatcctagtcattgggttggaaatatgttagtgatatgctctagaggcaatcatagagatgattatatcacatactatgtttacatatttatccgacattgttccttaaaatagattactcattattggttaatgaatatgtgattctttcatgagactctttatattatgtgttgctatttctaaaggatccctgatcaaatatcatatgtggaacaaatatgtttagatgatcagcacatgtattaattgatgatcatgtctcatagatcatggtatagagataccaaattaataatgtggacacaagttggtgaatatgttgttggatagacccaacatgagacactgcaagagccatatgtgttgtgtcatcagtgatctcatttagtgttggtgttgaatccttagacctgagattatcatggttctcaacatgtgtagtagcttacttagggactgttaaacgctactctgtaattgggtagttataaaaagtagttttcgggtatgctatgaaacatgtagtgggatatgaataatcaagatgagatctgcccctcctatggagagatatctctgggcctctcgatgttgtagattatggaagtgcatggccatgccaaaggtgattgagcagtcaatcacaagttatataatctattaacaggttcgagtgaatgattgagctattagaggatggcacatatctagccttgagcttaatcgatatcgtgaggcaatggggttcatacaagtatacactagaggttcagccgatatgatctttatatatgcccggtgggtcaatacgttctgctaggggccgctgttgacgcgtggaccgaaaaggagttctcgggttacagccgagtatacatgaacctccagggtcgcacgcttaatgggccggaataaggggattggatggagatccaatatgagcttaattcggatagggatccgaatatgagtcctacgggccttggaggcccgagtgatggattttatatattcgtgaggggtgtgaccggcggatataattgcatcacgtgagaaaccctagccgtcacttccctccccaagcaaaaccctagccgcgcgcgggtgctagcacatctgcacgtggccttcccttccctatacgtgtggataccggtagaggcgccgctggtttgcggtgctgatcggcgtgggagtacggcgaggagaacgtacgaggaggagaaggtcgagccggtgcgatcgactacttcctctacatcgacgcacgctacttcgcgagagttccttcgacttctcagcgtcttcttccgctgcgcagcacgtcaagtggtaacgatctatgatctaatacttgcatggttcctggtttacgcgataaaaaattttgatttattctatcgtagcctacgcgtatcccaacaaaatggtcttaagagattttcaaagatagagcccatcattttagtcccatcatttcaaagatatcgcactggtggtcaccagggagagagggggagaccgagagcaagaggggagatggaaagcactagctggtgatttttattcccatcggctccgctatagcttgatgaatgagctcggcttggctgctattttgtaccggtttacctaaacaaccggctgtggtgatatgacattatgttactgttagttcatttaaaaaattaggtactaattaatgaccttatatcaagtttttatatcctcgtggcatgcaggggtgtaaagtccctgtcattaccagtttttacctaacatacatcattgggacaatactaacaacgtattatgtagtagtcgtgttatttttatattatttgtatataggccacttgctattgagattcactgtgacagcagatttttttttaacgaactgtgtacgtgttatttttctatggaccacttgcgctataggttcagtgtaacagcaaacattagtctttttcttttctccaagcaagctggctacaatgcagccttcaagatctatataattgtcgatcagtaacaacgtccagagtgcagcgcaaatagttactacctattatggtgaagttcactgcacgccggggcaaatctgagctagtggcaccagcgagggccacaccaaatgagcgaaagtatctctccgatattgacaaccaacactctctacggttctatgctaccgccgttgagttcttccagctatgcactttcgatggctacaagccacacgatccggtgaaagcaatcaggtccgcgcttgcagaggccttggtacactactaccccatagccggtcggctgagagaacttccacaaggtaagctggtagtagactgcacggtagaaggggtggttttcgtggaggcgtatgcagacgtgcggctagaggagctcggcaagccgcttttgctgccctacccgtgtgtagaggagttcttatgtgaccccggcgatactaaagtggtggtcggcaaaccattgttgtttctgcaggtactatatatatatatatatatatatcactcattttatttcctttcccttcaaattttcaatgtggtttacaactttcagaattagagacatatataatttttagattttcaagtatttgttaataggcatctctaggttatagttatagtaacccaagatttgaaaacattgggcatgcagtttgttttatatgcctactatatatactatatattttatatggcttttggtttctagtcttgtcatatttttcattgataacattttatagcctgattttattggtagatgtgatagataacatgcataatgctagaatctttatgcaataatttagaaaaatcatttgtgttcctagccgctattgtgttaatggaatttgtttgggtgtgtacgtgccatgtaggtgacacgactaaaatgtggaggatttgtaattggccttcatatgtgccataacataagtgatggctttggaatggctcatttcatcaaagctgtgggtgacatcgcacgtggcgaagcactactgaccatatctcctttatggaacagagagatgctaactatgtgttacccaccccaaatcacgcacacacatttagcatacgagccacttcgtgatggtgatcctaccaatgatataatgcaatccactacgcctgacaccatggtaggccaatactttctctttgggccaagagagatatctgctatgagaaaccatgttcctgtacaccttaggcagtcatatactacgttcgaattaatagctgcggcggtatggaaatgccgcaccgctgcattgggttattctctcgaccaacatgtgcgtctcatgttcaccttaaactctcgtggcaactggaaacgcaacccaccaatcccacaaggttactacggttgttgtctcgtctttcctgttgcagaaacaacggtggctgacttgtgcggaaaccctctagggtatgcacttgaccttgttcgtaaggccaaattggaggtgacagatgaatacgttaaatcaactgtggactttctagcatcacgcaagtggccatctcttgttgttgatcgaacatacattgtatcagacataacatccgttggagatgacaaattagactttgggtgggggaagcgtatgggtggtggcataccaatggctggagacatcatgtccaggctaataagctattttaccaagtgcaagaatgctgatggtgaggactgtattgtagtgccaatgtacttgccaagcataaccatggatagattcgcagcagagatctctgtttggtcaatgaaacaaggaagtaaattcattgtcagcgcactttagatgcataaggcatgcgaggttgccaatggttataaaaaatagcaaataatgtttcatgctatttgaaatcaataataatgtcggtctttaatttatatgtatgggtacatcttgcatgatgtatgtaacacatgggtatgaatgtggagtcatgaataaaagaaattatccatcttctatcacacatgcagacctcatgttttcatattgcaaatgtggttgcccttatttgttgttcatgtatctataggagcaatataggtcaaaatacggccataccaaggcatcagcaatgtgaaaatataaggtgatattaaggcttactatggtcagtctcaaacatagagcatttaagggcacatatagtgtatataaaatctactccatccgttttatattataatatgttttgatttttttcctagttaaacttatttatgtttgattaagtttattgaaaaatctagcaacatctataacaccaaattagtttcgttaaatctagcattgaatatattttgatagtatgcttgttttgtgttagaaacatttctatattttctattaacttgatcaaacttaaagaagtttgacttaataaaaagtcaaaatgtcttacaatacgaaatagatagagtaggtctttaagcaataaaatattctttgtagattggacacaaacattatgagaatgggttaactcacaaacatatatctctaaaaaccagtaaattggtaggagaccgatctttaagccaaaaaaaaatacaatacttttcagcatactaggagtagtacgtacattatccaatagtaagtttcattttttcctaattgccgaacctaccttagtaccaatggaaggtattacggtatcaacaatgcatataaaaacagtccttatgatatcataaagtcatccatatatatcgtgagggtagtctatgtagaatacaattaggctagaactgcattctttatgggactgctatttagaaacaaaaaatttgctcaaagttcacatgtagtaacccatttagttaactcatttatttgtacccttggataattaacacgaaccattcatatattcagccattcaatcattcaacagaaaacaacacatgctaagagataaaatagatttttaaggctccttttggtatcatggtggattataataatcttgtttggtgcaatatgatatattaattatcaaactccgtacttcgacctatttgtaagcttccatttacatggaatttaaaaataagcacatcatagaatagcacaaccaaaaacttagccttaaaagaccttagttaacgaaacttctatgcctagtttacgattgaaattgttagaaaccttaatatctccaaataatggaaggaaacctcgacaaactatcacatgtttacccacattattctagttaaggtacaacatggaccgctctaagaaggggttaaggtacaacatgtaaccttgggatgaaatcatgtgcataaccaagtgtcactcaaatctttgtaacattgaaaggttgtgttgcttgcatggcctggccaatattgtggaaagatagactcctattgtcttttccaaagatcaacagaagaaatttagaaatctccaatgaataggaggacaagagcaataggctgctttgttggtttgttggggaagaagataaggccttagagaggacaaataggtaaagttggagtggactagactaccacttggtggtatggtgctctagatttcttattgttgcttttgcatcaaaagagtggttggaagtcctgtcaactcactactacaaaacaatttttcatagcacttcccttttattttttccaggcggactaaaaataatgccaccagtgaaaatcacatttattattaccgccagtgaaaaataatgccacatgtgcccattctctggtcctttggtggtatgtggtcatctatgtgaatttgattttgttacatacaagctatttcttgtaatgtgtcagttgatctatagttctgtactctcttcatcctaaaatttatctacctttatctgtaagctatactatggaaaggagggagtattgatttatggttgaattatcttctttagaaatagcatgcattggtgcggtagccaacagagcttaatgatgccagccatttagaggagacaacaatagcaagaggtcggtgaagggtgcccgacatatgtgtctatatatatatgtatatatgtatatatatgtatatatatatatatgtatatatatatatatatatgtatatatatatgtatatatatatatatatatatatatatatatatatatatatatatatatatatata

SEQ ID NO: 69937 - DNA, 27113 bp, Oryza sativa
tttagacttgcccacaaacaaaaaaagaaaagagaaattgcttttgcaaaacgacggtggtgaaaatcgagttttaattcgaggagcacggttagaccgacattgtccagtcggttagaccggttgcctggcccggtcagaccgcaagtacagcggcggtcagaccggcctcggggcaattttgcgcgaaattcaaatcagacttttatgaagcgaaaaggtaatttttcagataagtctgattctgattttgtttgtgcatatgtacctcatggttttatcaagcaaaaatatgacaatgagaaaaaattaagaaaaaaagagctttcttctatacatatggtgttttcttgtgcatgctagcaatactttgaagggttatttgtctctagcatagtttgtatgtattctagtcttttcatgatatttagattttgcttttaagggagatgatacatgatacttaaattctatacttgaattaagcaaatatgcaatgttgatgctagcatatagtttgatctctctctctctatatatatatatattctttattgaattgttattcctcatatagctttaattgctcattgtgaaaagagaagaaaaatatgaaaaaaaaaagaataccgaatccttgaaacaatcttgacgacaaggacgtattcgatgtgagcaaaataatgggtgccgaatctctggaaacaatcttgatgacagggacgtgcccggaataaaagagaaaaatatgagcaaaaaggctcaagaaaaagaaaaagtaaaaattctcttgtttgttttgtgctgaaagctaatttgagaaagagtgataaatgcaataggtatatgtgtttagtgtttatttttcaacctatgtgcttgttaagatgttgcattttaaattgtatgaaatcatgaattttgattattgattcaagtttaattgtaaaatctttggttcatgattatactttaatgcatgcttgctatattatagattagttcatcttctttttattgcaacacatgacatgatatgatatatgtatactaagctcttatacattaatgaacataatttctatgcttgatgaaatcattgtcaaaggggggaaaagtaaggtgaaaattttttggagtagcaaatgagttgagaagaggcatgttgtttttggttcgattggaaatttctttcttttcaaaagtgagagaagttttcttttggattttttagcacgatgtgtacatttgtacaaagtgtgctttttaccacttttgtttttattttttcaaacaccaaaacatttttaatgggtttgccaatatgttcatcaagggggagattgtaaatcaaaggtgtttttgattgttattctgtgatgaacaattggcattagcgtttattggcttcgatatttggaatttatttacgaagttgttttggagacgattgcatttcacaggtgatctgctatgctttgggtccggtcagaccgggcagtgtgtgccggtcggaccggtgatgattgagcggtcagaccggccagcccgcggtctgaccggccgacgctgtgtcagtttcggttttgggttgtttgtttggatatccgtgattgtttcatggttatggcttctagatggataatatgcgtatctaatactgttgtttgctactaatgagttgtcacatcctgattttcgtttcaggatttataaattatctaataaattattaatagaatttatattaaatgttctttaatttacaagtgaagttaaatgtgggaaataaaatttcctaaatttaaagcatggatggatttaattctcattaaattctccatagttaattatactctctgaaattttctcggatttttcggagctcaattcctaaatgatacaaagaacaggtcagtaattatttaatcattaatgatctaattataattatgttaagtgcttttcttgtttaaaaatccttaatttataaattgttgtcgaaaagggaattattagaaatgatcttaaaagcctagaagagaagatctaattttaattaataaatcccaatataaaatggggccagataaaatttcgttaaatactttgcttgattctatagttcctagattttttctgggatttatttgagccaaggaagtatttttaataaatgaaattgcatttcatgaataattataattgaaaaaggttttaaaatcctcttttggctttgggccgaaagtcggcccaaaaccctctctctctcctcctcggcccaagccggcccagtcaagccgagcagccgctctcctctctctctctcccgctgacaggtgggccccacctgtcggactcgtcgtcctcctcgcgccgtcgcccagccgtgccctagccgagtcgcgccgccgtctccttccaaatccggccgcccctttccgtttccgatgaaattaattgaggggaaatgtttcccgggatcccctctatcttttctcttatggaatcgtcggctaatttcgtttggaaatccatagattcgagttcgattcggatcgatctctcttctccgaaccctaatctttccttctcgtcgccggtcgccgtgggccttcgccgccgcctccttgcccctttaaaaggacccccaagtccgccgctacctgccgccaccctcgccttcgtctctcgccgtcgatagcgccctagcaccgtgtagcctcgcgccgccgtcgtcgccgccgctccagccgtgcgtcgccgtcgctccagtcgtcgtcgtcgctcgggaaggccgccgtcgtggtcgccgtcgcgtcgccgtcctcgtccgcccctccgccgtcgctgtcgaccgccggaacaccgccgtcgtcgtcaagccgatcatcgccgccgctcttcctcgacgccgtcgccgtccgttgatcttccgccgttgttttggtcaccggtgagttcgccgcgtcgccctctacgtgttggtgtcctccgttcgcgctgtcgtgccgtcgttcaccggcgagcacgcgaggccgagccgtcgccggtgatgacgtcatcgccgacgtcgtcgtcgtcgtctctcgtggtccggccgtggaccgatcgatctcggcccgttcgtttggatggaaagatctcggccgttagtttccgtgagccgccgccgtgcacccggtccaccgtgaacccgagccgctgacgcaataaacccccttttccttttcaaaaataattcattattgcgtcataattcaattaaaacccatataattgatttaatctgatttatctttgaaaattcataaataattcatcttagctcggatttagttggttcaagtctctaaatttttctaaaattgagatctacatgttaaaaatatccacatgtactgttcatgcttgtttatgtgttgttttggtgttttgctcctttctgtttagattccgacgtttccggagagttcgttttcgcaggaaaagaatttgaagagttccaaggccagcaaggcaagtcacacagatcctaaacacaatcctttgagcatgttgatcctatatttaaattctctatttatttcaattgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcatagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgattttcggttgtgaaacattaaccgtgccaaccacaagccagcgtgggcaacggctttaccttttgtatagcatggttcattgcggagcaccagactgagaagtggcggagataagcccacgggggtcgctgttgatagctttgtatagcatcgttaccagactgtttggatagctttagatttgtttttggtaatagctgtcgtaattaggcatatttatggttttccttttcattttaagagataaatctctagccgatcaagtcgtgttcgaatgggacttagttaggtcgagggtatcagtataagtgcctgcaaagtcaacatgaaaattaaagtttttggttggctgtttctcatggacagagtgaatactagagacttgttggatagaaaacattgtgctctcttgagcgcatcgatttcttgttcgttgtgccaggagaatgcaagagaaaccagggagcatctgttctttgattgcgccttcagtaaagggtgttggaataggctgggatggtgttggaacacgtcattggagtttaatcaaatgctacactcccagcgctcctctttctcccatcatggtttcatggaattgttccttctggctgcttggaacatctgaaaggagagaaacggtctgatctttcaagggattcagccctctattacaagttgtttggccaatctcaagtcggatctgagcctacatttaattaggttcagggaaagtgatcgccccttagtgcaatcatggattggtcatttgtaatcttctttcttcttttctttccctcttgttcctttgttttcttctctctgtaaatttttttggttattaatttaaatcataccgtgggggcctccctcactgtttttttttttgttcaaaaaaaatataagtgcctacaatcattatgacgatatcaacagtttaatatacaactctcagtgcatcgttaccttttacttttgatgagttcttattttcaagcggggttgcattggttcgatctccagtgagaaagtaagttctatcaacttcgtttgtataggcttagttaggacttaattggttgagtacgatattctaattaaattactacaaacgttccttatctgttatatcggctctttccttcattgcattgctttttgggtagatttgatatatctattactttgcatagaatctatcagtttgattaagtctacttattttatcaatcccatgttgtgtcagcttggtccgacatattagattgtagataattaagtaaatttcattaagatttataggttctaaccaaggtttcattggagttctagccgataagttatcttatttcaatttctgagtattacatcggcttatacttaatctaatacattcattatctactctacttatctatctacttacacctaagttgttctgtaatttttagtatcattaaaattttttatttctatgcgaaataactgaagagagtagaagagaaaattgtggttgggaagattatactagtagcaaaaagccagtcctaactaaatcaacacacaattacctcaaccttctaccatccatcatatcaggcaagtcgaggagattcagccttatctatagataaggctaatcccttttttcttccttcaatattttagttttaatcagttcatgaaaaaaattatactattaatttattcttatccataatggatttatttgggccaatacaagaaattcttgtgctattcggggatttattcttcgccaatcagtatcatgtcaagattcatcaaaataattttgaagaagaggaacaaacattgtcttcaacaacactcatccacttattgacattaatacatatgaatcttcattaaaagggccccaaaaaaatctttttgctaatgattaatttcttctgaaacctagaacgaatccacttctataggaagatggaacattttggggtaatgtaccctgcttttcaaaaaaaaacatataggtcttgttcgtttccactgcaaggagtggatgaaattttggatttttgtggcatgtttttcaaactgccaaacggtgtgtttcgtgcaaaaaaaaactttatatatgaaaattgttctaaaatatcatattaatccatttttcaagtttgtgataattaaaacttaattgatcatacgttattaccacttcattttatatgaaacacttaatcttcatcttcatcttcaggagattcaaacaccaccatagttcgctatctgagcctgcccacttgctagttaggaaaaataattgtttcgttccgtgggcttctttcactgctatcttaacgctcgctttacgagtgcaaccaacgaaaaattccaggattgctttagtattgactcaccatacacatcttctacctcatcactgtcaatggtgtagctgatgtgtcatgctaggtatctcttattggccattttttatttctagctggtagaggtatttccaaagttcatcctttatttagctcaacatgccctttatgctagttaattgttcacattgttactatcaaagagcctaatagagaagaaagagtagcttttgtagagctgggaaaatgtgccgaagagagtggtttatgcttccgggcttacagaccttgctaacttcatttggtagtatagttgtgaatttttgaactttttttgctttgcccaatagaggatcagtaactgtgtccaagtccatattcaacatccaataccatttcaagtattggagccacttctgcatttgattccaagcctatcaatggataaatggaatgagtcgtgtcaaggcaacggagtggttcacggctactgtttccgtggcgaatttgattttttagctttaaccaagtatgtagaaaaatgcaataacatttctaatatcaaaatatattcaatgctaaattttatgaaactaatttagtgttatatatgtgattaatttgaactttgacttaaaaaagtcaaacaactcccaccattttttaatttatgttgtcgttggctttttttaaaatacgtttaaccattcgttttattcagaaaatttatgtaactatcatttatcttattatgacttgatttatcaacaaatgattttgaccatgacttaatatttttatatattcacgaaaattttgaataagacgactagtcaaatatttgccaaaaagttcacagcgtcatatattaaaaaggatgtagcataagtcttgtagtaattactatgtaattatattttaattatattatagttctattttaaaatttttaaataaaatactatcaaattttgtatagttactcattaatttgttacatactggatttccaggattagctcacaactaagcctcctatcgatttgaggaactttacggaaaatattacgaaatttgagctaattcctgtaaaaaaaaaacgtgttgttggtcatccagagttggacagacagcgccttccttatcctaagcacacaccatccaaaacctcctccacgctctatctctccatggctgccgccgccgcttcgctgctccacctcgccacctccgcctgctccccgccgcgcgtcaggctcgtcggccccaccaccggccggagatcgccgctgcgcgcggctccggcgccgccgccgccgcgggcgtacaaggtgacgatcgagcacggcggcgagtcgcgggtggtggaggtggaggagggcgagaccatcctgtcgcgggcgctcgacgagggcatcgacgtgccgcacgactgcaagctcggcgtgtgcatgacgtgcccggcgcgcctcgtcgccggcgaggtggaccagagcgacggcatgctcagcgacgacgtcgtggcgcagggctacgcgctgctctgcgcctcctacccgcgctccgactgcaccatccgcgtcatccccgaggacgagctgctcaaggtccagctcgccaccgccgacgactgaggcacatcgcgcgcccgccgccgccgccgtcgccggcgtgtgtgtcatctccggctagcttgtacaacttttttcccctcaagtggtatttcccgagatatttgtgacaattgctcctttgcctagctagttgtttcagttgtgataatgtagtatctactatttttgttttaagcattatgtaggatacatagtattatttctatctttttcatattctaagagacgaactacaaaagggtaatgtacaaaaatttggggagctcagcatgtctggaagcacgggagaacgttcttttgctgatattattaccagtattcgatactgggttattcatagcattactataccttccctattcattgcgggttggttatttgtcagtacgggtttagcttatgacgtgtttggaagtcctcggccaaacgagtatttcacagaaagccgacaaggaattccgttaataaccgaccgttttgattctttagaacaactcgatgaatttagtagatccttttaggaggccctcaatgaccatagatcgaacctatcctatttttacagtgcgatggctggctgttcacggactagctgtacctactgtttttttcttgggatcaatatcagcaatgcagttcatccaacgataaaccaaattccccaattaagaagcaaaacattttaacttggagatatattttagtgcaatccagtaacatatagagctatattacagcatggagcagttcattcagtataaagctccgaatttattcatggggatatcatggacatgttcctaacaacatgcagtttgcgtctccatgtttgctagcccacgcccaatgcctgaaaccaaacatcatgtcatccatactgattttggtacattagataatcttgtaatgcgtatcatttttaagaactaaagaagaaagagttgaacagaataatgaaatgtgatgtgtgctatagaagctctcagctggaaagagttgaacgggataacgaaatgtgatgtgctatagaagctctcagctggatttctaacatcagatatgatatgtaactactaccagaacatgaaaatggtgttgcagagcactgatgttacttacacgactgttacagcaagcaaatcatgctccgcaattacatatcgcctgtgcctgagcttgtaacttctaggccattgcctgtaacaggacaaaactgtataagcaatcgtagagttatgtttgtcacacgaaagcattacataaagatgttatcaattttaattcaagttttgtttcacagctcagaactcagaattgctatcttgagtcacagtcaggaaggtgactacttttttgatacaataggaaggtgagtgggtgactatttgcagtccataaacttctgcattcagtcatgcagaaatgactagtgaaaacacgcatgacaagagctattgagctaataccggtaaagcctttggataagacatgagtcacacaccactaaaccagtcgcatttttgcaagttgaaggagaacaaataggagcaaacatttggacgattggtgtcacatgcacaagctattggcttgctagtatgccactctgtttcaagcttacagtatcagctagttgtactggagatcagcacatcgccagacagagcaagcacttctatcattagaatatacttgctacattcacatggagaaaatggcaccaggaaactttctacagaagtagtcagggttatgaaatacttttagcaaatcgtagatttccacagaattcttgtaagaaatacatgatatgatagcattctttgaaattacagaaaataatctaacactagttagaaggcaatgccaaccagatactgactaaaacaagtgaatttctgtcttgagcttatcttaaatcattagacagattgctatctattggtggtttttaagcaaactctggtacattgtgggaactaataccagtgaattttcagaatctattccaaagagtgtgtactactttaatgactaatgacaacagatatctagtgacattgtccttgattactacaagctgcttaaaaagagagacagaaaagcaattacagaatatcttactacactatgatcaatttgattacaaccaacaagcatcaacaatgaatagataggcatatgccgcagagaacaaatgtgtaatttaacaaatcctaaaaatcatggcataataagatagtatagctaatatcactgaacttctctattagaagcagcccgtaaaacataccaaatcgcaataaaattctgcattttgactgcacatcatcatagggatgttatctgtaatggactagtaaaccctacacggtcctccatcagaattcagaactatgctgcatattaagcaacaatagaatttcaatatatattacgatttttacccccagaaacaccacatatcagccttttgtagcttctattgctgtaatgccaagaataacttcttatcaagttttattttctgacacgttgtttaatttcgatacacctggaaaacgctagtgaatttatactagaaactatatgatcgaaatgataaattgcatacagacttacgagatggtagctgccagaactagaactctggcattatgcaggcaaacaagcgacactcaaatgcaacagacacgtgattggaggcaacattctaggaccttcattgacagaatagtatcggatttctataccagaaaagcctaaacatggcactgtgattccactgatactcacaataattctgtttcggaacatctaggagagccacataattgtattcccaatttccatcaagaaccccaagtctaatcatagcacaaacaaacaaacgcaaggttgaaaattgtgaggatcccaagttgcttactccaactaagatacgcaacagagctacctaccacagagctgcaacaggtaaccagaatgtcccaatttctcatcattgcaagcacaaatgccaatcaatcgcccaggagcagaatcaataaatacccggagcctctgggatccaaaggggcgctcaccatcggggtcgaagaagaagacctggcgcgtgcgcccgtcgggctgcgtcttctcgaacacgtacgtgccccgggccttcagcccggtgaggaacccgtcgtagtcggcgacggagaaggcgaggtggtggcgcctgggcagctgcgcgggcggggcgcccgcggcgcccggggcgacggccgcgggcgccgccgcggggtcgcgctcgatgatgtggagcgcgacgccgggcgtccccgggaggcggagccaggcgacctggaaggccgggtagttcggggagcgacccgctcgaagccgagcacctcctcgtagaaggcggcgaggcggcgcacgtcgtctgtctcccgcgcgacgtggttgagctgcagcgtggccatcgcggcgagagagcagagaggagagagagcggagcgcggcgtaggcggaagaagagtgagaggagaggacggcaatgtgtagtgccgcgcaccgcacacgtgtgcgctactcgaagagaggagggggttcgagcgcagtgtcacatatttacagagtattaacatctatatgaaagagagagtataaacgaaaaaataattaattacacggattgcgtgtaaattatgagacgaatcttttaagcctaaatacgccatgatttgatgatgttgtgctacagtaaacatttgctaatgacggattaattaggcttaataaattcgtctcgcggtttacatacggattttgtaatttgttttgttattagactacgtttaatattcaaatgtgtgcccgtatatccgatgtgacacgccaaaactttacacccctaatctaaacacaacctcagttttgtttatctacttcgtgtttgtgttggtgtttatccctatgaacgcttactagacacttccaaaagattgaatcggcataccttaagattaatgaagtcagcgttcacaatacgtgcaatcacctatatgaacacaaccttacccctaccctataaacagttttcgaaagaatgcattggtatatcttaaaattaacgaagtacgaacatcccgttgtcgataaatacataattaaccataaatacaaatacccgtgttaaattaggacttaaacctaagtaagctaatttcaccaaaaaaaacctaattagttgagccatgtccactccgttattgattgatgagtttttaaggtcttgccaaattaatcgtgtagaatcgtagttgaatataacaagtcgtggaatcgtagttgaatcctggcagaatttgtggaaaacagaagttctagtcataaaaaagacagtaaaatgtagtaaacgactattaaaggtcaaggattgttccactcatctttggaggacattgtcattacatagaggggatgagaattgctctcattcattttacattaatagtagctcataattacaattccgttaagaggaaaatcgctttcggagatttctcctcagcttacaattaacacatacatccatcaacaagcatttgatatggaatgatgcaagatgttcatcagcttcattcattcaggtatcacggccttgtgttgcgtccacggtgacctatctatcttttgcctccccatctcctcttgaagttgcgctcatcatcgcttgaatcctcgtaagtaaggctcctggaactgtgactggacctcgctctgctgtgcctgtcaccaccggttggagatgaatcctcgtaagtaagcttcctggaactgtacctggacctcgctctgctgtgcctgtcaccaccggttggagatggagaagacgcgcgcattctcttgctgctgcggtgatcctcggcgtaatcactagagcggtgatcctcgacgtaatcaatggagcgcctatggtccctcctgtcagagcttgacctgctggtcttgtaactgggatcggtgccatgagaagagctcagacgctggttacgctctgatgatcgagactgattggcaggttcaggttctttgggcttcgccgccagccttggacgtgcagcgtcttcgtttgcccagtgaatcatagattgagtttcccagctgaagatgacgaataaacgaactgttaagtgttgaaatggaaagaggggttctacatgactgacagccaagtgtaatatagggaaattaaaatgcaacctttctaagaatctcttgaccaaattgttctattagttaattttgtcgtcattttactattagtactggtgagataacaagtctgataacatacataccagtgagtatttgccaaattgccttgcattgctgatggaaattgcagtggcatgttgccgatggaattgacaccataagggcccatcggatagccaccataaggcatgcccgctgggccgtacatgtaaggatcggttaaccaaggatacccactgacgtaagggttgcaatacgcagggtcaaatggaatgctgtaaccatagttagcattgttaggatgaacaattttagttgaatctgccttcttgcgcttcttcttcaattgatcagtcttggaagctttgggttccatggttcctgaaatagtggccggctttgaagtggagtcagttacatcttttaatctggcatcagcagttggtacaatcttctctaccaatatccctgcagaattgccttcatctttcacttcgagatcaacacctgttgtcaatttatgctcaagatggctaacatgttctgtagcaacttggaggccagcatcaggagcagctgatgatatgtggtgatccttagattgcttttccaaggcagctgaaggagtttggcttgctgaattaggatccacgttgctgcctgaagagctcctgtgcttccctgtaccactagtgatgctgctagcccttgttgccagcatattgctgattgtgctccgaagtgtttggttgggaatcaggtcatctgcaagaaccttgactccacaaatgcacttggattgtgtaatgatgtaatcacgaatgcctgagagaagaacaacacagttattagctatgcagttgaggacaggcaggaaatgctatcacagagaccgctgttattaaactattaccgttgaaaacatgtttaagcatgtatttagacaaagttttgagtattggtaaattactaaatgtttatatttgtcttggaaagtacttaacagtgctataattttatcgagttttacaaatatagtactccctctgttcttttatgtatgatgttgtttagttcaattttgaactaaccaacatcatatattgaaggatggaggtcgtacaacaataactattcgtaatttttcctgtcaaataccacgtcaatgtccaaaacaacatgcttctgtgactaatttgaagcatgactagccacatttcgaatatcaaagtaatgacattgttcatatccacagcaaagagttaaggagaaatacagaatttactcacatttatcacagaaactgtcgaagcagcacttgcttgtcaacaccgcatctgccatcactttattacatagccggcaatggagctcagctggcaagtcgtcaacaacactcacagatgcagctggggcaagagctgatggaatgccatcaataggacatgcagatacttctggcacaagagtatggggcttcttgtaatcgtcaaatttgggatcaccaatggtcgggcaatggtgaataaaatgccctggaattcggcatctgtagcagacatagccagatggaggtgtctttctctcctgttggcaatgttgaatgaaatggcctggaactccacagctgcggcacacatagcctggtggaggtgtctccccttcgaccggtccatgaccttcagttataatagatagatatgtcaaaacaaatgcagcgcaatcatataatttacataacaacaatacaaagcaaatcattagagttctggcatcagaaaatggtgaggaactgtctagcttaaccaatgataagttcaagtgaaaaatgccattacaatgtgcatgaccatttgtctcataacaaatcaacaaccatgattttttccattttttaaccaacttagtgtccatatcataatcataactgggacaacagaacataaatctgaaccaaagaggattccagcattaccataacgtcctgacgtaaaccttccaccagtctgtcctcttttagatggcttgtcttccctgcatgcaccaagatacaaggctgtcattaggaaggtgccagaaaaaattgatacctgtgaggaaagaaaataagatgcactaaccatttgagttcagctgcatcaattatagatgcgattgcagcatcctcatcctgtacttctgtagaggaacaagattttgaggttgattcagtaatctctgacttgtttgaagctatagcaccatcttctataacttcccgcctgcaattaagcccacaatgccaagtattagtatatacaaacaaacctctcctcagctgattcagattcaatccaagcacttgaagtaaaatctcaaataaaagattgtggagaagacatacgaggagaacaagacgattttctctgattgttgcccagaagttcggcggaccaacacagtcgagttctgcggtatcatggcattttcatctagaaattctgttttgagaaacaaacacagaaaacagaaatgtcaaaagcattgcactcaaacaatactccttttattggtgaaacgaagtcttctcatgtacaagatgcgcttaaacaacaaaactgaactgtccagatgaaattaaagaatattttagtaatagatcacaaaactgggaattttgtgggaacaactgaggtgtaatccttgtgaaatctgggttcacgtacaggatggcaaaagaagacgggatggtggaagtacaatttgcaagtacaaaccttccacaaggattactggacaagatgtacaaaaaaaaaaaagaaaggaaagtgatatggcaaaacttctcatccaggaacaagctcactgaaaaaaaaaacttatatggacatatctcgtcaactggcgaaaagatgaggccatcttccactgcaataataatgtgctaacacctgtgtccgagtacagtatcttaagcacgtaaaatggacctccattacaatcacaaaacaggatttcatcctctctaaaatacaaattaggatgtcacagggatacagaaacattgaccatcagatgggaatcagtgacacgcaaaactgatagccaatgccattactggaacatttcaacaacaacataggaagaaacataataaaaccatctaataagaattcatgaaatgggggaaaataataatcagggttgtaataacatatttaggcatgtcgaacatgcgcagactgaaatgagcttacacttaatatcattatattgacaaagcataaagatcattaaaaacatctgaatagcattggtatgagtcccaatattgcattcagatcaaccgaacaacagaatatgatcaacacataggagtgcctaatagaactaacacatatctagattcctaattcatatcttgcaagaacgttcaattcctaattctgatcaccttacaataattactagttactaataatcggattgacactttgcccaacacttgacctagttaaacttagatagttacattgagtaggatatataaaataagtttgtttcacatcagcaaaatattgggaacttggatgcacgcagaataatagctaatgggcaaaattgttattacttatgatgtatcttaagctttcctaaaggttacagcaagaattaataatcgacagaggcgctaatatgccagcattcttcattgagaagaaatgctgggtacaatgccctgactcagtcctaattggtaaaatcatgaaccaatattatcctacaggctaaaaagataatccatatggacaaaagaaaaaaaatactattccaagtattatccaattcccagctttgtgatcatacaatgatttgtttcagtgattcaagccaattaacaggaaactgatgcggttacggataaacgaatgcgttgtacagatagttaactaccttcgccggtctgggcgttggagaggacaatatcttctctggggccgcggccacgggtgcggccacggccatgtttgtcgctcgtcaagatgagctgcttgagttcagaaacagagacaaaagaatggggcacgggcacagaaatagtttcctttgaactcttatatttgtaatacacaacacccatggtgttgatatcaagttttttttccccttctcgcctcttctgcacaattatttttttttctttcggcgagagaggctgagactttttccctcagatatcaaaatacacaaataatacacagagatagagagttacagatcgaatcgatctacggggggaatcgcgtcgatcggcggccggcgtgtcccttcgccgccgaggaggaagaagacgaaccccgcgcgagtgagtcccgagtcccgacgaaggaggcctgcccggagtcggaacgcgagaggcgggcggagtagaggaaggcgccgagtcgaggcgatggcggggaggggggggggcgagcgcgcgcgggcgggcggtcgacttccgccggcgtcgctggcccggatgcggatgcggatgcggaggcggagtcctcgccggaggcggccggagagctagggtttccgtcgcgttcgccgaatagaaggggattttggggggggtggaatttgggggagaaatccgcgagcggcgtgcagttggagtcggtggcggtttataggcggctctggcgcgataacgcgtgacgggaaggaatccgacgcggtcacgtctcttggcctctgcttccgtttccgtggccacgaaggttctagctttcggtgtgctggaaaaagtgatctatcgtgtgtgcgcaatactcgccgacggcaccccagtgttgcggatgtttgtgcggtcgcgaccggctcgttactgggccatggtgggctcgcgcgacgtgtgggccatactgggccatgtttgtgcggatgttgatgtatcgaaatgatcaatttacaagttgttgtacttatttacacccaccacataagtttatgtaccgtgagcgcaaaagaagataaatgtttcacacgtgtatgatcgttttagaatggtcatttcattcataccgctgcatgcaaggataacttggcatgcttacgtggcattttttgtgtgtccaaagactatattaacctaaataattaatttgaaggatttgtttggacgatttgaaacatagaggactgaaatgagcccgaagcgaaacttcagggaccgtattggctattcaccctttttattaatagcctagcaaagtattcctacgttgcaatggatgaagtcaacaataattgcatacatggatgattataagaaatatatcgatactaactcaaaataaaattatattttacatattactaagtttatttgtcttgattaggtcacaaatattagtagttactttattccaaaactttagtgattttattttggaatccatagtgaaatcaaattgcatttttttaaaaaaaataatcaaagctagctttgtttggcatttgcgagcttcatggctgaaattaatttgacaatctttctctgacaagctgcatgagttcattttatttgacattgatgtcctgaaattgatatgaatatcagatggtgtttaaggaaaagtacttaactaaactattttattttagtaagttatatttggatccttaaactcccatgagattagtagttatattgattattgacgtaatttctatgaatctgcatgtccaaattgatagcattagcaaaaaagggctgcatgcgcagaaagtaaaatatgaagctagtgctagtgctggccatatttatatgctgaaaatcatctagagtatctaggcactgtttacatcccatcccataatttttcacactatcatatcaaacgtttaaacatctatgggaagtattaaatataggcttaaaaataactaatcgcacagattgcgactaatttgcgagacgaatcttttaagcctaattgttccatgatttgacaatgtggtgctacagtaaacatttgctaatgatggattaattaggcttaataaattaatcttgtagtttacaggcggaatctgtaatttgttttgttattcgtctattaatacttcaaatatgtgtctgtatatccgatgtgacacgccaaaattttacacgaatctaaatacccccttattagtcaaatctttgaagctgcatgataaatctagaattcagccttacaccggaagtccttcgaatcaagcctgtgtctggcatgatcatatcacacaactgaataattgttttttccattgccttgcaaagagaagccaaacccaggcgagcacctgacagagagacacatgcaggtaaacctgttgttgctatgtctcgaattagggccttcccaaacaaaattttttacgttgtcaaatcgaatattttaacatatacatggagtattaaatgtagaaaaaaaaccaattacacagttcgccaggaaattgcgagacgaatcttttaagcctaattgcgccatgatttgacaatatggtgctacaatatttatttgctaatgatgaattaattaggcttaataaattcatctcgcagtttcctggcggaatctataatttattttgttattagactacatttaatactttaaatgtgtgtccgtatatccgatgtgatataaaggggcaaattttttttttgccaactatacagtcccttattcctgtcctttggtaagagaggattttagcattgcatcaaagcgcagaagcaaatcttcctttccaaggggaaatcaaacgtgaccaacgtgtaggattcacgggaacaaacgaaaacaaaaccaaaagaacgagatgcatcgcgctgtgtcatgatcaagaaagcaagacccttcacatggcactctgctcccgttgcattctgctgatttcatctgtcaccgccgcctgccggtggccaagttcagtccacgaccaacatgttccagatcacagcaagcgtgagcgacgcatatgcgcgagcttttggaaagcaaagcgcgatagttttaaggctacatataccagcgaattaaatgttccgtctcaactatcggagtagtgggaaacgatgggtgcggtgacaaggtatagatggccatatgctctgaggcccatggcctggcccgaagcacgccattttggtccggcccaagcacgatacggtccgactggggggggtcatgtctatgccggcccggcccgacccaacagctgggtcgtgcctgggctgcaccctcggcacggtgggccagcctggcatggctcgatcaaataaaaaatatatatggatgcaaaatctataactaatataaatattcgtatttttccggtcgtcacatctatttttgtcccgcttcgtccacgtacgcaatccgattcggttagcaataccatggaaaaaaattgcaaaaaaaaaatcgcccccctccccccaaaatcccaatcggaatccaatcaaaccccaaaaaaatcccaatcggagttcaatcacacaacaaaatcgaagaaagcatgatgcatgtacacatatatatccaaataaaaacaaaaaattagatcgaagggggtcgccgccaccgccgtcgtcgccgaaccaccgccgtcgccgccgcagggatggctggccgccggcggctcccctcctgctggatctggtggaggggagagtgccgccgccactgggacgccgacaggccgccgccgcctcaccttccgctagatccgccgccgccgccgccggcggagggcgctggcggaggggagagcgccgccgccgcctccccttctgctagatccgccgctggtggtgggggagggctccgccgccgccgctcgcggggcgcctctcctcccgctagatccgtcgccggtgatgggggcccctcccgctagagccgtcgccgccaccgccgtcggtggtgggggagggctccgccgccgccgccgccgctcgcgggaggaggggcgccgtcgccgccgccgctcgggggcgctgaggggagggcggcgaagagagagatgggagggaaggaaatggactagggtttcggcggctgagggagggggttttgtttccccgatatcgacgctcggccgtccgatcaaaaccctagagatcagacggccagcgttggataggccgaaattggcccaagagggatcgagagtgaggccacttttccggcccaagcctaggttgcggcctggggaggaaaagtgcgcccgcgcgtgcgcaaaaggctgtgggccaatcggcaagggccagaaataagtctatattaggtccctcgggccggaaaaaagagaggttcatttttttcagaagcatttacaattatacttattgaatgtgtttatttctaagtaaacctaaaaggaaggatttttatctttttccaattaaataattattaaatgatgtttgcattattaaaattagcaattaagctctgaaaattccaataagattccaaagagcgtaactaatcatggagaattcaataaaattaaatttaaccatgtcattttatttctcacacttgctttacttgtatatttatttaattatacacatacctacttaaaaataccaaatatttcagcgaatttgtattttaattaattgcatatttttctgatctgtacgcttcccggtgcaacgcacgggcacttttgctaaaccaaacaatacttttggtcaatatacacactccgtaatcacccggtgcaacgcacgggcacttttgctagtagacttaaataaccgtacacggcaaggccaaaagagaagagaaatacaaattagactcattttctactttgactcccttaaaagtgacccgaatctaattcatgaccctcaaccgtaaaaccggataggacgactccccaaactattgaaaccagtgcaatttgactcccttagtggttttggagggcggttttgctgatatggcgctgacgtggcgatgttgacctagtctttgtcccacgtggcgcttacatggcagcaataagtccactttgactcccttaaaagtgacccgaatctaattcatgaccctcaaccacaaaaccagataggacgactcccgaactattgaaaccagtgcaatttgactcccttagtggttttggagggcggttttgctgatatggagctgacgtggcaatgttgacctagtcttcgtcccacatggcgtttacgtggcagagcggagcacgtgcgtagaagccaccaccaccaccgccgccttcctcggccccgacttccccatccaggagacctcccagacggcctacgtttcgccgactcctcaagatcctcgtccacggtacgcgcgtgcgacgcgtgttcttcttgtgttattggtcgagtcgtggtttcttcttgccttgcttacctacctccgtgctcttgcctcaccatgttcatcgcttcttgtttcggtggtgagattcttgatctgaggtgttgaaatgttctgaccgtaatatccagaatcgtcgtttgcattttaatttcattaaagaacggagaatcaactggtgaaatgcatcgtatgtagcaatgccgtccaatttcttcagaactttttagtaaaatcgtggaatcatgcgtccgggtaatatttagccatcaggtgttcgaccaattgaccaagagaatacatggcagtgggacccacaatatttttatgtgtgaatcacagatgggtcccacagatatttcttttaattctaatgccacataagcgccacgtgggacgaagactagttcaacatcgccacgtcaataccacatcagcaaaatcgccctccaaaaccgctaagggagttaaattgcactggtttcaatagttcggggattcatcctatccggttttgtggttgagggtcacggattagattcgggtcacttttttaagggactcaaagtggacttattccttggaacacatagcttaagtgcttaggctcaagcttgatataaactcgaaccgagtctatactaacatcgagtttacggttaggtttgggcttggctcgaacgagcctcgagcctaatcgagcttgctcaaaaacaataaaatacaagcttatttataagggaacatagcctatgtacacaagctttctatacacactaattaacaaatgtcacaaaaaaataaaaaaaaattgtagtgcttgtagtactatctatggaacacacactgacacaaaactactgacagcagacacagtggcggaactatgtgtaagttgtgtggtcgattgaccctgcagtttttttcactattacccttactagtcttaaattttccatataaatccatttatatttacataaataaccccactaaaatatcaagtaataataattgactgcagagtaaatttaagccaaaatatagggataggttttgtggggtttgcttcattagagcaggtacaatagcaggctattagctagttataaacatattttaatgagataaacgatgaaagagaagagcagcgggctatagatctgtagccagctgtagcacggtgttaacgaccaaatttggtaatctgagtatcggagatgaagaaggaatcgaaacggagttcgagatggagatcgtcccggaaacagagtaaagatcggctaaagtctgaatcggctgtgatcaggatcggcaaagtctaagttggacagggttagctgattgagctgaatccgacaatatgacacggcatatgttgtcgggttaggttgatgtacttcacaatgattgccaaacatggatagagtcctgagaaggcaactgtatctattaattaggatattttatgtaatttccttagagatttgtttgggcaatagtctgccgcaaagacttatggtatcttagagtttgttagagataagagtcgtgtaacatattttgtaatctcgggtataaatagaccccgagccccatgtaatcaaaacaacacacgttcaatataatctcggcacatcgccaccctttaacttacgttttgtttcgacgagttcttactttcgggttgagctgcatcggtttcgatcttcaacaagaggtaaaacttgttatggcggtttgcgttctcaggattagtgcttccatctttatgatactctaatcttgcttacgtaattcgtcgagttatcatatatcttatataatctttggcaatatcgctatctaaccttcaatcggctaacgtctgttactggaaggcatccaattaggttatataccgacattgatttagattatataagatatctaccactctatgacacattgaacagcttgattgtctagatattgccattcttttcatacttatagctgcatcagttgagtttgatcttatgagtcgtgattagaatctcaatctctagcttgcttttggctgctgattagggtagcatcggggtttcagcctatcttacctgatttaactacttttctcttatgtgcttgattgacacgttaaatctgcctttatattaagatcttgttgcatttaagtatattaggcttttgtttggtatattctacttgctttgatatcttaatatggagtactattagagtattagccgatacatgctagatctatctgatcgactatgctataaacatatatagtctcattgttaatatatatttcgatctaagtgatttatactgtctcggcatggtaaccgatctatcccaatcacttgatttaagcatatatcgacataatgattatatattgttaatatctatagccgatcgagtagatttagctctttcttacttatttatgattgccgatcaatccacatatgacatcggcttagagataaatgatatgtcatcggcaactagccgatcggctatcgtttatggatttaaccgcggtctctttgtctttatttcttgttgattgcaggatcaaatcaactggcacgctcatacacctaaaggcaagcttttggatctgcactggagttaagcagatctcccaggtctcgtgtttttacatcaacatacggactccaagacacaatgtgtttatgacaggtgggactatatattaatagtataataagcaactattgtatgaattggttattagattcgctatagataaattgaaggtagtagtggactgtactattaaacttgctcttaggtaagggtgcatcattcattgttctttttagtttcaatttaaacctacggcttaattttttgtttcatgtcttacggtgctcttttagggtgaagctgaatttttctatgctggccaaggccacaacctctacgaagccctgattggattctgcttaggcttcttcgactgcagcttgcagtgatcgcatttgctgccatcttctacagaatcaacgaagcaaccgtggacagaaggaccgaactgcttcttttatcttttgctttgtccttctcaaaaaaatgctaggacctttatgtaattcatccaatcacatggagttgtcatgtaaaattggctatgtacccggtctttggtctttttttttttaaaaaaaaaagacttacggcttaattagctagggttttcattgataagggttatggttttttctttacaatttggagctcaaattagctcaaaattgtggccaagattttaatatatgaagattcacattagaaagtgtattcatccctcgaggaaatatccccttatttcatgtataccatctaaatagtcataaaaaaatttaaaataaattgataaaatagattaataagaaatatatcactctacaaatatgcaagttaaaattcaacttctacaaattataacaaaataaaaaatataactacgaatttacaataactattttcattttttttgctaaaagttgaatttggcattgcatgtatgtggagtgatatatttcatattaatctatcttgtcatttttttaaaaaaaaattggtaactatttacgacatgtaagcaacgagtggacatcctctcgcgagggataataatccatatctgattcacatggttattccattatatgcgtggcttaaaagatggggattatgtgctactccctctgtttcatattataattcgtttcgactttggtcaaaaagtcaaactactccaagtttgcttaagtttgtagaaaaaatagtaacatttttaacccaagataaatatattcaattatagattttataaaactaatttggtgttgcaaatacaactatatttatctacaaacttatctaacttagagtagtttaacttcgattaaagttaaaacgaattataaagtggaacggagggaatagttcttagtgcgaccccaatctagttgactagttgttctaaaagatttaagtataacccgactactgaaatgaatgctaaggacaaagcctaaacatccaagcctaaccctggcgctgatggagtgatgatgggtggactgttgcgacacctaggcatggtcgcggcaaggcacagaaacaaacattgaaccagactagacgcttgcgaccaattgtctcaaggttttcagtgtcaagtttcatcaacttgtgttgctagctaggtttctattaggggttatgattatgatgataacaaaatgtacaacctgtctgtaaggtctgaaacatcgttttggagtaattcacacttgaagtgagctatactattgtgtacttgctacattcacggtgaattcttgtttatcatgcctgaaaaaacgtcagccatcgatatttctctgctcgtttctgcttataacatacaaatgggcgaaccaatggatgtgcaagtacccggatctc

SEQ ID NO: 69938 - DNA, 1623 bp, Oryza sativa
acctttttcgctgcatttgtaatattttgtatttttgtaagacgtggatccgtatgtcaacaattgtcgtttgtgtaccctggctggtcctggacaggggtttaatacacattcagcttagaaattctggttcgtgaatttctgggcgtgacacaacctagctatgatcagttacaaaataccatattgtcttccttgacgagagaggttagacaatgctttgccaattttccattttatagctttataaaacagttttcacaatttcaatgtactttctgcagaacattataaacaactcttctagatttgaccttggtccactgccggaatcaaattttattgccacaaaccgaaaagctgcagtgcagccgccaataacgacagcaaccaaagagggcagggcaacaattcggaagagaaaagctgagccaaggaagagaaatacgcaacccaataagaaatcagagttgaagaaaagggaggagacaaagaaaaagtgaacaatatattcaacttgataaaaaggattagcttataatttagccagaagttctgtttattttttgccaaccaatcagacatgtttcattttggactgtgctctgttacattgctctaagttccaattcaggaacatctcttgtttttcctgtttatacaacagctatttatggtaaaacatttcagaatattaggagcacatttctgccaggatttgtctatggacaagaaaacataccacatatgtctgtacagaaattgctactggtcaaagcaatgttagcaaaattcaggttatcacttggacatacaattccaaaagagagaatacaagcagtatttgctacatcgtgttcaccattcatttaagtagctaaaaaattcatgtatcccttatataacaaaagcacttccagagtatttacaaaagcacctacattgccattattcactcacatactgctttgacagcaacaaagagtcaaagagtcctctcactgtggtacaccagatgcagttatcatgatgctgattccactatggacgaagaatcccataaaattacagcacaaaaaaatggaaggttcagattctcatcagttgaagggaacctactacggccatgggcagcgatggtggcttcaaggtctaacaaccccctgcactggctttgagtcctgacggtgccgtggccgggcttcgtgtcccatcgaccgctgacccacgccggtttcgagtcccgaggaccgccgccaccagctttgagtcccgacgactgctgccgcacgccggctttgagtcccaccgaccgctgcagccggaagctacatatttgaggtcctatccctcatggtgattaattgatcgtactagaaaatgtcctcaaatgggaaaaacaacaggggatttgtgcaaaattaatatgatgtgtaaagggccctcacgtagactttgtccaaggtggaaagctgacgtggcaaaaaatcttatgtggcagtcttttgaaccacaaacgcacccacctagccaagttgttgcatcgatatgtctaattttcaagttcttgtacttaatcgcacccacccgccaagttcttgtaccgtcaacgcaatttactct

SEQ ID NO: 69939 - DNA, 813 bp, Oryza sativa
ttcatccattgggcgtcagcttgtcatggttaattcgccggtaattactatgtcatcgcactgttggcaaccaaaatctactgggaacacgtatgttcttttccttttcttactggtattttttttctcataatcctctgttatcaaaagcagcaaaatatagtacgtactaccaccatagtacttgtattacacggcatatagaataaatctccaatagcaacgtctacgggtgcatgcatcaggctggcattcagccgaacgtcgtaggtgcagtcgcgcgtccagatcaatgcgcggcggcctactacatgggtcacatggcctgtgcgtgcgcccacgagcgccgggggatcatggccttgtttggttgacttgagggctctcgctcaggcaggtcgatccagctgcagacacaaaattagatgtcggagaattgcgtctgagtcaggcaagattttcagggcaagaagtaaccagaccccatgtccttcgtttgatcgactcactctcacctatgtgttctcccagtccctccattgctccggcaaagagagatcatgattatttatcatctagtctatggtcatgtttgaaaaagattcaagcagcacaatgtgtattagtaaatctctacagctactccaaacaatctagatttgaagaatcagcaactgtggaataaaaataaactaaaggcatttttcagcttcgctaaattgattactaagtgattatcattggttaattctcagaatctcaaacccccctaaatagagggtacatagatggttttatatgcatcattgtcac

SEQ ID NO: 69940 - DNA, 684 bp, Oryza sativa
tatcagtatcataattttaaaaccctaattaaaacacagtagaaacgcatagccgtcatgccgataatgtcacgccccgaactagtcccgaccggaactagcccgtgacgctccaaattaacctgttaatcgataccagtcccaggaaacagtgctggtatcacagggagacagagtatcacagcaacataggtctcttttttatagagtagaagtacagtcatgttgggctgcggacagatcccgagatcacaactgcattacaaaaggaaagcggaagccaggacttggaccaatcgtcacaggcgcgacttgggaactaggccgaaaccctaaaactcatcgtagccgacttgctcctgaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacaacacggaggagacagtgcgtctcgtccggtcggagtatgtgcaatgtatcagtctttagatcttgaaacagggttggcacccggccaatagcttttcaaacggccacccgggccaac

SEQ ID NO: 69941 - DNA, 7027 bp, Oryza sativa
ttcggatccagaacgaggaggggctggcttgcactttgtagcttcttcatacacagatccatcaaaacacaggagtagggtattacgcttctcagcggcccgaacctgtatacatcgcccgtgtcttgtgtgtttccactctcgcgaactttccacagattaggagcttagaatctcacccagggtccccggccgaaccggcaaaggggggccagcgcggtctcccggtgaggagctccacgctccgtcatctggcgcgccaggtagtggcctctgcgtgtgttcttctaagctctcgcgctctttcgtgtgcgcgaagcttttcctgttcagcccaatggccgaaccagcaaaggcgcacaacctctctccgagtgttagcggtgacgacggggagccgaacccacgccgtcgagctcgtactccactgccccctccacgccaaagtcctaggcgggagaaggcgctcgagagggccgaaggatccgcgacttcggcatccacgggagatggagaagggcggcgagatggggagcgtcgcctcctcgtctacggcgacggcagcacgccccagggtgcgctccaagctgcaggcgcgctcctacgtcacccgcccgtcgcccatgacccggagtctccagcccaacgttggctggacgatgtggccaaattggtcatgacggcgcggcagcgcctagatgctggtgggcggtcctccgccaccaagacctctggtgctgctaccaccggctccgcgtcgtcaaaacggagggcgcggcgagcggcggccgctgttcgccattcggccgccactccttcgtcagcgcctccgacccggaaagatctgcgtggggggccggatgcccgcatcagtatcgagcgccggcgtaatggccggtgtgctgcccacgcaacggagggcgcctcctcgtccggagtgtcacctcagcacggacgcggggatcggccctccgtgcccccggttggtggtgtcggctgtagagcctttgtggcgagccttcggaacgtccgttggcccccaaggttccggcccaccatcgccgaaaaatatgatggcagcgtcaaccccgccgagtttctccaggtctacacgaccgggatcgaggccgctgggggtgacgacagggtcatggcgaatttctttcccatggccctgaagggacaggcgcggggttggctaatgaacttgccacccgcatctgtccactcttgggaggatttgtgccaacagttcaccatgaactttcaaggcacatatccgcgcccaggtgaagaggcggacttgcacgcagtacagcgaagggatgatgagtcacttcgctcatacattcagcggttctgtcaagtccgcaacaccataccatgcatccttgcacacgcggtgatctacgcgttcagggggggtgtgcggcacaaccgcatgctcgaaaagattacctccaaagagccccatactaccgcggagctttttcagctcgcggaccgagtggctcgtaaggaggaggcatggacctggaacccctccggttccggagtggcagcttcggccgcccccggatccgctgctcagacagggcggcgtgacaggaggaggaagaagaggtcaccccattccgacgacgagggtcatgtcctcgccgtcgagggcgcttcacgggccacccgaaaggggaggcctgcgagcgatagaaagaaggaggccagcgctcccagcagggagcgcccaaccggcaagtggtgcaccgtccacaacacctcccttcatgacctcgcggactgccacgcagtcaaaagtttggctgagcggacgaggaagttggaggaggagaggaggcaggagcgccgagagggcaagtccccggcggttccttccggcaatcggcgaagtgaggccaagcagaaggcccccgccgaggacatcaatggcggcgatgatgacctaggtttccaagagcctggggccgccattgccactgtcgatgggggagcgtgtgctcacgtttctcgccggagcctcaaggccatgaagcgggaacttctggccgcggcccctactcatgaggcgacacgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatggtgctccgaccgtcccaaccgattatcggtgtgacgccggggcacacttggccgctaggtcatatcgaccttccagtcaccttcggtggatccgccaacttccgcacggaacgggtgaattttgatgtggcggacctcagtctgccctacaacgcggtcctagggaggcccgcgttggtgaagttcatggcggcggtccactacgcctacctccagatgaagatgccgggccccggtggtcccatctctgtccatggcgacctcaaagtcgcgcttgcttgcatggagcagcgcgcagaccacctcgccgccgcgtccaagcccgagggtggcgacgagaggcttggcacctccgtccccgccgccccgaggcagcggatgatcacatgcgacgaggtcccggtcaaggaagttgccctgggcgacggcccgtccaagaccacacggatcggtggtcttctggacgacaaataggaagacgcgctcgtctccttcctgcgggcaaatgctgacgtcttcgcatggagaccggcggatatgcccggggtccccagggaggtgattgagcaccgtctcgccgtgcggccgggcgcaaggccggtccggcagaaagtacggcggcaggccccggaacgtcaagccttcatccgcgaggaggtggcgcaacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccaccgcggggtgtgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtgaagacgcgcaaccgagacaccttactcacagatctagcggaaacttttgagagtctccgctccgcccgcataaaactgaaccccgataagtgcgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcgccggtagcatggccgccctaagtcggttcatatcgaggctgggagagaagacgctacccttatttaagctcctcaaacgctccggaccgtttacttggacggaggaagctgaacgtgccctcactcagttgaaggcgtatctcagctctcccccagttctggtcgcctcggagccaaatgagcccttgctactctacttagcggcgaccccgcaagtggttagtgcggcgttggttgtggagcacgatgaggacaatcctcattccgcgcacccccaccctgtgctgacttggcccgggagagagcagggaggagaggcccccgagccgaacggtggcccaaggcccccgacgaccggagctggccctttgcccacttgtcagacggtgccaggtgcccccgacccccaagatggcccggcggccactgcgggaaggccgcacctattgccctccgaccccgaggctaactctgtgccgactcggcccgggagagagcagggagaagaggcccccgagccgaacggtggcctaaggcccctgacgaccggagttggtccttttcccgcttgtccgacgacgccaggagcccccgacccccaggacggccccgaggccactgtggtaaggccgcccctgtcgtcctccgaccccgaggtcatcggcacagaagacgagtgcgccccacgtggccacttggacgaagagcgccccaaggacgcgacccctagcaaagaggatcggccccaccgaaaggtgcagcggcccgtctactttgttagtgaggccctccgggacgccaagacccgataccctcaggcccagaagatgctttacgctattctgatggcttcaaggaaactgcgccattatttccaggcgcatcgggtcacggtggttacgtcttaccccctcggccaaatcttgcataatcgagagggtactggacgggtggtgaaatgggcaatcgaactttctgagttcgatttgcactttgaaccacgccacgctatcaagagccaggccctcgccgattttgtggcagagtggaccccggctcccgagcccgtctcagtccccgaggccagctcgggcccctcgcagctgcctcacaccgcctactgggtgatgcagtttgacggctccctgtctcttcagggcgccggtgcgggggtcatgttgacctcgccgagtggagacgtcctcagatacctggttcgcctcgactttcgggcaaccaataatatggcagagtacgagggactccttgcgggactcagggtggcagctggactggggatccgccgcctcctggtattaggcgactcccagctggtcgttaaccaggtctgtaaggagtaccggtgctctgacccgcagatggatgcttatgtacgccaagtgcggcgtatggagcgccatttcgacggaatagagcttcagcacatgcccagacgggataacacgattgctgacgaactctcacggctcgcttcctcgcgagcccagaccccaccgggcgcctttgaagaaaggcttgcccagccgtcggcgcgacccgaccccttaggggagatggacgcgcctgaccggcccccgaggcccgtcggagtccaggcctcgggacccgaggggagtgctcccagctcccttagattgattgcttggattgctgagatccaagcatacctcacagataagactctacccgaggaccacgaagggagtgaacgcgtctagcgcatctccaaacgctacgtgctggtagaagggaccctctatcggcgtgcggctaacggaatcctcctgaagtgcattcctcgggaacaaggcgtcgagcttcttgccgatatccatgaaggcgagtgcggagctcactccgcctcgcgcaccttggttggcaaggtctttcgccagggtttttattggccgacggctctcaatgatgcggtcgacctggttcggcgatgcagagcgtgccagttccacgccaggcaaatccatcagccggcccaggccctgcagatcataccactttcatggccttttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgagcttttcggtgactactgcgaagacatgggcatcaagctctgcttcgcctcacctgcccaccccagaagcaatggccaagtggagcgcgccaatgcggaaatcctaagaggccttaaaaccaagaccttcaacatcctcaagaagcatggcgattcgtggatcgaggagttgccagcggtgctctgggcgaaccgaaccacaccaagccgagcaaccggggaaacgccttttttcctcgtctacggctcggaagtggttctcccatccgagctcaccctgaggtcccctcgggccaccatgtactgcgaggctgatcaagatcagcttcgcagagatgaccttgactacttgtaggagcgaagacggcgcgcggccctccgagccgcgcgcttccagcagagcctgcggcgctatcatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggcctaacccatggaacatcgaacaccttcgtcgcttctacccctaagggggatcgggtgtcaggttttggcctcgggccaaccccgcacccccctcgggagtgcagggttggccgggggctaccacacatgcatatttttatttctcttatgtctgctcttatatctgtatttcaataaaagcattttcgatttcctgaaggctgtatctgttctgttgtttccttttgaagaatcttaacttgaaatagctcactcgcgctcaatcctgtcctcgggggctcgggtcggctaaaatcgccaaacggggcccagaaccgagccgtgtcccggggcgtggtgaactccgggggggaatcggcaaaagcccacaatcgggtcacccataaccctcggtcacgacgcttccggcctggccagtctcgacacgtggatctccccaggcactagccccgacccgcgccttttgaggactgggacctgggcacgagcccttaatcaagctaagacacaaaaggaccacggctcagatcatcctcatctcatacacatagcaaaatgaaattgacacaaaaatttcttcattttgattgcagattaagtt

SEQ ID NO: 69942 - DNA, 530 bp, Oryza sativa
cataaataattaagatttatatcaatttattggtacagaattatggaccaactcgcttgtgctagagagataatattcatggatgtaaggctattatggccccatttggcacagctctagctctcaactccaacttacctggagccggagttgtgccaaacgtccaaatccactttttttgagtggagttggcagagctactcctagaaaatgaactacgggggtggggctggatttttgatgctccccagctccactccaccccaaaagacccactaccctctaatttttttagagtatttacacgaaaatgctactcaactacccctacaatcctcctttcctcccgttctctctcctcccctcccaatcccgagcgggcgccggcgacggcgggcggcggtggcagcagcagcgtcggcggcggtggcggcgggacgacgacaggcggcgacaggcggcgcggcgtgacgatgacgagcgggtggaggccagcggcggcgggctgcggcagcgtcggcggtgggggc

SEQ ID NO: 69943 - DNA, 733 bp, Oryza sativa
ccgaatgtgggccgagacagcgcagctgatcggccattccattcgtcccgctgcctcgattctattctttgccgtcgccgtcgcacgctcatcctattcccccacaccgactccccgtcagctgcccagagctactcgcctgaaatgttcctcatgtactccacgtagtttcctgcatctgggcaatttcatctcgtcagatatagtgtctggtcactggtgccctccaagaacgggcaaagctttgtcatcgctctagtctgtgggtaaattatttccgtcacaagatgctgccatggaatgctgacaaggacctcagtcctctcctcactcagccatggtccatggaccaggggcatccgcgttgccagaaatcagatcctgcacctgcacagaaccctttcccgtaccgtatgggccgccgcgtacgtacgctgccgtgggggcggccgagttgctgcagcttgcaagctgtgctgcgtcgagtaattcattaaaaataactcttattatccgaaaagtttttaatgtgcaccgacaacgcattcgcatatcgcaacagagaaattttgcgtgctatgttcgcccattggcatggaccatgagttaaggtaaagtgttaattggtagtcatatttggtccctactggagttgatttgatgtaatctcgctaccttgtcgctatcgattccgttagcgttttaaagacttgatttgccgggctgcaggaat

SEQ ID NO: 69944 - DNA, 1026 bp, Oryza sativa
  unsure (1)..(1026): unsure at all n locations
tccacccgtcctgccgccacgccgcaccggatccagtggaagcagcgcccagtgtcacggcctccacgctgcgttgccgcaattatgcgtcaccgcgtggggcccactcggcagtgagaccatgcaggctccgctgctgctgtcatcgcgagaaagcgattagcgggaggaggagtaacatcgaaggaaacccactaatcccggattattttgagcaattaccgctctaatccggggcgataagacgagggaaattactaattaagggaggggattaaccggtaatggtctttggagctggagagcttcgctataaaagagctccaatggcgtccctcacacctccccgcccaccattcccactttcgcccacacacacacccagatccacagccatcctcccaccgccgccgccaccatctccaagcccacgaacacccacagcccccgtgagctcgagcgaggtaagaaaagctttagatctgagcgacttcgagcgtcttcaaggtaaagttttctcgaaaccctcttcttcttcttcctcctctggctcccccacctgttcttctacggtttcttggttaggttgcttgcagagagcgagagacccagggccttttagatccagggctcccagatctgctgtttttctttcatcttctttgtgttctagtgttaggttggtagccaagaggggttctttttccacacctcacttgctagatctaccaccaaaaagccatctgtttttttactgtggctgtcgatttctccctccttcctgcctgttcttgattttggattcggaaccaggcaaatctttgttactactgttttagtatcagaaaaaaaaatcccaaaaaaaagagtgagagatggctgcagctatagatctgtcaggggaggagctngatgagagcactcgagccttttatccgagatgcctccggctcgcctccggtttgttcccagtttagtcccacctcgccattctccttcccgcacgcgttcgcgtacggtggcggg

SEQ ID NO: 69945 - DNA, 24599 bp, Oryza sativa
ttagtattcatgccactaaatagttagccaaatggctccttcgaatgcaacctgaggatgtgttattttctcccctttaattcccaacttatactccctgttttctatgggcacgcttcccgaactgttaaatgatgtgtatttttgtgaaacttttctataggaaagttgatttaaaaattatattgatctattgttcaatttttttaaactaatacttaattaattgtgactagttttatacagttcaaaagaaaccatgaataaacattcatagtagagataaaaggtgataaaaggtggtgagcaagtgatcattgttggtcgtaggagcgagagagcggataagtggtcaataattaggtgggagcatgctgggaacgaattaaagcttacaggagttgaagtaatttgatacaatagcaatgacggccaagaattaggcctcaaataccctcgagttggcccttgcccttttaactagagaacttttacggtaccgtaagtatatactatcagtatcagtatatgatagggtagatttggtatttgttaaaaatctgaaaaggttgtttagtcatttaaaatagagatttatttccataggatgaattttaaatcctttggttgttttttactggatctcgtcatccgcataatttgagcaatttttgctttgtaatttgagcttgtaacagctgtttatttcagcccaactctatgctgcattgctccaaaaaattgtgctgttaaattggattctctaatatatcgtctaaagttcgaaacgatgttaatggttttggagtctgaacattcttctttcaaggccttctctggaagactggaacttgggagttgacttagatagtagtcacagaattgttcatacattagttatattggcatgtaaccatgctaattacgtacattagttatgctaattatgctgctctgccgctgccacctgccaccgctagtctgccgctgccctggtcctcgaacgcgccgatgatgccgatgacgaaggccgtggagaaggactgcatcgccgtgctgttggacaccctgtggaactggagcggcgtcaggaagaggcgttcgaatcgatttttcagcgccttgaagatttggggatttttggaagaactaggttttgggtgaagaaaaggtgagggaaatcgaatcgattcccgatggcggcggcgccgattgtggttgttgacggccgcgcagcgcggcgtgctcgcagaggcagtaagcgacggcggtcgcccatgcgcgcggcttcgagaaaaattcgctttgactaggcgcaaaaggccggatctgactaggtgagaaacgcgaatttacaaaattactcctcacgcaaatagataaaaagacaaaaatgccctattcaatttatactgcagaataattgggaggaagatcagatgaatttacatcgttagatcaaatatactggtagtatatacttcaaatagaatgtaccgtaaaagtcctaaactatttgtacacgaatcttagacaaccatagcccactgattggtggtcccctgctgttcaacatatgtagatatatatctttggatatatcatgctccaagcacatgccatacataattatatctgtaatgattcacgtttagaccaactggccctctccagtctccacatacaagttcatgatctcattccctacacaaagatcagaaagagagggagagatcagaagccatttgttggcagtactaaggcccaagcagacagtgtcccccacccttgagtaaataaaaagaagattcttggggtacaactcaagttaacacatacatgaatgaacatcataatacctgaccggttaaatcaccaacagtgatgagtgagatggatgatattaacatcaccagtgtctacaccctttctactttccagtgttggatataaatctttgtttctaccattcacacacaagggtgggtaaaaatcgcggcgaaatacaaagtgcaaatgtgcactttgcaggggcttcataatgggcgcgtgcgcgctagctgcctaaccagcgcagccgcgcacgcccccttcttaggcctctcctcctaaacgctaataatgccaattagcattgatgatgttaattattgctaataataattgttagttttagttttttaaaaaaatcataattagaacttttcactcaaatttgaaaactttcaactcggatttgaaactttcaacccagatttgaaaactttcgactcacatttgaaaacttttaacttgctatttgaaactttcaagtcaagatttgaaaactttcaactcagatttaaaaaaacttttaactaaagatttaaaaactttcaactcatattcaaaaaaaattaactcaaatcttaaaaactttcaactaaaattgaaaatgaaatattcaacatctaaataaaaaaatcacgaaaaaagggcaaaagaaaacttaaaaaaacgcgtggacatcgcttttccagtaaaaaaaataacttacaacgtggatgccgttcgcttcatgcatgcgccaagttatgtggggcgtgggcctcgtgggcctaaaacacgcgccgccaacgcgcgcgcaaattagctctcgcgcactttgcatacttggcatgatatatttagggccctttgactcgcaggattgagaaaacgtaggaatagaaaaaatgtaggattttgataggaatgtaagtgtaaaacaaaggaatgtaaaacgcataaaaaacacaggaatgaccgtttgactgaaccgttaggaaaacacgggaattggatgagagagatagactcaaggaaagttaccaagaggttgaagctcttgctaaatttcctccaaaatctctataggattgtccattccatagaaatttcattcaatcctttgtttcaaatggctttataggaaatttttccataggactgaaatcctctaaaattcctatgtttttcctccaaatcgaaggggcccagtttgtcgtcgtttttaaccacacataatgtaccaactctactaaaatttgatagttccaaaagttctcccacaaaaaaactattgaaatttggtactgttaaaaaccaaacatattaaatgctaccaaaattttgtaatgtcaaaatctagacagattttagtaagattgctcgacaaactgaacaattccttagttacaccacagaaggtatgggccaagaagtagacttttttttaagaaggggagtagctgtttatccgagtggcaaaacttcaggataaaaatccaaaggcttgtttacaatttacagatgagttgaacagatatcagtcaaagccactcaaataagctgggcctactagcccaacatttcctctctttcagttacacttgggagtactactctataggcctaaatgtcatttagagcaagtttaatagtatagcccactactagttttaattcatctatagccaatctaatagccaattcatataatagttacttattatactatgaatatatggtcccacctgtcataaacacattgcgtcttggagtccgtgttgcagctggctacagatctgtagccctctgcttttctctctaatcatttatctcattaaaatatatttatagctggctaatagtttactatcgtacctgagacagcgtatccagaaccattttggctgggctccagaaagataatctctcggttctattggcaagcagtgcaggattgtagctcattaatgcccttgtctcctattcagcggccagctactccacccctacgaggtagccactccctgacaacaatttcatcaactagtagtaaccctagtagagagaaaaagcaccaacccatgtcttccttttctgccttccatagacacaagaatgctcggacgtgatgattgggctccattatttggtcagcactgtgtgggctctcatgtttgtactgccctaccttggcttcactgatggctgcttgtaaaagaaaaatgtccctttgtttccttctgaacaagaggattcttttaaccttttctagtgagtaagaaaagtaaaaggagaggatgaagagaagctgctctgaattaatcagatgctagctagaaagaagaaaagtctgcacaaaagcattcaaactaagttattacttctactcctttctctatcccaaaagaagaaaagtatagtatagtttttaatgtgaaagagatagataatgatctaatcaacttgagttcttattccatccgtcccaaaataaatattactcccccgttatcacatatatagttataagattcaaattttatacactatataagtatatatcaaagacaactattccaatgcattggaatccaagcattttcaaccaattaggttcttctaaggagaatacaaataattcagaatttaaaaattgagcactgagatgactgaaagtggatctttttctttggtaaataacttagaaatgtttatatttaagattggatggagtagcttaatactttaatctacatggtttcttaccatattaaggcacgtaccaaggacccatcaattggctgattataatctataacggcttatgtgcgatatatctttagtgacttaaaaatctaatgctgaaaaagaaactaagtaaaggaaatactgtaaaatcagcacaaaattaattttcataggcttattctcggtaagcaaacgataatgctgcaaaacaaaaaacatgtgacagtactctctctggacatgtcatatgcaggaaatctgcgtctgattcatgtataccccggtaaggagcgcgctcacacaagtggcagttgcgcgcgtacactgcagagagcgcgcggctgcggactgtgcgtgcgtgcggttggctgccgcgccgcgccgccggtttctgacggacggcgccgtgtcctcctcgtcgctgcggcagcaactactactgcctctcacagatcgcctgcttctgtctcacacatcacatggccctctcgacacggcgacgtgtaggcctggagctccacctgatccccttgtgctggttgctgccacacggatatgatctgctcctcctcctctgctaccctgcccttttttcttctccatgccttgcactgttgcttccccaactgctccaaccattctcgggattggaggtagtagtactggaatctccttttgtgtggggtttacagccttacggttttccttcttttttgagacacaccctttgacagtaacagttaaaagagcaattggatgcagcactgcactgtagttgtcctggttatccattttatttttaagctactatttacatttacaagtatgtaaattttaataaatcagactcatataattagaaatagactgagagcccatacttaacgagtcataccatataattagggagaaatggtggttacttttcacgtatggacgcgctgtgtgtgttgggatgacaggatgaaaggagaatgattctgtttttaggacagtagagatatcctgcaatagtgaaagatgcacaaacttttatctggaggtcctcaactatggaaggatccacatgagcttagctgtttagccaaatctctgctgattcatatgcaccatttctgtacacacgcagcacagtagcaaaggtgccgtgcaaagtgtccaaaatataatcaccacctgatatgtgtgcccgccgactcgcattgatcacttgccgacccagctttctttagaaccaagcaagcaacacaaggggtcgcgagaacgaacaaaaagtgaaaaaaaaaaaagaaaagaagctcatcactactcgcagagagaagcaacaatgggattactgagtactgacatggattagccgtgtctccccaaagagaaaaaaagttagacgaggttaatcaagtggccatcgatcaccacggtctctctctttctctcgctcagcgatgatgctcttggtccggaccaaaatacagcagcagcagcagcagtacaaagctctgacgctcgggtcccacatccgtcagaccatccgtccgtccgtccaagattcaggagacgaagcccatccgttggatggaccaaaagatgccgcggtcgatgcatatgtaaggatgcagatgcaggcagcatgctgtcgtcgaccgacccgatcgatcgatcgatctgtctctactgcagcacgacatcgccgtctcacagggcactggaaatgatgggtcgcctgcctgacctctctacacaaatcttaagcctagagacagacactgatataataataaatagagattgaccgggattttggtgctgtttgttaatggtgaccatccgacaaaatgctctatcaccgtcctctgcgtcctcgctctgcaccgactgattcaccacacttcacgttccacctcaccggagggtaaatacagcaatcaccgttccacacatttcgtacaattttgcttgtacaaaagctgatcaatttcgtgctcaaattaatagtacaaacccagccgaaaagcgctcacaaagccaaacaaacactcaatgtagcagcagcagcagcagcaatcagcatgagtgcccaccattgcttttttttttttttggtgccgtcttctccgtgttgttcgtggcacaacaggacatgatcgatcggtcaaagggtgaggggagaacgagacgacggtgcataaaaatcaaatggaatggaagcgagaagggagagaggagaggagcatgcatgcatcgttactccagtacgctgcgtacagcggccggccgcgccacgatctcgctgtctgctgctgctgcttccaactgctctctgctctgctctgcttctgctcctctcttcctctctaaaaagcgtcgccccaaccaacctgccccgtcctagctaaagccatagcagtaggcgggctacgcatcatctcccgatttggcaacacccatattgctgcagtgcagttgcagttgttgcggttgcagtgcaagagggagaagaggagtttcttggtgagggagagggagagatgagggacgtggtggtggcggttggcggcgggacgaaggcggcgagcaggcagcaggggcagggcggggtgacgttggcggcggcggcggcggggtcggggtcggggtcggcggcgtcgccatgcgcggcgtgcaagctgctgcggcggcggtgcgcggcggggtgcgtgttcgcgccctacttcccgccgggcgagccgcacaagttcgccaacgtccacaaggtcttcggcgccagcaatgtcagcaagctcctccaggtataccgcacgatcgctgcttcttctctcaatctatcgtcttctctccctagctgccatgccatgacatgccttgccttgcctcctcgtgtcgtgtgtacgcacgtctcacgagccctcaattccctctgtttccgtctacaatctctgtaccgccttctttctctgtatcatcgcgctcatgcacacacagacacagtcgagttactaccagttcttggatctttttttccttttcagttccgtgccaattcattagaaagatgtgatgtttcttgccattgtttagcccacagtttgtcaaatgtgtagtagtgcacaaaattgatatcttgtttcgccagaaatggattgcttatttttaacatatatggttaagaaagtttccccgggccataacgacgatgctagtactagggataatattggtttagtggtttcgtttgattacggtgttttcccaacatgtagcctgcaattctcaggaaaaaaaaattgaacgaaggcctgataatctcagaatgatatactgtattagatggtgtaatagtagattctgaatacaccgagattttgacaaattcggcaactatattttctgtttactagcagccagcctaaattcatttcctgggtatgccaagttcagaattgaactttcagaattttgcacttgttcttcagttttcaccgtgagtggcacatgtactgggcatgtgcatcaaaataaacatggcaaagatcctactttcactgcccactgggtcctcatccatgcagcaacccaaagcatttcttatgtgctaaagatcacctagccaaagaaaagaaaaagaaaagattgcttttttttttgtgagcaagttcgagtactgcagtgtgttgtagtactaattaaatcgacagagacctcagcatagtgatctccaaactgaaccctcccccatgtgtcgagccgcctgaaacagtagcccatcagtggtggtatacggcctcgtcctcacagtctcagcagccttgggcagtcaccttcacacaaggctcgcacatgctgcgtaaaaagaaaaagaaaaaaagctttcggctgcaccaaacatgcaaaaatgtccctaaaaatccttccttccattcccttttcttggaaccagagagacacccccaaatcgccaccatcttttctcaatttcttctccttggccctagcctcctagtagccttgtcacaatgtcactggctcactgtgtgtgtgcttgcacgattgtcaggtgggaatggacgtttcttctaccttgtcatgtactggtgcctgcacaaaaccagatcattcagatgtgacttgactgaaactctgctgctatgacaatcatatgtctgaaactttgggattgtggtggaatgcaggagataccggtgcagcacaggggggacgccgtgagcagcctggtgtacgaggcgaacgcgcgggtgagggacccgatctacggctgcgtcggcgccatctcgtcgctgcagcagcaggtggaggcgctgcaggcgcagctggcgctggcgcaggcggagatggtcaggctgaggatgagcaacgactacatcggccgccgcctccgggcgcgcggctgcgacggcggcggcggaggcgaaggcgggagcaccaccaccaccaccggctcgccgtcgtccatgtcgtcgccggccaagacggcggagccggagccgctctgcaagcccacgccggagctggacatggtggtggaccagccggacttcggcttctggtcctactagggctttgatcaaggtagtactactagctgattgtagctgtgatgatgatcaggtgatgtttttggagttaagtgacagatggtatggtatggtatggtatagtagtagttcatagtagagtcaagcgagtaaagtatatggcaatgtgtgcgcagtagcagcgtgacactgggagggaggtgaacataggcagagaggcctcctcctaaaccttcttctactgggatatatcaggggctttttttttggctgtccttctatgagaaggtagaacactgttacagacattgggtgtgcattcactgagttgtgttatccattgcaagaaactttgttgctcgtgacaatttacttggttgaaatagctgaactatgctgtgggaaatgcagatggtgctatctatgtttgtacaaatgttctttgattctgggcttgttttatgacatgtgacccattagcagagatgtaaaatgctttagtttgattaagtagatatcagactaatattgcaacttaaggttgccatgaggcttaaatactttcacgattgtatctgcaattttacaaggctggctcccatggatactatgggcaatgaattgctacccattttttacaaatacataaataaaacagacaccctgatgtcggacagaccccatcacttcataacctaatgcaggttcatatgacccaaaaattgcagctgcatattggacgccacacctttagatgcaataagttaatccaatcgaataacttcacattatctgcagttcttacaagaagttagcataatttgtcatgataaaaatttctcagcatatgaatcatggatggtgaaacactttatttttgtaagaaaccttaccagaagcgggaccaatgtgaagcatatgctctatggtaagcttcggttcagcaagccttggaaagagaggtaaagatctttgttgtctggaccaaagatctcttcagccttcttgagagtatcctggttcagatgtaaatatgctattgtaatcatgtaatgacataatgtaatcatgtctcataaactagccaacagatgcaagtgtggtacctctcttgattgcttatgagcattgagttccttgatgttggctaagaatgctccaaattgttcgtatgataggcggctcctggaattataatagagttctatcaatgataatacatctatcttggtttcgatttaaaatttgaagcgcaagatatcaacagacctggcctgacggaaaaattcttttccatcaatacgaggagtgcgacctgaaaacccaagcattatattacattccatacaatagcttcagaaaacatataccttcagggttcaggataaatgaaacctgggttgggacgtccccttggaggtgagttagctgctgacgattgcttgcttgaggggtaccatggtgtcatggacatgtatccttcaattcgagtttttgatggtgaagtagttccagacatcaattttggtgttgctgttgtagacattcttctcggagaagcagaagttgacataatttttggtgtagcttctggagtaaggcggggggtgatgtgtgatgagagggcatacttctgtattggaggctttgacactgtacctaagagaattagagaaaattcagtgcatggaaacttatgttgccagaataattcaacaaaatcaaaacaaacaatgagcgaaaagctaataataccttcttggactgtgcttccaacatccagagaggtgctcagtagatttgttgtagtgtgggtgatagaatctccatctgcaatgttcaatgaaaatattagtgagagattggtgccggacattttctatgacaaatatatgaagggcattcgaatagggcaaaacctccacaagatgatgcttttgatgatattgactgatcacatgtggtaatgtcaaccgtttcttgtggctgcttgggaggattcagcagagaatcaagcgcaaagaacaaacattactacaagctagagaagaaataataaaaatggaccaataattgctcatagtccattatgggatccattggatgagtagatgaactcaccgatggactatcatcacgtagtgactgcatcagatgcctcttgaaggactccagctgatagaagcaaagcaaaggaaagaaaaaaacagaattcagagtgttgtagaggttagatattagaaaagacagactgataagctgaacaaacatcttactcattgcttaaacagctcaaaagaaagtgaaaagaagaacagcgcctcatttttttcagtcctaaaggagttcttgcatcccacagtgggattaccactatttttgtgatcaactatccagggatcaacatggatgtgggattggacgggcagtattcatttcagaagaaaaataaccagctgatggacaatctttacttgcctttacattggctgcaatcagcaaaatgacccttcttcgctatcgttataaatggcattaaacatctaacgaactccatacttactccctaactcactccaatttgcagcataaaagcgcactttcccctgcttctcctaaaattaggcagcattcgtttggaggacattgagggagaaagcatctcgttttctgcacgcacgcttcccaagctattaaacggtgtgttttttgcaaaaaatttctataggaaagttgctttaaaaaatcatattaatccattttttaaatttaaaatagttaatactcaattaatcacgagctaatggctcacctcgttttgcgtatctacccaatctcctcaatccccttctcctcaaacacacccttaatcttcatagatagttcaattagaggcgtctagtcaaaggtggaccatctaataatacaccgacagacatctacaagcaagcattcgaacaatgaagaagatcaaataaatcaccttctgcaggtcccgcgccagcttcttggacgtctgcgccaacgagtcccgctccttgctcagcttaatctgcatccacaaaagcagacaccgaaatcaaatcaacaaatcgaggggaaataaaaaacattaacacaagagagccgcggggcgccaccgacgttatcctcgagcgcggcgcggagcctggagttggtctcctgcagggcgcggtcgagcagcgcgacgcgctcccgcagctccccgttctcgcggtccttgtccgcggcggactccctcagccgcgccgcctcccgctccagcccggtcacccgccctgccacggccagcgccgtgatgcgccgcgcaagatccagctgctcgtacgggtcccgcggcatcaccgccaggacctcgtccgccagcgcgaactccccctccgccagtggcattgccgccgccgccgccgccgccgcgcccgcgcgagatctcgcccgctctctgcttgggtttcgccgccttcggaagaaggggaggggagaggagaggagagcgcggagaagggaccacgcgacgccgcggagcgcttggagattttcggatttgaaatggggggagagggagaggcggatggggttgggggggacagtgcagagcggctcggcggccgaagcgaggtttgaaattgtttttgggggagagggcggccgcgttggcctcgtttctgttgttgagtgggcgcgcgcccaaagtagcaattgtttgaaacgacccgccttgtttccaagcaaaccccctctaaaatagtagtacttgggtgtgtttagttcacaccaaaattagaagtttggataaaattagaatgatgtgatggaaaagttgaaaattcatgtgtgtaggaaagttttaatacgatggaaaagttgaaagtttgaagaaaaacttggccttgcttggagcaaaattggaaacgttttttcttcgctcctaaggagtacttaggctgagtttagttccaaactttttttcaaacttccaactttttcatcacatcaaaactttcctacacacataggggctgtttggttgatggtcataagttgccacacttgaggttaggcaagtttgaccatgttaggtgagtgtttggttggctcccataagtgtggcaagattcctcttttgtaatctaggtctcacatgtaactgactctgaaaagtgtagcatggttttattttgttggctagagtgtggcttagattttgaaggcctcacctttggcaagtttagctaagagaagtatggtgaacctaggcaacgttagtatgtgaaccaaacagccccataaacttccaacttttccatcacatcgttccaatttcaaccaaactttcaattttgacatgaactaaacacacccttactacgtacactatggatgtgtttagttcctgaaaaaagttggaagtttatatgtgtagaaaaatttttatgtgatggaaagttaggaacgggggaaacggcctataacagatactacacatataattagaaatagatcaaattaacttcaatggaccaggcccatatatttaagaagtgacggtgattatgtactaatgcactgagcatgttagcataaggggatggaaaaaaaacaactccgcttttaagatagtataggaaaaaaccataaatgtataggatttttaagaatttctcttctcccaacatataaaaacctaatttaactccctccatccttaaaaaaaatataaaaaccaggttcagggatggagggagtacacaggaacgttctgattttgattcagattcacctgctattttcaagtgaaaggatgcaaatccctcctgttgcatgcttccaaaacgtacatgggatttatgggccattcggttcagttcggtaccaaatgcagccaaagcacgccttacacatcgaaacaatttcccgtgacaacattcgacgaaagagaacaaaatcacagagccatcggtaaattgtcttgtaacaaatccaaatcgaatataatttgtcagcacaaaattgcattgacaagctacacaattcttttgtagaacacacaggagcgcagcgcaagcctgcaatactgcatgttgcagttccaacctatatagggtacaaaagatttcaacagaaaaagcaaaatgagatgagctgaagaacatttctgtacaagaataggccgggcttgcccattcagacggtagggaatgtacacatgtcatgagtaggtacaattcagcaaccttactcaacaacgaaaaagaaaagaaattaacagattctgcagcttaacgcggtatgttcagccgacacaagtctgcaatgcatattcgtcattatcctttgatggtggagcgggcaacatatcagcttgcttaataacataggcaactttcgcccaaccgccctccaccagtgttcttcgtctgcaattcccttctgttttccttcctatattttctatgttacctgaccattttcatttcgaggtggatcagtgtaatcttgaccatgatcacggacatctctaaacatagagaagaaagatactatgccatcagaagctccgcctcctagcaaccacaataaaagggaaccaaatggattcaaggagccagagcctgccggagcattgccaggttgctgagggttttgatcttgatagtgcagaggattgttggccactaactctgcattttcaattggttgaccctcttgttggttcctgttaggctcatccggaaccagcagggcatctgcttcacgagcagcaccaaggccctcattcattgcgccagggtccctcatatttacccttgctatatgtaatgttgatgtatagatggttgaggatgtgatctgaacacccgtttgttggtgaaggtgagctcggcttctaatgaatctctgaagggctggcacctaaagcaacacaagccaagtaaatacaatggggacatggactttttttttgttttgctgttaaacatgcattaaatatacaatttgtcccctacttgcgtgaaccctaatctatttcctcagtgaattgaccaagttcaggtgatcattccagtttaataaatgaagatgaaagcaaggctagcactaaatcctaagcagtgttcagaaattagaaatggcctaatatcaaaggggaaaatataaaaaaaaattgcaggccaaagcaataaacaagcagtaatgactgataagtccaaaataaagaacaggaaatacacaggtaaaaatgcatattagcatacctcgaagcggttccaaaaatataaaattagatgttgcatgaacgccgcggtggcagaaaaggccaggtaggagaagcctgataaatacagaaatatgcaagtcatatatcgataggatattccagtagtttcttgccaatataggtcaccaaaaagacatatgtagtcataccatatgtgtacgagaagaagtaaatgtggaaaaccaagaaatacagcaagaaaaagcgcgggaagaactgcattgatatagatgtcctcacactgcaaaggacacaaaattcagtaaattcagacagaccgaatttgctatgcatgacaacaattctgataatgcatgcttgaaagttgcaaatgttaaatgcacctatattatgctcaagtgcctactattctaatctaattgctctctcatatgactaaaccctgtttgtttcctcataatttcacatgaataagttagtaggacagacgcttcacagcacagaaatctcacatgattaaaatagtatttcctcgaaatagtaaagcattccagcaatatgtatatggaaacagtacctgatcatcgtaaatagctcacacaaccatacaagagtcaaaactagaaatgcaagcaactgatcatcatagaactcaaatagaaaaaagaggatcccaatcattatctgcaatgatcacaacaaagaaattagtaagatatgagaaatctgttgagtagatacatctaaacagccacaaaattttcagctcattaaggaaaaaaaatatcataccggaacaaaaaccaatgattcgataacatggacaaatatcagttgaaatgtggggagttggtggcgtgcatgatgttgaagctgcactgaaattttcaatgaagaaaacaaaatattatttattaccataagataatatcataataacaagttgagcatctagcaggccaagaaacaacgtaaagcaataagcacaaacctgtgaacctaagcatgcgggattgcgtctctctcagggtaaatgaaacagacatggtggttgtgaaaaaaacaaagagtgacattaaaagtacaccacatttcgtcacaaaataatctgcaccacaaaagttgcaatagataagatttaaatacgcagaaatgaaaataagatatgaaaggcaacaaaatagaattatcaggtggcatgtaagctggtggaatcatctggtacaaatttataaagcattaaaaccactaatagctgaacacattataaaagtgcagtcattcaggtgaacatatttgggatggcaaattttgtaaaatcagcactatacaaacctccaaatcttgttggacctgctggtggttcatgtccgtaactgagatcataaagctcctttgtttgaaagttgtataaatagcctgcatatcaaaccaaagtacaaaatatgtgagctaactaagtttgcgacagttgcatagaacatcctgatagttaaaagtaccaaaagcaaaatcacatcagaagcataccatgaccaggggagttcactaagctgtttgtaagtatagtgtcatagccaacaatgctgttgattaaaagctgttgccacctgaaaggttaaaaaagagagattggatagcataagaaaatagcggtgggcatgaaagaacagtggagcattatcacattctgcagatacccactacagaagcaaaatgaaagaagacagaacgaatgcaaaatcttgtttaagttctcaatataaatgacagatttttaagtagcaattagatattccatatttgtaacgctagaatttttatgcagctctttgaaactcagtaaatgttccaactatttgggtacaagagcaatataaaacaaagatcaataaacaaaatgagaaaattccttgcatgccatccaaagtccttacacgccatccaaagtttatgagtttgtttcctaatatgccatgtcgaaattattgttccattcaccaatgcctaaacttctcttgccttttttttttttgccattctcatcatcctaatgttagcaaactgttacatgggcggtaagatgaccattgggccctccatatcttcttcaacttgtctccttcctcttccattctttcacgccacttcactgcgcctacctcccatgcaactgctcccccggttgcacatgctttctcgatctcattgccccacagcacacaaccaggcatggaaggcgaggacagcaccaccataccatctgtcatggcatcacagcagatgcaagcatgtgtggtatgcagcaatctgaatccattttttttcttcatgggcacggaaatgaaccccagtctgcagcaggcgtacatacggtgcccgtgctcctcctggcaacccccctcccccccccccaacaaactctctctctctctctcctctctttagacataacaaaacaaagcaagcactggtatctagccataccacacatagaatggccttgctaagctgccagttcaacagaggtgggaagtgagctgccaatccaccatgcggttcacgccatcataacctagcctcactaggtgaagggagcagtgatgttgaggccccagctttcgcatccaatttgggaggaactctctgaatctatgcgcaaagagtaatttcaccattatcacaagaaaatgataatgttcctagctgtgattgttgctagctaacggaagagcgacgtggatggcaaaagagggcaaaaaaatttggttcgatggcatatggtggaatgacagcttccaatgcatttaaaggaactcatgaactttgaatggcatcaaacaagtagacttgccagagcaatgaattacacaaacatgaacttttgggcagaatcaggacataaaagttagaatctaatctaagtagcatgaagtagaaagatgtcaagtggaaacttttggagacacatctagtgtgatatgcccattatgaggagcaagtactcgataatgacctatttccaaagcaaggatttcgagcagaaattgtgatatttatagtccgaacaccatgacgaactttggccccttctgaaagcaagaaatatccctgcaggaaagaaggcaacatataagagagttcttgaagtgagtgatagttgaattctccagtcatttctggcaaaagttgattcttactttgctagggagttcataaagaagtaatcaagcaacttaacaacatactagaacaaacataattaagttgaataggtgataacaatatgccaaaatgaaccttaccttctccacaccatataaataggtaggttcaaatgctttgcttcgtctctcaaaccactgtactgtaataaacaacataccacgagaagttagagaaaatgagacccttgtgagttgacagcaaagggcaaagataagaaaagtcatataggcaccactagatcatatgaccagtttactgccagacaacatacctattgttgaaacaagatgatccacgcttggtaattgaatacccttgatggtatggaggaagtcattccagtttgatctgaactgttgttaaaataatcaagaaaaaataaccctcggtaaatgagtgcatgttactttgtttaactaattaagtgatacagataataaaaagcacaaaaatcagcatcacacgaatcatgaaagagtaacttgatcaaaataaatgttatttcactgcatggcattcaaacattccttaatccaaaacttgatgaatatcatttatatgagtaagacatatgttgacaaatcaatactactagtccacaattctccaagtgttcctcacacagcaagttagatatcaaggtgacatgcgccaagcaaccacatggactaactactactccattacccgcataaatgattctcccaggtccaactatacaagaatcttttgtaataccagagtaacataaagggaacatgaatgctgaaatgataacaatcaacttcttaccattaattgaaaagtattatctgaaagttgttttatattcctccagaacgagacaacacgaaagtaccactttctgaataaatacataactgctgctttaaatgattcttttgcggataatggatggtatgcagaaccctccacagttgtcttcgaatccgatactcctgaagtggttgcggtaatagctgtgtcagctgcattctctggttgtggttcaaattccttgtctcccttccaagttctgaacataattttgctccttctagctccaggaccaacccaagttgaccaaaacttagatgccaaaatattgaacctatcaccattaacctctagaattttctcagctgaacgccccaggttctgaagatccataatgtaggatgcacctttgctgacccatagtccaccactgattatctacaaatttaaaggcagggaacaaacaagtcataccaataggaaacatgagctagtattgcaagcaagggaaaaaacataaggaatattatcacacttgagtcccaagtgcaaaaaggagaaaatgctcgacacacttcacagaatagcaaagagtctaacagcaagaaatgcaaaatagtgacaagcagcaatgtgtaccttgatttggacaagttgcgcttcaccaaattcaatcccagaaaactcgcttgaacagccaggcttcacatgaaaaaggtaactcaaagttgtgaggctacatatgcacactagactattatggaacaaggtaaaggaaaaagaaacaaccagataaaaaggtttggcatttttctttatttcaaatccaggatattgtgtttctaagttgaacaggagatagctttcagcatgtaaatatatatgaatgatactttttaggagatttaagggttgtagttgcatgcacttacaagtaagttatgatgtgtgcacaacgcagtatacttaagacatggaacggaatggtttatcaaacttctattttgttctagtttccacgtggtactaaatcaattgcataaggatcaacaaacacgtcaaactggatgcaatctacgttaacactaacacattcctagagagtatataatctcgttcatttgaagtgcagtagtatttaccagaataggaggggatcactactacaaagttagcttacgtagcaataccctcatgctttttcatctcgatatgttcacactataacagaaaccataagcatattcatacacattcgaagaaaaaaaaatcatcttaaagatttcatattaggcaaaccaaatgcaaatttggcatgctgtttctgggggagcaatgaatagaggaatagctggcatatcatagttttacagtagcgtgggactattccagaacaagcagttgcagagaagaacaaaaaactagcatacaccaaatctgaaacaatgcggtattgtaagtacctctgcaggactaagccagaagccaggatggtcaggggatcactaatcgaaattactgttacattacaacttaaaaagttgctaaaattataagtgtttcctattcagtagccaaactagagaaatccagcaactactgcgcagtgcgcacacaggtaactttgatactagcctcaggcttgctcaattttttaccagggcgtcgaattgacaacattggcgaacccaggccagggcagttcgcacaaaattcgcaacacccaggctagcacgaacgcgcgcagtacaagcacgggcagaagacgaagaagggcgaggaggggcgggatgctcacctgctgcacgaagttggtgtgcatgacgacgagcaggcagaagagcgcgacggcgccggcgaggtagaggtactcgagcgcgaggcggatccgcggcgtgagcagctgcgacagcatcccggacagccgcgcgtgcacccgcaggaacgtctgctccggatccatcccccccccctccgccctcgccgacgccgacgagccccaaaccctaaccaccgccgcgccgcgccgcgggcactccacctcccccgcccgcccgcctagggatcggaaaattcgaggcgttcccgatgaaactggctttaggcgacggtggaattattcgggggaaattggggagtgattttgaatttgtacgtttcgctttcccccctctctctgttcctcgcctctctgtcgtcgcacgagcactgcgagcctgcgattatctctgcgaggattctttcttggggaatgggccaagaggtgggtggggcccgcgcccgcaggaattttttttttcctttttttcctctggcgccggcacgttggttggccctggctctgcgagcggttggccgctgggattaggccgccacacgagcgagattttcttcttttttgtgtgatcggatggtctcgcgttattttcggaggagatcggacggtccagacgtccactttttttgctggcttggccaccaatttttaccgccgtggacaaattgattttcgcgtaggaagcacatagggtgatcgcgtcgaactatcggagcaaaaaataactatcgttttatgttgtgtgatgcttatattttaaaatttaccattaaaataaacggttggtttgttttacagataagagatgtggttagtgcaaatacccttatacattgtatattgtcaatttcaattatgtacaacataagtttaaaaaaggagcagttttacatcctcaaggagctatggtatcttttttttattgtaaatttagtatctcttaatacctagatactattaggtactaaattttacattaaatttttgatgtatcataatacctcatcaagaatcgtaaaatttctcttaaaaaagttaagtttagcaaccacttaaatgttcaagcataattataccaaacgagatcatcataatttgggataacgctagccggacctgaaaagctggtggtgaacagctcggcatgaattttagaagtgttttttgctggtggatgcaacctgataattggtgataagattaattaatcttctttcttaagttcagtagcaatgcttgaagcgctatcaggaaaagagaattgcaacatttaggaaaagaaaacaaaagagagctttttatctcgaaggatacgaggtggtgggctggtttccttccggaaacagatcaaagtgggcctctttccccgtgttggatataggctgtgttcggtgggagtttccagcactttcttattttcggcgcgcatgctttttaaactgctaaaatatacagtttttttaaaaaatttctatagaaaagttgcttaaaaattatattaatctattttttaaaaaaatagctaaaacttaattaatcacgcgctaaacactacttcattttacgtgcggtgagtgagccatagacgtgttagacccaaacattaaacggtattaggcactactatttgcattggaaataagttatttttcaatttgacgtgaagttttaaattcatttctcaaaaaaaaaagatataacgtgtctttcaactccacaatgtaaacttgattccaagatggtttgaatgacgatttctgctaaggtgatatctatgtggctagtttgattggggttatcatctcacatgttgttgatgtggcacttgcaatcataaaaagtcggtaggatccacatgtcagtgattatatggttaaaaaaataaaaaaaaatacaatgggtcccaccttttttttcctttctcttctcttctttctttcttgcttcttctcctcgttcccttctattcttcttggattattttttagtgtacctttttctcgctcacgtgcccaggacagacgccggcgcggtggcgggaagcgacagaggagaggcagcacagaaaggggtcgccgtgggctggcgtggccgagcgccgcaacgccctggtttggccagggcgctggtggcaagtaggcccgttgggcggcggcacagcagtgggtggatccgtggatgggcagagcgaggaggttgctcgcccttattggtagctcgggaggaataaacggccacacgacgatagccctgaatcaaggcgaagacggtggcatgctccggtagcatccctgagcagtcgaaggcggcgtgagctccatgcaatagcatcgacctcgatgccaactagctccattgtgaatttgtgacatccagattggtgtctagagtgagctggccttcgacagtgcacctcgcatgtcgtcatccaagtcgtttgtcacgtgtcgaacctagcaacaaggcaaccatgtcgatgctgccgccaaactcctcctccctcccgctagtggctgcgatgtacaacccgccgcgtccctcctcttcgccactgctccccaaccgtctggacccacgcgtctggaaaatgaatatttttatatgcgggcagcccaaccgtacaggataaacatttttccatacggtcggattaagtggaccgcactggataatcgattatcccgtacggtcaatttatatctcccgcacgcaaaaaaaaaacccaaaaataaaaaaaacgcgaacatcgtcgactgcccgcatccggccgccgctgcgagccgttgagcctgcccgcctcccccgagctctacggcgaaactcgtgaaactactacagaaactcgtcaacgagcggaggagaaacttatcgccgttgccgtcgcgagcccgcccaccgccgccagttgcgtaggctgccgcctcgcctggccgtcgcctcgcgcgccgctcgctgcttgccgctccttcgccgagcaacgcgctgccgcggccgccgcgctgtccgccgcccgtcccgcgcccgccgcagccactgcgtcgcctccgccagcagccgccacaccccttcgccagcagccgccgcgcctcgccgacggagccgccgccgcagccttctcccgccgagccgctactccctcacggggaggaggggagggggagcagccgccaccgccggggccgccgccgctgttgacggaggaggggaggggaaggaggagctaggggaatggttgagaagataaggtagagagagagaggagtggttgagggagaataaaaaggaaaaaagaagagagataatgtgaaaattttgaagtgagtggaaaggaaatgagttaagtttttttctgtgcgatccacttgaaaagcacgcacgtgaaaat

SEQ ID NO: 69946 - DNA, 529 bp, Oryza sativa
aagctggagctccaccgcggtggcggccgctctagaactagtggatccccctgagcggtgtagccgagcgcggcacgggcgtcgagcgggaggcggtggcgcgtggaggcgtccacctccttccactgcgcgtaggtgagcgagcaatcctgcgtgtggtcgcgccccggcggcggcgccgtgaactctatccctggagccgcgatgggtggggaggggctggccatcatggaagaagacatgacgaagaaaggaagacgaaggagtacagtaggagagaaaaagaaaaaaaataatattccctaataggtgggtcccacaggagagtgagcctttattggggttcaagggtaaaaccataatttcacaactgtttctctctctattttctccagaaataataaaataatgtcgtgagtgtacatcagctaattaccagtgttttacgatgctctccagcatatacacattcttccggtgttcttcggctaattacatgtcctgtagcaaattttgccttatgttaatg

SEQ ID NO: 69947 - DNA, 683 bp, Oryza sativa
ggcgatcgaaccagacaagattgaaatatgttttgacacaagaggatcagaagctgggattactgcaaaggtggtcttctgctgcgacagtagctggatgagatcttggcgatacatgctgctgtaagccctgcagatttgcttcatctcctggctgctccttgcggtgaagatctccaggaccggtctcgcattgttcggggaaacatttcctgcagattttgtgataatcaatcgtggttaatctctggcaaggaatgaagctaacagagatttgtcaaaaaaaggttaacaaagggttaaattacggatttggagatgtcagtgacatgacaccatgtttgagtcgtgttagaaagaaaacgtatggcagaaacatgtatgaacattgaacagtgcagtgaaacagaaattgatacagaataaaatgtaaacagattgttctgataaactgttcaaatctctgaaaaaagaaactgatgaactgttcttgatgctagcatgagacaagatggcggtgctgatatcatcagttgatatgtaccagaaaagaattggttgaggtgtctgcagtcagcttcatatctcttggcaaaatctctaatcgaggccattttgatcagggaattagaagaacccaacttatcagctactaccactgaactcaaaagcgatcgatggtg

SEQ ID NO: 69948 - DNA, 576 bp, Oryza sativa
ttgttgtattaggatatgtcgcattctaggttgtcttattttacgacagagagagtataacagttgccggatgaaaatccctcgtaggtgtcggattcccaaccagcattaatttggaggcgcctttgcccgttcgcataggtgccagttataaaatcaacacttatagagattataggtgtcaattctatagacagacccgacacctataatctttggaaaaaagggttgtggaggcgcaagggatcaccgacctggtagcaaagggcgacaaagctccttgtagaagtgcttgaagtgtcctagcaactcgtcgacagcggggaaagataggcggtgggccccgggcgtgcagtccctgtggaacttcaataggtgctcatccaccagggttccgagcgttgaacgaggagtccccctgtgcatgagcacgcatgtgcacacacaatgacacgaccacaccttagacaccaccggaccaaatcgttggagggaggaaggggaggggggagtggacattatacttgtcagctttttaattaattaacgcctatgatatattatatgtgtcattcg

SEQ ID NO: 69949 - DNA, 731 bp, Oryza sativa
ttttaataattttttcggatttaatgggggactggccattcttccacacatgattggctacataggcattgagaaatgtaaatattaatgaattgtttatttacgaggaatgactagtagcatgtttaaatagatgacaagtagaattatttatccttgatctgtgtgccaagataaaatatgtagatagtagtatacattgcatttcctcgtactgatgaaacatgggcagcatcagcggccggtgagtgagcgtaaagctgcctctcgccgcccacacaagttgctcagataaatactatggagcctggagagattttgttcggactaggtcgtgctattttgttattatatactccatccgtttcaaaatgtttgacgccgttgactttttagcatatgtttgaccgttcgtcttattcaaaaaatttaagtaattattaattcttttcttatcatttaatttattgttaaatatatttttatgtaggcatataattttacatatttcacaaaagtttttaaataagacgaacggtcaaacatgtgataaaaagtcaacggtgtcaaatatttcgaaacggagggagtacctgattagatgtaacgcatcctattacaacgaatttggacaagttatccagattggtcacattcaatcaaaatctcttatatttagggacatatgaaataggttttatcttgatttttatttccatattttttaaaat

SEQ ID NO: 69950 - DNA, 1426 bp, Oryza sativa
atcgactatgcttttcgacctgatcttgggtcctcctaagtcctactcaccctcctccaggacgaaccttgtggacaaatgacatcttcaattatcagaaattgtaacattagtattagtaaatttatattatatctaataacaatgatttctttagttatatatttgctttaacaatggcacaatgattggggtccatttaaaagaccgttcccatttttatgtccattttgtctccacggatcctgttttttatcatgctatcataagagttaagtacgattgtctctttcagaaaaatgtttaagtacatttttttgtgacaccctagaagttttgttgtgacagttgctaatgattgtgtgcactataatactttattaaaatgctatacatgctgccagcttcttggagatggaaggaattacggagtagcacaaataactgtgattggctggttcaagacttcaagaagacacaacaactctcaggagcctctctaagctacaacacatgctaattacgattcgtgatgcatcgctttcctgaggaaataaaacactgctggctgttaaatgttactccctgttaatgggactcctatttgtatccaagctgttgaacatcaaattgtttcatcattgaatggtaagacatggaacactaacgtacagttgttggttcgaatactccgataagggttcaatagagcattcagtttataattggaaagagagaagttatctgaaaaatataattgcacattgctgatagtggtaccaattagagtttttttatggtacattctactgctagtatatactaccagtatgtttgatctgacggtgtaaatttatctgatttccctcccaattatactgcagtataatttggatagggtatatttgtttttttatctttttgcatgggggtatttttgtaaattaacgcgaactcacttagtcagatccgtttcaccacatcgactctaaaccgaatccgctcggctcgcatgggtgtccgccgccgctggcttctatccaggagcactccagtggctgcagggcaggcagggcaaccaggacggagatgggaggcgtggggaggctgccggctcgacgagggcactctcgccgttgtggtttgggcaaggcacaagctgtgggaggtcggatgtgggggagaataggctagggatggaggcaaggcgccggggacgtgggagacgccgggcacgtggaggttcggcttctcccggcgccggaggaatcgggatggaggcgtcggcgcgggagcgatgtgcgccaggagcagcgacgccggagacgcgagatgtatcgagaagaagcggatgacgacatccacagaaaaaactaaggaaaattaatccgggtgaaattataattctctaatttaaatgaccaaa

SEQ ID NO: 69951 - DNA, 1050 bp, Oryza sativa
ccgcgcttccacccacacgcacaggtgccgccagaccgcatcagcgccctgccggacgaggtgctccgcctcgtgctgttgctgctcccggcgcacgaggcggtggcgacgtgcgtgctcgcccgtcgttggctccaccactgggaggaagcaccgggcctctccatcgattggtggggttatcaggagttggacaggttcatcagcttcgtggatcgggttttcacgctccgcaggtacaacgcgcctctgaatcactgccatttctacatgtatttcctgaggttagtgcctggaagggagcggctcttcgtccgctggatccggcaagccttgcgctgccaagctcgggtgctacgaatctgtttgatacttaggggctgtttggttcccagccacactttaccattacttgccaacaaaagttgtcacaccttacctaaggtgaggtgatcaaattgttagccacaacttactaagtctaagggaatcttgccacacttttttgagccattgacacgtgggacccaatttgttggaggggaatcttgccacaactgtggctacaaccaaacacctgtcaaatctgtctaaccttaggcgttgcaaactgtggcaaagtgtagcttgcaaccaaacacacccttactccaagatgcctaacatgactctcatctctcagcacctcacaaggtctagagcattgaccatgaaggctatcatctctcagcacctcacaaggtctagagcattgaccatgaaggctatcatctctcagcacctcacaaggtctagagcattgaccatgaaggctagtatttgggatttttgtttaaattttgtaattgcctatatttgtgattcttttttgttaaagtaaaaaacatcacaagagatgcttatatttggtcaaaatgctcatcacacaagctgaaatcacaaattaggagcaaaatcacgcaaaactgaaaaaaatagggcaaaaatacaataaccatccaggatataaatgtccttttttttaacaactagcaccgttaaaatcggccg

SEQ ID NO: 69952 - DNA, 1149 bp, Oryza sativa
agggtaatactttcgcatccattgattctcctgtataagctctcatccactatactgcctttgccaaaggcaaataaaccacctcggacgtcagggtgtcctgtagcatttcatattgttttgttgccacggcatataggcctaaaatgctgtccctgatcaagcacagcagtgccactgagaatggattcatctgtgttcactttaaaaagaccagctgctggtggggtcacaactcaccgcttgctttcctgatgcaaatttttcagccttctgttggtcgtgagttgtttgctgcgggctttgcaagttgctgggcccaaatgaatgaaacatcccaggagcaacttgtgagaagtctcaagactgcattctcatctcagaacatacctccagaaattcttgccacactgctgaacttggtaaattactaaatttaccattagattttttaatcatttttacactttgtcatcttgcttctaatcggtcctttgcgtaagtaggcagagtttatggaacatgatgagaagccgcttccaattgatacaagactgctcggtgcacttgctgaaaaggttagttttactttatgcatcttcggcaaattttcgtgttcccatgtaatctctgtttctgttgaaacctttgaacttttttcagtgtcgagcatttgcaaaagcactgcattataaagaaatggagtttgaagctgtatgttccaagaagatgggtgcaaatcctgttactgttgttgaatctcttattcatattaacaaccaattacaccagcatgaggttggtttctatgtcatacaaagctaagaagagttatgtgtcgtggcttgttaatcctcttgttatttatgcaggcagctattgggatattgacttactcacaacaacatttagaagttcaattgaaggagtcctggtacagttgccacgaacctatgatcccctgctctatattttgttggattaaatacattctttttacattttgtaaaactatcaaacacttttgaaaaatttaactgtaatgatatatgtaaattttgtggaaacatggatcactctagacttcatctaagatcttgcttcaatgcttgctttaattttgtgcaatcaggtacgaaaaattgcaca

SEQ ID NO: 69953 - DNA, 2146 bp, Oryza sativa
attcctgcagcccctaattggatacgattatgtaaatagaaaaggaaactcgggccgtgtccagcagggtttttctccttttaaccttgtctttgaacctgtataagaatggtaggaagccccaagaacataaccacaactcgatcatcagatcaataaacacttgacggatccaatcctgaaaacaggaatataatatttcttctcacctttgctcatccactttatctcgtgtgctacgccttttctcattgctaatttctagaatcggcacatatgcacgtaaacacaagtttgaagctataatattcggtctggacacatacttggttatcttaatttcactagacttgaacaaacgaactacagtcttttctcttagggcaaattttatagtaggggtaattgtcacgtctaattttattcatataagataagaggtgatatatacaatacaccacatctacaccacctctatcattgtaacctaaataattttattttatttgtttgtccaatcccctatttctttcatctcattttccttggggtttgtgtggaggttgctccttgcatgaggggtggctcaccttctctttcctcaattattactcccacctcatcatctaatcgtatatggtatttttagagagaacacatcaagcatcatagtacttgcccttaggctgtgttcgggagccccacttccttgcacggaaaacgaaccagtccactagcatgtgattaataaagtattagtttttttttaaaatgaatcaatattattttttaaagcaactttcatataaaagttttgtttgaaaaaaaacacgcaccgtttagtcgttttaaaaacgtgcgggcggaaaatgagatgagtgagttgggaacttaaagaaacgaaatcagccttaggtagtcttcttttaggcggtgattttcccccacgtttccaacttcaactatcttgtttttcacgcacatgcttcctaaactgctaaacgtgtattttttgaaaaaaatagtttttcacataaaagttgcttaaaaatcatattaatccatttttcaagcttttttttttgctaatacttaattcatcacacgctaataggtaacatcgatttccatgcccagccttaagccattgcaaatttgtcatattagaaaaatgccactactgtttacaatatcggctagatgccattagaattttgtcaaattggatctataccatagccatcacgtttttagttcgggatgaaaacggagtggacacggatagataacgctcgtaccatattcgtttttttttttttgccgaatatggattatctcgaatatgatcggacacgatcacacgaatacggaaacattttttcctcagaacacaaaaaccaattcaacttctaatataaacaaatatcaacatatataattagctcattttatataaaatataggataatttataaatagttttaaataattaaataatattaatagtgtggactagtgtcaagacataactactattaaaatctaaaaaggtatattgaaggtcatcggacatccgaattattatctgtatccgacggaaaccccgataccatattcgtattcatatctgggagaaaatatccatagctgtatctatattcgaaaggtatccatattcgtttttatctggagcggacggaaacaactatccgcttcattttcatccctattttcattcttcatatggaccaaatacccttgaacttgggacccatctgtcagtttcatctccttcctccatccctcctccagcctcccagcgcctctcttatgttcgtctgcaacctccgcgcccgtgacaaccgcttcaggacagcttcaagtggtccaccatgtcggcgaggtgggccaggtacaccaggagcactgccgcagcgtaccataaaattcgattcgaagttctcatattttaaaattaatttttaatgactattttcgcatgcggtcctattaatgaggcgcatgcaaaaatctattttcgcatgcaaactcttaagtggttgcagcgacggcgacggcatcggtgggcggcagcggcaggcggcgagggcggcggatccggcggcgccgtctcggggctgcagga

SEQ ID NO: 69954 - DNA, 3893 bp, Oryza sativa
cgattaagataagtcaatattttgtcatgttgctgccaaatataaacaaacggtaattagtatattaagtataggactccacataggaagaaccgaacaatcaattaccattgttgggaaaattgactctcggcatgaaaactttgaggcaattgcgcactgccgttttccacccattgccgcgtgattaacatgttttaactcatgattattaccataattatgcaatcacgtgcattgattggtagcgcccaaaaccttatgtttttggaaagcccccgattcccctcagtgcaaaataaaatgggaggccgaccctagaggaaggtgacaactttttctctcggtctcaaatctcaccaacacaaaaataacgtaatcccgatcaagctaaaccgctggaggggaaacatggtacagtccaggccgatgcaggtggaggccggaggacgctgccagcctgccacatcatctctgcttaaactactacgccgccaacgaacaccagagcagttcaagagactccatcctcttctttcactccggttccaagagaggaaatcgcaacaagtgcaatggcttcaaacaatggttagcgcccctaatattccgcattaggtgatcttttaggcttagcatattatgaatcttaagtagattatgaaatctacaatcattatgacttcccatatcttcaaatgtcgagctgacaatatatgaggtttttgggtcatactgggtaccactttcttcatactgttgccaagagataccacaaaatagctatagaatgcgtgtaccttgtggtatctcctcaaagaccataaaaggctcacaatttattatgtaaaaaagaacatatgtaaaacaacatttagaatctcaccagatcctgatacataagtaaaagatgaggagatatatagtctgaaacgagaacatattatttcacaatgggtactgcacttccagtgggaatcatagatagtgagttttgccaatacttttgagatttatgcaaacaggggacaagagatgcacggctaacactcacctcgtcaacacggatattgtagagtagaatcgaagagtcatccgttccaatagctatgatgttattgtcatgcgggtggaatgcgaggaaagttgcagagggtggaggtgctatgaaagtagtcatggtctgtgagtgattccacaaaatcagttaagtaaaagaaaggccatgatcgatgcaactatgaaataaaaaatattttccggaagtagtcatgacctgtgagagatcaatcatgaaattaccagattattgtgttacatgactgaagaagacataccttgaaatttaacatgttgaacaacgaaactttgccaccagatgcagaaattagatagcagtcatttttggatagtagactgcaggcagctgcttcttcagggttgccattagcagtgtcattcattagaatgtcactttccggttgccacacttgaggtgggacagatgtggtggactaacaaaaagtagtgatggttttaagaaaacaaccaaacagaactgcgctgttgaaatcaaaataatttagttctcctgtctaaccatgccagcaggattcttgtcattgctctcccatttccacagcttatgaacagcatttgagctgagagctaaaagtcccttcccactttttctataaagcagacagataacctataaagaaaagaaataaaacacaatgcttatcagaattgtataccgatctgaatattctagtgaactgccagaattgtataccgctctgaatacagcttataagttataccactatcgctttgaattctagtgtgctacatcacaaaaatgagaaatcacatccaatgtcaatatcaacaaatatagacgcttgtgaaatatttacatgcaaatatcaacagatactgtgatcttccttgcattaaatagaatgtaaggtcctatgtttcaggttgataacttgatatttcatggtcaacgtactaatacgaaaagatgcacgtgcaaacatcgctgaacatactttgcttgaagatgcttctgtaactggcatacgcagtgctcgaatacggccagagctaacaatgttcgccttccaggcctcatttaccaactccggggttctgctcacatgcatatatgcctgcattttcaatacaattagcaaataatattgaacagcaaacgaacaagaaagtgcagcaaactcagctggccactcatgagttcctggctataactacagtacacacattccaaatggaaccaagggcattcacaatcaggggctgcatggtaaaaaaaacagtggttatttttcctctttctcccagtttcttcatccaacggccaaccaagctcaacagcagcaacggtcttcctgtggcaggacacggcagtagatgggtgtcgaagcatctccacgtcatgaagaaatctgcagtgaaatgaattggcacagaggacagtgatggtggggagacgtcaaccagtactagagaacacagtcaagccagagatactcagagttttcaatttcggaaattgttattctgtgggagagaacaataactgaggcatcagccaagttagaaacatttgcatggtggtgtatctctgaggaatcggcccggcacccactgacagtttaaaccgatggagtcactaccaggtcaccagtgcacacttgctactgcaggctaaagtagcatacctccggtttgctcgctcatgtgtatattgattcacgagaacgtgaactcaaatcaagaaggaataagtttaaggaccattggtaacttaactcgaatataaacatggtgcaactagtagcataggccctcaagaggcctgtacctcataaagatattgtaatcaaattgaaggccaaacatgcatctaggtacgttttttgcaatatcaaatgatagacaggacatgaatttttctactcgtataaaagaagggaaaggaatggatataggactaattaaaagaagagaaactagaagtggctagattcgactcctagtttgtgaggcataatataggggaagtaattacctttactacaaaaagcaacatgggaatgaattaataagatgaaccaacgttggtctatcaatgtgcatgcatgatcagttcctacctcttggtagggtgagagcacagcttgttcgtcttgccatttggtttgaacagttgggtgtttgggatggaccgcagctgagttcatcaatgcagcagccacttcctccacctctgacagacgggcatctccacatttcagtactatggtgactttctggagcgaacttcttccaagcttctcgaagctaagcagcttgtcaaaaccaagctgggttgcatctttcaggaaccgcatatggacagcaaactcgaggaattcaagacttggcatgataatagatgctaagcttctattgtctgtgatgttgcacttgctgccgtgcagatcaaaccagatagatgtaccaagtatccttaagattctcaacttccgaaagtagccaacatcttcagtatgaatctttatgctaaccaattcggtctcatgcaaacgcagcacaaggcagcggagctctggcaacctcgcaagggtttccatgtcctgctctttcacaattagcacaaccacatccagacaggagaggttcggagcaagcgatgatttaatccatgctggcagtccagagaacacaaagcaattcagacacaggtatcggagatgcaggcaggagacagatcttgcactgcttgtcactctccttgtcactaggggtgggccctcaatgtgcaggtcccggatattgtgcagcttgcttagggctgcaggaat

SEQ ID NO: 69955 - DNA, 2329 bp, Oryza sativa
  unsure (1)..(2329): unsure at all n locations
tcaaaccgatgaatgtttgtgagtgacatgaatagattttacagcaaaacttaattaattgtgttttcagacaatagaaacaaactatgcatgcaaattattattgcatccaaaatatatatatcctactagcatacatatgcatgttgcattatattgcctgaagttgaataatttcagcggcggcctctgtcacgcaccatacgtgcagaagagaatcgacctggctgatgaagcggataagagtggggagaatctctccgccacactgcacccaagcggccgggacgacatgtcaatcctttcaatgcaacggctcaacgatcagtacgtgcctttgcccctcaagtctttacttgaaataaaaaacgttaagcacataaaagaacacttcaaaagttatttgattttttttgcgacaaaaagttattcgaattgatttgtcttactgtaagagtatagatagatataganaatcgtttgaaatttgtgtaaggactgaactaatcgtatattgggcctcgaaagatgtaggactatcaactaggcccaaaaagacactaaggcctccttcaagatttatagttggaattttgatagatcaatgaacaagttgattttgtgatagctatttgagggtatatacacaaattaattaattaactactacttacaaatttaaaaagttggttcagcaaaacagtatatagaaaactgacacaaaatatccatttagaagcttagaaaacgcgcaaatgaaaaatccaaaatccagtacaagctagctggcctgaataactggcctgacaagcagtacaacatagcactacaagctgtgaatttactttctgctgtttcgggtgcgtgcaaatgcatgcaattggcagcctacccaacggcccgtcgtcgccggtggacatgcggtggactacttcacctacgactacgagttcgccgagccgccgcgcgtgaccagcctgcagaacaccgttcccctccccactttcccgactttcggagacgacacctatttggtcgcgaaccaacgtggttagaagtccgtcgtccaccacctcgccggccagtacctcaacgccgacaagtccggcaacatcgccgacgcccgcctgaagctcaacaaggttgatcatatcacttctgatgccatgatcttttctgtcagaaaagatgaactgattaagcacgcgatcatcatggtggtatatatgatcgatgcaggtggtgcgtgagatctcctactcctcgaccggcgtcaccgtgaagacggaggacaactcgacgtaccaggcagactatgtcatggtttctgcgagcttgggagtcctgcagagcgatctcatacagttcaagccacagctgcctgtcagtttctatgtccaaatgtccttgcatgttcaacatatcctcttccaaatataaattaagatgtgcatatcgagcagtcaaatttactttacgtttcttgcatgtttccatcagtcttggaagattcttgcgatctaccaattcgacatggccgtgtacaccaagatattcgtcaagttccccaagaaattctggcccgaaggggcagggagggagttcttcctctacgcgagcaccaggagaggctactacggagtctggcaggtacaaaatatgcagcaatatatacaatccactcacatcgaattgtagtacattgcgatgatctgaacattcttcaggagtttgagaagcaatacccggatgccaatgtgctcctggtgacggtgaccgacgaggagtcgaggcggatcgagcagcagccggacagccagaccaaggcagagatcatggaggttgtgaggagcatgttccctgacgaggacgtccccgacgccaccgacatcctcgtcccgagatggtggcggacaggttcttccaaggcagcttctccaactggcccatcggcgtcagtcgctacgaacatgaccagctcagggtacgagctgttactccaaccaaatgctaatcgcaattcactacagatcatgtttttcattgctactttgatgtttctttggtcatgaacaaatgaggtttaaatttgagcttaatttggttttgtgtatgttttgctggtttctgcacacaaagcgccggttgggagagtctatttcacccggtgagcacacgagcgagcgctacaatggctatgtccatggagcttatcttgcaggtatctatgcctaatttgttagcctatgtctctaatgttagagagaccggagatgtaaaccatttttattgtcttaaaaaaatacctgctctagtgattgacgagatt

SEQ ID NO: 69956 - DNA, 761 bp, Oryza sativa
tataactataaattcttagaatctaaactaaaagctaaactgtgtagggagtttttaagtctaaaagatactacgaagatccctagacaggccctatgagcatagctaataatacaaccagctactgagattatagatttttattagtctatctttcaacccactcatatagttgttagcttttcactgtaataaatatatggtccatctgcccttcatagatttattttttggttttttttctaaaccagctgtcacaaattcatagaccgtttctcctcacttttctctcctctctcgtctactttcttacagagacgtctattatgcttgctctaagcccctgattaggcaggccaatgccgccggtatttgattcgaccggcgcgcagcgcgcgaactcgaacggctcggctcggcgcgcgcgcgcgcgcgaagcggtcgcggattcgcggcgcaggcgaggcggcggcatgcaaggggtccagcgctgcgggacgcgtggccgtcgtcgggccacgtcgcgctgcggtgggggccgcgtgtaacgcctgcgggccccacgcctgggcccctaccccccgctcgatgtggcgcgcaggtgtcccgcgtgcgtggcgcgtgccctgcatgcatgcaatgcaatgcaatacgctctcttctcccgcgcgggcgcggccttcgtttcgcgaccccccactgcttcttcttcctcggtcggcgaccatggctatctactactaccactacctccctcttat

SEQ ID NO: 69957 - DNA, 710 bp, Oryza sativa
ccatgaattcagaaccccagagtccgcacatcctcaaatacaaagcacttccctagttagatgtaagttagacttgccgttcgaaaaactctttacttctttacttgccttcatttaatgcccaattaatgaatgccacctgggtggaaccgaaaggtggaaatggaaggtcttagttcggaggtgggatctctacctgatagttgcattgcattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaaatacggatgtaaccttggatgtgcccgtgcccaatgaagaagaagagcgcaacatgaaacgtaagtaccaaagtaccggacacccacccaaatcccaataaaatccgccaaatcctgcgggaaattgtaatcccattcaccagctcctacatttaattaacaagagaactattgtatttatctaacacctggattatctccacctttcatttgatcccta

SEQ ID NO: 69958 - DNA, 1588 bp, Oryza sativa
agccccatgtgatagctaaatcattgacgtttagatgttggacttcgataacaggatcactagcgtcgggaaaaaaggtctaattttaaatatgtgcttttaagaatctatttacaaaataatttttaaaaggctcgaaacataatagaatccgacagtagtagggtaagtctggttgcttggctgggcttggcgttccatgacttctatccttgctgctacacgggaaaaatatacagtgcaaaccacatgacacatatgtagtggaaacctgaaagctatagttacataaaaaaatagacgtattcgtccacgtcattatgagtaaaattttgacccctaatgatggtagttctcgatgcaaaggtattcatacgtctattttttaatttgatggtagtttttgggtgtttactatatacgtaatttccggtgtatatttatactactctatgctgaatgctgaagtaaatgtgaaatggcaggcacaccagccactggacaaggaggtagggtcggcctcatctgcaactgatcaccggtcaccaccaccgttgggtaagtagcagcagcgtgtagtgggcaagtctcaaatacagtgatccttggtggccggtacaacattcttgatggcaaagtggttgctcacatacagtgatccataactagtgctttatttttgttgggaagtccaaatgatactcttttttgttgaatgaaaaatagggccaattggtttggagccggtttttttgtcataccaaaatttagtgccaaaatgttggtatgtttagtaccactagattgatagtatagaatttgtatagtatgtgtaaaaattgatagcaaacaaaacatccatataacattattgaagttgccaaatttttttggtaggacaaagcactataaaaaaattattttcccatacaatcaaaaccaattttcgcatgtggttgggtcgccgcctgctagggcagcgcacctgtccgcgaaaatccgccttctgcgggcggtaaattatgtcgcccaccctcggaaagaaaaatcgctaaaaccctatctagctcccatccacaggtgacattaacactatagtctgctatcgctcgtcaccgtcgttgccacagaggccccgcagctcatactcatcgtcgtcgccctgcccccatgccttcaccacctccaccgttgccccttctcaccccggtagcagcggcagcgtggatccgcctgtcacggggatgctcgacagcggaacccattgcggcgccacccgacggcggatcccgcctagaggggagttagctgccgaatcctcgtgggagaggagttgagagagaagggatcgactacagtcaccgtcgccgagcttgagcacgctgtcagctgctcgggagggggaggcgagggagagaggaggtgagaaatgagagagagaagagggggggggggggttgagagagataaggatgaggaagagaggaggtgaaagataaggatgagaacttataaaattttgaagatgtggaaaggaagagagaaggacggtcaaacttttcgtaggcggacctcttaatcggcctct

SEQ ID NO: 69959 - DNA, 4236 bp, Oryza sativa
acacctcaaggtacttttgtgcatcaaacgaagtatacaaaggatcttttgagacggttcaagatggataattgcaagccaatttcaacaccaattggttctacagctgtgttggatcctgatgaagatggtgaagctattgatcaaaaggagtatagaagtatgattggatctttgttgtatctaactgcttctaggccagacatacaatttgctatgtgtttgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgattttggtggttgtagaatttatagaaaaagtactagtggaacatgtcattttcttggtacatcattgattgcatggtcttctaggaaacaatctagtgttgctcaatcaactgttgaatctgaatatgttgctgctgctagttgttgttcgcagattctttggcttttatctactttgaaagattatggtcttacttttgagaaagtacctctcttttgtgataatactagtgctattaacattgctaagaatcctgttcaacactcacgcacaaagcacattgatattcgttttcactttttgagggatcatgttgagaaaggagatgttgaattgcagtttttggacaccaagttgcaaattgctgatattttcactaaacctttggattctaatcgctttgcttttcttcgtggtgaattgggcataattcatccttttggcatggtttgagggggagtttgtacctcatggttttatcaagctataatatgacaatgagaaaaattaagaaaagagagctttgtttatgcatatggtattttcttgtgcttgctagcaatactttgaaggtttatttgtctctagtatagcttgtatgtattctagtctttcaatgagacttagattttgtttttaagggagatgatacatgacacttaaattctatacttgaattaagaaaatatgcaatgttgatgctagcatatggtttgatctataaagcacgctttatgtatatgctttattgaattgttattcctcaactagttttaattgctcattgtgaaaagagaataaaaatatgaaaaaaaaaatgaataccgaatccttggaaatagtcttgacgacaaggacgtattcgacgtgagcaaaataatgggtgccgaatccctggaaacagtcttgacgacagggacgtacccggaataaaagagaaaaatatgagcaaaaaggctcaagaaattctcttggttgttttttgtgctaaaggttatttgggaaagagtgataaatgcaaataggtatatgtgtttggtgtatattcttcaatctatgtgcttgttaagatgttgcattataaatcgtatgaaatcatgaattttgattgttgattcaagcttaattgtaaaatctttggttcatgtttatactttaatgcatgcttgttatattatagatgggttcatcttttttttattgcgacacatgacttgatatgctatatgtatgctaagctcttgaacattaatgaatataattcctattcttgatgaaatcattgtcaaaagggggagaagagatgagtttttggagaagcaaggtgttgagaagagcatgttttttggttcagttgggaatttctttcttttaaaatggaaaaaggggaagaagttttcttttggattttttagcacgatgtgtacatttgtacgaagtgtgctttttaccacttttgtttttattttttcaaacaacaaaacatttttatgagtttgccaatgtgtttatcaagggggagattgtaaaatcaaaggtgtttttgattattattttgtgatgaacaattgggcattgaaagttattggttttgttatttggaatttattcacgaagtggttttggagatgattggatttacaggtagccgatccccgctgtcgccgtcgtcgcactcacccgccgccagctgccgatgttgctgccggcgttgctgctgatgttgctgtcgacgacgaagcggtagtggacgtcgttgcgctcgagccccacgccaccgagccccaggatgccgccgcggagccccggcaacatcagcccgaagtgcttcagtgggctgtacaccgtcacgccggcgcatagtagcggcgccgcctgctccggcgctagcctcgccgggattttcaccacggcttcacggcgacgacgcgggcgcggccatggacgacctggcgctgctgccatcggcttcacggcgacgagcgctacaaggaaaccccgtccctctgctccgcccgagcccggagccgccgctcgcccaccgcttgccgccgccacagccgcgctcgcccactgacgccgcccctccgcttgctccaaccgcgcgccgccgcccgctgccgctcgccctctgcggccgcgctcgccgacgccgcccctccgcctgctccggcctcggcgggggtgaggtggagctcggagatgaggcggtcgagcttgttgagaacgaggcaggggcggaggcgctcgaggaaggcctggcggagggcggcgtgggtctgaatgtggacgccctcgacggcgtcaacgaggatgagcgccgatcgagtcggagagcctcgcggcgccggtggaggagacctcggagcagaagtcgatgtgccccagggagtcgatgaggttgacgcggtgtcccccgtggtggagcacgaggtggcggacttcatggtgatggcgcgacatgtatagttgcagcacattgcaggattcttgctcgctttagcttggctttttttttggatgggcgacgagtgctcggctgccatttcatctcctccacttctcgctggattttgctgtgttcttcgtgtttagattctcgccgccgtccgctttagctagacacgggtgcctactgctagattgttttggagcagaagcaggtgtcaccttgcgatgaagaatcgtcagaaatgagtgtggtgactgcttggatatgcagaggggcatttggttgttgagacgaaaagatggaatactatctgcagcacattgcaggattcttgcaatgtgatggtgatggcgcggcgctgctcctcgtcgaggtagtccatgaagcggaggcgccccgcgagcctcgggttgacgtaatttttttaccgcgagcctcggctgacatgtgggccctacgtatttttttaatttttttttctgactaggatgccacgtcaacaaaatcggaaaaaaaatattaccatgagacctcctttgaacggtttgagtgagtttaggggtacatttctgattttgtagtcaagggatcttagaaaatctcgatgttaagttgagggacctccggtgaccttattccttttatgcgtacaccactctatctctatcgtggacaaaattatcatttccgaatcataaaaggcatgacggacgaaagttttgacaaaaacattttaattttttataatagtagagatagatattaaactagaaaagatgcccatgcgttgcaacgggtagagccgatttaatttgtacatatgtgtcagtggataaataattacaacctattgtttcgtctattcatgtgcttatccgaatcacttattgccaaataaaagactatttgtgtgtaaatcttttatatacatgttcttagcaaccaaaaaacaaatgttgtaaaataaagtacgataaaaaccaaaaagtcaaattcaaaggataagccaaacaatgaggcctttaaacacgagcttattttatcgtccaactttatttcaagtcgggcaggaattgatgatggacggaatcagcaacttctatcatcctttatttcagttggcatgttcttttcaaaagtaaaactgattattatggattattatggattattgtaacagtatccctaatagtacgtacgagcatgtgtggagactgacttgaaatcatgctaacatgttccaggaatcgtgtcgtgtaatacgaatagaatcagatgatctaggcaacaacgtacgtgatatccacatggactctgcgagttttattcgcttggtatctacatcacacggactctcttttgcagttcgcttgcgagtcgtggcttcacaatgaatgttacatgtgatgggaatc

SEQ ID NO: 69960 - DNA, 745 bp, Oryza sativa
aaatttggtttatcaacattttgggaataaatggtttacatttgctatctgcgtcgacattttaactatttgtactagccttcatattgttttttgatatgttattactggaaccatgtgaaataaatctgtgaaacttgaggcctatgaagtcaacaagacaatttaatctgatttcaaaattatttaagttatgattgggccatcgatagtaaaaaagatagtttgatttttcagtgctattagcctttgtagtcatattttccttttgttataaggacatattttgaaataaaaaaaatggatctttgcttccagatgcaccacttgtgacaattgagtattttgttcctcaattgattgttataacatctaaacaaagaccaagaaaactgacaattcatggaagtgatggcaacgattatgcattcttgctgaaaggccatgaagatttacggcaggatgagcgtgtaatgcaggtttgtatatatatgacaatcttttcttgatctgattctgtgagttcttttgatcaccatagaacctggaatgatgagcatatttttgtattctgtacccatcaattgctttgaactccattctcctatgtggagggggcagctctttcgtttttcagtacccttgtgctgctttaccatatgaatagtaatgtttacgaatcgtcattttctttatctttgattatacacaattaaggaagactagtaatcaggacttgatcaat

SEQ ID NO: 69961 - DNA, 7027 bp, Oryza sativa
cggaccaattaagtggcgcctgcaaaaaatcattttcgtaggcgccgcttaattggtccgcctgtgaaaatagattttcgcaggcatacatcaaatttcaccccaatttatatttttgtaggcggtcatttggctctaaatgttatgtccgcctgcgaaaataagacccccacgtcgggaaaaatactttttccggtagtgcaaatggctgctctccgtggctacttccagtcagccaaggtcgccgaggagcaggcggtggagatagccgcagtcctggcacctggtggcctcccgcggtcccgccgtgctcatcagctcggcgccgagctcaagctcccgcgtgcagcaggccgcgccagcgaggtccagctgctgtgcaagctgcatgaacaacgtgtccccggtattggcgcaccgccagcgccgccgaccagctggcccacggcgtggaacggaccatgcatcatcgtcgactttcctggcgccggcatgtatggcgcggccggcgttgtgacgaacccacgagcacggaaaccagcccgagcgcgtccacgccaaccagctgcgtgccatgcatgtccgatccacagcctgctcgattgccatagccgctccacgatagtcgtgtcacggcaagcatgctcccgagcgaagtggcgtacgtgcatgcatgcatgcattgatgcaaccgatcgatcgcggaggcgcggagcttgagctgaccaagcagacatgtagcagctagaaatggcatgtctaggtcccgtgagatctctcaaggaaggagccaattaatattgtggcggtgcgatgtggtatgtctcaatgaattccggactccgtcttcgcagcggcagcatgcaaaggtttcgcggcataagcgttgccgcgcacaagggccgctaagatatatatctaaggacaatcaagcggcgacgacggtgaggacttgtgggttgtgttcttacccagttttcctcgattttcaaaccgttaaacggtgtgttttttataaaaaagttttctatacagaagttgcttaaaaatcacattggttcattttttttaaaaataaactaatatttaattaatcacacgctaatggattgttctgtttttcgtgcgcactgtttcggttgggaacacgctggagcgaacacagccggtcgtgtgcgtgtggcagcgtcgaatggtcggcagacggtggctgctgccagcaatagcggcgagcatatgcctccaccgtaccgtcggttgcacggccacggaggctagaacgagcgcatccacgcggaccagatgtgccgccgccgcgttagaaccctgccgagagtgccatgggcggctcgatcggcgtgcgaaatccacctcgaggctttccgcttctatcattgactgggggcaccgcgccaccgcgccgcacgcctagctacttcaaacggcgccggggcaggagaacgcgcgagctggtcgcgtcctggactagcagtgagcgagcttggacggccgccagcagcagtggcgcgcgattgtctctgtagcagcgctgacgagagtcgagagggccgcgaccacgaccacgcgctctggagtttctcggcaaggcgccggcgagcgcaataggccgcctatcgatgagttcccacgttccacgccagctgccggcggcaagcgtcctgtggttgcggagagtacctccagcgccttctccttcacgaccatggaaaccgtcgaatgtttggagttggcacgcgcacgaactctagttctgagactcttcgtcgaacaggcgtgggcgctaatatgtgaaaaccacgattcaaacagctggactaaactgcaaaattttgaagtgtcgctactcgcaaggggggctcctagcgcgcgcttgcgccagaagatcaagtcgcgagcgcgtggagctgactaggagtcatttcccttttgctacgttcaacccgtgtaagtgcccccctcctactgatactaataatgtgattagagttaattgcatgattaacgctaataaatacagtactagctaacatgaagatttaaattttagattcggagtcgaaacttttgaaatttgaaactaaaagttttgaactttggacttgaaagttctagaataggaattgatttttttttaaaaaaaatttggagttgaaagttttcaattttggatttgaaagttttgaaaattcggatgaaagtttttaatttttagttgaaagtttttgaaaatttgaattgaaagttttaaaatttaggttgaaagttttaaataattgatttgaaagttttcaattttaagttgaaagttttcaaaatttgagttgaaagttttaaaattttagatgaaagttttcgaaaatttgagttgaaagtttcaaaatttaggttgaaagtttcaaaatttcgagttaaaattttcaaatttgagtttaaagttttaaaaaacgggttgaaagttttcagatatgagtactcatgttaatcacgacacctaatcaaaaattagaactaataatgaagaattatagcgttaattaagctgtagattgatttgcctcacttgcccgactgccccttcgcgttaattcctatctatactagcacatgcatgcatcggcgctttcaggaagaaaaaaattcctgcacatgcatgcgtcggcgctttcagaaagaaaaacaaaaaagtcaaaagtgtggttgggccttaggcctggctaatgatgggccaaaacagaaacgcgcgctacttatttatctagtgcgtctgcgcctgcgccgattagcaatttcgactcgcaagtcgcaacgacgtatcccatatccttccaataagcaattccgaatttccgataggcgatcaatcgggcaccggaggcgaacgcgatcgctccacctccacccgcgccaagccagcccacccaacctaatcttccttccacgtgcactttctttcctttccaagcatgagcccaacaagcaattcctcctttccaggccatgagcccaacaagcagatctttagcccgtccaaaaaatcatatacgaagtactcaaatatcaatgtacaaacttttcattaatatacaaacttcccattcaacttttttctatgtacaaactttctttgtagatactttgttctatatcgatatattttcctatatgtatatataccttctatgtagataattttttcatgtataaactttctatatacaaaatttctataaatatttaaacttttaaattttgatgatatagaaactttcacaagaaacatgccactttctaacaataaaaatttcagattcaattaaaaaaaacaacggtattcagcccaaagatgacccagatagactcaaagtgtgagcgcgcaacccatacgttggaaaaaaaggaaaccataaaacaggctcaaaaagagaaaacgaaggaaagatggttgatcgctcgcacgatgcgcgcgacccctcgcgtgatagccttttcgctgatcttttgtgatggctacgaatccttgatgggttctatggttttgggccgaagcctgcagccgattaccgccgcagcctaaaatgcggcctgacacagtgacactgagggtgtgaaaatatgcagttacaccctctgtttcatattataagccgtttgactttgtttagtcaaacttctttaagtttgattaagcttaaagaaaaatatactaacattttcaataccaaacaaacatattagtcgaacctaaagaactttgatttaaagaaaaagttaaatggcttataatatgaaacaaacgagtacaaattaggcctactatcatagtgcgtttcatatatactgtacatatacattgacaagcttcattgtcattgggtgatccatgagccctccagatggaatctgcatgtcaactgcttgctagagtattgaattattttccagctgacatcaaattatctcttggtctataatgatccgaaccctagttgacactggagctgaacttgtaatggttatatctattgtctggcttgattgatccatacatgtagatgtctcgtcaccacctttttcgacttcattacttagctcagaaggcttcttaggatcatctaataagatcacgcttccagaactcagcattgcggcgacatccggcatggtgggccgaactgttggatcttcctgggtgcagagcaatgccacttgggtgcaccgaattatctgatcaagttcatacacattccctaatgatggatctacaagctcatgcaaccttccgtccctccacatatgccaagcctgaaaaatatgtatatatatcctttaatataattcacacatatatttgaatatatttagcatcaaatgttgcaatttagatttataactagaaaattggtgcgccgttagcgcaccatccatatagcaaaccatattaatactatatatactatttattgttattcgtaaaagcgtaaaattttaaagagatattttagcagtttttaattttatgcctacaagtctgagtaaacattatatttgtaaatatttaaattacagaggaaaaaaatgatgtcaaatatatgttggttgatggtcgatttaattattattaataagataaggctaaaaggtgaagtcttatatgaaaattgtttgggactataataattagaggtttcttataatagcactaacagttgggattgtttttttaactgcttatgaaaaaaaagggaaatgattttgttctttttcttcttcccatatttttattttctttcggcctaagtataacattctaaattctcttcatttattttacttttacattattaaatcctcgatggttaaaaatcttatcatttgtatctctaccacgctctctctttttttcccaatatttgcttatattctcagtagtcgaaaatattgtcatgactcatgactacgagagggccacatagttcacacactatttgaagagccacatgtgaatggagagggacacgcctccatatcttcttttgtgagtagtacaccatttagatgtcacaattcgtagcctcatatgtataatttggaaaactatagctataccacctctcttagggcgttcgtagtgcaagaccctcctcaaagtatcacgtaggatgagctagcatatctcaaatttgtttatcctataatgcaaagtaactctagagatattcttgatttttcatgccgggccctcatatttcttactttagttcttatgtttttcaaatttatagaatagtccaatattacactaaataccctaaaaattagaaacaaatatacaatctcacatccctatcctttcccaattccctgcttccatatcctagaaaattggcgcaccatcggcacaccaacttatagctaggatatatttactcatttagaaaaattattgttgttgttgtctagagtttcaaatgcagtagatttagaagaacctatttaatgaattttgaaaagattgaggaacgattaacttatagtaataactgtatttatgtaaagatttaagcgttgtaaaagaattaatacataaagcaaaattatgtataaaaattatgtatagtacttgcctatttgctttcaaacctttgtttttctcttccattagacagagtaattaacacctattattaattggtaagattagatcattagtggaccgaaaactaaaggatatagtttttgacaagtctctctaagagaaatttcttctgctaatatactagtgtcacctactcctctctgtagtctcatatacgatactcccccatcttaaaaataatacaagctaatcataggtacaatcaaacatagttagagcaatattatcaacaaatagagtaatatggttaattagtgtatgcatggctaattaattcttctctaccgcatttagatagccatacttctctgctgtatattataattcaacttgaaaaaagttttgctaatgaaagattaacttgtttaagcgtctataagtaccttgaacaaatactttagaagacgtgtcttttgaattagtacaatttacagaatttgtcaacctatagaaaaattacgaaatttatgtaaggcataattttttaggctaatgactctaattgtcagcttaatatgcagagccagtctttgtattaaaagattactctttgtattaaaagttaaaaccagtcttaaaaagttaaagcatcaaaggtcttggaaatcaatatgtgactatgtgagtactgacatagtttgtgcgtataaatacacgtgaagaaccatgttatatcttaatttttctagagacttcggaagggttacatatccaacttcttcacaagggtcaggcaaggtgatttattgactcctgacttttcctaagagttcagtggacagaagaatgcagtttaattatgtataggggaggacacgtggcataatttcagagtagccctagaaaattttgtagagtgccacgtggcccaatggcagcctggatgctgcaccctgaaatcgttatttaagatgtgggactagtaactcagagaatcaggaacataaaaataatgagtgttcgcttacatcccgtacaagatcacctatagcatccctctgcttataaagtatggaattctttcgtccactaatgatcactagaaccaagacaccgaagctaaacacatccgtcttcactgaataaactcctcgagatgcatactccggagctttgaaaccactgaataaagaaagattaaaacagtcaagtcaacacaagtaaggaaacttatatttatgacatgtcagaaaactcatacctagtgcccacaacccttcttgtatgttcttctgcaacttctgaactcagtgaactggatgatccaaaatcggaaatctttgggttcatgttataatctaagaggatgttatctggtttcaaatccctatggacaatccataacatgga

SEQ ID NO: 69962 - DNA, 11329 bp, Oryza sativa
tttattatttgtcgctgacatgtagggcccatgtgggccccgctattttaaaattattcttttgtgtgtagctgacaggtgggcccatagtttttattgttttttaaaatataattgccacgtaagcgccacgtcaataccacgtgggacagagacctagtcaaacaagccacgtgggcgccacgttaaccaaaaccaccttcaaaaccgctgagggatcacgtttgcccgattttcgtaagttgggggacgggtcgtacccggttttgcggttaagggacgaaaatcggactggatgataaatagagggacccaaagtgaacttattcctaaatagattgcattatgctcgtgggccaaaaacaaaggtactccgtaccagttagcgagtgggccaaaaggcaagccggcacatgggccaaaagacaagtcaatacgtgctgctcatggctcatgagatagaaaccgaaccgatgccaatcgggaaaaacagaggcagatcatgcggcatcgttctggaaaaggaaaacacacgtagcatccaagccggcctgaaagcgatcgcacgcggtgatgaggtggcgcgatcgatcgtgtactagacgcccgcaggtgaggtggctgcgttgcacggttgcgagtgccagcccttcctgccggtgctgttcacatgcagtgttaagtgctactccctccggagttgataatacttcgttttggataaggacacggtttttaaaaaacaactttgattattattttctattataatatgtataaaaatattaacaaatatattatcttaataaagtatttttaagactaatttatacatgtagtcaccaaatttgaaagataaatattttaaaaatggttcataatcaaagattctaaagtttgatcttacccttgtctaaaacaataagtattattagcctggagggagtaactcccagctaatgcaatgcgaactattcacatgcagtgggaaggtaattataacttactgtgcgtctgtgctcattagtaaaacggtaaaaacgagtattactcacccgtcccattttaatcgcagtcatgagtttccgtattcaatttttatttattgtccgtattatttaaaattattttatgattaatatttttattgttattagatgataaaatatgaatattactttatgtgcgacttatgttttttatttttttaaaaaaagtttaaataagacggtcgaataaagttagacacggaaactgattgatgcgtttaaaatgggacggaggaagtatatggcaagcaagcaagacactaatcatccaggtagcagagaactaacattgcaagtttccaacgtcttacagatgatagtttaaagcaacacaaattattttcgctcaatcacttgtcttttctgagtttccattggtagtatcaagcagtcctcttcccagggagcagacctgattgaaaatgagagataaattaggaaaacagaaaagggattgcaagtgtggataaactattcctggtattaaccgaagagagtaaagttaggaataccataataattgcatttccagagaattacagatagaataacatcgaacacgatttaccacaataataaccctatttattaaagtgcatgcacatatttcataagtatactccatcaaaagaaaggttgaggcgcacattatatatgtaaactagattaaaaggaaggtttaggtacacatttcatttgttgggtcctattttataaaacacatttttttataactttgataggaatgtaattattatgaaatagagggagtaatacctagtaaagaggtaggcacctctgccctcttcagcttctccacagagaatttggtagaagtacttgggatggtgatggtaccatcgtaccccttgaagtggtctgcggtcaactccagctcacaacggtacccagtaacctttcaatagagaaaaaccgataaacaaaacaggagtataatacaaacagcattagtgtactgtatgctggagaatggagatgaataggagtattaccttggtggcaacccacctacttcctggggcgaaattggtgggagtgtatcccttggactggagcatcattaccatggttctagaacttgtagtcaatgccttcccgtgtcctggcagcagagccaccgagcccaaggcagagcacaccttgcactatagtacacagcattcaacatacagatataaaagtagaaaacgattgtgtaaacaattgtactatgtattaatggggtgggaactaaaacacaaaacggagaagtagattagcacataattaattaagtactattagctattttttaacaattaatatgttttaaaaaatcaactttctatatattttttctttgcaaaaactcacaccgtttaaaagtttgagaagcatacgcgtagaaaatgagtaagttgatgttgagaaatggaagaaaacatcacaataactctcatatttggttcatggcctatttggttcactaccctaccagcacactaaatgaaagaattagcagtactaaaatatagataagatttttgacacttctaattatttggtaacttaaagtttatattggtcatgattggttcgctatcaacgtagagtcaaattgtgaaactatagtgaagaatattctaaattgctagcaaatttagtatgtgtattactatatagttgcatggcttcaaaccaaatggattgcatatactatttagcctaccagaatatttgtaggacacatttagtagggcgtttgatatcaaatccaaaacatccctaaataacacacaagaacagggcttttttggttaagaagcaaatttttgctaacaaaaatattagtagttgcataaccttggtaggttttagtactaacaaatttggttgtatataacttgaactaatgtgggcaaaaaatggttgcaaaccaaataatcgtttgacactgttaaaattgccaaaattttaattgggcaaaattagcttaaaaccaaacaagcccactatttagactaccaaaaccacacaagtgctatttagagtaccaaaaaattgaatgggtaaaatttggcactaaaccaaagcagtcctaaatgttgatagtactgtgaaggaacctctaggatgtatccaaatagaacatattcaaccaattgtctaacctcagtccaaactagtaccacctctatcattcaaagccaaacaattgccatatttactatttaaagttgccgtttttaaagatgattttaagttgccaaatcgtgactagcagtgcatgctatgttctcaagagaataaactccaacctggtggtggttaaatcaaaatctgaacctcaccttacggactactacgtgtcctgaatccgggcaggtggggtagcaagtatacctccactggttcttgattccgggcaggttggtgcacgaatctggcccaggcacaaggcacacgtctctggtggtaggctctccacaggtgtcacaagaaagctgcaaacacagagaacataaaaattccagataaacaggagataaacgaatcgagaattcgagggtatcaagccctacacgttaccttcaggtagtacgcggcagcaggaccgttgaaacctccacccactggctcctcaacgaaaagtccaaagaaagccatcgcgttgcgagagatgcttgaggtgagaatgagattgattcggagcttgagacgagacaggacgcagcgtagagaagaagacgagatgggaagaggagaggaaggggagcagttgggcgaccagggcgaggctacgggctaccaagtactgtactgggcttgtgttgtgtcagctttttctttttaccattcaccgcgcaatccccgcttggagccccagctgtcagtgcctcgtgtatttagataggaacactctagaacacgcagaaaaagtagagtaaacgtactagatgaaacacaaattcaaatttaaagtgctactcttatactaacttcagtagtctagtattacttgtggatgacgaggatttcatatatacgtggacgcatgcatgccatgcatgcgcatgcagcatgtacgtcatgcaaccatctaggcatctaggagtacatgtctcgattctgtgccggcgccggcacgctagctgcggtgtctggtgttcatgactcgcgttcgcgtactccgtcgcccccaatgccaggatcaggacatacgcgtgcccgcgcacacgcgcgacggcggcggcgagacatgcagctgacgctctaaggacacaacaatcacaacggagcgtgcgctgcggcgccgtcgcgacgacggcacggacaagggatgaacggcctaggctaggcagttggcgcggggccagttggcgccagacggtactatctccatgtcgcggatggacgtacgctagatcgagcgcatccacatagacaaggatgcgctgcggcgttcgagtcctgacgaggttgccatgggcgcgcgcgcggctcgacgtacctgcaaacaccacctcgcgacgcgaggcgttccctgactgcggacggcactacgtacagcagcggacgacgaggcgcacatagtaaccaaccaaactaaaccaatgcatccggcaccggcgagctccacctccagccatcacaataggcgtctcctaggagtgcagactgcgccgccagcaccaccacagagaccagccagaggcccggaggccggagcgcgtccactccgaccagctatgccatgttcgacgcctgcccctacccgagagggcccaaaggctgctcgccgtggctacatctagccaaggtcgccgacgagaaggcggtggaggtagccacgcgcagtgcacctaggagctgctcgtggggcctcgatccattccctggtggcctcccgccgcatcagctcggcgagctcaagctcccgcgagcagcaggcctccaacgagatccggctgctgcgcgcggtcgcgtccacgccaaccacagccacgccgcggcgtggaacggaccatgcatggtcgcgacatgccggctggcatggcatggccgacgttggcacgaaaccacgatcatggacaccggctggagtgcgtctgcgatgaccagctgcgctccatgcatgcatgtctccgacgcagcccttgccgaagcgcgcgcccacaggctgctcgccgtagcctctccacaatagtcgtgtcgacaaggcaagctagcatggagatggattcccggcaagcatgctccagagaagcggcgtgcgtgcatgcatgcatgcatgcaaccctgtatggagcttaagctggcgatcatttattcatttgcatatttgcatgcatcattggaccatccgtacgtgaccactatagcagcgcatgcaggctgcagcagataacaactggcatttctatttctcgcgcgactctcgtggaaggaaatcggtagtagcatgcgaaggtttcgcggcatacgccgatacgcgttgccgcgcacagcgcacacgcgcgagggcggcgaagatagcaaaggacaatcaagtaacgcgcagcgacaactccggcaacgacggtgaggacttggccgtgcgtgccgggcacgacgaattaatgactggaagacggtggttgctctcgctacgatctccatgcatggctgctgccagcaagctcagaggcgcgcctccaccgtcggttggatggtcacggaggccagatgcatgcgccgccgcgtctaccgagagtaacagattaagatcaatctggggtggtgtttgacgtctgctttatctcacggtgaggagaagcaaattaaaccagtcctgacacaagggcggtgaaaataccgcacactactgtattgtacaactttatggaccagatgttgcgagtcgacacgagacgggatgaagttgaagagggaggagacgagaggaggtgcaagtcatccccaaggctggcgcggcagggccagctgccacgctgaggtgcaccccatcgacaacgtgttgtccacatggaccacataggtggtggaggtgaaggtggacgacaaggcaaatcatacggcttgtgcggatgtcgacatggccggtgatgacgatcacaccatgcttaggttggagcagatcattaagctatttcacttacatatgggtcccacgtggtttttttctttgcttcttgtgccacatcacccaaaaccacctttaataccgcgttaggactacctttgcaatggttttggaagatgagggatgcgttatacccagttttatggtttaggaaagttattcaaactcgacgtcaagatgaggaacctaaagtgaacttattccttcttactacgcaagtagaacgggcatgggctcaatcctaggtagaggcagatatgcttgccggtagcttcacggcaagttgtgcaccgtagctgacaaggacgtaccaaaattattatcaacaaaaaaaaacccagatacaagagatcacccccaaaaccaagattacaagaacaaaacacccccaaaccccaaatcacaaggaaaaatactaatacgccacccaagaaaagagctaaagctagtgcatacatgcaaaaagtatgccgtcgcggctccactgaaaactccccgatgggattgagctcgaggactccctccatctccacggcggcgaagagcccgtagcgaggcatggtgagagatgaggcggcgcgcgttggagatggggagagaatggagttgaggaggaaaggagtgtaccagacaagaggagcttcgagaccaatctggggtggtgtttggtgtctgtctgggatggtgtttggcatctgctttatctcacggtgaggagaagcaaattaaacgagtcctgacacaggggctatgaaaataccacacactactgcattgtacaactttatggactagatgttgcgagtcgacatgagacaggacgaagttgaagagggaggaggcgagaggaggtgtaagtcatccccaaggccgtcgcagcattgccggagggcagcgtctgctgccacgcggaggtgcaccccatcgacaacgtgctacccccagaggtggtggaggtgaaggtggacgacaaggcaaaccatacagcttgtgtggatgtcgatatggccggtgacgacgatcacgccatgctcaggctggagaagatcattaagctatttcacttacatatgggtcccacgtggtttttgtttgcttcttgtgccacatgacccaaaaccaccttcaatactgccttaggactacatttccactggttttggaagatgagggatgcgttatacctggttttacggtttagggatgttattcaaactcgacgtcaagatgagggacctaaagtgaacttattccttcttactacgcaagtagaacgggcataggctcggtcctgggtagaggcaaatctgcttgctggtagcttcacggcaagttgtgcaccacagctggaacaagtacgtatcaaaatcattatcaaccaaaaagaaaccttagatgcaagagatcaccccaaaccagattacaagaacaaaacatccccaagccccaaatcacaaggaaaattactagtacgccgcccaagaaaagagctagagctagtgcatacctgcaaaaagtatgccgtcgcagctccattgaaaactcccttgatgggatcgagctcgtggactccctccatctccacggcggcgaagagcatgtagcgaggcatggtgagagatgaggcgacgcgcattggagatggggagagaatggaattgaggaggaaaggagcgcaccggacaagaggagctttgagatcaatctggggtggtgtttggcgtcagctttatctcacaatgaggagaagcaaattaaaccagtcctgacacaagggtggtgaaaataccacaaagtactgcattgtacaactttatggaccagattttgcgagacaggacaatgccgaagagggaggaggcgagaggaggtgtaagtcatctccaaggacgtcacggcatcgccggagggcagggccatctaccgcgcggaggtgcaccccatcgacaacgtgctgcctccagaggtggtggaggtgaagatggacaacaaggcaaaccatatgacttgtatgtttgtcgacatggccggtgacaacgatcacgccatgctcaggctggagcagataattaagctatttcacttacatatgggtcccacgtggtttttttttttgcttcttgtcccacgtcagcaccacgtcacccaaaaccactttcaatactgccttaggactacatttgcactggttttggaagatgagggatgcgttatacccggttttacggtttagggaagttattcaaactcgatgtcaagatgagggacctaaagtgtcgcggctccgttgaaaactcccctgatgggatcgagctcgaggactccctccatctccacggcggcgaagagcccgtagcgaggcatggtgagagatgaggcggcgcgtgttggagatggggagagaatggagttgaggaggaaaggagtgcaccggacaagaggagcttggagatcaatctgtggtggtgtttggcgtctgctttatctcacaatgaggagaagcaaattaaacaagtcctgacacaaggggtgaaaataccacaaattacttcattgtacaactttatggaccagatgttgcgagtcgacacgagacgggacgaaatcgaagagggagggggcgagaggaggtgtaagtcatctccaaggccgtcacggcatcgccggagggcagcgccatctgccgcacgaatgtgcaccacatcgacaacgtgctgccccaagaggtggtgggggtgaagttggatgacaaggcaaaccatacgacttgtgtgtttgtcgacatggccagtgacgacgatcacgccattctcagggtggtgcagatcattaagctatttcacttacatatggatcccacgtggttatttttgcttcttgtcccacgtcagcgccacgtcacccaaaaccactttcaatactgccttaggactatatttgcgctggttttggaagatgagggatgtgttatacccggatttacggtttagggaagttattcagactcaacgtcaagatgagggacctaaagtgaacttattccttcttaccacgcaagtagaacgggcatgggctctatcttgggtagaggcagatctgcttaccggtagcttcacggcaagttgtgcaccgcagctggaacaaggacgtaccaaaatcattatcaaccaaaaacaaacctcagatgcaagagatcacccccaaaccccagattacaagaacaaaacacccccaaaccccaaatcacaaggaaaaatactagtacgccacccaagaaaagagctagagctagtgcatacgtgtaaaaagtatgccgtcgcggctccgttgaaaactcccccgatgggatggacctcgaggactccctccatctacacggcggcgatgagcccgtagcgaggcatggtgagagatgaggcggcgcacgttggagatggggagagaatggagttgaggaggaaaggagcgcaccagacaagaggagctttgagataaatctggggtggtgtttcgcatctgctttatctcacggtgaggagaagcaaattaaaccagtcctgacacaagggcggcgaaaataccacacactactgcattgtacaatgttatggatcagatgttgcgagttgacacgagacgggacgaagtcgaagagggaggaggcgaggagcagttggcgagtcagggcggtctacctctaccgcgagtagtacgtactatgcatgggtcagctttatcccagctatacccatggttcgtgtgtactaccgtatatgcattttcttccttttagaacactctagaacacacacaaaaaagaaggtcgcaattcaaatttaaaatgctatagtacttggtgacgaccgcggttcatccatacgtgtgaaggaacacacgcatgcaagagctggcgaccatgcgaatttctgtttgcacatgcatgactggaccgtggaccgtacgtccgcgccgtggcgtaccggcgtacgtgggtgacccggagcacgtacggcgttgcaacagctagcagtggcatgtggcggcaccgccagcgcgcgctgcggtgtctcgatgactggcgtcatccgtcaccaaggcggtggccggcatgcatgcagctgcagggccatatacaccctccttcctgcgcacacggccacgacaacggcggcgattgctgcagtgcagcgagacatgcgcatgcacccgaatttcgacacagctatgtacgctccaaggacacaacaatcactcggggcatgcgcgcgctgccccaacaccacggcgccgtggacaagggatgaccgggccaggcactaggcagttggctacttggctggcgtgcgcggcgccgcgaccactgtcgcttactcgtttgcatgggcacggaagccagaccgagagcgcatccgcgtggatcaggatgcgtcgcgcgcggcgttcgagttccctgccgagggtttggtgccatgagcgttatctggccggaggagggaggggggaggccggcggcagcggcgacggtgcggggcggcggcggcggctcccctcccccctccctcccatatctggctggaggagggaggggggaggccggcggcggcggctcccggcgtgggccggcgatttttttttcgttccttccatttttcgcaggcgggccgttgccccaactgcgaaaatcgttgtggtgcaggtggacctatctcccgcttgggaaaattagttttagccgcctgcaaaaatgctttttctagtagtgttggcgctctcggacacggacaggcgtcgaacgtggcgtatctgatcggcgtggacgcgctctcgctgtttctgtgtggtggtgctggtggcatagtctgcatgcgctccgaggcggcgcctatcgtgagggctggagctcaccgcgccgcctctcctcctcgccgcttccgccccccgccgccaccgcccgccactgccgccggggagagtagaggtgaggggaggggagaggagaggggaggggagaggccggtgaggagaggtgaggggaggggaaaggaggagaggtgtggaggggaggagaggtgtgaggacttaaaaaaaattagggcccgcaaatctatttatatttaattctattttcgtaggcgga

SEQ ID NO: 69963 - DNA, 697 bp, Oryza sativa
attccaaacttagctaaggtgttcggctggcatgtacccttgccgtgatggaacaactggtcacataaaaatccgtacacaaagtatagtgaatgaccgaatgagtgtagcaatgcattggagggaatattggattacataggatagtcaaacgaggaacctactgttctgttgaccacttgctacgcgagagaaagcagacgtcgcggccagaaaccaagtcaaacgaactgaaatttttgaaaatatttggattgttttgaccctgataacacccggctggagctgctcagctcggtctttgcttgctggcggcctaaattccatcaattcgtcccaggacaactggatcgacgggttgacttttcaatggaacacttgtatcaacctggtcgacaggatgtcgttactctactttttcatcaatcatctggtgacaattgactttttgtgtgagtgacagggtgcttgacctggtcgtagcccatagtaggccaactcagaatttttagtgggcttggttggacaagtgggccaaaagttgtagccctatataactaaaacggcccactagttagagccaaacccaatgcaggcaggaggcagccctcccctgaaccaaacatccgagatttttttttaataagttcactttaactcccttaactactcatcgaatctgattcgtattcttaaa

SEQ ID NO: 69964 - DNA, 1305 bp, Oryza sativa
ttcgtggcagccgcaggcagcattgcagcaggagagcaaaagcaacgaaacgaggctaatcggcaaaagcagctagcaacgtcatggggcacaagaaaaattcagagagagcacctcaacgcaaacgttggttggagttggatcagtttgtcaccatcgggctggtctctaacccaaaagcagcatatgggactatggtcgtgtttagttatttggccaaaaaattttaaagtatacggacacacatttaaacatagattaataacaaaacaaattactaatttcgcttgtaaacacacccttagattcaggggtgtaaagttttgcgtatcacatcgaatatacgtacacacatttgaagtattaaacgtagtctaataacaaaacaaattacagaatccgcctgtaaaccgcgagacgaatttattaagcctaattaatccgtcattagcaaatgtttactgcagcaccacattgtcaaatcatggcgcaattaggcttaaaagattcgtctcgcaattttcacgcaatttgtgtaattagttattttttcgtttatatttaatacttcatgtgtccaaacattcgatgtgacatggtataaaattttaccaggggatctaaacaggccctctgtatcatgatagtgcacacaaccaagtgaacaagacactgcacacttaggctaagttctttgcctcaactccaaacttcaacttttttccgttagcatgtttttcaaacagtcaatgatgtgtttttttttgcaaaattttctatatagaagttgtttaaaaaattcagataaaatctatttttaagtttataattattaatatttaattaatcatatggtaatgaggtttctcgttttacgtgcactaaaaatttatctccaaaaggatagatcaaacgaggccttaaaagaagagagaaaatcataaaaactctcgagatcaaggtcttacaactcgaaaactaggtcatcacccaaatgccaggtataaaactccttaaccacttgctccaaatataaataagctgaagtgataataccatataaaccgagcttctggagaaataatcaagaaaacaacctgcaaaggaaaataaaccgttttcccataaaaaacaacatcattatttgagagccaaaattgctcggcacgttgttatcgtctctagtaaaaaaactggtctaaactttttgttatgtcgcaaaatccattacccaaagatatggacgcgtttatggatgatcaaatacgactacgagtatactccctccgattctatattaattga

SEQ ID NO: 69965 - DNA, 554 bp, Oryza sativa
tggttttaggctagaagtccaataaatactcgttcttggttgtagcttactcacgcaatcagtttggatgcttttggtttcgagcttgagttatctttgagtgttctcaaagttagaattttgttatctcatatgtccaaaaccttgctaacattatggatataccttttaacttgttgcacaggtaagtgttgatgttcctgatgtacgcggaaggacagagattcttaaggtgcacggtagcaacaagaagttcgatactgatgtctctcttgaagtcatagcaatgagaacacctggctttagtggagcagacttggcaaatcttctaaatgaagcagccatattagcgggccgacgtggtcggacagcaatttcctcaaaggagattgatgattcaattgacagaatagtggctggtaggaaggaactgtgatgacagatgggaagagcaaaagtcttgttgcttaccatgaagttgggcatgcaatttgtgggtaagagataatctgcatatttgctaactgtgcttttgtttattacttgcatatcaa

SEQ ID NO: 69966 - DNA, 1915 bp, Oryza sativa
cttttagcattcaaaattgtcccaaaatataacttctcccgctgcattctcttctctaccaatcacaaccttccaccattcaaattctccgcctatcgcctcctcttctcaaccaatcacaaccttccccatttatttccacctactttcttaatacccgtgactaactccaaaaatccttatattctgggacagaagtagtaattattttagtttccatagcaaacatgcagcaaatttgtcgctttcttgcttaactgagaataactagagactcactttattggtcaggccctttttggaggaaatgcttgtgctgaaaagcttgatggtttaatggttgttttttgtgagcacctcaagtcatgtaaagaacatggtcgcttaccccaggtgaaacagatagtcaatacttacgttttaaagactttcttaaagtatagcaagttcgataatatgattatggatgttaaaccaggtaataatggctaaaaactgtttagtgtagaaacacgcgagtatcagttgcatctatctgttatgtgtacgttttttctaatatcttatacttgttgcccagtacgtggcgttgcgttggtcctgtacatattgttggcagacttataagtcacttattactcctgcttactgtcctgctctagactttataggatgagatataacttctgtgatgcatttctgaaggagttttgtttctgggatccagaggtgtttcatgtcttgtaattattgaatgaagttcatgaatcatgagataattctcctaaaactggtattttgatgctaaaatgaaattatttgacacctaaagtatgttgtccttactatataaagaaaagaatcctattgggcctgagttgaaaataaataaatgtgattttttgcaccaatatatccttccttttttttctccacaaggaagattcaatagtgtctacactttgaacacactaattgtgaaattaactgataattgcatatatactccggaatttggtcactggcacctttccgtattaaattaactttagaagacaaacaaataagaatataataggtctgctgtgcaatattaattgtaatattttgcgcacttcattacaaatgcaacatagatgtggtggctgcagactcacaaccagtaccatttctttctgaagtatatacagataaatgaactattttaccctgtattgttgtctgttggttcttcatagtttggtttgaactggacaggagtttgacattctgaagactatctttcgagcatctgtgctaagggtgcacaaatccaaatttgcacaggttaagattaaccttttttttgtgttaactagattcactataattttgtgagtgcaccatgtgctattcagcattatatatttattccatcgctctctgcttcgttcttgttatctgattcttctgctgtaaatttgcagtttatcatgttttatgcctgctcactggatcctgaaatctgtggccttgaattcgctctcttcctctctgatatctttattaaaaaggaagaggattcaatttctaggtatttttttcccatatcatgcatacagctaacgtgcataccttgtatttctttgtcttgtgaacttgtgatcatagctggcattgggtgctgagtgattacttagaacaagcttcaccttttgcatgtttggtgaggtggtcatttttgtggctgaaattttagttgcaaccagatctttggagcacaaaattagctttttgatccacctgtcatagggcacacctttttgccgaaaaattctcgcttagtttggcagaaagtgtatatttattggcctgggctcctgccaactttggttgtaactgtttatcgaggggattgctgtagactgtatatttg

SEQ ID NO: 69967 - DNA, 729 bp, Oryza sativa
cagcaacagtaccaaacttgctgttcttggtttaacgataggacatgtcatctattagaaggataacctagagaacatatcaacaatgaaggaactggatttatagcacaggtctgcaggaggcttgatgagatattttaaaaacaatgaggaaatatttgtctattttctcacttgttagttttctttcaatgttttacttatgtcctgttttcctctattctccagaattgaatttgcttagccttctagtagttatatgcatttcaaatagttgtgtatatcctaatgctgctgaaacctgcaataccagttaaaacaagtatgactggtgaccacctgataggaacccattagaaagtttacctacattagtcttgacagttattttacatgacctaactattgttttggttactttgctatcttaatcaggcattgatgtatcctctgttggttgcttgcaaatcaataagcatattaagacaacgagcggcgcaagaggtcgtcgataagatccgccaacatagtggaggtcttgttgatcaggttagcatcagcacctatggggtctgtaaaaaaatattcatttcactcctgatatttctgtgaatgttcgttgttccaggcacagcttgtttcaaaggaactgatacgagttgccattctgtggcatgagatgggcatgaggctcttaaggaagctagcaggatgtattttggtgagcac

SEQ ID NO: 69968 - DNA, 4601 bp, Oryza sativa
caatgttcatagcttggagctgtttgatgaggtgcagaaggtccagtggatgggtgcggtgtctgtgggtatactcgcacatactggaacagcagaccagccacgacttagtgaagaggacaagcagaatatgcctcttccagttcaaggccctgcctgcaactcttctgggcacctagccgggtggcacacatttaactcattgccttttgccgggaaaactgccactgttgttggagaggcagcaccggttctaccaaggggtttggagtgggctggttttgtgttgaactctaggattctttggaaagaggcggagggaaaacctgattgggtgaaggatctggatgctgtgggtgagaacggcgaggaaatcgagaacccccttattttgttgaatgatccatcctccgttgagccattggggaactgtgggaagaagatcctcttgtggtggctccgtgttgaagcgcgagctgacagcaaatttcctcaggggtgagatttattttggaatttttcattacatttttcactggttactttaaactcgccattatgttgatgcaaaatattgaaatgctctatgcacctttgttcggtacttcaaacaacttgtgtagccacaatctaagtcatagagtctagagaatcccttccataagttagttatgctgaccagactttctagttaggcactcaactcagtattttctggggagaattggacaagccaaccatccaatattttttttcgaataagagcaaccatctaataattagttattcagcaactgagactttgattcagtttgaatctagtaatggtactgccactaatatggttgcactgagttgagtctggtgctagatcgaacggtgtgaattactcataaatctccttgttagtaattcacattaaattaaatagtccattgtctagtctcttagttgtttgacttcttgtttaagagctccattctgcacttgggatctgggattgggaactttgcagacccaagatggcatcctgcaagatgtcaaatttaactctgtttttgtaaaatgacctttattttgttcttttttccttctataattacttgcagtggttgtccttttttttttttggtatttccaatcagaaatgcgtctgtttttgtttattttaatgccactgtgttacatttactgctgtagcagcagcactagaattttgcatttccaatttaaccaaagtgctcaagtataaactttggctgcaacaaacgcttttgcaagtagcattcatgtgtacccaacacttgttggatagccaccactcctctgatacgtaatagaggcagtgtaggattaggtatttaacaactgtgaccccttcaactgacatgctgccatgtggtagtggcatgaaagatgccaaaccatcaataattaactaattatcattatcaacattttgttttgaaatttggacacaaagttttcattgcattcatgttggagtcaatttcatggttgaccactgtcatcggtcacatggtaaagaaagtttgtgtccttgtatcagaaatatgttctccaaagccatggatatggagcttcatcgagagaaacttagctttagagaattagagttataaaggatgtttccataaactgcaaatttcatttaaatcaactaaaacaattgattgaatattaggttcttctaaccaaacacaataacacctggaatcatcaagaatggctgactatttaattgtttgttaatgtttcttcccttatcttttatccttaagttcatgagtttttatgtttgctaagctgcaatgaaatgtgttctgcaggtgggtaattgagccacctttggacatagttgttcccgccaagcgcaccccatggcctgaaactaccgctgagctttcggctgaattagtagattccaaacaagatcaggagggtaggcggttgtcaagaaccgacagatcatctcggtcccgaagcaccacaaagcggaaggagaactgaagcaaaataaacacatcttgtaatgtatatcttacatctgcacaaactacaataggaaccatgtctggttaatctggtgggtattatgtttattttttttcctgatgttttgctaatgtggcagcgcttcatactcgtatgtcttctgtagaagactgtttttttattggtagctgtattatctatgttgtaatatacagtgcaatcttgaatcaaggaaatggaagctggatcctggatatcatatacgctccctgaagtagggtttcgtgctcgttttatgtgcttctgtgttggtgatctctgttactattcttgctgttggcagtggaatggtggaaaattcactttaatatagcgtttcgacaacggttctactaagtattgccgcttcattccaatcgatttggttgtgtattaacccttttgttaacagcgccaagctaataatcagtgcgcagaaagaaccttaagtatatatgatacaatttctttcgtacaaactatctcaagtttatactcactccgtttcaaaataaatcaaattaatacaagtgagatatcttaaaataaatcaaattaatacaagtgagatatcttagtaagaggcacgtttagattcgtattagagaatacattgctaccatactttttttctttttgtgtaacaaatctttggcctaaatgcttgatgggactattaaagattcctcgctcaattgacaattcaatgatgtatcgaataccagaaaatcttggagacatctgggacagaaaatacatgtaccaatatttaaagcactcattttctgggtacaacattatcagattagatcagaattgaggcgttttggtcccactgaattagtgatttgaatgcatcacagcatactgctgctactcctatcctatgcatttgatgcatgagcactgtcgttacttttttcttttggaaccaacactgtcactatcttatatttggatgatggaatggaagcatcgtggtccctttattcgattgcatcggtcattttttctgcccatgctgtttctgcctccatgttgttagtccatatctaaacgaggttattacaatttcgtataggctttataccataatctccttgtcttattgaaataaaaataggatgctctactgccaattttggagatggagttcgttttgttgcaaaccggcacattaacacattataaacaaaatggccctacacagtacaggcccactaattggcccaactgacctactatctacagatgggccctacacgggcctcaatgatgtgatgtgcaggcccatcagaaattgggccgcgaaattggcaagcggccaagcgggtgcgtgagcagaagaagaacccgcacccggcgccacgtgtcagtctggttcgggtcggataaatcccgcgtctcccctgctcgcccgcttcctctctccttcctccactcccgcaaaaaccctagctagggccgcctcctcgccgcccaccgcctccacgccgccgcctccctcctcccgacgagccggtgaggaatcccccatcccttcccgcctctaggctcgtgaggccaccgccctacctggtgctgattccgattcagtttggtaggttttcttcaagcgcgagattattctccaagggaggtaaggtgtcgggtcggctggcgatgggggcggagctgcggcgcgacgacatggaggtggcggaggaggacatcagcgactcccaggcgttccggttcgtcgagcacgtgctccagtccgtgcggatggtatgggattgagctccttgctcctctgctcagtttttatgtggggggatgggggtaccatgatcagctttcgaatcagtcgtacgatggctcagacattagttttttgatagctccatgggtagaatttagagttgtgttcggtctcaagtggttagtcctgctttggattgcattcccttgtaaattagcattccgaagctccgtttttttgttttattttgtcctttgattttgatacctgatagttcaatctgtggagggatgccggtagacaagttgatatagtaaaactagttcaccttttccaagttgtttctatggacgacaattcgacagaccatattgccatatacaaagcaaaaaaaataaaataaaactgtaatgtgacacgcagctttcatcttctatgttatttgccatgtattgaagtcagacgacggagctagcagtgtgtgcccatatgttaaatactaagagctctctttgtgtaagtttgcagtctgagcaacgaatgcattcacttataatgctaattctaggatagcattttttttctcaaaccaaaatcatacctctttgtgttgtttcacaatccaaataaaaaatacggccactcatgctatggataatacatttcttcagacaaaatgggggcgtgcagtgagttacctagtactgctttcaagttcgaaatccaagggtgttttgaagatgtgatgaaatgcggcagatgcatgaaccatgcggagttaggaaatacaaaggtgactgttgcc

SEQ ID NO: 69969 - DNA, 7578 bp, Oryza sativa
aaattaaagttacctaccacataatcatccgatgctaggtgttcggatggatttgtgttgcttcgttattagattctaggtctacgcttcggtgcaaattgttgaaaattcaggcatgtcctctaagagtttgaccacaaacttttctaaaacatcaacatgtatcttttgtgttacagaaaacattcaaacctttatcatcagagggtgcgtgtacaagtacaacttaattacaaaaaaaacattcaaacctttattcagagtagtagaagcagaagccggcattaaagagggagaccataaattggtctgcaatttgcaaagtccttttcaaatagctgaaccttttttatttttaatattgccaaattgatgaatgttgacaaacctggtttgatttggagggaattttcacatatttatatagtagaaatttaaaagttcctggatgtccaattgccaatccccaaaccaaacagaggccgtgtttagtttctcctccaaaaatttttttgacgtatacgaacacacatttgaagtattaaacgtagactaataacaaaacaaattacagattccgcctgtaaactgcgagacgaatttattaagcctaattaatccgttattagcaaatatttactgtagcaccatattatcaaatcatggtgtaattaggctcaaaagattcgtctcgcaatttacatgtaaactgtgcaattaattttttttcgtccacatttaatgttccatgcatgtgttcaaacattttatgtgccggattttttcggaagtttgaagaaaactaaacacagtcagaacctgaaaagtacaattgctgaatgttctcaaatacctgaagaaaaaaaattcctcctttttctataaagcaaaagcttcacagagtccaggggcgcacctacagcaccaagtgtaaccagagcttacacaaaaaaaaggcaccacctttgctcggtgctcgtgggggagagagagagagagagacagatggcgacgcggatggctgcggcggtggcggccatggtggcggctgtggcgatctcgctggcggcgggcggggcggcgcagtcgtcgccgagcacgccgagctgcgcgtcgaagctggtgccgtgcgcgcagtacatgaacgggacggacacgccgccggcggcgtgctgcgacccgctcaaggaggcggtgaagaacgagctcaagtgcctctgcgacctctacgcctcgccggagatcttcaaggccttcaacatcaacatctccgacgccctccgcctctccacgcggtgcggcatcagccagaccaccagcatgtgccccggtaaccaacttattttaccctcctcctcctccttctatcccttgttcttttaacagcaaaagagagagagagagagagagaatatgttgtttttgatagaaattatcaccgtggcatcgatcatgagttgttaatttttgtaatattggtatccaaaaactcacccaaatagcatgatttgactgttcctacactgaataaatatgaggccttgttcttgctaatgcattgtttgcctggttgatggaatgatggtttgcacatcgaagtcactgcactgtggttgaagaaataaatccggttaggatgttttaaacaaacggccgcataaactgttcttactgccatgtataatgtcatatttctagtgacaagtcgatgtaattaacacaaatttgtccggcgaaaaaaaaaggtaattactacaaatttgggaaagtaaaggaatgtttttgcctttttgttgcataagtcaataagtggcgtagggaagttggctttgcatttctgtctctatcagggcaaaacgaaacaaagaaaaaacatttaggtgtgaatataagaccaagctccatgatttgggtcgaccagaagtttgtaggcatccagattcctgttttttgcttccccagtcctgtcctgtaataatcgtagtttaatctgaagacgcaacgatgtcagattataccagttcgccttgggtataatactagttgaatgattagtctcagcctaccgttggatatagtattgtagccatttcacatttgggatgatgtttataaatcaactaggaaaatagctaatttctttgacctgatgaaatggaaccatgaaacttaatctagatttgtttagcactgttttgttgtgctggtaacttttaccaaacatcattacaaaattcatttttttttggaagtcacaccagttcgctactatatctgttgtatttggcaaccgtccttttccttagataattttaatacatatatttgtatggttttctgataagtgtcctacaataatattttgcagggaattcccctacgaactctcctccaggtaatatatactttctgaagatagtatgcatggctatttaaacttaagattttcttagcttgttatatgtgcgatacctcactacctgaaactttttgtctggtccgataatttttaatgctatgaatttcaactggaagcagcagcattttgataaagtcatatcagatagatctgtaggaagaaatccctcaacttgagtttgatgtgaacttggaccccaattaaatagatgaatgaattaatatgtatggttagacatgtattagacatggtcccaaggattactgtggactactgttaagcacaatgatttgaaggttcatcactgctgtatgatactacctgtttagaaaatgtttatggtgctaaaaccatagcagttaagacagataataaatgctgcataaagtaggagttagtttggtctgaacaaatttatttaaagatgttacattttaagtcggcaaatcaaccaaataacatgggtgatcaggctaactagcatcattgaaagaggctagaaatggttaacacggacagtttgtgttgacctgggcatctggcatgctattagtaacagtctatcagactgccttacagagttatatttatgcatcctactgctgttagtcagtttatttagcgatgatatttttgcattttacgctcacactagccatgaagtagatgtatcaaattcttcaaaattccagacttgctatggatactcgtgcgttcaatgttcagggatagcaaacactgggtcttttttttatagagctaatgtggggtctaagtgtctacaattaagaagtagtgtagccattttatttgaatacaatgcattatattacttcggtaggaatacatgtagcattagcaaagtaaaggataacaaagatcccattctgcctctttttctcacatgtaaaatagttaaaattaaaagtttattcgaattgattacgcatgtaacatcacgataacactttacagagtacttttttttaacctcaattcttaattctattgtttgcagcctctccatcaggtggcaaaaacgctggtcatcgcactatgtcagttggtcttccaggattgatgagcttgttcctagcgttgtggtctgtattggcataagaattttggttccatatcagagatgttatcgcttatgccacagtagaggatttacatgtgacggtgtttgttgattggctgtatcatcattctgtacttggatcagaattcgttttgctgtgtatcaatgtcgcaagtcagaagacttacattgtgttgtacttagacctgtgctgatcaaagcgtaatggatgaattgtttatcttctactcctgctcaacatattttctcgatgtgattgtccaacacaaatagtttgccaatactagcttcaattgcctgtgatttgatcttcctaaaaagttgccttgcgattttgagtggatttcttcctctctgttttttttcctttttgaaaaagaggatttcaattttcagccaagcactgacgacgaaacctacagcctcatccgatggctatgtgcggaaaatacgccatttggcgtattagtaaaaaaaatataatttgtgattaaaacttttacagttatgttcgtagcgacttaaatgacaatcttgtaaaagaaactatgatgaaaaaaactcaaaaacaacttcaaaattaagttaaaaaatttaaatgttggcattggcatatgctgattgggccaaaagatgagagccctagccatcctagttgggctcgttgtgatccgttggatcaagaatacgcggcccacaccgaggagagtaaagcccagagggatagttttccctataagccctcatacaatattgtatttccgtttacaccctgcgaatatttttcgcatccacgttggacttgtcttaaccgttcgatgaaccgtaggcggccaagatagatccaggagagaatggcgaaaggaattttctcataaaggtccctcacagaattgaattttacattcactttcactaaaccccatccccttcctctcgcccatgctcctccggtgagcagcggcggcggcgacggcgaggtctagactctggagacgtgtggctgtcgaaatgaatcaactgagtgcctccgcaatgctctcccgcgcagcctctctccgccgcgccgcggcggcggccttctccaccgccgcggcgaggccggagaccgggctgtacggcttcgatgtgctgcgcacggccaagggcttccgccgcttcgtcgacgacgccatcgagaggtaaggggtggagatactgaaccgcaacctactcatctggaagctggagccatccattggctgctgagattttactgaaacgcgcaggtcggacgagctcgtggcctacatcgggcagctgccgccgtccgcggagattgtccgcgccatggatgagatatcgaacactgtagcctacttcctcttctgctaatgatttttttgcggaattagtacttgagttggtattgagggagtgatgtgcgttttatacttgatgatttggttaggtctgctcagttattgattcggcagagctgtgcaggaatacgcacccagataagtgagtgtacactggttactggttgcttcttatgaaaatcatactctggagcaatgtgttttagttttgagtggccaattacatgtgtattctgtgccagggaatttatggatgaggcagataaggcatcaatgaggatttatgaacatcttcaagtaagctcgataacatggatgttgcataccgaaatagttggtttgaggaaaaaatgagggagagaacttagtgaaatgaccaagtcagaaccattaaatttcctttttccctgtgattctatgcagtatctgaataccaatactactttgtacaatgcaatacttaaagctgagagcgaaggtgtcatgctcacagaggaagctcgaagggcagccaccaccttgcgtgttgactttgagaaagggggaattcatcttcctaaaggttggcctactagagttatactggtgcttcttgttttccacttgagtgttgctaaaagtataatttcttccatggcagataaactcgaacatgttaatcatctgaaccttgagattgcccagctgggtcgaaagtaggtacatgaattgtataatagacagtggctgtcattgtactattttttgttgaacttttcatattagctttgcattccttgttccagttgcatgtctgccagactgcaacttactatcagcaagcgatctcattatttggtgacatttgcttgttggtaagatatatatgttcaacatatatggtgttgagttcatattaacccttgggagatgcttctgttctgaaaatatatcattatttagcttgtttgactgcatagagtctatagggatgtgtgtcaagctgtcttactgcctgctaatttgctgtatagctgttctgttacaatgcttaaaaatagcgggatcatattacctactaaataattcttagtagtcctcacatcatcatattactaatgtataaatggtttagtttatgcacagactgctagtgctaagtatgaggctaaggtgtatatcgatctgttcaatgatgcacttgttcaatttatttcccatctcttttccattatcattagaaatgcgagaaatgatattgaatctccttgcacacacacaatatgcatgtggcttataagtgtattcgtaaatggtctctcattcaaatggcattctgatcgctataaggatatctattaattttactttttttttccatttaactgcacagttccattgtggctttcctgtttctttgcctgtccagtacatttccctaccgcccctttcttttcactgaattgattctgtgaattgtaattaatgccatgcctgttgatttgaggttctaaaatgtataaatttgcttgttgctagtgaacttactcattttttctgtgccaggttcagtgaaaatgttatgaacaaaccaggttttgtggatatatatccagcttcgcgcattccaagaaatatgcaacgccattttaaatccattcaccgtattaaaccttggggcgatgaggaacaaagaaatcaaatggacactacaaagcaaaagggtctaaggatagtcactgattcaggaactctatcaacagcactgagatgggtctcagatgaggaagtatgttccctttattccactcaccaaccattaattatcaatgtattatatgttatcaacctaacatttccaaactttccaaagatcaggaaacaggtatacctggtaggaaactctgaacctcgtgaaaacattacagttcttggcaagcttataaatgcacgtgacgagcttgcgaaggtaatttttttcatgttattgtagggcatttatttgaaggaaatagatgctataatgccattgtttttaaatttgatttgtttatgatttactacactccatggtgtactgtcaactagatatggtctgtaatacagagaagatgagggttaagctatggttaggtttactaaaatagcatgtttaacatgcattcttgtatgcatcaatacctgataaattgcttgaaggatatggtcatgtggtatcttgactcaaaaggtttcaaccatgtaattgaggagataaatttgagttggcattatgtggaaaatattcccagccaatggaagaccagtttgttgatttagttgagaagttattggatgcagtttatttgtgttataccaatgtgcttgatcttgactattgcagaatcaaaccttcctttccaaaggccttggatgacctatataggcctcattgcgtctatcctttagcaaaatatctaagctagatgtgacatgttaaactttcttatctcacatcattggatccagtgagagttatcagtggcctgccctcttcctttgcagtaaaatgtgctgcagcctgcagtatacatttttgtaaatgattttgcttggatcttacctgttgggaccaattagacccaaaattttgttggtatttgtgctttggatatatagtgcaagttgtatttcttaatctaattgagttgttatttggatcacatgttataagttga

SEQ ID NO: 69970 - DNA, 12555 bp, Oryza sativa
ttctccgattccccttgaacccaaaatccttcaacagcagaacaatgcaatgcagcggttaagaatgagttaaccgacataaatttacccgtccaaatgcatgtgtgtcgaggccattggtgaggaggtcggctatgtccttcttcatgaatcgaatcatcgcctgcttcttccgccgtatgagagccagccgcgtacgaatgcatttgaatgcgtgcttgctgcatccattgttcaagaaccgaaacgattggtcaaaccttctccatgaactcaaaacaatatttttcaaggtggaatcaaacaaatccatcgcaagcccaagaatttgtaacccaaattcgcgcaatccaagaaaataatctatcaaccaatccggaccgaacgcgtaagctgacgaactcgagaacctaggagaaaacaagaagcaagaaccactcgagaacctaggagaaaacaagaagcaagaacccggaaacccaagaacgcacccggcgaaaagttcgcccctccatgcggggaggattcaagaaccaagaaccccaaaagtagagcctcaaataaccagattggaccataagaactcagctgagctcgaaccctcgtaccctactaccctaggaacccaagaaccaaaaagaacaagcagaaaagaagcaatttctcaccatttgttgtagaacttggagttgagcaggctgccaaacatcttcccccactcctcccctcctcccagcttcttcttcttcttcttcttcttcttctcccttccgcctcgcttcacccaacaggcgaagcttccaatggcattaaatcatcaggaggacgaggaggagaagatgagagggagcaatgggggaggggaaggaggcggttgtgggggaggaggaagtggaggtggtggtggacagaatcgatgtgagctgttgcaacagaaggcgaaaaccaggtatggcttggccagctagggcgatcacgagccgtccgatcggaaattgacggtgaggattggttgcagcggaaagagggaggattcgtaacaaaccaggcgaaagtttaccgcacaaagcaaccaaccgaatttcgaatttgaagccctaatctttggggaaattacccgttgcagccgatattttgcttcaggtcacaaaagatgagaaaaatactgctgctttttttgttaatcttgaaggtgaacacgttgattaaattgcatcttaattactatcatgattaatcttcaatatacttagtattttgttattcggaagaggtaaactgagaacactgacattttgaagcatttgatacgaaacagtttcaagttggaagttgacaaaaaaatatatactccccacgtttcaggatataagacgttttcactttgattaaagtcaaactgttttaagcctgatcaaatttatagaaaaaagtagtaacattttcaacctaagacaaatctattatgaaaatttatttaattattaatttgatgaaactaatttagtattataaatattactatatttgtttataaacttagttaaatttaaaatagtttgactttgatcaaagtcgaaacgtcttgtaacggatggagtatttctcacgtgaaagtcaactactgaacattctctctcgcgaacctttgcaagaaacattcctgtctcgtcaaatctctgctagtacaggttgcagttaaaaccttttggactaattaattagcttaacatgataactacagttagctctagtagtaaaactcaacttgtgtaaataaattaactaacagcaacagttcatccccaccgcaacactcaagtggataggattacttaacctcacgcgtgacacagccaatcgattagctcgcataagtggttttcacggactactaattactcatacattgtcaggtgttacccacggcatgatgttgcatccttttccattccatttggcagatcaagctacacgccatgaaagctcacggacagcaagacacagcatggcttctattgcaatactccttgttaagaacagcttggcagagacacaagtttgatcagcttccagcgaatcagttgatatcttctactattaattaagtttagctgtggactaatctgttcggtttactcgcctaaccttgtttgttctgtgaatctctctcgcatgaacaggcaagtgcaggaggaaaaggaaggcataaaagttcagagcatctttcttatgaatctcactgccgctacagctattgtacatactccagaaagcgagatgtccagatgtactaaaactatgcagaagagatcattttttgtataattcagtacagtttgtggccggctttgactgttttattcagactagattaggagactttttaaaactgttgactaacagttatgcttgcaaactggtgtcagccatgaagaacacccacagaagaagaagatttctcgactgcaaatacagaaatgagacgacaaacagtagtacgtgcaaggagattaggagaagagtgagttcgtggcccaagtgtcaggcaggatcttcgtctcttcgaggccaaatgcaaccgacaggaaaaaaaaacaataaaaaaaaaacgttgacacctcccatgactggcactggcacctccagaactctagcagcgagtacaaatggcacagggtgagatggaattcccgagagtttaatagtatagccaagtactaactccaatttttctatagctaatctaatagctcatttatacaatagttacatattacgctattaatatctggtcccacctgtcatatacacactacgttttggagtccgtactgcagctgactacaaatctatagccagctgtccttctctctcctcatttattttcttgaaatatgtttgcagctggtttatagcatgctactttacctgctcttaggaagcgggtggcttccaacggtcagaatgggcaaaaaggttgggttggggaagatgagtgcgggcagaggctccggcacggggacgtgcgtgagatcgaggcatcgtcacgagctaccagcctttttctggtttgtattgtacagctactacgctagaaatgctccaaaagtctatgaaccgttggatgtatgggttgctgaggtgcgacgatgcataggaattgacaattttgttgccgattgacgcagggatgctgaaccgtaggtacatatgtacagcattcagtattttattttgtactacatctgtcaaagtatatagctgtcattctaaattgtttagtgtagattaaggtttaaggagaaacagatgatagtgtccttcattaaatggtgtatggttagttatgaaagggtggttaaagataaaataggaataaacgtggggtgatcgatggaacatgtggtaggtattctaaagtgacaactattttaaaacgaaatttgaatcctcgagagatagttattttgggacgatcgtagtactcttttcaattcaaatcaacttttatatatgagatcacgtataataaaatttgatccattttgagatgagggggaatacattgaaagcaacacatcgttatgcgtttataatacactcagtacgtgcaaaaaatggacgccattctccgacacaacaggtcaaatggctcatttagtttgaagccctatcaaaatattgtagtgtcaggcattaccaaatttgatactagttaggctaaagatgatataaattgaaatgccactaaagtactattttgaagctaccaaaatatagatagggtacaaatcatcaccaatctaaacatgtctaaaatgaactggcttacattttatcgaaatcttatacccatccatcgtataatatagcaaattaaagctaaatgggacgttacaacgaatctagacactcatccgtattacgcgacggacggagggagtataaaattttaggctttactcgctgatggctgagctgggccgaacggcaagagccggcccactgcccatgggcaacgcaatgcgtttgcagtgtgttgctagtgctgcccaaaacctctccaactaccagtctgagcttcagaaactgaaagtctgaaacctaccagctgctgatcaattcctgctctgcttcctcatcatctttttatccatccaatgcgcggacagctaccagtctttgcatcaactgaaaaaaagaaaagcattgctacttcacttctgctcgcatttcaattctgaattatcctgatccaaacggcagcggtaaaagcgaactaggagcgatcgatcgatggggagcgatgttatccaggccaagctggtgggtatgtcttaccctgaattttctgattgtttggttctttgatccttgtcagtttatctgggcatttccaatattttggtaggtacttctgggtgacttgggagccgggaagacgagcatcgtggttcgatttgccaaaggattgtactacgattgccaggcaattaaacaatacctgcttaattgttgtttaaattctcatcaagttcagtttcggactgaagattttatgcttttcaggagtcgacgatcggggcagcgttcttctcgcaggtgctgatcatggacgaggccaccgtgaagcttgacatctgggacaccgccggccaagaacgctaccacagccttgcgcccatgtactaccgcggcgcggccgccgctgtcgtcgtctacgacatctccagcacggtaattatcaaaataactagcaagtgatcttcagatgctagctgattacgcacctgctggctcatcagcagaaatggtagatttgctcatttgcagctaagcaattagtataatcacatcggtagattttcagcaactgattaagtgatatgcatatctgtgtgtcatacaggattcttacattcgagcaaggaagtgggtcgacgaactccagagacaaggtatgcctgagtgcctgacaatagtactactgccgtttcagtatcattcatatgggtctgtagcaaattagaagcaaaagtgttagttcaaattgtgattttctcttagtcttactacctgtgtaaacacagggaatccacatttggtgatggcattagtgggcaacaaggtcgacctggaagaaaagaggcaggttggaacgcaggtaaaaatgcaattcagactttcagtatctctgtatctgaagacaaaattcagaaacttttgtagggcgtctccaaaattctcatcgtctctgcttattgaaaacgcaggaggcgatggaatacgcagagcgaaacggcctcttcttcatagagacctcggccaagacgtcgcagaacgtcaccgagctcttctacgaactaggcaagcactaccgaaacaactctgtcggattcaactctctgatgcatcgtcgcctgataataacatctacgtgttgttgccagctgataggctggtcaaagtgcgacctcaccgcccttccgggatggttctccacgacggccggcgccgccgcgacgacggcggcggctggccatggcggctctgttgctccggctgatgcgcctctaccgactcccgaaatacgccatccttaatcgaaaacgtcttttactgaacccgccttggactttaaatgtccctggtagataaggcaatggatatatgctgatgaggcacgtgctgacgtgtctatgtatacagtaaactcgtacgtgtacgcgattacgcaacagcaagtcggtgcggcccaccaggccgccactccgagtccgacacgacccatcatatcgcgttcgcgagcccaagttcgagtcggacccggacaccgacagaccgacctagtccgagccctacaaatctcgcgccgccgccgctgctctgctttcttcttccaacctatttccctttcccgccgctgctctcaccgcgaaccctacgcgccgccgccgccgccgccgcggctgcgcacgtcgagcagcccgcgatggagaacgcctgcgaggccggcctgccgctgtcggtggccgtgtcggtgccgccggtgatggttgacggggagacggttccgaaggaggtggaggagtgcgaggacgaggaggaggaggaggagtacgccggggatgcgccgccgccgtggaaggtgatgggttcggatgatgagggcgagacggaggccggcgaggaggaggagattgccgaggccgacggcgaggaagaggcggcggacgtggaggaggtcgagtacgagttctacgacagcgacggcagcgaggacgagggcgacggcgaggaggttgacccggcggtggcgagcgccgcgcagttcgtgccggaagggcagtttcttgggtcggcgcagttcgccgcctacggctgcgccgccggcttcatgcgggtcgccgccgtcgaggcggacccggccgacggccaagagatcctcgtgctctaccgctacaccctcctcaagagggcatggagcgatccggcgggcgtggagctgtccatgtgggcgaaggtgtcgaagatacaccgcctccggttcatcgtcccggcctccggcgacccggcgagctcgctgccattcgccgggctatctctgtccccgctgatctaccacaacgactacgtcgaggagctcgagacgctgtggtccaagctggcggcgcaggtgcgcgtcccgccggtagccacgcgcgtccaggtgatcgtcgacgtgggcatcctcagggcgggggacaacacgccggagcgcagggagtacatgcgcgccgagctggaggccaagaaggagatgccatggccggggaagctcctcggcatggagctgcacgtgccggagccggtggtggcggcggcggcgtcgtgcaagagggacagcagcgaggaggtgttcgacgacgcgccagcgccgccggcgaagcggaggaaggtgttcgacgccggggaggagtgccccgtctgcctggacgagctcgaggacggcgtcgtggcgtggcctgggtgctctgtcgcccatgtcttccatggccaatgcttggagacaactctcaaggggagccagatgtgccctatctgcaggcgtgatcttggcctgaaaaccttgcaggagtagactgatgttgcagacttgcatttgaaacagaatgaatgaatgaattgtaggttgtagtagcagattgattgttctgcagttgtagccttcaattcgatcgatttcttgtgtgaatctggagcattcttcagagttcatacacatggttcactgtaaaatttgttccatggattatactatatatgttgtttctgttctgttcgatgctaagtataagcaatccattgtaataagagattcttggctatttgtatactgtatcatgcatgcattcaattatgactctccacttatggcttatagcaaatcaagtaacaatgtcagaagcattacttgaaattttgatttgttctttgtgtccacttagaattgaaacatatagaataagatgccaatatgcaatttcagtattcagatctccgacaaatatgtcgttaaaattcagaagtcattgtttgagccgtacttttcttatgttcaagaaagcgccatcatttagctgaaaacgccgtccacagaatcaacttggatcattagcagtttagcagcatctaaagggagaggatatttatcctctgaggggatgtctcctcgtataactccctctctctcaaatttaatatttggttatgaaaaagaaaatctaaagtcatttagcaatgtagagtgtagtaacattatcttgagagtttaaaacactttcccgcgctaccataccactcaacatttattttacataccataccactgacatccaagagaaatatcggatgttccatatcggtcacgtttctctctcgctcatttgtagaaatggtgataaaggatggcggctcccagttgtcctcctcgagacgataacaccacctctagtcctcgggacgatgatgccgcttctcctagggcacccctccccagcctttccttgcacaccttcttcctcctggcaatgccccctccctccctccctttcccctctttggcttatcaatttgttttagtcctttggccaaatctagctaaccccaacattgaggtacgagatctagttaagaaccgtcctagacagaatgagggtggcgggtagatagctccttgttggggctttccacaagcatcgcctccatcgcggtgtccctcacttctgtagggggagggggagaaggtgaagaagcaggcgacggtgatgaaggagaggccagcagaggcaataagcggatgagcatgcatcattgattggcataatagctcattggactcacggaggcgtacgtggagtttatggtgccattataagcgccatatcacagagtatgttgcccacaatatcttcttaatatcgcaattggttttgtttggattttgcatgtattagttacaatattttcagaatgttgccgtcaattttcatgttgcatgcacttttttttattgcaagagtatttatgaatgttgcatctatttgaaattactaatttttaccacctccattccaagatattgctatttaggatatgattttacttatcctagggcaatgaatctggacaccagccagattcgttgccaagaatagaaattgacctattctagcaatattttgagacgaatatagtatcaagttaacttgaatcatttctttaattaaccaagtgacgaaatatattgcctgttttggctaggatcgggcagtactgatccctaatcgcatccgtatttatttattatggataaggcatcataatggtaatggatgtgctgactacattgtatatatattctttaaggaataatcaactatttgccacttgtacaagtggttctaaaagatttgccagacccacatgtcatacacacataagggtctacatgttatagatagcgagcgacaaattcttaattaacacatcttaaaaaggccccatgaatccgaatccactttgtgtccgaaccgaaaaggaaagcgagtgcgcgctcgaattaagccacccgccctagctagctcctgtagagatcgagatcgagcgagctcgccgccggatcgctacccgcggcggcggaggaggaggcgcccgccatctcggtggtggactacgagctgaccgacgacgacgagagcggcgacgaggccgacgagccgacgaaggcgagggacggcgaggcgccggcggccagaggcgagctgccgctggtcccggcgccgttcgtcccggaaggggagttcctcggcccggcgcggttcgccaccgccgggtgcgccgccggcttcatgcgtgtcgccgtcgtcgagggcgacggcggcggcggcggccaggagatcgtggtgctctaccgctacacccgctactcggggacgtggagcgggcgaaagggcgtggaggtgtcgaggaggacgaagctgaaccgcctccggttcgtcgtctcccccgccgccggcatggcgagctcgctggcgtgggccggctcgtcgctggcgccgctgatctacccctacttcttcaggcgggagctcctggagctttggtcgagcctgatcatggcggcgccggcgagcatcgtcccgccgggagccacgcgcgtggaggtgctcgtcgccgtcggcatcctccggccgttggacaagaggccggaccggatggagtacatgcggcgcgagctgtaggccgaggcgccggcggcgtggtcgtggccggggcaccacgtcggcctggacctcaacctgccggagccggtgctgtgcgacaggggcgccaccgccggcgaagtgttgtcggaggaggagggcgacggggcgccgccgccggcgaaaagaggaggagggcggtggctggggtcgccggagaggagtgtcccgtttgcttcttccagcttgagaccgacctcgtcgcgtggcccgggtgctccgtgcgccatgtcttccatggcgagtgcttggagttcactctcgagaggagtgacaagtgctaggaaggacctggttataaaaaatttgaagggaaactgttttaaacactcaggtggacatattaaatggttataaaaaattttttaaaaaattgacatgataggttaatatgtaatatatcatctcacaaacatgcaagttcaaattcgacttctacaagctgtaacaaaaataacaaatttgactgtgaatatacatatactagttagagttaaatttgttatttttgttatagcttgtagaagtcaaatttgaattttcatgtttatgaaatgatatattacatattaacctatcttacaattttttttggaattttttcataatcatttaggtggcatgcaagaaatgggtggacatccacccgagatattaaaatccatctccaaaatttgcaggcttgagttctggagccattgatcattgatgctgctgtctcaaaatatagtaacctaaaactaagggtgcgctcgtttcagtaggtgtggtggactgattagccacacgtaaaacgagaaatgagattagcatatgattaattaagtattaatatatattttttatgaataaatttgttggatttttttaaacaacttctttatagaaagttttcgcacgaaatataccatttagcagtttgaaaaacatgctaacagaaaacgagtagaatttaatcctataagctgaaaagagcgcaacctaaatgagacacatataatagtacaatgaatctgaaccgaggtatgtctaaattcatacgagggggccaaacgacaatgaacatataaaaacattactatatgttagtattatgccaggaatctaagcttgcaatggtaaaataaaggataacaacatattatatatgtttaatttggttgcttggggggaaaacatttgcccttatatttgacctataagcgtaatcgaatgttctctttttattcattattggacaattaagtactactctctccggtttagtggaacaaacatgtatacaaaatatccaatgaaattctcaaatgcttttacaaattttgtccatcaatttaccaacaaataatggagctcaacaaagtgagtttttaaataaaggaatatcactacaactttgatctatatgaagtttagtttacgttcatttgaatggatcaagaaacagagtcctcggctcggcaaagtccttatcatgagacaagagtcctcagcttggcagtgttctcaacacaacaaccattcagaaacacggaggagggggaggcaatctcatccattcgatctaatgcagacaaatatgtgtcgttggattttaagaatgaaaaatgagtaaaaacagttggtgcattgtagggtagaagatacaattaagaaaacaggtaaaatgaaaaatggatgtgatacaaagaactatataaacttacaatcagtatatgaacaaagaatatctacgcacaatcaatatctgtctatagtttaagctctacacatgcaaggcgtaagggggttttcccagaggtcgtagtgtgggaatgtggactcagggaggccagttcgtgtctggtgagtgatcatcacatcctccacgaaagttgcccatggcatgtagggatcgccgaagaacttggacatgaggcccttgtctggcttgatagacttgagccgatgccgacccatgtagcggcggaaaccgatgatcagcttggcgaaattgccaccgtgggtcatgacgaacacgtccgatttcaggcaaaccaggaagtccaatgcagcaaggctggtcacatgcttcttgaagtgttctatctcgtctttgcttgcaagatcttcttttgtaacctataattaacgaaaaaacagagagaggagagaacagatcaattgtctgaacagattttatgctggtcagaactatctcgactatctcgactacattcaaaactatatgcaactagtatattttcccatgggttgcaacagttctcaaacaatgatagaagacacatggcataagttctagccctgcataattactcataaataaaagataaccgttctctaattcaatgaatcacatgcatgattcacaaaagaattaaatgcaacatcaaatgtttctacaaagagcacgctcgtgtttacgcagatccatctataaaagatccggtcaagtaatgagtgtgtagagacatgacactactaacatttataagtcgtagtaaagattttgcaatatgtctacattaaaggaaacacggaatgcaataaattgaaccttctagtaaagacctaaagtactgaaatgttttcccggtaaaaaaactttgaagcacttaccaaattggggaacatattccttagcggagccattctattgcttccaccataaacttgaccggatgcaacatatatctgagtttcctttgtatatcccattgcacgttaaataatacctattttcccaggc

SEQ ID NO: 69971 - DNA, 18455 bp, Oryza sativa
ttacattagcatttttgtttgcaggcaccgcgtggcaaacattcttgggaagccaccttaaactatgctcgtcaatgtcaagagaccaagaccatgctttcaccttcagacttcagatgtaatcaacacttgccaaactgctgctaatgatgctttgatagtacaaagattctgtctgaataatttacaacaggtactgtatactaattaccaatgctacaacattctaggttagagtaaactaacaacaaaacaaatctttaggtgcttcctgtctgttgctctctcttaagcttatcttacaattgtttcattctagattgttcagataaactaatgtcaatgctacaagaatccatgcaaagaaataagtgaccccaaaagaaaaataaatcaaatgcttcatttcatcaggatggcatggcatctgagtgcacattggcatcttgtgttctctgcatcttgcattgcccgaggcttcacttaaactctttattaaaggcgatggatgcagagatggatatagatggatggcttggacatgtcaggtccgtgacttaaattccaagcgtattctgataacatctccccatctaacaacatttaaggcacatgatttggagatttttgtcaaacatttttggcaccaaatctgataatagctcacaactttcttgctgactttaggtgatatcataagcccttttctctgattgacttgagatatataattgtcctattacgtccatctttttggctactaatttgtagattcatcttgagcagcaatgcaaatgcaaccaccctaagccttcctagcccagtggttagcggttgcccggccaatctgaagctgatttgtacagcaaaagcatgcgagatggtacgttccatgtctgatgaggtgaagtgctgccttgctcgcttcttcagataatgacctcgtttaatgaggcgatctgacagtgactcgcgtagggagggcactaaatagcatgacggtgcactaccgctccttcagaaaatgactttgtttagattcatgaacattcttctattatttctattctgttccaatcttatgttttttctttgctgcaaccaaacactaatttcttttctttgggggaaattgggaatccatatcgcttccattgtgttttttctattcttgtctttcaaaaacgcccatgattcagaaagaactctactttctgaaaagaattctgttgcaaccctgtttttcctatgttacaaccgaacatctgtttgtgatttttttttctttaagaaaattcggaatccatataactattcctgtattattcatgtgttgtggccaagcatctcttttgaggttttcctatgtttttctcttttgaagattcatgtggcagtcttgtcattggcaggactagaaactggccggcggaggggcgtcggtcggatgtggcggaagccatgtgccgccgatgtttagatggtggacttagattgggcgacgaaccacggcggtaggggttccgagtgaaagcttagcccaatcctttgggctaacagtgactacgccttcgggcgtggtaaccctcctgaaggcattgttgaggtacccctccctcggcgaggagcactgggtgaaaactagtccagttctttggacggatgacgattgcgtctttcgccgttgcgaccctcgtgagggcgttgtttttgtgttttcgtgtcgtggtgatgttgttggctcggtggcgatcggtctcgcatagcgatggccggttcggtgcttggcttcctctctgtagcgtgtgtttggacggttggcacatggttcaaccgttcagggcgtgtgttctagtgcacatccttgtaaaacttttcttgtaaccttttttcttctatcttaattatattgaatgatctccttcagtcattccggcaaaagaaagatttctactttacggaggaggtttaagatacgatttttaggcggcaattaatctgctgttgcgtcctgtagcgatgatgctgctgcactggtttcccctttgattgtttggcattgattaagtttagctgcttggtcgtgtgactcatcacattgtgcaaccgtggcccgaaaggacgacagaaagcgatggcttgtcttggcttcatccactttttccattgaactaactatagtaccagcgatctccacagtaataatatcatacgaccaaactgacttgcctgtattatactactaacatttggttgacttggggcttggaaccgcggtaagatcgttgacattaaagattagcaaaagctaagctacaaactgtaacaactttccatcttttgatacacaaaagaaatactgaaaacttaacttatctgtaagtttacatttttaaatcgaaataaatacccccatatgttttatttaaccacaaaaatctgaaatagtttaattagcaggcaggcagcttagttcaggccccatttttgtccgattgagatgcatattttacattagtttcattagcacgtttgtcatcaaacagtaaaatggtcacatttcatgcaaaaaaaaattcctatatagaagttgatctaaactatcagataaatttattttttaagtttgctataagtaaaactcaactaattttatgctaatgactttcttattttatttttctaactttattttttatttttaagtagaatcgaataccacctcagcctgattaatcggagataatgagtctacgaatttgccaaacccaggagaagagaagaaaagaagagggagaagaaaagaaaagaagagaaaacgcagcagagtcacgtacgaaaacgaagagcggccaccgcaaatcccggcgggattaattcgcccttttacctacccaccccaacccaacccatcttcttcttcctcctctcctcctccacctcttctctcccttcctccacttcacccatctctccccacctccacctccatatctatccacttctcactctctcacactctcactagctaggagcactccactccaatttactactagtatctctctctctccaactaccgccattgccttcttggcaagctcggttttcttgcggagatgaaggggctcagtgggccgaagctgctggtggtccacccgtcgtcgaacaagccgctgggtggcgccgcgtcaccggcgatggcggtccttggctcccgccgccggatgtgggtggtgctgttcttggccgggttcgcctgcgtgtcgctcggcacgatgctgtgcgccgcgcgcgaccacccgccgccgcccgtcgccgcgaggaggctggcggcggcggaggcgcaggcggcgacgctcgcagtgtcggcgcggggtggcggtgcgggtggaggtgggggtgggttgccggggtacgtgttcgacgcgctggtgcagtacgcgtcggcgggggggaactcgacggcgagcatgccgggcggcgacgtgcgcgccatcgcggcggtggtgaagcggcgggcgccgtgcaacttcctggtgttcgggctcggcggggagacgccgctgtggcgggcgctcaaccacggcggccgcaccgtgttcctcgacgagaaccagtactacgtgtcccacctggagggacggcacccgggcctcgaggcctacgacgtcgtctacaccaccaccgtccgcgagttccccgacctcctcgacgccgcccgcgccgcccgctccgccgagtgccgccccgtccagaacctcctttactccgactgccgcctcgctatcaacgacctccccaaccagctctacgacgtcgcctgggacatcatcctcgtcgacggccctcgcgggtaacaaccaaacagatctaatccttcttcttcttcttgcaatcgattctcctcaccgataatgatgcaggtacacggcggcgtcgccggggaggatgtcggcgatattcacggcgggggtgatggcgaggtcgagggcggagaagggggcggagacggacgtgctggtgcacgactacgagagggaggtggagagggcgtgctcgagggagttcctctgcgaggagaatcgcgtggaggaaaccagcaccaggtcgctcgcccacttcgtcgtccccggcggccgcgacctccgccgggaaaccttctgcgccggcggcggcggcagcggcgcctcgacatagatttttctccctttttttactcacttggtagtttttttttttactcccatcttttgatggctaatgatgatgtcggtggccatggcccaatgagtgagagtgaacataagaacaagagaaagctgaaagcctgtaaaaaaatcggcgagatgcgaagcagcacataaaaatgtgtccatggcgttcatcttcgcttctctttctgtctcttttcttcacgttgagccacaaaaatacaaggtccagctgaaaacacaaagggccacaaaaacatttggtacacaacacaagaaaacataaactccgatttatcgacatctgctgcaactagtgggatgatagtaaaggtgagtgcgagagtggcgatatgaatggcgctgcatgcagctgctgccatatttggtgagggcgctggggcctcgctgccgtgccgtccatggtggccatgactggctgtggctggctggatggatggatgactggccagccacagtgccactcctcccaactgacgccctgtgttgggtgggagcagcgagacagcatggtgacacactgccacagtgccacgccccgtcggctgttgcctcgtcgcctctgctgctgctgcagcagcggttgcagcctgacgcgacgcgcacgttgccgggcgccgctgcggctgcggcgagggtcgcaactggctcggtggatgggactgcgtggatttggctgcaacgaggcaacgacgagggggatgttgttaacttgtttggcctgtgtgattaaccttgtcataatccataactgagttctgattgattgtcgtgttctgttctgtgtaacaaagttaggcagaaagctgtgttgcatgtctgaaatttttaggcttcaaaacaagatagcatttattatactgtgtgatgtgttggcattggatgctgcctcccaatgccaagtacccatatcctcgattgctctgagctcgagtcgatggttccacacttccacatgtactactgtaccgctcgatggcatactggtggcacccatggcgccaatgatacggtacaaaggtatgcgcactgttttgatggcttcacgccctgctttatttcttgttttgtacccctagaaccgtagaaaagcctagtagatgcatgatctcataaattgcccggcactaccttatatccatactttgtgtgtgcataattatgtttaactactacgaacattatacacaaaatagcggtgtcaacctgcacgccgccgcaggtgttagtcctgcctctgagaataccacgtgaatttccaaatgcaagttatgcaaaggtggtgaggatcaagaagaatacccattgattgaaacagtcaacatgtgaagttacaaaagctagtaggcaaccatcacaaaaatatttgccatgttttcacgaatctgacaagcacaattggaaatacatcgagcagggcatgcatgtagcgtcacgaaaaacttcgataaagagcagactgcaaataacctactcctaaatttaaaccacacgagcgacgaagctaaacaaacgtggcgtagattgattaccgcctcctcatgccccttccaccacggccccgcatcgctcctccgccacggccagccatcgcgctagcagccgcatcaccttgcgcactttcagactacagcaaagaagataacccggtcagacgaagtgatgcctattgtagcagcgatatgcatacggcaacttgcaccaaattgtgaggatggaaatgaatgactggctgaaacatctttttcactgtggcatcacaaaaggtgaataataccacaaattgtaagttcattaactagaagagattcaggtatttaaatttgtcattcgcttacagagcatactttacagtattgcctaaaaccatatgtacacaccctgaggtatgattcacttagacgtctaaaatgacgttactaaacaattattagtgaaaaagtagaagaatgaaccccatcacaaaaggatggcatggctatctttttttccttgttcaagttacaagcggaaacaatgtcatgttcctagaacaagcacacggtgtggcgcaattggcaaaggggaaaatagataatactggccaacggagaatttagatgcatttggcagagaagcgaaggatggtcaggttttattatgacagatgagaagaatcgatagtactttctttaccttgggatttttaactgtctcatccacgctgagaataaggcaagcagcttcagttgcagcatttatagcattgatctggaaatatttattttataccatcaacataacaatagggatatttaaagagttactgaaaaggagaagcaccattaccttcacaacagcaggttcccagacaaagttagcaaaggaatcagcaattccaccagtgttgatgtccacaccaaaattagcaccttcacctgttaacagtgaaccgagaataagagaagttcaccatatgagttcatataatgttacagttccacattggcttgaatgaattgaaacttttcaacagaaactaactattgaacctaagatacaggtaactaaccagatgcatgtttctgtcggagcttattgagtacatcagttgcatcaaatccagcattgtcacaaagttgtcttggaataacctgtagaagagttaatttcaactgagcaaatttgtatacttgcaaagctttgatctataagatttgaaacaacattgagcaaaagtgtaaaaccaacataagcttagtgccgttttagtgctagtcaaaaactgcagtgcttgatgaacataacctcaaaagacacaatagaacttcccattgaaaccaacggtagctcaccacaaggactggctgaacattaatgtttgttttaatgctacaagctactagagattatgccttgtcgatcacatcagggctgaaaactgaacctaatatttattaatccaacactctccaaaagaagaggacatattctatagtgaactcagggtctggttagcaacgccaaatacccaacattaacataacaacataagtgcaatttagttacagttacagttacagcatggaaggcattattcatagttaaattccccaacaatcacatcacacaaacaaagctcaattgttattctgattgcacaagtgataacaaagccttaaggaaccagcaattgcaaaaaaataaaaaaagttggattaaacaaagtactccatactatgaataaacaatggggaagaatgaagccaaggatgtacctcgagggctttagcaaatgagtttacgaagaattgagacttcccagctatggtacgtgcatgctgtctgaggtacttgcttatttccatctaatacccaaaaaaaattacagattagtacattaatatacgtggaaaattgcactgcttagtttaagctggtcatgcatacatcaatagcaccaccaccaggtacaactgttgagttcttaagagctcttctaacaatcatgatggcatcgtggaggctcctttctgcttcctcgatgaactgataacattaacagcagcattagtatatcatgattagttggaaaacttagcaaatcatatatagctgtagagcacctgatctgcaccaccacgaaggactatggttgctgtttgaccagaagggcaaccactaaatatattgaaccgttcattgcccacttgcctttcctcgaaaacttcgcaagtaccaagtaccttttcagcagaaaggaccatcatacattagtgtgcttatttgttgccaaaatagctaaccgatgcaaacatgtgtactatgactcaaaacatgaaaatttgaaaacatgattacctcatcaatgacattattcactgatgtctgaacggtaccacctgttgctgctgcaacacgttgtaaatcctcttctgcaacacggccagcacagaaaatgtcccggtctgcaaaatactggataaaagaaagtttttgagcttaggctacagtgctacacaaaaactaattgagagaacaggatgagttgcaacgagaatgcatacctgtgttgcaagatcaccaattgccaaccgagaaaggactatctttgccccacttttgacacatttatccaacttgtcataaatgatattccattcagcatcgacgattgattggtattgtaaagggtcagacaatctaaataaatgagactacagtaagaaataggggaagaacagagagtgcatgcaaatatgaatacagatcaagataacactacaagtgcttggattgtgctagtacctgatttctgcattttctttctcagatttcaattctagttctatgttcagcaaaagaatctttggactcaagaacttctttggctgttgctcaaatccagcataggaaaatgtcttcttgaaggcaacaccgttaacaaggaaggaatctctcatggtgcctccaggaacctaataagtacaaaatttagacatcctgattcataatgaaatttagatgctaaacatctattgaatggaaactggtttttgatcagtacaaatgtactatagtcatcatgcactcgatgatttaacacaaagctgtgtaccaatatcttgagaaattaccttttttattccaagaaggttaagtctgtcatcattgctaatggcaagaacagcatccacaaccatagatgcaaaaaattctttctcgccacctatcaactttgatgagagtgttgttgcagcacacttggctagcaattccttcttttcctcaaggcttttcccttcaatgctagtggccaagtctttgaccttttcaattgcctgatgattatttcatgtgagttagaaaggaatggagcaagtgggagggtgtatagagaggagaagaaaggcaagcatcctaaccaaatggccagcagtcctataactgcgaattagactatgcggatgtactccgtcctcaatgtaaggttttgcttctttcaggaactcagcagcaagaagcaccactgtggtagttccatcaccaacctgaaggaaacaagaggggtaagatacagcttactttcaagtgtatgttacaggctgcaagtatacaactaaaactggtggcagatgataaaacaagattaaattgataatcactatgaatacacaagcatcagcctaaacactaattatgccacacagcagcttatgaaagagcatcatcttgatccaatgcaacacgagcaaatcacaagcctttcatgacctaattaacagaattgtcttttttcccgtgggtcaggtcattgtatgaaatgagatgcgaaatttgaacataagtaatctgtttgatctaaaaacactaaggctatccaaacacatttttcatgaatccaaacatcacatatcagtaaaccacgggtaacaggggcaaagcaacgtgatccggaaggaacaagcagcacatccacggatcaccagataacttcatttcactcgtttaagtacttaacaaatcactcacacacacacacaaaaaaataacagatcatcgattcagatctctaccctatgcatcttgtggcacggcatattcactgaagcattgttccaaatcgcgcaaaacagtcttatgtagtaggacagctgcacactccaacgaggttctactgccaagcgcgcgcgcgccgccggggggggggggggggggctcgccagggttttacctcggagtcctgggacttggcgatgtccacgaggatcttggcggcggggtggatgatttcgaggaggcgcatgatggtggcgccgtcgttggagatggtggtgccgcccttgtcgtggtggatgagcttgtccatgccgcgtggccccagcgtggtgcgcaccgtgtccgccaccaccgtgcacgcgttgatgttgctcaccacctgccgcgcccctgcgacgtgtccgtcccctccttcagcaggatgatctgcggttgctgcaaaatccccccacaaaaaaccccaaaccacaaatcacgccagtgattcaaaacctcgcggggaggggagcagaggtcgcgtcaatggagactgggatagtggtgcttaccatcatggacgccatggcgaggagctcgcggtttcggggggatttggtggcggggagatggagatctgaggtggcggcggagggggagggggagggggaggagagcagcgagggtttttctcgatcgctcgttttgagagggcggcggcggcgcggggaaggcgagagttctaggaggccccccgggtgccgaatgaccttgcccttggaatgtttgcttgcatcctagccgtccatccttggaacgctataaagtagtacggagtagcagcttggacagtttctacaaaaccccttgataggctcggttattttctgttcaccgtttgccttgtttgtttttttaactggaacatgaataccccgtcgtgttgctgctggaaactaagttgtatagtatgtacaataagctatattatattttgtaagccaaaataaaatgacttcctatgttttatataattaacacatgactgcaaatataatgcaaggtgaacatatttttgatacttatgaattttgaataaaaacagctgaggttgtatggttttatgagagaagaatgaagagattatttgtaccatagatttattatttaaagactacaaataattggaattatgtggcttcatgagagaatagagaaattagcattaactatacttagtggggatgaacaatacaaatatagacaaaaaactgggattgtatggtttcacgagagaataaagaagagactagttgtagcatagatctatcatccaaaggctaaaaataattgggatgatgtggtttcataagagaagagagaaatagcattaactacacacttagtggggatgaactatataaatatacaagattaagtattagcctttttgttgaaaaatagattaatatgattttttaaatcaacttttgtgtagattttttttgcaaaaaatgcactgtttaataatttggtaaacgtgcacgcggaaaacgagggaagtgagttgggaacctgcaggaacgaacgcatccttagtcagatgtgtcctatatgagagaaaattctatttatgggcggataaaaaaaatgaggagctgaacaaactatataaaattataaccctcttctaaaagcatgtttaataggctaacatggaccggcgatagcgtgaccacgtcgatctcattgctatgttggaggagacaatggtagagagagaacgcgagctgacaatagaattatcgcccggttgcagcacactgtacaatgaaaaaagagaaacgagtcttatggagatcatagagattgattcatgcttggaacaactataaaggatgcaataattagtaggatctatatcaattaaaaaatatatcagttttcatatttacaacaccagcatagttttataaatctataattgaataagttttcataatatatttatatgaggttaaaaatattactaatttttttcaataaaattagtcaatcttaggagtagtttaactttaaccaaagttaaaacatcttataacctgaaacggagggagtaccattgttatatggacaatctatactaacaagctataaatgacgtagatgtgttacaactagcaagttgacaacatttataaatccgctctaatggatgtatgaaaaataaaattaataaggtgtaatggggacacccgtagttaccacgtcggcaatagaggctcagagacccattcgtatggcagatccacgtagttacccgtagttaccacgtcgtcccatggcagatccaacaccattcgtatgaatggctaccatatttttttctttcacaattcgaaaagataatccacgtattcacgaacccgtccaatccacgctcgccgcgcccggcaatcgcgtggcgcgtgtgacgagttcggagttcggttaatgtcaacgacgagttgggcagccacgcagcagcgagagcagcgtcgcgtggattccagccaaacccctcctcctctggtctccagtggcgtaacgacgagattcgtcctcctctcctccgagtaaaagaaggagaccccctttgcttcgctgttaccgcacagtgaggccacgtcgtagggtttttgcttgcttctcccggctgcaaagcggagccgcggcgcggcccggggacgaggagggaggggagccatggagatcgggcagcatccggcgagcggctactccaaggagcaccagaagacctaccaggagtggttcgccttcgccgactcaggtccgatcccaatcccaatcaccctggctgcttcgccccctttgatccctgttccccttccgctgtttggtggtatctgatgattgatggtttgttcgtgattcgttcggttaatcggcggcgcgcgcagatggcgacgggcgcatcacggggcccgacgccatcaagttcttcgccatgtccaagctcccccgcgccgacctcaagcaggtgccaagtctactgtttccccaatcctcttatttattactgtagagttgtgtgtactgacttcgtgaaatccgcgtcgcctctcaaggtttgggcaatcgcggactccaagcggcaggggtacttaggtttcagcgaattcgtcacggcaatgcaggttttcctccccttttcgatgccttggttgtactccgtgctgccatcagaagtgtatggctttattaattagtgatgggtttgtcgcaattgatagcttgtctctctggcgcaagcgggggatgagatcactcaagacagccttaagcgcgatggttgttattactagccaccaagtactaagcttctttgatgagtttgtatttactagtactaattatagtttacactgatttctgacagacttgggcagcctgaatcctccaacgatggatggtttggatgctctacttgtggtaagtctactatgcgtctatgcctcagtcagattcattaagttgtgctgcacaacacaaccggataatagtgtgatgattaattgctttacagaaatcaaagcatcatgctaagagagttgatccagatatcgatggtaaggaatgcacccttcaataggaaatcatgctgggaaaattagctatgtcataggacaaacaatttatatttgtgcaatcatgcaggatttcctcaggctcaatctcctgcaacgagccaatggttcagctcaaagtcctcaaagaaggtaatgttcgtgttatttatttttctttccttttgtgttctgaacaatagatacctacatgaaccttgaagctcttgcaaaattttggtgagttcaatttgcattacattcatattttgataacatgttgcaattttaaaaaggaaagtaaggcaagtaaggagtttgctgctgagttatttgagcggtgaagacatcaagttaagctttgacatgcaatttattgaactacgaagcaacagtacagaaaccttgattcaatgtcttaagatgaagtcgtgttgtttaaagatttaccccttatgtttttttttcacaggactgcgtcctctaaaactttgtctttaataatgttcacaaagaggcaattattaaggcctttgccctatacaaaccattgatgccagatgataaactgataaagaagttcctttctttaatgagacacatatcacttatgctgactttgtttgtggtgttctatatgtgcagatacccctgaatgctgttacttctgtcattgatgggttaaaaaaactatacatcgaaaaattaaagcctttggaagttacatacaaattcaatgattttgtatctccattactggtacatacttatatattctcattatctggtttcttattagctataaacatctaatttcttttgtttctctgttccttgttgttttccctgcttatggtatggtttaaagtaaattacttgcatgaataacaatatctatttcttcccttttgcagacaaatagtgattttgatgcaaagccaatggttatgcttttaggtcaatattctacagggaaaacaacttttataaaacatctgctcagaacaagctatccaggtttttatttagtattttctatatttatttttctgtagttttccagattaatttaggtagcatgtgcttgacagttgatatgcacttgcaggtgcccatattggaccagagccaacaactgacagatttgttgttgtcatggtaaactctagtctgcgcaattcttgcaaatgatttgttaaggaagtttgctacaacaactattggaagagctatcttgcatttttaaaatgaataagacgctatttcaatttctatatttcaatgctgataattggtttcacatgctttacgtttgaggctttgagccagtccaaagtggtagaatatttgtcagtcttttactttcctttttctttttagtttccatggctaataagagttagaacaagtagctcagtctttgccttcttttacttcaataatggtatttttatgtcggatgtatggattttgccattcattgaccctttgttaatgatagcttctaaaaaatgtcggctatctactctattgaatgctagcatggtgacactgttcaggcaccatcttatcaaaatttcctctgaattggttagctgaccatttgttcagtttctgttgtggttactacttttagggtttgttggctagtatagaagaagcataacacacccatcactatttagcataattttttcttagcttttgaacaaattcatttttagcttttactacaatggattgatgtgagcgagtgcaatgtaaacaatttgaatttccacttgcctagctggtgtgttgatgggtatattctatctgtacttctctattactacttactccagttaactttcttctccctatactagtcaggaccagatgaaaggactattcctgggaataccatagctgtgcaagcagacatgcctttcagtggtcttacaacatttggaactgcttttttatccaagttcgaatgctctcagatgccacatccagtaagatttaattttgatgcatgtagagggcatgtggtaatctagagactaattcctaatttggatgttgaagctactagagcatatcacctttgtcgacacacctggtgttctctcaggcgagaagcaacggacgcaacgtagctatgatttcactggtgtcacatcatggtttgcggccaagtgtgatcttattcttcttctgtttgatccacataagcttgatatcagtgatgagttcaaacgtgtcattggatctttacgcggacatgatgacaaaatacgtgtagtgctaaacaaggcagaccaagttgacactcagcaggtagagtatttcatagccatctcttctcacgacgcttgtttttgcatattgctttgttttgacataaatctgttttccttattggcgtgcagcttatgagagtctatggtgcattgatgtggtctcttgggaaagtattgaatacccctgaggttgcacgtgtttatattgggtaatttctcatgcccctgtcctcactgcttcgctcctacattatttttgcacagagtactttacaaactacaacttacaataccataaaaccataggttgaacattgctagaaatactgtagataaatttcatttaccttaggttagcacagaaattcacagcagtattagtgggttctcaaataattgcgtaatttggatctggtgcttgtactgatctttgaggccgcctcggcatattaaagcactaaactagtttcctgttttactcacagatcatttaatgacaaaccagtaaatgaatcagctgttggtccaattggaaaggaactatttgagagagagcaagatgatctactttctgatctgaaagatataccgaagaaagcttgtgaccgtcgagtaagttgttacagtaccttctattgtttggcttatttgagtcctggatttcacaaattaatctcattccatatttgcagatcaatgaatttgttaaacgtgcaagagcagccaagattcatgcccatataattggtcatttgaagaaggagatgcctgcgatgatgggcaaagccaaagctcagcagcgacttatagacaatttggagaatgagttcgcaaaggtatcttagctctgtaagcctgtaatttctactacatccgtttcaggttataagactttctagcattacccacatttagatatatattaatgaatctagatatatatgtgtgcctagattcattaacatctatatgaatgtgggcaatgctagaaaatcctataatctgaaacggaggaagtagtcattttggggccgttgtagtcttgtagactttacaaatggtagatttgtagtgagtatccaccctttgttcgtttagaacacgtggtagattctctgcctatcttgtcctcgtgctgtaatacttgcctaaccagttaattagtagttgtagtaatagctaattctggtttgtcgacgtatcgcattatgaagtattcatgcagttcacctgcatggttcatttcagttatgtaattccatgcttgattactatccgtggtctggtggaacaggtccaaagggaacaacatcttccagctggagatttcccttatgtggagcatttcagagatgtcctgggtgggtatagcattgacaagtttgagaaaatcaagcccaagatggtgcaggcggtggatgatatgcttgggatacgacattccagaactcctcaagaacttcaggaaacccatacgagtgaatgaacacctttaaattatgaccatggttttcaactttttatcatgatgagagactagtcatattcggagggaatagggatgcgctgcattccatagttttgcaactgtcagaaatctgggattgctgaggtttaggtcttgtaactcttgtagggcgtttattgtggcatactttaccttgttgtataactgcatgcataagaatctgagagccattgctcaattcttttcaacgaagatgtgaactgttggaaggcaatgtaaaacgggaagcgctgtatgaaagaatatgacgcacatcgtcttttgttttttaagaattgagtatatattcgttgtggggaacagcctgatgatgggccccgggaattaacgctcgagcaacgttggaccattctgacatcgcgtttcctgattagcacaatgtttcgttttatttggaaattgaattgaatgtttctactgttattaattgcagacagtacaccaaacgaccaaatctatctgcaaacaattaaccaagaccaactggagaatttacagatgaatcactgtgttacacctgtaaactgtggctcctttgagaattgagttacaacaagagtttggagatgaacttgtagttcatctatatcatcttaattaaacaataatatttattcaggaatgcagttcagagactgcttaacacacacacacacaaaaaaaaaacctaaacctgaggcttgtactggaacaaggtcattagcaaggtgtcctctagactcccggaccgacactacccttggaagtcaaacgcagctggcacaaacaaacggagcctcggtgacgccggtaaaccgcaccaatcattgttaaaccaaaaaacgtgaacaacaaaccaaaaagaaactaaaaaaccgctaaaaagacgcaaaagagagagaaaaaaaatgaaagaagaaaagaaacgacgcggactcgctgacgacccgcggcccggtccaacccaacccccaccgcctctctcgccgaccccgtccactccgccgaattcccccccaaacccaaacccaacgcgacctcacctcacccgcacgacgacggcacgacgcgacgcgttgcccgagctgacggcttgacgacgcctccgtccccgtccggcaccaacccatcccaacccaacgctccccttttccactgaccaattgatagcccaacctcacctctcctctcctcctcccccctcctctcctcctcgcctccgcaccagcagtttcgtgcaccgcacttcacccacctacctcccccaacctccccatcaaaaactagt

SEQ ID NO: 69972 - DNA, 6829 bp, Oryza sativa
tctcaaaacagctaaagactgccaacacctttttggggctggctttctgctttctcgaacaaaaccaaaaacttgattgtaactggtattgctgctgtaatctgggctgtctagaaaactagaaataaagcttgttttgataaaaaaaattgcctaatgatcccactgatgtagttttcctggtttgccactggatggaatcctaggctcttttgcagaagcgggaggcagatcaaagaaagctgctcttgggggccaagctcataaggcaaattgcaagtgatgtgtacaattctaggtttggatggaggccgacggggagactgcagtgttgatcttttggcgggggtagagtatgctttgttgattgtgtggatgctgggttcatggctcctgttagtcctggaagtcttgttatgcagttgttgattctgtgccttctggatagtccatgtatggtcaaagcagccggtgtgctggcttctgtcctttcttttctgttcttcagtttgtaagactttgatcttgtaatctctttcatttctagtaatggaaatgggggcgtaatgcccttggtcaaaaaaaaaactcaactaaagattaattatctctaattggatttatagtttaattgattaaaacataccgctcgtaatggtaccatccacgattgaaatataccgcttatagtttaattatatcaatagtctttcatgtgggaataaaaaaataaagactattgaaagaagagaccatctagaacacaacacgagattaattaaaattcagaaaaaaaaatccaaaaatataaaaataattgtaggagttaaagtatgaatacaatttataaataacaaaatattgaaatgaaaaatatattttttttaaaaaaaatagtccatctagaacacaacgatgacaagtgacataaagaggagagaagcaacaaacctgtaagaagtagtgttgtgggggttgatgggacctctaaaaactataagcaaaactattgacagtcattaagtaccaaatgcgatagtcaactatgataataaataaagagagaactagcatttcttacatgtattccaataataaatagtgtagtactactatgcttgaagaattaacatgaatgcagagaataaacacacttctggctaatcacgtgcgagcacacggattgagtcacccacaagtcagctcaaactgactcaaagtggggccaaaccaccgggaaccgaccaagaggcccacttgtcaaccacacaccaaaggaggtggctaatggcggttactctggttcagctgaaccagccttggagcgcccaacactcccttccacttggcaactcctcattcactcctgatggcagttatgcttgattcccggcccacaactgccttaagcaaccaccatttaaagctataaatagtgataaggacataactagcttggatatgtccatgactaacttgtgtatttatcaaccaaaggtacatatgttttatattagatttacttattactccgtatatatttgaataaacgttactacaccatgagttttgtatcttctcgtttgcagatctacttgcgtggatgatggaacagagaccgggcgtaaggaatgcatggatgatcaaaaaagttgattgggaccaaaccaagaccttctcctagtctacttttacctaaccacgtcacgtttggtccaaagaagataagagataaagttctacacgttttggattcggattcgggccttctgacagcattaacttcaaacagacctagccgctcgtataaaaggaatttcggggcccatgagtacttgttggaaagcttatggagtatactttcagatggttttggtcatacattaaaattcccaccgagttgtcggaaatctgcaaaacaagcctcataccttatccagtccaaatctgatttgggttttagaccttgtaattatgtcgtcgcttagaccaaaggggcgtgcgccattgggcaaccctaggacgtccctaattatatatatttagtagtcgtcatcgtttagagtcgagttttgcttagattatttctgccattgcagtttcgccgctaggtcggtttgtggaaccctaaatttgagtgcttaatcattcgtatgcaattgtgttgcaatctatcttattcttgcttgtgttcttcgattcgcatgcagggattagccttctcggcgtggtcaaccggacgatgcacggttgataaccagaggagacgtggtgctgcgatttgcatggttcggatcgtgttgatcggaagccggattgtgtgtgtcaagtttccgccaaatcgagagttatcaatacctatcgaaagatcgagacctagcatcctcatcatagaggagatcttttcacttcccaacacacacctcaaggagcaattctctctatctatattgtgttctctacagttttagtagaaataggcttggagtatctccggtcctatagtcttcttagagattccgatgtgtgtttagttctttactattttggtaagactatatttgaattaaggaacaattgcttacttgaccctagtttgaagcccaactactaaattgaccctattttttcaagtttgctcatttgaccccattttttaaaactgaacatcagagctgaccctattccgtgaagaccaaataacagtgttaactgtgaagcaattatcatttttgcccttgctcatttaccaatgttatatcaaagatttttttttctttcattcagtcctttttaatatttgtagttcatctcattgtcattggagctcaggacagtgttcagctgctcgctctccaacaccgggcaggagaactcggccgtcgagatgacgatggtggcgccagtggctgcctgttgctgttgacctgttgctgccgtcgatctgcaggccggggatgagaggctgtgccatgggcatgtgctctgttggctggatgaccatccggccaccgccgacgtcaatggcattggagttcgccggaactgacagaagagagagagcacaatcggattcgagcacttgtgtcagcccgcgcgcagtcgccgccacccctcagcgcgctggcgccggcgccactgccaatcgccgtccctctctccctccgcacggcagcaaccgctgccgctactccgtgcgcccgcgccgaccgccttcgctcgctggcgccgctcctcctccctccacacggcagcagcccgtgccgccactcctccgcctgcaggcgccgccggttctcctgcctccgcgtgccgacgccgcccctccctccgcgcggcagcagccgacgccgctgctcctccacacacaggcgccgcctcccctctgcgcgccagcgctggcagtcctcctccctgcgcggaccgccgcccctccctggctccctccctccgcttggcagcagtcgctgctgctactccaagcgcgcgcgcccatcgccgtccctcccttcgctcgctgacgccgccgcccgccgctcctccttcctccatgcgcccagccgtgccaccgagatgtgtgggtgaagactcttgatttgtaacttggataaggttattatttataatcaggggtatattggtcagttcatactagcaattttattttttttcattttgctaactaagacactaacggactattaaaaagaggctcagatggtggctttgattttaaaaagcggggtcaaatgagcaaagttaaaaaaaaaggggcaattgtatccatgcccccacttttaaaaccaattgctgttttaccccatattttagagtttgtatttttacccccactttttgaatctgaagcagctgtgtaccctcatttctaaccgccacaactaacggtgtcagttgtagagaaaaagacatatatacccttggtggttattgtagttttgcctccattttttttagctttgtgtgattttgccctcattttttttcagcttgtgtgagtgttataatgtgaggctttgaacggcctatgcattcactctgaaccctctaaactacacatcaacgccacatttagttgtacatggataatacaacagagttgtgaattgttccaaaaaaaaatacaacagcccatgtaccctagatttttttgttaattgttgatcgctctgtgtccagttcttcattgcatagagcaacaaaccgcaattaacgaagcagaatgtaagcaggaaataacagaacggaggagcatcatgcatttctatagctccatctctgacgacaaatgcagatagcaaccgcaaaatgagagctgcagatcgatggatcgatctctcctttatcattgtcgcatcacttgacgactttgatccactcagtgcaccctgcatgcgaatgcacaacacataggcaaattaacaaaagctgcagctaataacacagatcaaaaccgttattgatggcaaatgaattacctggagcagtcggtggaagggctgatggcgtaggggatgttgacgccgcacttggaggggatgccggcgacgaggtcgggcctcaggccgcccatgccgctcgtctgctgcttgatgcaggcgcaggtggtctggtggtcggcggcggcggagttgagggtcctgaccccgtcgcagcagccgccggtgggggcggacaccctccccgtcgcgtacatgatgcacggcgcaagcatgcggccaacaactttcccttttctgccttgtcttgccctcggctgtgagaggccgcctccacgtggaagagcagcggctgccggctgtggacctcctgcgagcgggcgccggcgcacgcccgcgtggccgcggcctcctcgcgcggccgcagccgccgccgccgccgcctccgtgccgcgccgccgcccccgcgctagctagctaggatttcgacccgactcacggagacgcacgggaagaaccctatccattccctttccctcaggggtacaaatgtcattacataatttctaaaacctttttttattttgtttttatttctttaacacaaaatgtgggacccaccaaacagttgtcacaagtgggggtagaaggctacttcagatttaaaaagtgggggtaaaaatgcaaaccctaaaagtgggggcaaaacagcaattggctttcaaagtaggggcacagatgcaattgccccttaaaaaaaatagggtcaatttaatagttgggcaaaatttaactatttgccattcttgtgacatggcaattaacgatttaccatactctatcaattacatgtgggctctcatgtgtatatgacatgtgggcctagtggcaaatcgttaagcaacatttgtaagagtggcaaatagttaaaagctccttagggtcaaatagcatttgccccttgaattaatggaattatcttattatttatttatttatttatgctcatagtatgtgtattcatttattggatatgtgttctatgagtagtatatatttcgcatatctcctacagcctaggctagtcgatccatgtaacaattgttcatttagaactaactgaaattcaaaattaaaaaaataagaaaacaaagagtagagcttagagtccacgtagaaatactatttagaaatatctaaaatcaaaatttttaaaaaaggatattggaagaagatgctagaaaccttatagtaatactcctgcaataaaggaattagaaaaggaatactgtaagaagagtctatagtccatatagggatacaatttagaaataacgaaaatttagaattaaaacataacgaatattaaaaaaaattctagattccatataggaatataatttataaataaatgaaactagaaataaaaaaaagagaaatattaaaagaagagtgtagtccatatagcaatacaaataacggaaattcaaattttttttaaaaggagtgttgaaagagaagtctagagtttatatagaaatacaatttttaaataactgaaatttgaaatttaaaaataagaaatatggaaagaagggtttagagaccatataggaacaaaatttataaataaagaaaatttgaaattataaaaataagaactgttgaaagataagtaatttagagtccatacagaaatataataaaaaataattaaaattagaaatcaaaaaataattattaattatcgcctatatacaatacactataaatatcacgtatcgaatagtttggccaggccagaacagtaattgaaaattatgttgtcattttaatatattttaataatacaaaaataaaaatatatatgctattatgtgagaaaaaatataatgattctagccgcgcaatatacaagaccataatgctacttgaaataaaaaagaaacagatagagcattaattttgtttgcgagcttcattgacaagcataacctttgcctagtggtgtgtttggatggagggatataggtggataggacatggcggcccattttttgtgggtgtttggttcctgggcaggggtgggatggagcggcccggggaggaatattccccccagatgccggatgaggggatccggccgaattggccggatgcagccgcccgagcgcggggcgagcgaccaaggcagtcgcatcactcctctccaagaaagagcgacggcgagggcggcgaccagcgggagctcggcggcggctgttgcgagcggcggcggcggctggtgcgagtggcggtggcggcgccagatgcgcgctcggccgcggcgccggatgcgagctcgttcggcggcggcggcgggaggcgcgctc

SEQ ID NO: 69973 - DNA, 4224 bp, Oryza sativa
tgattcctcttcaattccccccaatttcccccttggatcgtgcccccaatcgccgggaacgcccgcgttttctccggccgctttccatggccgccggccgccattcccgtcgccgttccgccctctcccgtgctcggctcgcttccctccgctataaaatgcaaccccctcgctccgttctatcgttttagccccctcccgcgatctcccgtggtccctagccctctccccgccgtcctcctctctctcccgtgccgccggccgcctccagccgcctctccctccttgccggagcgccgtccggtcgcgccgtcgcctcctccagcatcgcagtggcctccccttccccggcttgccctccgtttcccgcggagacccccggagctgcgttcccgccgtcgcccttccctttcctccgcgccggccgcctccagccgcctctgtctccctgcctgagcgccggttgacgtcgccagcacctcccttggctccgcgacgccgccctcatccccggcatcacctcctcctcgcacgaatttcgccggaacaccgtcgcccgcgccagcctctccttcctcctcatcgacgtctcctccggcagccccttccgccgcgcccgtgcatcagccggcgctgccgtcccctccctcggcgtcgccgcatcgccctccaccccggctgctcctcggtttcgccggaacgccgtcgccgcgccggcctctccatcctcttcgtcgccagcgtcctttcggccgccccttcctcctccccggctcgtcggcttgctgcacctctaccatcttcggcatcgcagccgcgacgtcgtcctcggcctcgcctcccctccgaccgaacaccgccggtgtccgtcgtcgtcttcaccgttcatcctcgccggctcgccgtctggcggcgccgcctccgtcgtcggcatcgcagcggtgtgttccacgccatcctcgcctccgtgcagccgctgccggctgccctcgtcgtctcctcgccggccccggtcgtcgtcgtcgtcctctcgtcgttcccggtcgttgtggcgttcgtccctccgtcaagccgttctcgtccgccgcccgcgtttcgtcaagtgtgcagcagccccgtcgtcgtcttcgtcctcgcctccgcgtcgtcaagcctcgtgccggctgtgtctcgccttcgtcccaggatcgccgccgaagtcgttccctcgccgtccgccgcgcccgttcgtcgttgtcgttcccacgcctcgtcgcgtggtggtaaggatccgtcctctcgctgccccgtcctcgtccttttggtgtcgccccgtacccgttgtgcggtcgtcgaccccggtacccgtgtaccggtgtcggtagtcgttcacgtgagcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttctaggctagcgcttccacatgttttattgttgcaaagcttaattataataatccgcaaatctccatataacagcattaaacttcggatgaacatatcttggtcatacgaactctgaatcgacccgttcaagtctcctaatgtttgttataacctaaagaactgtttgctttctttttatgtgttgttattgcttctttataggcttgtagctttgcttgtgtgcttcgcgtagctttcgtcgttccggaggttcccgaagtgtggttcgcggtcgtcgccaaaggttcggaaggccgttctctctgagcaaggcaagtcacatcatccttgagcatattgaatcccagtttataaaattattttgatttaaattaatgcattactgctttatttaaattcccgcgttatcactgttttatttagccatgcctatttatcattgttaagacattattattgctattgttattattaccttgttcaccctaggaaaataaaaccccaactagtgggtactctatttatggttccactagtgtgaacttaggtagatgcttcgctggttaattaggcaacattaggtggttttataactttagactttgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttttggctcagtctagttataaacaaaagtacacggatggaggtggatgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaataactaaaatgtggaatggttggcctgggttggcttgggacgagctgggacccagggtcgggttgccagttcagtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaattatgcatctgccggtgtggcttgctgagtactgtggttgtactcattcttgctctatctttctccccccccttcagtaagagaagcttcggagaagatgtcttaggtggagtcctggcttataccccagttgagcgcctgtgaagatggagccgtaggcccgctagtccgctgctgtttatttttgtttgtcaggcctgaagtgcctttgtaataatgtatttattatcgatataataaagatgtgccttttatatcatgtttgtttggtgtaccccggcttttcctgggacggggattaatacactagcgttcgggaaaaggcaattttctcggtcgcgacaagctggtatcagagccatctcgactgtaggataagccaagtggataaaacctaaggacatattttataaataaaactatttgcgaaagttcctgtttcctcctttccctaatgctatgtcacgtcctgataaattcatcccgaaataaaaatcattttttaaaaggaataatagaattaattaaaattcagaaagaaattggcaaacactaaaatgcgtacaagaaaaattcgaatgtggcccggagaatttttgttaaattctccttggtttaaaaggagccctcaaattttacttgaattttcagagcaccggaaataattattaagcaacaaaaacaattatcaaagtttagtaaaaagaaaaacctaaaaataaccttccttcctcctttgggccaagtttggctcaaagtccactctctctctctcggcccgcggccgaagtccctctctcctccctctttttctctccctctccctccccctcccctctctctcccgggccgttcctccctcccctcccggcctgcccggtcccgggccgccctgccccctcccgcctgggccgtgtcccggcccagccgagcctccccaagccgcgccgcacgcgcctgtcacgcgcacgccgcgcgtgcgctgaccgcgcgcctgaccggtgggtcccacgcgccgggtcatcgtcctcctcccgcccggccgtcctctctccctctcccgtgaaccctagcgccattcctccctcaaatccgcgc

SEQ ID NO: 69974 - DNA, 2776 bp, Oryza sativa
actgtttaattttgattgccaggcctgaagcgcctctgtaataatgtaaatactatcgatataataagagatgtgtcttttatatcatgtttgtgtggtgtaccccgacttttcctgggacggggattaatacactagcgttcgggaaaacgtatttttctcggtcgtgacaagctggtatcagagccatctcgactgtaggataagccaagtggataaaacctaaggacatattttataaataaaactatttgcgaaagttcctctttttcttcttcccctagtgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacacatcaacaagaagagttagttcctttaaggtcttgtccctagttctggtccattctttccttgtctgcttcccctctcaacctctaccttgtgacagatggataacactggtaacaaaggctatgggaatgatggatccgatgactcaagaacccaagccagtgggaatgagaaaagcatcaacaaaacctcaccagagctaatccaaattgtggttaaccaaaccaacatgttggcaacagcctttcaactattacagtattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcacaactcatcagttggttggaccggcttcagagtggtgggatagctacgaagcatcacggccagaaggacataccatcacctggaacgagttttcatctgtattcaagagatcacatgttcccgcaagaatgatcacactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaactcgaaagtgagcataatcggatgacgaactgcaagagaaggattgtcaacatcccagtatttccatgtggtaaccaaagacagcgcactgagccacttcagatcaccggatcttctgttgcgcatcaagagttactaccccaagaagatggacacaacgcagacaacaacattagcaatactaatgctgatgataccaccaacaaccatggttcttgccccattcatgaccacttagatcaagcgtgcaatgtcaacagcattcaccaagatatcgacgatagtatcaatgaaggcacccagaatgacaaccctagcaattttgactctgagaaagactccaatggtgatagcaactatggtaccactgatgccaatgttagcaaggatttccaaccaccaattccaactccaagtcagaatgatcgttcccagacggacaactcagtaaagaagacattgatttgttacaactgcaaagaaccaggtcatttctccaaagattgtccacagccgaagcgtaacctgcgtcatcactccggccattatgcaagaagaagacaagtcactcgccttgtggtcactggagcaaacgccatacctgtgaggcctcgagttaatcataacccatagtagaaacaatgtaccgatgttaagcatcttccctttttgtttaaggtagtgccttgtattcgtgtaataagggagaaatgtgtaatacggacaagatttatgaggattcttttggaagatgctgatatgggattatgtgtataattggttactgtcaaaggagacctagggtctcatttcagaggaactatgttctaacctcgagttaatacccaacctgatgatggaaaagaaaatcaagtgattaaccaaagagacatttgtttggactaagtgtttcagatgtgtcttctttggatcaaaggcaacaaccgtcagtctagcttttgatgaaccacttcaaggtttcactgaaaggcagcaagccaaaggacctcattgtcaccagaagcatccacaactctcggagtgaagagtacttggttgacaaagtttaaaaggtgattgatagaagatatcagcaaaggtgtttattatcgggcaaagaagtaggtcgaaaggtgattgataagagaaatctaaaaaaaagaatacgtcagggttgaatgtgtaaaggcatactttgaatgctaaataataacaacatgaagagaatagtggaaagtgaatccgagttgcttgttcgtgagagctattcccagttatgaaccaagtgatatgttcgaagatagtttacagaggtcagattaaaatcacatgtaacagcg

SEQ ID NO: 69975 - DNA, 1162 bp, Oryza sativa
tgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttctaggctagcgcttccacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagtcttcgtcgttccggaggttcccgaagcgtggttttcggtcgtcgccgaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttgttatggccttattattattgctattgttattattaccttgttcaccctaggataaacaaaccccccccccccaactagtgggtactctatttatggttccactagtgtgaacttaggtagatgcttcgctggttaattaggcaacattaggtggttttataactttagacattgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttttggctcagtctagttataaacaaaagtacacggatggaggtggatgaagtcgggggtcgatggacatctctaggacaatgaaggctacacgagctgcggcccggtagtcga

SEQ ID NO: 69976 - DNA, 8986 bp, Oryza sativa
taactactgaccaaggagcttctttcatgtcacatcaatttagtgagtttgtcgaatcttttagaattaaattgctgaatttgtcgccttattatgctcaagctaatggacaggccgaatctagcaacaaaattttgattaagcttataaaaaagaaggtagaggagcatccaagaaggtggcatgaggtgttgtcagaggctttatgggctcatcggatatctaagcatggtgcgactcaagtaacaccgtatgagctagtctatgggcaggaggccgtgttaactgtggaggttaatttacaagctcttagaatagccagacaaaatggtttgtcggctgtagattataggaatttaatgatggacaggatagatgacgtcccagaggaaagattgaaggccttgagacatattgagaaagaaaaattaagagtagctagggcttataataagaaggtgagagaaaaatcgtttcagataggtgagttggtatggaaaacgattttgcccattggaactaggagtagcaaatttggcaagtggtcaccgagctgggaaggtccttataaagttgtagagattgttcctggaaattcatattttgtgtagtctttgcagggggataagttgcctaaagctttgaatggaagatatttgaaaaagtattatcccagtgtatggcagggagcttgatatggttatggccggtgtattgtttgaaacatcgtcctcagaaaaatattagttatagtgtttttggtgaaatttataatatattaccaaaaacaggggggcatgtgttaataatgtaatttggccgattaggtagttcaaatggccagattatttttaatgagtagttagatgatttgaatatattctttaggactttggttttgttttctaagtgcaggtatgatgctatattatctggagagcagcagcagcagattgatggcttggaagattcatgcatgatggtctgcttcacaaggctgtgcgtgtgctgtctatctgcatggaggtgcatatacgttatgcgggtctttttgccgtatgattccatatacgtatgctgcagttgagtgggcctattggatcatgcacagaacaacatgggtttgggctatatcaagaccaatggatcatgcagagatgaggctggttgttttgacgccgaagcttatacggaagggaatacaaggtggcacgcatgtcagctgagataaggcattgtttgatttggtttgttttgtattcggcttagagaattgatcgctacttggtactttctatatacgtgggctaaatacatctactaaagaccggagcacgcctgtacatatatcaggtgcatggccgattggaagaaaaagaatcgaacaaaatcaatctacttatttagattttcatctatttctgttttctctttcccgtgctttttctctctactgccaagctctagggtttggtggatctttgccattttgcgcaggaaaacggtcggttttcctccacgaaagcgaggaatctttgttgctttgctcggaaagcatccggtgatcgtcacgtaagcacggtcagtatcgtgttgttgcgcggatcaatttcgcgtgccaacaggatctaaccatggcatccaagtgactttgaaagtacttagcccacttccggactgtgatcagaactccatgtaatagcttctggtcctatgcatagcgtgtcttggagccagccaaaacatcactgatgaaataaatgggcctctgaaccttttggatgtgtccttctcatttaatatccaacactgcactgacaacatgcgaagttgctgacacataaagtggcaagggctcttgtggatatggtgaagctagcatgtgcggtgtcataagaaaattcttgaagtcttcaaaggttttggctttaggtgtccattgaaaaagggcatgcctcattctccaagcctagagacaaaccgactaagagctgacaggcatctggtgtgtttttggatgtccttctaggtacttggcggcttcatattctgcataccattcatttcctctgggatggcttcgatgccacagtgtgacaccatgaaatcaaacagcttccctgatgctacttcaaaggagcaattctccgggtttaatttcattctgaagacccggatgttttgaaaggtttcctccaagtcagcgattaagttatccttctccttcatcttgatgacaacatcatcgacataggcctccacattgcgcccaagctatgattgcaagcatttctgaatcatgtgctggtacgtggctattgactgtcggtatcaagccatttcgtctgttaatatatccaaaataaaggagaactagctatgcttgcatgcatattttgtttaagaataatctatctccacttgtaattggaattttatttcgttgcagagaactttacataattggaggagaatcgatggagaataaccgaacaatcgattgaactccgtcgagaggtagacttatgggtggatgggattacaaatcaagtaaaataatatcaaatgggcccaaccaccacactactagaccaaagagtcatcacacgacacggctacaaaattctgggctgattgggccaggccagggttcggcgcaccgttgatctccccctttcacatggatgtctaggattgctccccaacgacggttgtagggtatttcggataattccaaccgtcacaaccgtcattggcagcctacagatggaggatagctcactccactccaacacatactcaagaagaagatcaagaagctctctcaattttagtttattgttctagtgctagtggagtaggaatggagtagttctcttagttctcgagtcttcatgtgatttcgggtatggctctagtagctcttccttcttttttaagacttataatgttaataaaatattctcctttatatactttcggtcttttacttaattcatattattcgagtaccgactttagttcttacttgtcttgatataattgtgtaactagcttaccagagatatgctatggtgtgggtttaatgttcatttcaatgatttctctatgtctgctgcagcgatatgaagtagtatttagtaatgtaagcgtggtgcttagattattagataccattaattggggttatatgctgcgggtcagtagaggtgagccgctgatggtgacagctcagtacgagtattcctcaatgttagtatataatcctaagagacttttctagcatgggaactcctccgtattcattaccggtcggatcgccatgacgggttgtcgtaaggaacttggcaatcaggggtgatctctcgaaacaccaggttgacattgtaaggaggtattggttgcatgattgtatactagcaagtgtaaactaaagatgtttatatactagaagtgcaggaatgattatttccttattctttctccactcagcctagattatatctaaataagtgaaaggagagtcatttctcacaaaattactgtgccacttcattcgaataagcatagtcgtccgatttccaatacaaaagatgtgagccgttagattctctaatcatcaaaatatcttcacaattcttcaataatcttcttttcacaaagaagtccttccacaatccacatcccaaacttatataaaaagaagcgaaaaaatgcatgctcttgcgtttgctgcttttcatgctgcatccggtcagcgccgcctcttcttctctttcttggcacaagcggctatcgctggcttccgtacctctgcctgctccaccttttctcccaagtcaccgccttccccaccacaggcgcctcccatctcttttccccactgctgccgctgccgccgcatcctcctcttcctcactgtcgctgccttctgttctcctcctcaacaccgtctcctccccgtcccggcaaggatcaggcagcagggctgcggcggtggccgtacctcctgcgaagacaagatttgaacttctctggtactgctcctttctgtcctctcacaccctagcaccaaatcgggagtatgcaccatagtccgtagatactgattcattgtgaaagtttattttactgtgttattaatttgtatccatgctgtttgtaattggtaatacctgcactaaatcaaatggtggatgtgatttagaacgcctaaatcatatgcccataccaaattctaaccacaccaatctttcgttggagttgtcaatcaggacactaggtcaacacggtcttgctaaatgttcagtcatgtaattgaatttttagcatatataattttgattgtaattgttcagtcatgttagtacaaccatattgttaataagcatttagttcataaacttttaagaatgctaaaatatcaggtccttatgtttttttctcgcttccaatttgtcataataatagaagttcaaattttattttatcaagcttccaatctgtcgtaaatagtagaggttcaattttcttctgtccatgcttttaagttactattgcaatgttggtttaaagaatttttaacacgtctttgtgctttgaatcaatggtacggagcttttctaaccacaagtgtcgctttgcatgttctctacaattatttgacaggagtaaactagagaagatttttgaggatgcatgcagggttcactggaatgattttgtattctcagctgaacattcttgagttattgagtttagcatccgtaaaatctgtaattttttcatcaatgaacaatgcaataccatgagccctctaatgtcccttttgtttccatcaaaattttcctttcaatgtactatcttttcatcaaaatttacgctcatgcacgtctctttcagcacaacccttatttaaatgtatgtgctgccgtgtcctgtgattttggaaaaaaaacaaaaataaaaatagaatatattatcatatattacggcatagatataaagggctttatagctacactttatgtaaaatgaagtatgtcgtgcacacacttatttacattgttaattattattataaatttaaacttattgctataaacaatatgtaaatatatttaagagaggttaaggttatagtcgtacgaatgcacgacttaataagatagttttagtgagagtatcttggttctttcttgtgtgtgtcaactttatcctacctatgaattgattaacccctacctacactttggtttatgcaagtaatatataaattattagcatggtactctcttgtcatatcttggattaaataaatacgatacattggattacttctgggtgaaatgctacaatgctatatccatgcgcttgcggattatatctgtaaccataaatataccgagaatacttcagcgccattgctgggaattatatttctagtaatgtcattaagaaatattaacagtggctctaacattcttcagactgaaaggcattgtgatgtaacaatactctccgaacggggtgataaacgaggtctccaagcggtcagactctttcatgctgatttgatgatatcccaaatagcagtcgtgaaagctgagaaggtcgctgatggccgtcgaatcgacgacttgatcaatgtgaggtaatccaaagggatcttggaggcaatacttgttgagatccgtgtagttcatgcatatacaccattgtcccatcttcttcagaactagaacagggttagctagccagttgggatggtaaacatccttgatgaatctagctgccagaagcttactctgttctttcttcatagcgtctctttgatcttgtgcgaataggtggagtcgttgtttgatatgctttgcgtcagtcttcacatttaatgagtgctcaatcacctctctaggaataccaagtatatcagaaggtttccaagcaaatatatctttactatcttaaagaaagatgatgagtgtgttttcctatttacaatttagctcggcaccaattatggtagtcttggagggattggcttgatcaagtgggatcttctttgtcttggcatcactttctcttgacttcagtatcttcttggcaggcaattcaccttcatgtgatgttgatgcaacgagtcagacctcttgctggtcgagtgccctcccatgagattgggtcatctcgcagctctccttgtcggaggtgacggcttgtttgacgtcgctacgcaatgagataactcgttgtgacttggcatcttcaacatcaagtaggtgtagtaggggacgacaacgaacttagctagagctggccttcccagtatggcataataagctgcctcaaaatcagcaacttcaaagcagatattctgtctggaaattattccgagtccgaaggtgactggaaggctgatctggccgagtagcattgaggatatcatagggacaaccctatgaaacggagcagaactcgacttcatcttggatcttggaatctgcatcttatccagtgtcttggtgaacaggatattgagcgcgctgccaccgtcgatgaggacacgcttcaacttaacattatgaaccactagatcttgtaccaggatgtaccactccgggtgagccactcggccaagatgatccgagcggtcgaacatcattgctacctcggaccaccataaatattggggtacttctggctagatggtgttgatctccctatcggtcgacttctgcttccttttggattcgtaggcgggtgggcctccgaagatgtggtttcactcggtcctgggatcttggaaggcccttctccgttgtttttattttgcccagaagttccttcgccattggtgatcttgagttgcgctttttgtgcttgtcgcagtcattggccacctgtgctttgagttcgggtgatttaggcattgcccattcataaccttatcgcagtggttgggacgacgttgtgattgctaattagatgttgtggccaccaagtcttcaggtttgtgcttgcgatccttctggttgttgagttattattcttctaggggcgccaatagctacccgactacttttcctcctatgatgcattgacagtgtccactgccttggcgtaggagttggtagtctcaaatagcttcatgactattcacgaaggcttgcgattgaacttgccaataagtaacttgtctcgaatgcctttttggaaagtagcggtgataacatcgtcagtgaccttcgggatcttgttgcgggcctccgagaaatgtcagatgtagtccaaaagagacatattggaacaacatggtataggtcaaagtgagtactgcgtctctcgtaggtgccttggaagttgacgatgaactagcttcaaagctctcttcaggaatcaatggatcgccttggaagccccattagccagctccttgttgaatcagcgagtgccataggtaggtaattcgccagtgccttgttgtctcctcctactgcacaaatggccagggtttagacggtcttgccatcgtacttttcaatccctcttgatttgaaaccagtcggccaatccactcgatacagatctcaagtaaaagctaggattcctttgtcatcgtagttgatccttacggtgagagcaattttcccgatcgtgatgacgttggttcagcgtaatcctcaagtatttgggtattcaacgtctgtgtccttcgtcatggtctcggtcgtcgtgatggctcgacattgtcatgattgatctggatgccgacctctgttttcttggtgatgctagatggaagcggtgtgacctctgctatattcaggttttatgtggcccctggatctatgattcgagggctaatgacagccaaccagagtcctgggggagtcagcattggattctttcggtcggcgagaagctccggcatcattttcttgttgggctgcagtggcgacgatcatagtcttgaccttattcaacatcaaagtcatgttttctggagctttgtcgatgtgggtgtcaatcaacgtgacggccaccacagcgttctattgaggtgtagcgaaaacattactgtcttctatgcgggtttggatgatgttgtgtgcaatgtgaccgcttctaatcagatcctgctgccttcactagcgttcctcctcagctttggcacgtgcttcctcttgatccctcgtgatgccggcttgctcgtctttgtctgtggtgccaccgacaatgaagacttcgaagaaaaactaaagctcaaattcggaagtcgttgtagctactgagactatcaatgtcgaagtcgttgtagccatctaaaaaactaaagctgttgacaactttcgtggtgctatgtcgcgcccgaaaatcaccctaaaattttatcgtctaaattatttatgtaaaataggtgattccccacgctttgctgcgggaattacaattcttaatttttttttgtcaatcaagtttggagtaaaaagaaaaaaataatgaaacatcaggatttatcagtcaaatggaacccgtgctttagagtgaaacatattgataagtatagatagatttgttaaaatattgtgcaaatgatatgagaggtgatgattagatatgcttgtattttgatttgtaaaattaaataaattgtagatgatgttgtatgcttacatgagattaaatatgtaattattactagtgggtgatgatgtgttatggttgcatgttgagttttagacttagtgggctttaacttcaacaattaaaaattaccatgtttcaactcaaattgatgtgtgggtatttttgttgaattcctcatgcttcaaaatatttaaacaacttttacttgaattttacataataaataattttaatgcaacaataacctttctcagattttattaaaaaaagaaaaactaaaataaatctcgtcgcccttcttgcgaaaatacattacgttgggcgaccggcgcggggg

SEQ ID NO: 69977 - DNA, 1530 bp, Oryza sativa
cgcgcgcccctcccccacgtgcgtactgttgggcccacccacttctccctccctttttccacaaaagatatttcacctaatgtacttccaatgtttcactctttatagatctaatgttgcagtgaattaaaatattcttttgcaaaaaaaaaacccacatattttggaaaatctctattaagggaatttggtttattttttgttccaccaaaaatgtttcacctagtgtactcacaatgtttcactatgtatagatctaatgttgtagtgaatgaaacattccattgcaacaagaaacccacatattttgaaagcccctattaagggaatttggtttatgttttgttccactgaaaaatgtttcacctagtgtactcacaatgtttcactatgtatagattgaggtgtagcgaaaacattagtgtcttctatgcgggtttggatgatgttgtgtgcaatgtgaccgcttctaatcagatcgtgctgccttcactagcgttcctcctcagctttggcacgtgcttcctcttgctccctagtgatgccggtttgctcgtctttctctgtggtgccaccgacaatgaagactttgaagaaaaactaaagctcaaattcggaagtcgttgtagctactgagactatcaatgtcgaagtcgttgtagccatctaaaaaactaaagttgttgacaacttccgtggtgctatgtcgcacccgaaaatcaccctaaaattgcagtgaactgaaacattctttcgctatttgctgaaacattgtttttatataaggtgaaacaacacccgatttaaacgtgtgaaacattttcgatctacttagtgaaacaattccgatatacctagtggaacatcgtgcaacatttaaaaataattcaataataatctaaattttttttgtcagaatatatctatgtgaggtcttgttttgaagatttaattgcaacaaatttaatggtgcaatcatatcatgatttagataagtaatttaagagaaaaattagtttaaagaaatttttcacgtaagtcgatggcgtcagcgtccgattttaccccctcccgatcgggcacccgaccgggagtcgtctcccccttcttgggccattttcggctcaaattcctcccctctccccctcggcttaaattcctcccctccctctctttcccatcctttctcggcccggcccagccgccccctccccggcccagccgagccactgctcctgctgcaggcgacgctgccacgccgcacatgcgatgcacgcgcgcaccgtcatgggtcccgctcgtcaggagcatctcctacctccaagccaggctattcctctctctcccatgaaactcaacactcccgcctcctttgatctccctcccctatcgttccgcctccaaattaattgcaaatctatttcttgtgtagcgggcatcaattcccctaacaaatcccattcaatctcgtattaaatcgcactcaatcgaattctttaactgatggactaaattgggagactcactgcc

SEQ ID NO: 69978 - DNA, 13025 bp, Oryza sativa
  unsure (1)..(13025): unsure at all n locations
tcgccgtcgttgtttcctcaccgttccagccgtttgggtgagcctcgccgccgccctcgcatctctcgtgtcgcgcaccgctgcaccatgaccgatagccggggttgccggctgccatgtcctgacacacctctctctccctctctactgtttccccctctctgctgttacaggcagcaagcacacacagtagtttttctttacaaaattaattcataaattagtaaaatgccaagcaaacaacacctagaatttaaatgaccatatattgactgtttgaattcagaaccgatctattcatattgctattgttttccttaaacagtgatgaacccatttttagggttattactgcatcttatatggtttttatttatgttttgggcctttttcgttgcatatattgtatagatgctgcatatctggaagagccgctctaccttgaagtggatctagaagattttggtagtgagcaaggcaaatcatgtcattttgatcatattgttgtcccaatttataaaattatgtttatctaaattattgcattttgctttattaaattccgacgcttatctttgttttgtttagccctacagattctccttgttatagccttattatttgtattattatgatccttgataactctaggaaaaataaaactagtcataacattatatatgtggtgcttactagtaaatttaggaatatgcttagcgctgcttaaatagaaacaattagatgttttccaataattacaaattgggaataacttgtaaagaatggtaaatatggttcagtggttgtttatccatgacatgatgttccccttcaaaattccccaaacatattttgggttgggctcagggtgcttggtttcgctagtcgcaccctggccgtcattaggacaggtcttcgaacctccgttgcaaagcatatgctgtacagccacctgtctgatgggtagggcttaacgcatcatctagtacggtcatgtacaaggaagacacggatagggatggatgaagcccttggtggggtcgatgactctggcagtacgccagggggcatagactgtctgctcgacccagggcacctggtgggggaagtctatatcagtcttctttgtttagggcggtactaagaggtgggttatgtcatgtcttatgtccgtatgccgtggtggcatgtggcacatggcaacatgtgagaaagatgtgttgcaatatacccaagttagaatttagttctattaattgcgtaattggagttgtcagttgttggcacgagttaaggcaagatcgcattggtgtgcggcttgaaaataatttgactagagataggtttgtgttttatttaaatgcctttaaatatttaaatgctttgaaatgctagttttatgcaaaaaaaatccttaaaaatgaattctttgtactcccttgcattatatctgcattttcatgacatggcttgctgagtacggtggttgtacatagccttgctcttttccccccttctagcagaggagtacttcggatatgatggctttgatgtctagctcgtgcctgccgtcaagcgcctgtggtgactctcgtagcttctggctttttactgtttatctttcattgttgggcttttggtcgcccatgtaataaagtactctatttaagctttcgcttatatactctattatttaccaactttgtaatgtgtaccttgcctccttggacaaggatttatgcactcacaaacggaatatattgttctattttccgggcatgacatgctatattatccaagtgattcgatcatgattcccgcctccctagttctgatctcgggtggacttgggacttggccgggtcgtgaccttggagaggaggttgatcatcccgaaagtcatggcgaggagcggagggagttgcatggcactcttgggatgctgcattgttggataggctgtgaagatttgttgatgatgacgattccctcagtggtttgaagccaactcagaggtgagaatccttgagtagatctcggcagtgttcggggcactgaacgaggccaaagagatggggtccctccctgattggttcaaatccgagtcgagtagagagatcttgacaaagtcatcggtgatgaagtcgatgtcaccgaattgatatgcctagcccggatggaaagcggagtcgccggctctcagaattaatccgattgcacttgtttgcgaaaaactctacgcaacccctaccttgcttgccaactattgattctagaaatcaacaatgagaaagggggacgagatctaaagtggatgagtaaaataacaaacgtttatacaggttcaagccttcttgatgaaaactaataccgtactcttgtttcgaggattgaatccaccgggtgttgtattgatctgatgatcgagttgtggttatgcccttaagagcatctccaacaacctctccatcctactctccaagctaaattttagcaactttggacaaaaaaaatgcactccaatagaatggctatccccctagccaaaaaatagcaatggccaaagatagggtcaagctagctaaatttggccagccgttggccatccacagcaactagctatctgtgggccccaccatctttttcccttctatctctccaccatccgcacatccctgcccgtgccctcccttcctccgcctattgctgccacgcccctccttcctcctcccatgcctaccgccgccacgggaaggaggctcgccgtcgcagccggcaaggagtgcctcggcttcatcgccggcgacaagatgggagaccagcagtgaagagggccaccgctgtgcgcctcctctcaatcccgctacttcatgggcaccgaggtgaggaccctctcccgctactccggtgactggagattcactgtatccacctccgacctcccctccagcctctcccccgccgccatctcctccctcgtccgacgacgctgtggaggccgtcctaatgctcctgtttggtgctgcaaggagggcgcgacagcaagagaggctcgacgacgcacgccggttgaggaggaggaggccggtgatctccatcatcatcgccatcgcaatctgttgtccaccatcaccatctgttgatcttcatgagagtatgaagcatggggaaaaggaaggaatatggggaagaagaaaggattgtagaggctgacatgtgggtcccactgtcatagattcagagtagagagggtgaatggagaggctgttggagcaaacatcaagttagacttgataaattagatggagagttggccaaatagacaaatggagagtgagatttgtgtcgacgggggatacccgtagactggataaagagggtattggggtacgctagtacgaggatctacgtaatatgacatcaagcaggcagaaaacaaagattatactagttcaggccccttgataggtaatagccctaatccagttgatatgggattatatgatggaaaccacagattacaaagggaatagtggaactcgacaataccgacaagatcgtagtcgagttgattcgactagatctcccggcgacttggctccgataagctccggcttcgtaggctgtggtggatgtgttggcagtaagattcgatcccttaggccctcccggggggtcccttttatatcgcaagtcaactggtctccaagtatgactcggagacatcgggcccggcacgatacaataacgacccagttctgtccgagtaggattccttccatctgtgaacttccataatgaatttccttaacttatgccgaaaacgtccgtatacgcgcaagtataccatatcgatatgtgacgtatatcgaagggtagagggtataccttacccgtaaccctaacagtagcccccgacttctgcttaaatgaactcgtgaaactgatcgcgacttctgatgtcgaggttgtcgttgttctcggtgtaaggaccgagagacaaggagtgatcgacaacgccgggtgaagctcaacggtcatgagtgaatttaaattgaagtccaaaaaactgccgcgcgtaacggacccagaaatttccggcggccatctctctcctttccttagaattcgcaccgtcggaggtgcgtctatttaagagagttttggggatccaagttgaagcccgcttgttgtgaaaaaactcaccagctttcaaacgtccctcgtcttctctgctcccacaaaaaaccctagctagctcatctcggtcctttctccggcgatccccggcggaaatggatcttgacaagtctacctccaccagcgcgtcgctgaagaagttgcaggaagatggcgcccttcccggtcgcgggaccgcggagagagaagtgggaggtactgaaccccagcctgtcctgggtcgcatggttgcgatcgaggactttattctctgtggttttcttcctccgccttctgaatttcttctcttggtcttgaatttctacggtgttttcttgctccacttgaaccccaattccatcgccttcttgagtatcttttcgcatctttgtgaggcctacattggggtagagccgtttcttgacctcttccgcttttactatgagttacgctggatggaacccaaaaaggtgtccgggtgtgttggtttccgactttgggatggcctgaagtcgcgatacatccccttccagtgcccctcatctcgcagcaaatggcgggggaggtggttctatcttcagatagaggattcggatccggtcttcgttgttcctgaggagcaaccaaacaagattccatcttgggccaccaaacccgccttgaccccatccctccaatctttcatcgatatcgttgacgacctccgagaacaggggttgtcggggtatgaagtcgctgccgacttcattggtaggcggatccagccgcttcaggctcgagaccatccggcctttgattattctgggccagaggacgcgacccgggtttctcctcggggtattttcctttttagttaaattgactcccttatgcgtgtgttcctcccggcttatcggattctggtctcgatctacaggctaggagcgccgcgtcagccaacttatgatcagtggcccgacaacggcgagcaacgtccccgtccccctttgcgagaaaggggcagccgagcacgacgttgccatcaatgtaagtgtactcagcggtccttttgcatttttcttccgggatcgcattatgacttcatgaagcgtaggctctccctctgactgatatcatcgagccacttgtggaccatctggtggcggcgtcgctgaaggagaaagtcgccaaggaggcgtctgacgctgctgctgccgctgccataacgagcggcggcaacgttccgaaaaaggggaggacattctcctctgtggtcagacatcgtcggaagacgtccaccccctcggtaagttctcctgccctttgatcgcgtagtcggaaagcttctacctcacatcatatcggttgtactccaggcctcggatgcatctcccacacctccacgacggcagtggctagtgacgcttggcgagaagtaagtggttgactttgaggtcttgtcactttgtcaaactgttgcagcctgtttcagttgcagctttacgcagggcggcgcggccaaaggcggcgcaagatgggtctagagggacctccaacgcgtctcctgtcgtggtcgcgcctaggagccgcgaggcgacacctaacggcctagctagcgatcttgcggctggtcggggtctgccggctgccgttctcacctgggaggagctccaggtcgagatggggtgcctcctcgaggctggtgctcgtggcattggccacgagatcacggaggtgaaggcggcggcggcgtcgtcggcgaatgagcgtgctgatcggcttgcgcgcgatttagcggaggttcgcgaggacctccataagatgcgggagctggtggctggcaatgagcgacaacggcaagggctcaagcaccgtatgtctgagcttgagaaccatttgtcagagatccgtggctcactgcaggtcacctacaccggcatgcaccagctcgccgggtagtgtggtgtcaaggccaccatcccgacgaatcccaacgagttctcgttgtcgtcttcgcttgcggaactggcaacggcgatggaggtgatcccctccaagcacgcggccatggtcggagaggagacgtccaacgggatctataccggggcgtgccatgtccttgcgtgtgtgaggctggcgcatcctgaactcgatctgcggaagatcttggatcagggggcggctagcgatgcgcgcaaggatgtgatggaggaggtcggcgacctgggggagtccgtcctcccgctttttgaagagtaggatcttagctctcttgtactctttagccatgctttgtaaaactcttattggttcaaaccacctttgtgtgtgcagtattttgatcttgagtactttgttgtcatttgtagagatgttgatgtcgaggatgtccagcagcgcgggcagcctgagttgccagtggtcgttccgttacttgcgtccgagccacatgtgccggagggcgatgtagctcaaaattcgcctgtggagatgagcatggcaacggctcccttaggttggttatctttgttttcatccactttactcttccgtccggatcgacttgattcgctgtattcttggaagagaagagcagtctaacttagtcgtttccatactaagtagacctcgagagtgcgcttgctgaccaggatcgtcgcatccagtattggaggacgaagtttgaggtcgcggaactcgagaggactatgttggaagtgaggaaggactaggccgtggagacactccgtggtcgcgaggtgtggttcaactcgtatctgaagagttgctgtacctccatgtcaagagtctttagagagcttcgagtaccccgtggggatcccgaggaatcggcggctggatacatctcgtggctgaatggggcctgcgcccagctcgagggcatcggccagcatatcgacgaggccctgaagcaggagtgtcgtcgatcgagctgatatgccggggggcatgtattggcttgtatacgagatcatcgtccgcagctgcacctcgagttcctccacgaagggttttctcgctctcggagaactcctacggagatagatggcctagcgaagtcgatggcgccgctggcggaaaaggtcttccagtctatggactggcgttggccttcctggtagtctccgtgtcctatgacaaatgtcttaggggaaaagtgtaatataattttggatttttatggaactgtaagaagtacttgtaaaatagaaaagaaatctatctaactaagctttcttactctggatgtagcgtgtatgagtgtcttctcacttcgtgactttgattagttgtttgagttatacactctccctagcccccagcctttgacctgcctcggttgaacaagcactgatcctagcccccagccatgaagttacaaaatttatttccgattacacgacttggttaatacgcacggcgagaactcttacacgaccagatcttacatggtctgtcgtctctacaggatccgataaggccttatcggctctgggcgtccccagccgaagttcccttaggttcctcggaggccttgtcaagacggcgtaaagggacatgaggataggtttcaacgctaggtgtcatctgggtaagggatcatcgggaaggaacactttgattgtagtctgtacctgaaaataggctttattgaagttgtaagatgtcttacaagtatggatactattgacttatacatagaatttacgtaattgatcaatgttctaggaatttgccaactcgcgactatcgccgtctgcaattttgaatgcgcccggccgcagaacttgtgtgatcgtgtacggtccttcccatttgggtgagagcttgtttccccctgcttggctttgaacccgtcggaggacgtagtcgccgatcgaaagcgtgcgtgctcggatgcgcttctcatggtaacggcgaagggcctgttggtagctggctgctcgaacggcaactcgttcgcgatgttcctcgagtagattcacatcatcgtatcgctgctcctcttgatcctcatcggaatacttctgtactcgtgtactttgatgttgtagctcggtggggagcatcgcctctgagccgtacacgaggaagaagggtgtctccttgttggatgttgtcggtgtggtacgcacggcccatagtactgatggaagatcctcgacccacttcttgtcgtgtgacatgagcctgtcgtagacgcgggtcttggattccttgtagtactatgccgtttgctctctcgacttgttcattgctctgagggtgagaaaccgaggcatagcatatcttgactcccagcctgatgcagtaatcctggaaatcggcactgatgaactaggagccgttgtctgttatgatacggtggggcaatccgaatctgcagaatattcctttgatgaatttgatggtgttgtcggccttgatttcccccgtgggtgtcgcttcaatccacttggtgaatttgtcgatcaccacgaataggaacctgtagctaccctgtcctcgtgggaatggcccgagtatatctagcccccagcacgagaacggtcaagtgagagggatagtctagagtgcttgcgctggcagctttgtgtgtttactgtggaattgacaggcttcacaccgctgaaccatgtcacaggcgtctttgagggcggttggccagaaaaacccttgtcggaaagcttttctgactaatgtccgaccggcggcatgtgacccacagatcccttcatgtatgtcgaggaggaggtgtctgccatcgtcggacgagacgcattttaggagtaccctgtttggtgccttcttgtatagatcgttgccgatcatacagtagacttttgctttacgggatattttctcggcttctgcgtcgtcctcgggcaactcttcgctatctatgaatttaatgagtggggtgcgccagtcgtccgtggtctcgagatcggcaatggcgtgctctgcctctgtagcccccgagctgatgttgggggcgaccgggctatcttcgccgcttgcctctttcactgatggcctggtcaggacgtccagaaaggtgccaggttcgaatggctctcgtctggatgcatgctgtgctagatcatctggttcgatgttgtctttgcggtatacatgtcggacctcgatcctatcgaaccttttcttcaacttcctaacttctgcgagatacctggataactcggggctagagcacttgtaatctttatgcacctggttcgcgactagttcagaatcccctttcacgatcagtcgagtgcagctgcagctcttatcctggcgagtagtccttcgtactcggctatgttattggtcgccctaaagttgaggtgaattgcatgcttgaattgatctcccaaaggtgatgtcaagatgaatcctgcccctgctccttggctgttgagtgcgccgtcgaacgccattgtccacgtttcgttgtcgatttggttgtctgacctgttatcaggcatagtccaatcggctacgaagtcggcaagtacctgggacttgnnnnnnnnnnnnnnnnnnnnnnnnnnntcaaactggcttagctcgactacccatttcgcaatgcggccgacaacgtctttgtttctcactacttcaccgagagggaaggaggatacaactgtgaccctgtgggcttgaaagtagtggcatagctntcttgatgtcatgattaccgcgcaaagcagtttttggatctatggatatcttgtctttgcgtcgtggagagcttcgctgacatagtagactggtcgttgcaccttctctctctcgacaacaatgacagtgctaacgaaatatggcgtggcggcaatatagagaaataattcttcattaggttggggggcaacaagtacaggtggatttgataggtagcacttgagtgcaatgaatgcctcttcggcttcctgtgtccatcaaaatttgtcttgctttttcagcagagcgaagaaaggttgtcctcaccctcccatcctagcgacgaacctacgtagtgccaccatgcatccggttaacttctgtacttccttgagtcttgtaggcgacttcatgttcttgattgccttgatcttctcgggatttgcttctattcctctaccagagacgaggaagccgagtagcttgcccgatggtactccgaacgtgcacttctctggattgagcatgaggcgatatcgtcggaggttgttatacgtttcccgcagatcgtcaatcaatgagtcacttgtcttggtcttgacaacaatgttgtcgacgtaggcctcgacattgtttctgagttggtcgctaagtgcgccctggaccatgtgctggaaagtgtttcctgcggttattagtccgaatggcatcttaacgtagcagaataccccgaacggcgtgatgattgttgtcttctcctcgtcctctttcgccatgctgatttggtggtagccagagcaagcgtcgagaaagctcaacaactcacaaccggctattgagtccaccaattgatctattcgaggaagagggaagtgatccttgggacacgccttgatgagatcggtgaaatcgacacacattctccatttcccgttggccttccgcaccatgactgggttggctagccactctggatggagtacctctctgatgaaaccggctttgagaagcttgtcgagttcttctcgtatggcttgttttcgatctggtgcaaatctccgcagtttttgctttactggcttggcatcgggtcgcaccatgagtttgtgctcaatcacctccctgggtacccccagcatgtcggacggctgccaagagaacacgtcagcattgtcgcggaggaaggtgatgagcgcgagttcctatttctcgcctagtgatgctccgatcttgacgatcttgtcggggttggtactggagagtggaacgatcttgattgtgccgtccggtttcggcgtcttgtttgttttgctcactttcttgggtggttcagctgtggcaggtgggctaggcgtgtgcttgaccatgtcgaggctctacttgtcgcattgcactgccagcttagcattcccttgaatagtgattgttcccttcggtcccgacatcttgagtacttgatacgcatagtgagatgcggccatgaactttgcgagtgcagttctcccaatgatggcactgtatgctgtatcgaattcagcgacatcaaaggtgatctgttccgttcggaagttgtttgcttggctgaaagtcacaggcaacgtaattttgcccaatggtttggacgatgactgaggagtgatttcatggaagggttgattggtaggtgtcaactcgcttcgtgggatcctaatcgcgtccaaggtgctggcgaagagaaggttgattgagctgccgccgtcgatcagaactcgtgcgaccttgatattacgaatagtgggttcgaccacgatcggatattgccctgggatgacagcagtcctggggtggtcctcttctgagaattctatcttctgctcggaccacttcatcttgggcgcagccccctgccacatctaacagacttcacgttccaccttcttgtattctcgctttgaggagtacgccgtggaacctccgaagatgtgcgagacatggagatcggagtctggatatgctgagtctgattcctgagtaaccgcctcagcgtccttctcaaccacaagtactcgcttgccttttaccaatgccatgtgttttgcgagcgactttttgaagacgaggcaatcttctagagagtgtctgtctgacatgtgtatagggcaccatattttcttcgcgtcgctgccttgtgggtctgggcgcttgggagggtccgcgtattctgttgcgagaacttccgattgagctttccttttcctactcttgtgattcttcttcttgcttgacttaggtgcgtccttggctggtttcttctctcctctggtcttcggtttgtcgttcttgtgtctcagtgcgtcgtccgcatgagcgcatcgatcgacaatttctaataatctcctagtagtcgtgacgtgcctcgttgccaactcctgagtagtatagcgatctctgataccggacttgaaagcgcgaattacagaagcatcggtgataccggggattgtgtttctgcactcgttaaagcgccgaacataatccctcaaggattcactcgggttctgtgtcaatgcatgtaggtcgtcttcgatcgcgtggcgcttgtaagttccttcgaagttggctacgaactgctgccacaggtctgcccacgaagagatcgagtaggggaggagatgcatcagccatgaacgtgcagagcctttcaatgcggttggcaagtaattcgccaacacgttgccgtccgctccagcagcgtagagtaccgtagagtaaacctgaaggaattcttcaggatcggtactcccatcatatttctctattgttcctagtcggaatctttcaggccatcggacatctcgaagtgaacgaccgaaagctctacacccagcgctgggcacggtgggttgtcggcgatcgtatgtccttcgtggatgtctatctgatgatgaggatgaggaggatgacgatgatgacgatgggtcgcttggttccggcgcacgattacgaggacgtcggtcgggttctcgagaatcctgttgtcgtcgcctgttgtgtctcagtgccgatctccatcatcgtcgtcattatggcgacgtcctcgaccagtatcgcccagcccccgccgttcgtgatcgtcgtgatcgcggcggttgtggcggttatcatggcctcggtctttgctcaaacggcctcctcgatct

SEQ ID NO: 69979 - DNA, 6611 bp, Oryza sativa
ctatgaagagacgcaatgtcgagaatggttctcgttgtctcgtgtgcgtcgcgcctctcggcagccattcaggtgatcgcggagatcgccggtgccgcgaggtggaggggtggctcgatgaggcgattcccgccgttcagggttttcaccattagcatcgccagttggtggctgttccgggtgcgccgcagcagcggcctcttcgaacgcgttgctgaggttggtcactaactctcgtaaccattctgtccatcgtgcgagatcgtcgttcagaacggggttgtaggaagtttccctcagtattgtattgacggctctgatgtgctaggccggtgtagtcacttgattctccgcttccgcattggtgcgtgctgacgtgccgacatcgtcgatagccaatacctcacgcggcgtactcgttgttgatgaaccatagccttcgagcaggtgcaagactgatggttcgtggggatcgatgtcgattacccaacaaatcgatctgaaatcggcgtcgctccttgttccttgtcctcatccctaagggggatgcatgactgctggaccttagtatgtggtgtcttcatggcgctgaaaagaccttgcagctcgagaggttgtgattctttgtcttgtaaataggacaaaagacatcacgagttggagaggtacgctgaattccacgctctttgcaggcacgaatttcagcatggacgttcagaaaaacccaacaggcttgcaaggtgtgttttctggttttgtggataggacaccaggaccttgtcacctcggaagtaatcctcgtcggctcgtgattcctgtcggaaagacaaggcttggccgcactagaatccttctcgggctcggatgtcgtcgaagtttcgatttccacttcggcgggaggatccttcgacatggagtcgtcccgggttgtacccactgcgttctcatttccggccattggcggaccagctgagattggcactgtggtgtaaaccggaaagacgatttacccgacttgagtccacaccagtgttgttgaagtaggaactccttggttgaggttggtgttgacgctgttgtcgacgaagctggatgtcatagtagtagaaccttgagcaccaagtccccctacctggcgcgccaatatcaacgggggatacccgtagactggatatagagggcattagggtacgctggaacgagtctctacgtaatacgacatcaagcaggcagaaaacaaagattatactggttcaggccccttgataggtaatagccttaatccagttgatacgggataatatgatggaaaaaacatattacaaagggaatagtggaactcggcgataccgacaagatcgtagtcgagttgattcgactagatctcccggcgacttggctccgataagctcttgcttcgtaggctgtggtggatgtgttgccagtaagattcgatcccttaggccctcccggggggtcccttttatatcgcaggtcaactggtctccaagtaggactcggagacatcgggcccggcacgatacaatgacgacccagttctgtccgagtaggattccttccatctatgaacttgcataatgaatttccttaacttatgccgaaaacatccgtatacgcgcaagtataccatatcgatatgtgacgtatatcgaagggtagagggtatatcttacccgtaaccctgacaatttggagagactgttagagatgctctagggactccatgtcttccttatatagcttcaggggcaaggatataaaggagagaacccaattggacacgacttggttccattatacatttacataattgtatgctacaaaacgtatggtacatgtcttgggaaacacgacaatgtaatttccaaagcttagtctatttacataatatacgtatatggcccaccacctatctcccgtcagagatgctgtccacatgggtatatggtacctataatcttcaaagggcacaatggaggtaatcagctaatcaacaatgctctatgttcctcaaccaagtcgaaaacattagaaacaacaattaacatacacaataatagaattcagtaagaaaaaaaaacatcatttgatcagcaagcataagttgttttaacagagaactttttgctgcagaagttgattaggtcctctagaattggaccaaaaagatcaatcagcatgatattgtacttctcctctccaaacaactacacatgaggacttccagctgaaatttataaccaaaacataaataaaatgagtgaacaaatttatttgaattggtaaacattttttgttaggcaggatgccagtctctttgttcaccttttggaaactagtaatttgctcgtactaacgctacggtgacatttaataaaataattagccaaccaaaaatatatacaatgcatgctttagtgattaagactataatgcgcaatatagttttaagatcacgcaaaagaaaagaaagagaattagattgttcaaacatttatcaatatgatatatatacataaataggtccaaagtacacgtgttcggtacaatacataaatacctttcatcagtagtaaaacacattgtctgctaaggcaacatgttgcgcatacaccatcatccattagagcagacatggtcagtacatggctagttgttatgtaacttaagacatgttgatcttcaggatgcgtttgcacagcctcacagatttaggagaaaacatattcgtagatcttaaagcgcaaaggaggtcaacaaaatttaattggttctatgacaataatctaacatccacaacactataagaagtgatttctaaatggtatgagtaggttggtgcacagggccatcgaaggccatgcgcgagcacagtggccgcacatggctcccaatttttgagggggcccacctcggagtaggcctacagcctggcttgaattcagcggcccataagtgaggaggcaaggagttaggaactatgctagacgcaaacgagttacagccaattattacagagtaactgtttagtgttcactcacggagagacgcgagttgctgcgtgtgtgcagcacaggcggcagcgacagcatcacgcctcacggcagcaggcagcacatcgctgatgttgccgagcggagcaacgggaaacgacgagcggcgcgctgacacagagcagcgccgaggccgcgaggcccagctctagttggaaacctggaatcgataatttactttgaatcaaggctaatgaaattacactgttacagtattttcaatgatccatcattccattggattgataattattgaatcaaaagtaatgtgaacgtcttcactttttttataaaacaggaagacctcaaatcctcgccagatgatgcttctcactggaatattagatcagtactacctttactcttttaccattaatatttgaaaatatatttctatatatcgtagaaaataacacattaaagttatataattaactaaaaataacatattatttttcaaaatttagggtctcaatttgcattcgttccggggcacccaaatcctagagacggccctgttggtgcagtagtgcgtaagatgcaacttaaaccttgaagcccatgattttcaccctttggctctagaaactctagctctgaattgtcatcatccactgagatgaagagtattatctgaacattgtagtattatacccgaaggaaatgaaaaaaatgtttttttccaatgtaccggatgcacgcaaagcaatattaaataatagcaactacaattatttttttctccgagtctaaccctaccaatgttgagaaaaatagtaagggcaaaatatataaaaggtacagaaaaaaatatctagtgtcagaagttccgtgagaaacatgcttgacccttttgtatttcacaccataattttatataggctcctaaaacacaattcggatatcaagttaatcaaacaaaatgtagtatacatgaaaaaaaatcattctacattaaatttaattgtcaaaacgtgacataatatttaccctgcgatattcatctatcatctcatataactccagcattcaggtttgtaaggggcatctataaatttggtgaaggaacctatcaaagttcatcactcagctagttacagttcttataagtgagtttcgtgttgaacatgtaacggttttccgattgcaaaaaaaaaaacagagagaacttgcagaaagcaagttgagatttcattaaaaaaaagagttcaatggttgggagtagagaagaaaataaagcttaaaaatgttaatgtaattgttgaaattataagcacataatgatttaatttcttccataaataaatcatgacattgcagatgtaaacaagcatgaacgcatcattagatgcaaagtgcataatgatgcaaagtatttcagaaagtataatgatgcaatacggttgtttatcagccaagtgcataatgatgcaaagtatttcagaaatcatatacagtatttcaactcccatttatcattcacgagccttggagttacccttgaccaacgagtcagcactgtagtgggaactggtgtgtatacatttcgtgtgcacggtgcattgtaccatcgcctggataatttggttccaggttctcaagggccgcgccatatgcagctttacttttatgatacagaagatgctgatgcactagcccatagggttcgcaggtctcctgaccttgatatcaaccttgttcgggtcattgtacgtattttggcgcaaaagccgtacgtacagaccttcagcagagttggatccatgcccaatatagatgactacatgattgagctcaacactaatgtaacgcctgaccaacgaagatggggatgatccaatgagaacttttgatagacaagtcttggtacatgcaaaaggtgataagccctgttacatcaaagcataccatggttgttatgaccctttagcgtatcctttatttaaccctaatggggagactgggtggaacctgaaaatgccgtacaacgatcccaaccagattctgcgtgatgtggaaatggatgaacagtgtgacatcatctttaggtgatgtacgtaccaacgaagaaagcacttttgatgatcttccaggtacgtacactcgtggcttttgtcgaataatttctaaactttatgtccttatccattgtttatgtatattattatgtaagtttggacgcagagaacgaggttgtcgacaattatctagacaatgaagatgataatgatgatagtagtaaatccggcaaaagggaaaaaggacaagtttgtcacagcgagggagtactattgcttcaggctgcaggttagaaggtgatgcggacatcactacctcggatacacatagcaatcctcctacggtcattcaaggaccgataacaagagctcgtgcgtgacaattgaatttagaggtgagctcgttcctatgttcttctttgtatgaattcgagaatagattgctacctaatgattatattgtgattaggaacaatggaggggacaaggagacacttggggaaggacttagagccatggatgatcatcgaggacgtccaagtcaaggtggaggcccaaaccaattcgacctcgggtgcaattcggagtctaggaccagtctgcactaaaacgggcgcccaggtcgcatatgtgctcggattagggcgttctttatatatatggaaagctaagaacataacctttccaatggttttggtcccacatccaaattcttcccgagtcaatgggaattgatcgaacaagttgacgtccagaatttgtcccggtgctgcgtcaccgtatttgggcttttggcccgtgtatcgtgttggaacccattagggttgtgtcgagagggggttgcacaagcctaaactctatatatcagtacccaccgccatctttaggtttttgggttttgcttagattattctttcaagaacagtttcgccgctagatcggtttgtaagaccccaatttgtgagcttaatcattcatctgcaattttggttgttttctatctcgttcttgtttgtattctttgattggcaaacaaggattagccttctcggcgaggtcatccgcgtttcgacacgggtgataactagaggagacatggtgctgcgattgcggggctcaagagcatgcgcgttcaagaagccggatcgatttgtgttgcgactccgcccaaatcgttgtttatcagaacctctcggaagatcgggaaccctagtgcacatcaggaggggacttctaaacatcattttgttcggaggatgacttttccaacaatgggctattgatatgtacatcaaaatcgagtctatgaggcttgattggtactcaaaacctgagaagcaaaaaaagattcaggctgagctataccaggtaaatggtgtaacatatttccacaactattgacactgtctcccatctgtgattcaacataccagttatttgatcatggtgttatttaatgattgcagggcgtggttgatgtgctttcttctggagagaagcggttccgcagttggtaaga

SEQ ID NO: 69980 - DNA, 35043 bp, Oryza sativa
  unsure (1)..(35043): unsure at all n locations
actgtcacatcaatgttgaggcttgtgcaagcatcaaatctgtgaagtacctctataagtatgtgtataaaggacacgactgtgcatctttctcggttgatccaactggggaaataaacgagatacaacagtacagaaatgccagatacgtgacaccaccagaggctatatataggatgcttggtttcccactgttcggtatctatccagctgttctgcagctccaacttcatcttcctaacatgcagtatgtcacgtataatgaggatggtaatcttgaggatgttgtaaatcgtccatcttctaccaggacaactcttacggagtatttcaaaatgaatcaagtagacccggaagcaaggaagctgctatacaaggagttccctgaactctaccgttggataaccggacagaatgtgtggcagaaaaggaaaatgaagagaggccaagttggacgggttgtgtacgctcaccctgcagaggtggagagatactacttgagagtgctcctcaaccacgtgcgaggtgcaacctcatttgaagatttgaggacagtgtcaggtacttcatactctacctttagagaggcatgcgagaagagagggcttgtggagacggataagtcacatgatgattgtttgaatgaggcatccactttccaaatgccatttgctttgcatcgattatttgcaaccatattggtattttgcgaagtcactgatatccgtgcactatgggacaatcacaaggatgcaatgtctgaagattatagccgagggaacactaaccctgcagtagtagagaagatggtgctacgagacatacatgatttgcttcattccatgggaaaggatatcacggagtatggtcttcccgaggtcattgatataggtattttttgttatactatcacgtcttttccttattaatttacatttgcaccacccaccaatagtttcatcatgcatatatttgttttcactaatcaggtgaacgttgcaacgacgtaatgacagagattatagaggaacttaacgtgctagtggatcaagaccatttagacatatacacatcccttaatgatgagcagcgtgcaagatttgatgagatcattgatcatgtaactaataaaaagagccaggtattttttatcgacggcccaggtggcactggcaaaacatttatgtacaaggcgtttcttgctagagtgcggtccaagggattaatagccattgcaactacgacgtcaggtatagcagcgtcgattatgcctggaggatgtaccgcacactcgagattcaaaatccctattaagattgctcacaatagcatgtgcaacttcacgaagcaaagtggcaccgcggaattgcttcacatgtcgtccttaattatttgggatgaagctgcaatgacgaagcgtcaagccgtagagacccttgataggtctcttcaagacattatgggttgttcattgccatttggaggaaagtttattgttttttgcagtgattttagacaggtacatcccgtggttacacgtgggacaagggcccagataactgatgcaacattacagatattgtatttatgggataatattaggaagatcagattgtcacgtaacatgagggctcaatctgatctattggtttcgggatatctcctttagaatnaggaaatggcactgaanacactatcagagatgattatgttcgcttgcctgatgaaattgtgattgcttatggggatagtgaggattcagtacacgaattgattaatcatgtgtttccctcgcttgaagatgaaaagaatgcaagctctgcatcttatatgagcacacgtgctattctatccactaaaaatgattatgtggacaagctgaatgcggatatgattgacagatttccagggcaggccaaggtttatcacagctttgactctgttgatgatgaccctcacaacagttatcctctggactaccttaactctatcactccaaatggtctcccaccacacgagctaatagtaaaaatcaattgtcccgtgattcttcttcgcaaccttgatccaaataatggattgtgcaacgggactagactaatggttagagcttttcaagataatgcaattgatgctgagattgttggtggacaacatgccagcaaaagggtgttcatcccacggatccctttgtctccctccgacgatatatctctacctttcaaattcaagaggaagcaattcccaatacgtctcaatttcgcaatgaccattaacaaatctcaaggacaaaccatcctaaatgttgggatctatcttccagagcccgtgttttcacatggtcagctatatgtcgcattgttaaggggtatgtcaaggctaacaacaaagattttggctaagccaaagaaagaagttgattcaacagggaagagcactagaaatatcgtgaataaaaacgttcttgactggtgaacaaagataggttcgcatgatctaaattaattcaaaaaaatattgaatatagtaaattgctcatcgaatgttactcaccatcgtcctcttgtttggtacagcacgccatcaccttttatatggaatgccgtgtgattatcttttacaaactatctcacactagatgcgtcagtttgcaccagactgtcatttgagattgtaaatatggtctgtattatataaagggatacatatgcttacaaaattgttctggattattatttttctatatggttcatccatacaacttaaatgaataatgcaccgtagacagcccgaaccaccgccattgccatcaccatccaccacatacagcctgcaccactaccatcaccatcaccaacgccgccgccgccgcttgctctgctgtttttttgggagaaaagacagagagggagaatagggctgacgagtgagccctacgctttttaatttttctcctatcacttacatgtgagcctcatcttgtaaagttttattgtgcccacgcaatatcatagtactgcaccttacatgaaatatattttatataggatatgaattgaattaaagttcaaatgcatcgatcatataaaaatattttttgctaacatgaaattctaaaaattattaaagacatatacaattgcaccgtagcgtttagcacgggcatgttactagttaaatttaattgtcaaaaggtgacataatatttaccctgcgatattcatctatcatctcatataactccagcattcagatttgtaaggggcactataaatttggtgaaggaacctatcaaagttcatctctcagctagttacagttcttataagtgagagttttgtgttgaacatgtaacggttttccgattgcaaaaaaaacagagagaacttgcaaaaagcaagttgagatttcattaaaaaaaagagttcaatggttgggagtagagaagaaaataaagcttacaaatgtgaatgcaattgttgaaattataagcacataatgatttaatttattccataaataaatcatgaaattgcagatgtaaactagcatgaacgcatcattagatctacacatgtaaactaagcagtaaaacatgaacagatcaaatatgcgcaacatgtcgaacacgtaccgaggtgatggaaagaccggttgctcggcaggaactactcgcggttgcgggcatcgacgagggcacgcagcacgcgagcggagaggaaggcgagccgtcgcggacgaacaggaagcagtcgcgcgaagcgcttcccaaaaaccttattaccgccttctcccggtgcaggacgtcgaaggcagaagttccggagacctgctctcccgattgccggtgcacgccagcgagcgagatggagtagtctacgagcgacggcgcagcatagagtaggaggcaaaccctagattgatttcgcgtgtgttgcgtgaagacggcggctcggtttacatagagataggtcgcttgatcagggcgcccgcacgatctccactccgcgtaaccgaacctgataagtcgctcataacctatccggactccatgccattttcacgcaccggattgtttggaatgtttccaaaacaaaacaaatctgaatcttccgcaacaaaacaaaactgcaaaaggagaaaaaaaacctgcgcaagggtgaggagccaatttgcggaccattcgacgcgtacgtcgtgcacgcgcgccgcctgccctgccaggccaggcgaggcgagcgagcgcgcgcatgtgttccccctcttctctccaccacacatgctttaagtggcaaggagggcatcctcccttttaaggaggtccccctttcctagaataagtaaggtggtactaaactccacatgcatgctatcctatgaggtgggcttttgtgattttccaaagaattaatcttcgagtgggccttagcccatccattaattccgacaatccccccaccaaatctcaaaatcccactgagatttgccttttccaatataatgtttatataccagcggttcgatggagaccaattatggttgaacatccatctagaactccaagctacacttactcacaacttgaacaatggactacgccttgaattgcaagtcttgtgcaagcaagtttcactcagagtcttacctggtactagatcgtctgtagactacccctcgggtggagcgtataagtcatactcctaggtctttagtaagcttcctagaagattcacccaaaatctccatagactgcgaccaacagtcaagctcacaaacgtgaattctttcaagaatgctttgcaggacagcaccttcgctaattaaagccagcagaactcattaaggcattgccaacctgccttgcagcaacgagagtacatgcatcttcacttagagagggtataaattggtactctcctctactttactaatggttagttcttcccaggttctaatccacgggatctccgatcacatagactgggttaccaccatagtataactcacatgggtctcaaacccatctccttcgatgcattgtctatcacgtttcgtgatagtcccttcgtgaagggatcttccaggtttctagctgtttggatgtaatccaacgttataactccggagtttctcaatttcttgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagctattctgcctcaacagtagcagtatctagtaccgtcagctctgtttccatggttgacctcgtcaaaatggtttgtttgcaagacctccacgaaacaacaccatacccagtgtgaagacatatccactagtggatttgatctcatccacatcagagatccagttagaatcagtataaccctccagtaccgcaggatacccagtatagtgaagccctaattccatagtacttttcagatagcgcattactcgctcaagcgcacaccagtgatcatctcccggattagaggtaaaccggctcaacttgctcgcagcaaaggatatatcaggcctagttgcactagccaggtacatcagcgagccaatgatttcggagtattccagttgatccctaccatttctcttgttcttgcgaagcaacaagctaggattataaagtgttggagaaggcttactatcaatgtagccaaagcaattcaagatcttctccacataatgggactgcaagagtgtaatcctattctcacctctaattagcttaatgtttaagataacatcagctactcccaaatccttcatatcaaaattttgagaaaagaatgatttaacctcatttatcacctcaaggtttgtcccaaatatcagtatgtcatcaacatacaaacacagaataactccctcacgcccaccatgacgatagtacacacatttatctgcctcattgactgtgaagcctgcagatgtcaatgttttgtcaaatttctcatgccattgcttatgagcttgtttcagaccatacaaagacttcaacaatttgcacaccttaccttcttgaccttcaactacaaacccatcaggttgatccatatagatctcctcatccagctctccattaagaaaagttgtcttaacgtccatttgatgaacgagaagaccatgtgaggctgctagggaaagtagcacatgaattgtgttcaatctagcagcaggtgagtaagtgtcaaagaaatcttcgccttctttctgagtatagtccttagcaacaagccgagccttgtacttttcgatagtaccgtcaggcctaagcttcttcttgaacacccacttgcaccccacatgtttacacccatagggtcgctctgtcacctcccaagtcccgttagcgataatggaatccatttcactacagacagcctccttccagtagtctgcatcaggagatgcatatgcttctgaaattgacttaggagtgtcatccacgaggtacacagtgaaatcatcaccaaaggacttagccgtcctttgtctcttactctttcgaggagcttcactgacatcctcctcagtgatatgttcatgtgtatgttcagtttgttctggtggtgtgattgaaatgggaattatttcaaagggttggctcgaaccactatgtgtatcattcatagggaaaaagctctcaaagaaggtagcatcacgagactccataattgtactaacatgcatgtcaggtacctcagatttaactattaaaaatctataggcaatgttgtgatgagcatataccagaaagacacagtccacagttttaggtccaagtttgtgcttcttcgttattggtacattgactttcgtcaagcacccccatatgcgcaaataagaaagtgatggttttctcccaatccatatctcatatggtgttttgtccttatttttgttaggaactctttttaacacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcatttgagaaaaactctcaagcacgatcagacctaagtctttttatctttctgtcaagttgattttcaacatctaccttataaattttaaaatagtctagagcctcgtctttcgttttcaacaagtacacatagtaaaatctagtagcatcatcaatcaacgtcatgaaatatcgttttccacccttcgtcaacactccattcatttcacaaagatctgaatgtaggagttctagtggtgccaagtttctctcctcggcagccttgtgaggcttgcgaagttgcttcgattgcacacaactatggcacttagaacctttgacaatggaaatcttaggaattaaacacatgctggaaagtcgagacatcaagctaaaattaatatgacataaacgtgagtgccaaatattagcctcatcatccacactgccacaaatatgattcacagacttattgcagaaatcaaaaagggaaaagcggaacaggcatccgcactcataacctttaccaataaaatatccatgtttagacacgactactttattagactcaaaaaccaacttaaatccgtctctagtcagacgggagccactaacaagattcctgtcgatagaagggacatgttgcacgttcttcagctgcacgatctttcctgaagtaaacttcagatctaccatgccaacaccatgaacagaagcatgtgacccattcctcattaggacggtggaaccccgtgcgacctgataagaagaaaacaatgagatgtcagcacaaacatatacattggccccagtatcaacccaccaattaatagactgattaactgaaaaaacagtaggtaaattaccatacctgcttccatctccagtattgccaatggtcacattagcagacttagtctgccctgcaggtgccttcatccccttgcgttgtggatacttcctggccagatgaccaggttggccacacacaaagcaagtcctctcatcctgattaggattgttgttgttcttcttctccttcttgaagttggtggtctattgagctttgtatttccctttgctcttgttatgggccttgtgcacaacattggcactggacagcccaccatcgcccttagacgcagcatctttttcccaagctttctcctcaacatcaagagacgctatcaacccctcaacggagtattcttgtctcttgtgtttgagtgcagtaccgaaacttctccaagatggaggtagttttgcaataatgcacccggccacaaatttgtcgggtaagacacacttaaggagttcgagttccttagccatggtttgtatctcatgagcctgttcgactatagaacggttgtcagccatcctgtagtcatgaaactactccatgatgtacagatcattgctagcatcaatagcaccgaatttagtattcagtgcatcgcacaactccttagcgttggtcatgtgcatatacacctcgaccaaacgatcgccaagaacactaagaatgtatcccacaaagagagtagtggcttcctcgaattgcttctgctgattagcagtaagaattccttcaggtttaccagtacacatacagaagcatttcatagctgttagccacagagtgatcctgatctgccatctcttaaaatgcacaccggtgaatttatccggcctcaatgcatcggcaaaaccagccatagtaaaatcacaacgcctataataaggttttattgaaattataagcacataatgatttagtttattccataaaaaaatcatgacattgcagatgtaaactagcatgaacgcatcattagatctacacatgtaaattaagcagtaaaacatgaacagatcaaatatgtgcaacatgtcgaacacgtatcgaggtggcggaaagaccggttgctcggcaggaactactcgcggttgcgggcatcgacgaaggcgcgcagcacacgagcagagaggaaggcagccgtcgtggacgaacaggaagcagtcgcgcgaagcgcttcccaaaaaccttattaccgccttctcccggtgcaggacgccgaaggcagaggttccggagacctgctctcccgattgccggtgcacgccggcgagcgggatggagtagtctacgagcgacggcgcagcacagagtaggaggcaaaccctaaattgatttcgcgtgtgttgcgtgaagacggcggctcggtttatatagagaaaggtcgcttgatcagggaaaaccctagattgatttcgcgtgtgttgcgtgaaggcggcggctcggtttatatagagataggtcgcttgatcagggcgcctacacgatctccactccgcgtaactgaaccggataggtcgcgcgtaacttatccggactccatgccgttttcccacaccatgacaaaacactgcaaaaggaggcgtacgtcatgcacgcgcaacgcctgccaggcgaggcgagcgagcgcgcgcgtgtgttcccctctcttttctccatcacacatgcttcaagtgactaggagggcatcctctcttttaaggaggtccccctctctttaaataagtaaggtggtactaaactccacatgcatgccatcccatgaagtgagcttttgtgattttacaaagaattaatcttcgagtgggccttagcccatccatttaattccaacggtaattacagggaatgaaattgtggtgtaagcattgaaactatcagtgatgcacgggttaacttgactattacctgtaggttctttgctccatcactaactgcatggctactgagtcttgccaccagtgccagcgagggcggtcgctgccttgcctatgagagtgtgagagagagagatcggggagagagaagggaggaggcgagaattgagaatttaagaccgatagtgagagcttcccaaaaaaagtgagagaagggtgaggaataaaaggcaagagagagaactcgacttggatcagtcctgcttttatgaaaacccagtagagcagatacaatagcaggctataagccagctataaatatattttaaagagataaagatagagagagaagagcagcgggcaacaaatctgtagccagctacaacacggactccaagatgtaatgtgtgtatgataggtgggaccagatattaacagtatattaagcaactattgtataaattggttattacattggctatagatggtttggagctagcacacatcaatgcctttctaaaaagaaccgacattgataacatcagagccagttattctaatgaattggtattggtatttttgtctcatcaataccgtttttttaagctgacactggttggttgcgtggggttctgatgaacgggaaccactattggtgtaagatttagtcgaacagacactaacaagggtattagtgaaaaacatatctctatctctatctctactattataaaaattgaaaatgtttttgtcagattatttggaccatcgtcttagaatctcaatcgctcccgttcgtcgtttttcttttcagcattcgcatgcatttcctttttttcttaagtccgtaacgcatagcttagctccgtatcagtgggagagcaccgtgcaactgtgcacctggaaaggcccacgtgtgtgtagggctgcatcttctatttttaggcccactcatcctgagatgtctattattctattatataaaggaaaataaatctctactattataaaaattaaaaatattcttgccgatattttggtgcgtcatccgtgtatgagtcggttatatatatatatatatatcaagcgaactcccacagtgaatattatcttaactaaaccatataacaataataaaattaaaataaacttcacccgttgtaacgcacgggtatttttttctagtctacttaataattattcaaatttaatatttcataaccctggtgctatttgaagtttgaactaatttgcagggtagcagaaataagttgttgctgcaggagcagaagagtgaggcctggtttacactactacaaaacatcaaataggtgtcaccactataggtgccggtagtgctaaaactggcacctatagaccttttcccacctctgcgggttaaaatcgtaaaaaaccgacacctttaagtaattataggtgccggttctaaataaagtcggcacctattctattttgtgttagttttttttaaaaagggaacctttagtattaaaaaccggcacctataataaattataggtgccggtttatgtaaaataccggcacctatgaattgagtcgagctgggatgagccgagccagcgggccccaccacgaagcttcgaggagataaggccgctccgcagcgctcgtctctctctgtctctccactctcttctctcctctcggtgcctgtctccactcatctcctctcgttctctccgctctcttctcttctctttctcctctcccggccagcggaggcggcggcgggggccgcgcgctcccctccgcaagatccggggaggggcggcccagcggcagcggaggggagggaggatgcggcggcgggatgagaggcagtggcggcctggcgacggcaccctcccctctcgattccctcgctgtccgcggcttgcggaggcggtagcagcggccgcgccctcccctccgccagatccggggaggggcggcccaacagcgttcgcagaggggcagcctagcggcggcggaagggcggggggatacggtggcgccctccctccatgagatctggcgaaatgtttcttaaaagatttgtgtgaaatgatttgtatgatgttcttcaatgtttcttgatgttagtgaaatgatttgtgtgaatgacttctatggttggggattggggattagtgaaatgatttctgtgatttatgtgaatgtgttgtgtgattggggattggggattggggattagggattgtgatgcagggtggatgagctcgatgcatcggctcaaatcgagccgatgcatcgagcctttatttttttttgctcgcgagtggtatcgaaggttctggtttttaaaataagattggtgccggtttaatgctgccttcatagtgccggttgggaaaaccgacacagaaaggggtttctcaactggcactaatctcgtgtcctgtggtagtgttagctcctaacttattcttcaaacttccaacttttccatcacatcaaaacttccctacacacataaacttttaacttttttcttcaaacttctaattttagtcaaatttctaattttggcatggatctaaacacaccctgaatgttcagattgctaccgctacagagcgagttgcccaaatactccttccgaaactactgtgttcaaaatcaaaaagtacaataaacataggagcagtgtgtgccattggaatcggaatcggaatatataaaggggcgcgagttgggcaagcgaggacgggtgccacgtcaggattttgctacagtatgtacagtgcgcgaggtggtatttttgtgaaaaaacccttcgatttccagataattcaatcgaggtccctcaagaatagtgcctctgaggtgtttattgcattaaggtccttatagaattcggatattccgtgcatagaaaagaaaaatcgtgaattaaaaccgcgttgtaaaacttaaaacatgaggggctttttcggaaaaatggctcacactaacccacccaccccatgccctagccgtataggtgtccaaacgggcggcacgccccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccggcagctgagctgcactggccgccaggccgccaggccgccagccgccaggccgccagtgcacagtgttttttaaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattttactggggttggtctggatccaggtagagttgctcgaactgggcggccaattcttggttgtctgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacttgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgacagccgtatgatccggtacctcctccacagatggtggagttggagccgatccggaggtatcgtcaaacctcgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttcaaattttgtcaaaataaaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccctgctttcggcctggcgcgtgtgccgctggcccgctttcggcctgacgggccgccggtgaaacgggccgtgccgtgccgcgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctacctagccgccgccgcccttctcccctcctccctctcgtctcaccctctccctctccctctgccgccgccgagcaccgtcgcctccccctcgcgccgtagccatcgtcgtccccatcgccatcgcgccaccgccaccgcctccacccactctgccaccgccgtcgcgtcgccgtttcggagctcctccaccgccgcctcgcgctgtcgccaagcgcagctatctctgccgagcaacggtgaaggcgggcacagccttcatcagcgacgaggtcggacctccgacgaccacgccacaggcggcgcaaagagctaacggcccagatcctggcatcgggagccacgccgctgcgcccgccgatggtggcggcgaggaggaggaggaggccccgtcgccgcgtccgtctccgccggttgctacaccttcctccgatcctcgtctcgccgcggcaggcaccggcgccttgactcctccgcctccgcttccggggcggcgcatgtggtcagggtggaggtggggacgacgaagggggagaggagcttgttcccctgtcgacccggccgtgctcgaggccgggctggtgtggcgcctcctcgcgggggccgggcagctgacccgcggcggcgcggtggcggtcgccgtgnacgctttgctgttcgagcacctgtggtggctgcagcatacgccgacttcgtccctcccctcaccatcgtgggtcatcaattcccctagcagccgacccctcgcgccgcccgactccgtcgacgtcatccctcccctcgccatcgtcggccgtcgcgccgccaccccaccgccgctgccctcccacgcagcaggtccatgccgcaagacgtccactggccacaaccatcgctgccctctcctgcagcagatccacgccaccggccgccgccctcaatcacaatgtgatttggaggtggagaagcttggtgtggtacgagttcattttcaaatccgctaccctcgatgacagcccaggctgcggcttcttcgccaacaccagggtcaaccttgccaacgacatgtgagttagcttcttcctctctacagagatttctggtgatttttgtttaggcggaacaacgactacacgttgatgcggttgctggcacaggcggacgccatcaacttcatcttcttcaccaagatggacattggtgggttgttgtgctgccttcaattatgcagggttgggttggactctatgagggtttcgagggcgtgtgcattgctgaccatggctgcgggtggtcctcacaccaacagcagcctgtgactccatgaagtatcgtgtctggatggatggtgagtgactggctttcttttttaactttctgactagccctaattgccacctaattctatacattcacctgttcatccagcgattccagaatgtggcagtggcagtgcggcttgccttgatttgatttgttgtgctccacgattatcagttcagaatgtcagataagtgaaggttggttggttagctagcaggaagttccctgatcattctgttatttgtcaaaatgtgacaagcatactgatctctttgttttgtagtgtggtgctacctagctgggatgccggtagcgatcgctgtagtggccgcggcgacgattgcttcttccttggatgggagccaccgttcgccaaccttgctgctgccgacgctcgcatatccttccctgtctgtgtgccagaggtaaacggcagtttcttcctgttcttccaccgtttgtgctgatgaatgctgtgcattccctccttgtttgagctcggccatggaggagtcactggtatctctgggctggcggtgctagaacagtacacatggtcgcgttgccgagggagctggacggccttttcagggtgggttcctgcaggacagggcaaagatgatggttttgtcgaggaatttctgtgatgttatgagccattatgttgatctgcttctgtttcccttccaggatttgtgggatgcaagcaacagcagcaacagcgaccgggcacgtctgattccagctatgttcagcatcatgtatgggaaggtggggatcagtgccgacacccccagttctacctccgattctttcttcagtgatagtcttaatagctcttgtgggcagtcattgataggcatggtgtgtacttaactgcttattgaaatgatcaggtttactttccattcctaccggttcatacattgttctgctctaaatattttcttttattcgaggggataggcagatgttcgcacaggcatggggcaatccggtttcctttctattttgtttgtattgccatggtgcacttcgttggattgtggtgttctgtgtagttttctactatatttaggtttaccacggcttgttgtttactggttgtaagaaagcacataagaaatgaaacctgaatatctggattgatgggtgatgggggaatatttatgtttctgcttaattggatgggtttgatttctctgtcaattaatattccgtatacatagagcctcaatttttggtagagggagattgtcaatgctcttgcctcgctcgctatagatttcctttctagataattatagacatgttttgttagtttatatatgtgttggttggctgttcctatttactccgcatgcagaggattgttcaaggtgaaagaaagagcatggagattctctgtgtcgtcctatctatatttggatcctattttatcatgctcagtgtttttttgttgtgcaatacctttggcttttattttcgtgccaaacagttttagaattggttcagacatccttttacttctatggctgcaatgaggttgcggcgtgatggagaatccttcttgatattataggtgcagaggcttatgcgttctttcctttatcaaaaaaagatagagttgttcttaaaaaggcactgcccatgttctcttttatagttctctgtgtatttatcgctatgggaaaaaatgatccgtgataaaaaaaattgttagcttgaacgtagagtgtcaacatgttccttaggtgctggtcactacattttgttatttaaaggtcggtgtgataggattcctttatttctggtagatgttcagttatatatgctattggtagagtgcctgcagaaacatagagtgttccagtttcatctattttgtttccaggtgctcatgcagcattcgatgccgcttttgctcgttcttactggtgtttgcatgttggtttatgtccctgtgtttctgctagcatggtgcattccattgccttgtggtaccctatgtgattttctatttcatttctgctggcatggtgcattccgttggcttgtggtcccctgtgtaattttctattatatttacctttgctgcagcttgccatctactaattgcatggaagcaaacaggagataaaattttaatatctgcgttgatgtgtaaggagtggatgtttatatgcgtgtttaattggatgggttggttccactgccggttaaggttttatatagataaggcctcaattgttggtagaggaaggttatcagtgtctatggttcacttgttatgcatttcctttgtggatgattatagacagattttgttaatctatatatatatgttgattggctgtgcctttttattccgcatgcagagtgttgttcaaggtaaaaagaaagaaagtagaaattgtctatgtcgtcccatctgcttttggattttattttatggtgcccgatgttttttattgtgcagtgcctctggcttttattgttgcgccagacatttttagaattaaccgagacatcctttcctttgtttcctgtatagtttcaaatcaaatcaaacagacatgtgcatcaatcatccaaggtatcaatatcagctatcagcctcacaccagagcaattactatttctgccacttccactgaaggttatcctttatcatttctcatacaactattatttttgtatatctagcccatcttatgtgcttgtttcttcatctagagatacacatatataaatgactgtttattccaaccatccaccacatgcagatacatcagacacttcttccaacactaaaactgatctatcatctgataccccttccaacaccaccatgacaggtaaatctaatccttgttttatgtaaattaattaaatttgttcacacagtataatgaagatcaaataatctcgcatgataaaactacatggaaaacaatcatgccaagcttcgtataatgttgtcagtacattttactcacactgaccttcttaaaaaaaactccgccagctgacacctaacatctattttatacttatgcaattttcacttcacttacagtcattacaccctatctagcagcttgaatactcctcagctagatctcttaaaactccgtcctaagttttttagatgctaatgtaccagttgcagcctgcaaaaactctcttcatcagcaacttttaaatgttcattcagttctttcgcaaacaatgcaaatactaataggagtattttcatacaggcagcactaagcgtgcgtttaacgagctgtgtttctgtgcaaagaatgttgatccaacagctgacttgaaaaagtatatcgaagatcttgagtgcctagaccgttcaagcaaattctatgctgttgctgtgaataacacattcatgaagcaggatagagttgtaagttcctacatctgctactcatttatttatatacaccatacatggctatctatcttaccaattatgagtcaaggctgatatacaatgccaattacagtactgtactaaagaattttctcaagactacttaaagccattaatggaaggcaaggaaaccatcagcattggagttcaaattgcaggtggtgtttcaaagaatatgatcctccatatgtcaacggatggtcgatgcaacctgaagaaaggatgggcaaaatttgcaacccacaatcacatatacctacaatcactatgcaccttccatttctacaaaacaactcgcctggaagccaccttcgatgttctataaagaacatagcaatactcatggctatgttgcagccatccttttgctgccatcaaccaggttgatcactgtcaagataacatgtattagttctaggccttacatggtaatcatggaacctcctaatatgaagaaccatctatatatgtacttactgctattagagacctctaaatatcaagatgcctgtgtgcaatttgtactgtggtttgcttctatgtaagacacttcctcgtactttcttgaccctggttgcgtccaggcggcatttcctcgtactgtcattggcgcgcccctagctctagtgtgatagtagggtggactttctgtgcccaccggcactcgcttgcacagccacaagctataccgacaaaaacttcagggaagcagctagaagtcaaaagttctcttggagtcgagagatccttcgactgttactgatcatcttcacttttacttttcgcttcaggctgtgtttagatttaaacttttttcttcaaactttcaacttttttatcacgtcaaatgtttagacacatgcatagagctttaaatgtggacgaaaaaaccaattacacagtttgcatgtaaatcgcgagacgaatcttttgagcctaattatgtcatgttttaataatgtggtgctatagtaaacatttgctaatgacggattaattaggcttaatagattcgtctcacatgtagtttacaggtggaatctataatttgttttgttattattttatatttaatactttaaatatgtgtccgtatacttaaaaaaatttaacacacaaactaaacacagaaacagaacctaatctggagagatgcctgtttgcagatgtcactctggtacgagtgcgacacgcagtcagtccagtacacataagagagcaagaacaggtgtccaccatgtgattgatcagtgcgccccagtacaccaaacaaaaacaatgatcatctgatgaaaatgatgttatttttcgttgggctggaacacaatatttttacttgagcgatcgatctatggaagttggaatatcgttctcacagggcagccaaatggcagcacgctctgagaattttcacaactcgatcgatcacagcacagccgaacttacaataggaattgaagctagctagagaggagaggaaaaaaataagaatgtgccaacatccatgcacgatcatgcctcaatttctaccctagcaagcaatgcaacaaatcgcaatgcaagcgcgcctgcctcatctcatctgatggaggtggcagaggcggaggcgaggacgccgtggaaggtggcctcatcgcagggcagggtgatacccatgtcgtggtcgaagccaaactcctcctcggccttcctgagaagctcctggaactctggcgccgcaaggcacgccaccggcacgatgtagcgtctccggctgatgccgacgtacacggcgaagtggcccctcggcacgtccccaggcagcccatcgtcgtcgccgccggcgccctttatcccgaggctggacgagcacctccgcagcatctgcttgagctgccccggcttcttggaccccgtgatcgccatatggcgccggtcgatgtccaccggacgtccggacggttagtgcgtgcagcagtagtagtggtacgtcgagcagcgagacatcgacctgccacctgcggaatagcgtggtatttaagggggaagggtgggagacacgcgggtgcatgtgggcgtgggctcgctcgggcacacggcggcagcggcacggccgggtgggtgttagtagtagaaggctggtagctagtgggtcgcgcgcgaggtggaatgtacggtcctaccacgctactgcctggcgccgatcgcgcgccgcggatatggctgatttctctactccggtttcgcggcctctgggagcgtggcggggtagggaccgtgtaccgggcctaccggcacgggtgcgcagggcggtatgtggcgcatgtggacgttgtcccggcacctgctacgccagaagccgttgctgcgtactgtactaacccggttgctgcttctctggagagagggataacaagggagattttctgtcttgcgcggtcaattgattgaatgattgattttgattcgggcaggacggtccttttttgggcgggtttatcaggccacagaaggctagctagtactagctgtctatactgattgcaggatttccgaaacaccatgttctctacactgccaatctgcgatgttcaatgaatctactcccaaattgcatctgggaatgtactgcttttcgggggttgctggctggtgatcagtagggaccggaaatggtaggtgaggattgtacgtaacactgtacgactgtttgtactcctcgcaagttgcagccaatgctcccaaaaaacatttctttatgccatatttcaaatacagtaaattaatcacttttgggctgtcccttttaaagaaactaggtgatgcgggaattagtaaacaatgctcaatttgtttttcaagagaaaaaaaataataaaacatcagggtttatcaatgcttatcatgaaacaaacaaatgataccccgtattaatgtgaaacatattgataagtatatcttaaatattgtaaaaatgatagatttgttaaaatattgtgcaaatgatgtgaggggtgatgattagatatacttacatgttgatttataaaattaaataaattgtagatgatgttgtatgcttgataagaatatgtaattattactagtgggtgataatgtgatatggttgcatgttgagctttagacttagtgggatataactttatagaaagtacatatgaaagaatacatagataggcacgcttctcaaactactaaacgatataattttaataaaaactttatatacatatgaatttattaaaaatctgtttaaaatataatttcaactttataataattaattcattctatggatctgtttgggggagcttctagcagctgcagcttctcctagaatctccagtagccagaagctccctccaacagttcagctttttacccagattctgagaatcaatctgtagtcgtagaatctagaaaatgaactagaaaccaaaagctgggttttctagcttctctagattctcaccagctagcttctcagcagctgcttttcataatgttaagctcccccaaacaggccctattccatttagaagccgcgtgcatatagatactatagtatccatcctcccttaacaatacaatcactggtggagaagaagtttttactcccggttcgtaacccccctttagtcccagttttccaatcgagactacaaatccggaactaaagatcgctatcgttagtcctgggtgaaataaccgggactaaaaatctatctttaggactaaagatattgcctttagttccggtactaaagatagagccaggctgatcccggctgctcctttattctattcttttcttcattgtttttaatatattgatttcactccatccccatctccaaaatcccaaatcaattatcacctccaaatcctcaaatcgatcatctccaaatacatcacaaaatcttaaaaaaaattacatcacaacttctaataaattcatcacatattcacatcacacacaaatcaaatacatctcagatccggatcacaaattctcaaaaaaaaaaaacaacaaaacaagccgccatcttccgtctgccgcccagccgctgccttccgccttccgccggccagcgccgcgcgaggccggcgccgcgcctgcagaccggggaggaggggggagggggaggagaaggagcctcgtgcggcggcggcgccgcctgcagatcggggaggaggggggagggggaggagaatgagaggagggagaggaggaggggatcctccgcgtgtaagatagcgaggagaaggggatcggaggagaggagaagaggagaaggggaggaggagatatgtatcttgatcccgcacgcctcgatctctgtgcgcatgccgatctttttttccggttgatgttactaaccaggactaaagattgattaccaaccgagactaaagatcaaaaagtacctataacctttttcaaccgagacttaagataatctttagtcccggttttattgtaaccgggattattatggaatctggtcgaccgaccaaagatggtttctccgccaatgaattataccatgttcagacacgaatattctacaccgctcgattattgagtgtaccgatgataatgagcaccatctttgctcttcaacttatcaaacgtgaccatattataaatttgattttttttcatgtttttaacattgtttaatttaaatatataaaagtttgaaaagaaattcattttttcccttaagctatttcaccagagcactcgacctctaaacaatttttgttcttcttttacacctcaaactattggagatggtcctacttaatccctaactgcatttctctttttcccttcctatatattacttcttctgtttcaggttataagactttgtagcattgcacatatttatatacatgttaataaatctaggcgcgcgcgcacatatatatatatatatatatatatgtatatatatatatatatatatatatatagattctttaacatatatatgaatgtgggcaatggttgaaagtcttataacctgaaacggaggtagtagtaagtaatattctcctataagtctcgacactatttataattttttttatcatcattgttcgcatggtttggaagctccaaaagactgatctaaaaatcaattgctctacaaaactacagcataaaaatatatagcttacatagaaagttttgaaaagaaaaatattattatggataaagtaaaccattttcaacagtttagagtaaaatgagcaaataaatagtataagggttaaatgatcccatgaaataattcgactgaataaaaaaagttttttttttctaaagggacataaattaattttttgctactaagcattgctgcctaataattaatgacagataaaatatcgtaaattgatcgatttaattgcatcttttagataatggaaagactcccggcctttgcttcagagaagctacaaccattccctaaaaaaaaaaagaacctacaaccacttattacatagttcactcaataaagagcacataaaaactaggaaatgatgaaacaataactaataactcgaacatcgtttattcaagtccatttggaaatatacacccaaagttagcaaatatatacatgaccattgtttctaggtttcagcacgcaatatatattagtttcttgtcctcgtcacatctttgaagttgtgcccagaaccgaaatcggtacgttgcccttaacaggacctgcagataagatttcattaatgatttgttaaaaatcatatcatttttacaaaacaaaaaacccaacatatagcagatgcccctactagaataagcttctttgtttttgagtcaatacctttaagccaatttccatcaatatgagaagtactaactccatcccaaaataagtttatttttacacataccaataaaaaacaaaaaaaaaacagaataacccaactttattaaatcccaatgcaactatttctcactttatcaaatcccaatacaattattctctactttcacaaactccaatgcaatgattattctaaaaacaaacttattttgggacaaatagaagaagcttaaaatgaacctactacgggatagaggaagtaatttttagaggttccaagccacaagaaatatgtattgatctccaaagaaatttagcaaaatggtactaaaaactgataaatagtttcacttttaataaaaaaaaagttatattgctattccaattccttcatggtaaattatctttagttaatattacttctttaaatggtaatacacaaaaatgtttattttaagaagcattttaatttctataaaaatatgtttctcttaatatggtcattatttattaaagccaagtgcatagaacaaacccaaaattaacaaatttgatgaagattccatctaaatagtcaatatcatcattcaattgaatatgcacaattaatattggtcactaaatcatgccaattttccaggttctggcctaccaataatgcacttttaaagaaaccatttagtggaatagaagtcatgaccgttacaactgaaacatttctctttgagcaatattgtagagaattggatatctatccataaagtagaggaaatatttcctaaccattatccttccaatatcttacttgcttcccatcatttactacccatgatcctaatttttttaataaaattcttgacctttatgaggcttgaccaaaaatgagaatcctcttgttttctcttaacttgggtgactgtattgttttataaatatttttctttaatatgtccggccaaatatctttctaattaatcagtttaaaaacaatttgcttaacatatatttattatgatttctattttatgcacccctagtctatcctggttctttgattgagcaataatattccatcttgctaatctatatttcttttttatcatctcctaaaaaatacgatctataataatcactttaattgcatataaaatatgattgtatcaattatacactaccagcgacgtacgtcttactttctactagcttgtggtccactctagtagtacgtatttatttaatttaagttcgattgctgttcaataaaggtcccgcattatctaatagttttaatttagacaaattttacggtacattgtactgcaaatatatactaccagtacattttatctaacggtgtaaattaatctgatttttctctaaattattctgcaatataaattaaatagggtatatttgtcttttcatctatttgcgtggagggtaattttgtaaattcgcatttcctcacttagtcagatccggtcgataggcgcccagtcaaatccgctgctgggggaccgtgccataggcgcacagctgcggcagctcgcagcggcaagggcagccgagcggcggcaggtggaagtagcagggcggcatgcggtagcagctgggcagggaagccccgcggcggcgatagcctataagtaatgcaaaaatcacaaattaatatttctactagacaaggactcttgtccgaccatgacgaccataaaaattcacaaataaaccaattcacaagtgtttgtagagaattacttcgagttgaactaattagagataggtttaattattgcttgtgtatccattgtcccgggtgaaataaccgggagtaaaaatctatctttaggactaaagatattgcctttagttccgggactaaagatagagccaggctgatcccgactgctcctttattctattcttttcttcattgtttttaatatattgatttcactccatccccatctccaaaatcccaaatcaattatcacctccaaatcctcaaatcgatcatctccaaatacatcacaaaatcttaaaaaaaattacatcacaacttctaataaattcatcacatatccacatcacacacaaatcaaatacatctcagatccggatcacaaattctcaaaaaaaaaaaaacaaaacaagccgccatcttccgcctgccgcccagccgccgccttccgccttccgcctgcggccgccagccgcccgggcgcgaggccggcgccgcgcctgcagaccggggaggaggggggagggggaggagaaggagcctcgcgcggcaccgccgccgcctgcagatcggggaggaggggggagggggaggagaatgagaggaggaagaggaggaggggatcctccgcgtgtaagatagcgaggagaaggggatcggaggagatgagaagaggaggaggggaggaggagatatgtatctcgatcccgcatgcctcgatctctccgcgcatgccgatcttttttcccggttggtgttactaaccgggactaaagattgattaccaaccgagactaaagatcaaaaagtacctataacctttttcaaccgggacttaagataatctttagtcccggttttattgtaaccgggattattatggaatttgatcgaccgaccaaagatggtttctccaccaatgaattataccacgttcagacacgaatattctacaccgctcgattattgagtgtaccgatgataatgagcaccatctttgctcttcaacttatcaaacatgaccatattataaatttgatttccggcactgatgatagtctgctagttacgaactgacactgatgttattttctgtagtagtgattattgaggaaaacacagaccttttcgaacgctagaatactgttctcctcgctagaatctatacgcacgaatgactagaataaaaccatgaaaaatagatggaagaatggcggaatctattatattattaaaacagcttgtgttgacaacgagtcacagctctacaccttaaacacgttgtgtgcaactcgtggtggcaccctaagacagaccactgtacggagtgcgtagatgtcgccgaacgaacacccgggagaggccccgtcagggtggacgttacaccggtttattttcgactcggcaggccagttagaacgtcctctaactctgtagagacgagagacaacaagcaattttgagattggaggagaatacatttgggattggtagtaagaaggagggtgatatagaatatagagggtttggatactaaatagatttggacaattgattggttgtttattcaatcgatcttagcccacttatattaataggaggggcgggattccttcccatggttttttccacgtccaattaggtgtagaaaccaattaagactctaaaatcttaggctttagcaagaaaatccgaggaccgacaaatcagacttagaatcggactccgttggtttgaccggccccctaccgtctatctgactggccagatggctatggtcagactgacctcacgtgacaagtctttgcatgtctgggttattttcaaatttaatcatggttttctattattagtgtaggagcaaaatttggattaacgccttgaaaggaagcaccatgttcattacggaggctaaaaactagtgagaaaagaagacttcgactaggaatacatttagaagtaattgaaattcgaaataaaaaataaaaataaataaaaagaagagttcatgtaaaactcaactaaagagattggactaatccaatgtttaggggtcggagaaggagcgatggcggagagggcgattgggcggcgactcctctcgcaggagagttcatcggcggcgagggtctctccggcgacctcggcggcgctcagagacggaggtaaggttcaaggggcgggatccggaagtttgaaagggcatatcgcgacaaaattcctcgcgggaggggtttcgcgctgcttttcggaagtttctggggaagggcccaaggagctcatccatggcggagggagattgggccatctagcccatccctatagccggggttttggccctagactttcacgtcagctggcacatctggatcggcacctgaagcatctgtggggatcgaatcctcgagagctagggtttagaggggggtggagaaaagaggagttgagggaggtgaaggcggcggcggaggagtggccgaggctaggaattggtggcggggaatcgaggtggacaggtacgatcaagggagatacgcgcagatttgagaaggttgttcgaggtcggattccagcaatggcgcaacaaggagggggttggagagggcgcttccaaccaaggccagcgttccatgggaggcgaccgctaggagtggagcatcatgggaggcaaggccaggagggagttcgagcagttcatccactaccagggcgcgctgaagaaaagagggatgagcaagtctcggctgtggcaaccaaagaggggagtttagtgcagcagatcaagccgatgcagatgcaggagaagaccgaagtgggaattactgtctcaaacctcaagcaggatgaggcgaaagctgaggttgcagcttctcgtcctcctccccaagcaaacccaagacatggtatgaatccgaactctcacagaatcttttgtgtgagatgcaaaggtgttggtcacttggttaaggattgtcatgttgctgtgttttgtgtcaattgtgctaagcctactcacaagactaaggattgtctatatgataagcaacccagacctattgccaagttggtgagatatggtgctccagggcttggatgtatattgattcagaacactagatctgagccagcaaaggaacacattaatcctttggcaatgatttcaatcattagtggagggggattaactgtggcgcaattggaacaaggttttactcagcagttcaagtggaattggatatggaaagcaaaagaaattcctaatgggacctttcaaatgaggtttcccaataggatgaggtttgatgagctgtcaaactttgatcactttactgtcaaggggactaatgtgcaggttaatgtcaaagaatggacccaagaacctgaagctgtagggaagatgcatacagtttgggcaagagtgacaggtattccggatgaaatgaagacttaccctgccccttttgaggttggttctaacttgggactagtgatggaagtagacatgattactttcagggcaaaaggtctcatcagaatcaaggtgggtatgatggatttggaagcccttcctctaaaactaattctgactacaccaaaagggctgctattccaggctcagtacactttggaggaagtggtagagcaagggtggtttagagagcaagtctttgaagaggataaggaagctgtctatactccaaccaaggtgggatagagggaggaaaaacaacatgtcaatgaggggggagaacagggaccaagtagtaacaagggtgtgtatagggctgggaagggggatgaagttgtgctagtactggaccctggattgacaactgaatctgatgtggctaagtgtgttcagttccatagggacagagatttggccatgaagttgcaagatgaggagatggaaaaacaatctgctaggattttggtccaagaaggaaatgtgattctatctaaaagcaaaggggctgggaaagggtctgagatgtctgaaattcccattgtagaagagacacgtgctggagatggggctttatctagtggtgggacaggaactttaagctgtttggaggtgatggctgagactgaattgggccctaggggagaagaaggagaaagagttaacttgggagacagtgaggatttcctagattcccaagaatctgaaggaaactttgccaagcaagttggtgtggttctgactgaagagggcatcgacagtcaagaagaagacacaaggagaagcaagagactgagagataaagaagacaaaaaaccacaagacatggcaatggaaaggaaagaggctcagaatgcctttattaacaaaggtcaggcttcaatcccttctattattgatgaaccaaatagctctctcatgaacattgctaatttgttaggagttagtcttgggtgtgccttggttgatgttgattctaatcttcatctaataaaggatatggagaatgctagagtcaatttgtttatgaaaaatcaagaagcaattttagacaaaactcaagagagcaaatcaggagattttcctgaactctctggcttgggagaattatactctttagaagatgatgtggactctgaacttgatgagatcgaaaatttgattaaaaacatacacacttccagtgggaaagggaaaagaatgaagggaaaccttgacactgttaaggtaacacccatattaggtaagagaaaagggaaaaataattctaagaaaaatgattggacttttttggaatattaggggaatggggagtcctgaaaaaataggtcacttgcaagacctaatcaaggatcatcatttagattttattggcatcattgaaactgttaagcaggaattttctgctactatgttgggtagtcttggaggtggtaggaatttggtttggaggtggatccctgctaatgggagatcaggtgggattcttgttgggatagattctgataggcatgatattttagatactagctttgggaactatcatgcgagattgaagttacaaaaaatagatgataagaggtgttgggatcttgtggtagtatatggggcagctcaatacgcacaaaagaacaactttttggctgagctagccaatgttttatattatcagaacagacccttggttgtaggtgaggatttcaatattctgagaaaggaaagtgaaaagaataaacctaggggatacaacaaatggagtttcttatttaatgccatcattgagcaatccaatctaagagaggttggtatggggaatagacagtatacatggtttaacaaccagattcagtccactctagaaaagtagataggatttttatcaacaatgattgggggggtgcttttcctttaaccatggctagaattttagtgaagactttctctgatcatagccctgttctgatgagaactgagggcatttgttaataaaaaacatttgttcagatttgagttaggttagttccttagggaagacttggggagtgtgataattgatgtttggaataaacagtattctggcaatagtattgagagatggcagaaaaaactcagggcgcttaggaaaaaaactcaatgggtggaacaggaattgggagggtttatataggagggaaaaagaaaacattctaaaataaattgatgccattgacatcaagattgaagcacttggtatgacccataagtatagggaagatagaaaggagttagaacagaaactagcctatgttataagggaggaaaaatggaagtggtttcaaaggagtaaggttagagaaattctagagggggatagaaatacaaaatactaccatgcaaaagctaatgggagaagaagaaattgtcaaattcattctcttagtcaagaggaaggagaaattgaggggcaaagtaatttgctgtgttatatcactcatttctataaaaagttgtttggtcattcagttgaaaactctatttctattgaaatggaagggatctgccaagttactgaagaggataagaggagactcactgagcccttctctatggaggaaatcaaaagagtggtctttgaactgaaacaacacaggcccctggccctgatgggatacctggggaattctacaaaaaattctgggatttaattaaaaatgatttgtttgaactccttagtgatttccaaaagggtttgttaaatgtggaaaggctcaattatggcatcatcacccttgttcctaaaacaaaagatgctgcccaaattcaaaaatttagaccaatttgcattttgaatgttagcttcaaaattataacagaggttctgatgagcagaatttatcatgtgatgtgttatattatctcaaaaaatcaatctgctttccttaagaacagatatattttagaaggggttgtcattttgcatgaaattttgaattctcttcatcataaaaagcaaagtggcattctcttcaaagtcgatttggaaaaagcttatgacaaagtgaattgggtttttgtgcatagaatgctagtctctaaaggtttccctgatcaatggtgtgactggattatgaaagtcattaagggagggaaggtggctgttaaagttaatgatgagataggtcctcttttccaaactcacaaaggtctgaggcagggagaccctttgtccccattgctgttcaatttggcagctgaagcacttactttactggtgcagagggctgaggagcactctcttctggagggtctaggtaataatgaagaaaataagatctctattttacaatatgctgatgacaccatcttcttgctccctgacaacttagaatatgctaggaacttgaaatttattctttgtctgtttgaacagctttcagacctcaaaatcaattttcataaaagtgaggtcttttgtataggagaggccagagatagaaaagtgttgttcagccagcttttcacttgtaacataggtgatttgcctatgaggtatttgggggttcctattgatcaaaaaaggattctcaataaagaccggaaaactgctgagaatacaatggaaagtaaactgagctgctggcagggcagactccagtcaattggggggagattgattctcattaattccagtctgagttatgttcctttatatatgatatctttctatagacttcccactggtgtgaaggaaaggatggatttctttagaaggagattgctctggcaagaagatcaggggattaggaaatatcatcttgtacagtggcctgtgatttgtactcctagagatcaggagggtttgggtgttctagatttggatcttatgaataaagctcttttaggaaaatggatttggaaacttgagaatgaggacgggtggtggcaggaggtgttgagggataaatacctgaagaagaaaacaatgtctatacagaaacctaaacctggtgattcccacttttggcaaggtttgatggaagtaaaggagagattctataatttttgcacaaagaaagtgggggatggaaggtccattatgttttgggaagatagttggctcgggggcagacctctggctcacttattcc

SEQ ID NO: 69981 - DNA, 1165 bp, Oryza sativa
aggggtgagactaatcacggtgaatctggttgatcgcccataaccgcgggcacggctattagaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattctaattaactcacaccattgcggtggcaccaatctaaagctatgccaatagacaaagtctatgtaataatgtgatccccatttgtgtactagttgaactaagcatggctaagcatttcctaaaccaacatctagtcattttgatacccaggttatcaatggcatatggtaaacaataaatggctgagtaataggacccatcccacatgatattgtaaaagaatgcaacatttaatagaaatgcgggatatttgtaaattgggtacaatatgatcaaacgtattgcatgacttgccttgctctcgcactgatgagacctcagcaacgtcttcgagaaaccgcggatcgacgaaacggccgaaatctacgcgacaaacaaagcacacaagcaaaacatgctataagtctacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcactttattgcgcaataaagcccagggctgacgtcatccaagggggggggcggctgcgccgacaggcgggccccactggcagcggcacaaggggagagggagggggc

SEQ ID NO: 69982 - DNA, 1274 bp, Oryza sativa
  unsure (1)..(1274): unsure at all n locations
aacaaagtggcaggtttggattttaaatcacctttttaattgggatgaagttgaggatttggagggtaaataacttgatttgaactacgattatgtttgttatttagagaagaaaggtgtgtccggttcctgctagtgttttcttatttttctcttatgaccctagtgtttcgatcttcttctatgatctgtatgtgcttaatgatctagtttgttatatcggtcagatgaagaaggtgggcacaaagacgttgacaacacagccgcccgcggcgacaatgatgatggcggcggcggcggtgacaacgatgatggcagccgtggcggcaacaacgatgatggcagtgacgacggcggtgccagcggcggcggagacggcgacaatgatgatggcggcggcggtgtcggtgcagcacacgccggcacaggtaatacacttaagtgtttttttttgctcagcttgtttactgaatgagcctttgcatgtagctatgcatgcacagtaccatgcaaaccatgagtaatcttgttgttgttgcttgatcgcggtcgatatataccatgagtaaacatgacaaaactatgcaaaccatgcaaatcatgactgcaatatatgcacgtactaagcatcatcaaccatgtctaggtatcaatatcaagaggaggaggcactaccctcctgatgtaaaacgaaccatatatgccaagttattagagaaatcaaatcctggcatgatgaaggagggagtgacaaagtcagttgctaatgaaatgggggtgccgttgagagatgtccaacgcgtatggcgacatatacagattggagatggaattgaagcttttgagtccaagaagaagaagtattgtggcacaaaaaacttccgtgtgatcctagtgtcatcaaagatgtgccgcttggacaacgccatagcatccgtgacctagcccaccgctttggttatggaaaagccccattgtttcggcttcgcaagaaggattgttacgcgccatcaaaaggcataatgttcaccccgacccgaatataacctgtaggnncgtgggcttatgtgctatacaagggcttgaatggttaagcaatatgggccccccctaactttcaaaaggggggttaccggcatttccgtggtcagaaattggtttttagggacaagggtttccaccattttttccttgggtaaggcgataggaaatcctaaagaaacgggggttctttggaaagggaatgtgtaaacgaaaccaaggtcctcccaggg

SEQ ID NO: 69983 - DNA, 1631 bp, Oryza sativa
  unsure (1)..(1631): unsure at all n locations
ttgcgtgagntcnannnccgtagttagatangttanaantcaccannnnagnannnaaaaanacaccttntaatgcaagtaacataggctgattgtgaatagtttatccacatgaacatactatttttaccatnctccacatnattgttgttttcctatggaagagccaaaatatccccaccccgcataatcttagaacctgacatgtntacttctgcacacaacgtaaaaatattgcaaacattttaatctcagatgaaccgaactgtcattttaatctcaaaagaatcaaattacattttaacctttccaataatttgcaggcaatgagtgaagaatctttgcaaacatgtctttgagcttcccatttgatgtcattgctttcaatatcttgtcattgaatatcactttctgtgaaaagtgaagaatctttacaaacatgtctttgagctcccccatgtgatgtcattgcttccaatatgttgtcattgaaaatcacttcttgtgagattttgaaccctgcaggctgtggtaatgtggtttttccgaaaacaacagtttggacatatgatccttcctagcttgtctatcatatttgactttctcctatgttcctttctgcgattagattgtttgagtacaccaattctatatgcatggcctatcaccttccatacaacatcgatgagaatttcacgtgatgccccaacaagtgtaatgccttcatagaaccaaggttgtttaatctcaaaataatcaaattacatctagatctagtaatagtatggagcttagatcaccattacatggcaacaattaatcccagttttagtattcaagcaataaaccttttaatgcaagtcacatagcctgattgtgaatagtttatccacatgaacattctaagcttaccattctccacattattgtgcttttcctatggagaagccaaaatattaaatattgattaatcttagaacctgacatgtctacttctgcacacaacgtaaaaatattgcaaacattttaatctcagatgaaccgaactgtcattttaatctcaaaagatcaaattacattttaacctttccataatttgcaggcaatgagtgaagaatcttttgcaacatgtctttgagcttcccaattgatgtcaattgcttctaatatctggccatggaaaataactttttgggaaaagggaaaaattttaccaaccttgcttttggcttcccaagggaaggcaatgctttcaatatgtgtggaatggaaataactttttgtgagaattttaaccctgtcagctgtggttatgtggttttttccaaaacacaaagttggacctatgagaccttctagattggtatcatatttgacattctcccaaggtccttttgcgaatagaatggtgagtacacccatttatatgcatgggctattaacttcatacaacaattatgagaatattcgtgatgcgccacacatgtgattctttatataaaccagttggttaactccaaataatccaattcactttgaactcttaatagtgttgggcctttaacaccctttcatgggacacattaatcccgtttaggattctagccaataccctttaaaggacgggcaat

SEQ ID NO: 69984 - DNA, 1575 bp, Oryza sativa
  unsure (1)..(1575): unsure at all n locations
gcgcgcctttgagtgcgcatcgcattggacncnncncanattagnacacaatatcccctcgaccaattctataggcatggcctatcgcctgccttacaatagaagggtttttatgttttattgatgagaatttcacgcgatgccccaacaagtgtaatgccttcacaaaaccaatgttgttaaaatcgccaccttgaatttaaaaccataaaatcgtacaatcaagcacattttaattacaatcgtaaattcataaaatcatatgacaaaatcgagtctttgacaaccttgtacaacactccttcgttgatgcaaccattacattagcattgtgtttcatgtcattgaaggcctccacggcttcttgaaattttactaggacatttccactcatctacaggatctccttattttcggtccaattgaacattgtgctaagctggtccatgatgaaagacagttattcatgatattgactgagcatatgcactcactctttcatggcttcaccacaaatggacaatctccaagacaaaccttgtgatctccaagacaatctccaagacaagccatgcatatatatatgtttgtatatactatatacatacatatacaaattttattcataagtatgtatagcatacacatacatatatacgtacaaaagagatataggggtgatttgttgtcgtctagcgcgcaccacgcacggcgcacggttatccgcccatcagcaccccagaccgctcctcttctcgagcgaagaaccctagcgccgccgccctcttgatttccctccccgcacgtttcctccacaaattaattgccaaaattgtttccttacattgtgggcattatttcccctcttgaattgcattcgatcgagcctttaatcaccgtgggagacgcctgtttcctctctgccttcaatggctggtttcccacttcgccggtgccgatctccctgcctagcgccgttccttctccctagtggcttatataagcccgccggaggagtgtcctcgccagtgaccagtgaagacgccatcgtcttcttcctccaacagcgcatccaacctcaccggagtgccatcccgcaacgccgtcgctgccgccagcctcgcctcattgagatcttcctcgtccacgccttcaccaagatcagcaagcaccggacctccatcctcaccgtcaacccgagctacccacctctccttcttcgtcagccggaagtgattgtagctcaccggtggcagtgataatggcatgttgacatcagatctatgaccaatggaccggatgcaaacatggaagcactggtggagaaaccatctttggtcggtcggccgaaatccacaatagtcccggttccactaaaaactgggacatctttagtcccggatcaaaaggttagagctacttttttgatctttagtcccagttggtaacatcaaccaggactaaagatcatttttagtccccgtttaaaagacagcaagctgtgtcagacccctctgtatatttagtcacgggtggtaacacccacccgcactaaagatctatttntaggctcgg

SEQ ID NO: 69985 - DNA, 15687 bp, Oryza sativa
  unsure (1)..(15687): unsure at all n locations
cgcactggtgattgacattgcagctggcacattggcacatcatatacatcccacttgatttgggagaaaataaaaagaaaatggaccaaccgggactgcccctatcctctctttagtctcggttggtagcattaaccgggactaaagatccctctttttagtcccggttggttaccaactgggattaaagatcgatgtttactctcgattatttcacccgggacttaagccctgggactacaggggttataaaccgggagtaaagatgatttctctatcagtgaaggataccagtgaaggagaggatgactgttgtgaagaggagggaagctttattatttttggcatcttcacaatttttttctggattttctttcttattgaaaaattctagattcatcttattgaagaagataaaaatggattgaataagtcgaccttggaatcagggtaccttttctttaacatttatcattttcttttcgcgcggatgtttctagaattacctggatgttgctactctcttcattttcttgtgctccgttgatgcatgcacgtgggcagcgtttcccatggccaagcacagtgaggtttgttttaatcctaaaatccttaattaatttatcttaaaggttaactccaattaatcaacgataaactaaaaggcgacataatttatttatttatttagtaaaattaaaccttttccaattacaaagattttattaagttattttaggtaaataaacacggatgtgaattttcgagttcaggaaaattaaaaaacacgaaaaacgggagtaagatgcctcagtgctccatctctgtatctccaacccccaaaatgatggttgatccccataaccaaacatgatacgaaaatcatcccaagttaccaacgggcccgggaccatcccatcctatattttctctaaaccgaattcatgattattactccctctatttcgtattttaagtcgtttaactttttttcataaacaaattttgttatgtttgactaagtttatagaaaaatctagcaacatttattaattagttcgttaaatctaacattgaatatattttaacaatatatttgttttgggttcaaaacattaatatatttttctataaatttgatcgaattaattaaatgaagtttgactagagaaaaagtcaaacgtcttatataatatgaaacttaaaacttagagagtagaattatctgtgcgctattgtcaagagccataacaagtgggtctgatttaaaaccttatccaatccaaaacgtacacatctactccagcagtccagccccgtgttcagatctttgattcttgagagaaggcgtgcacgaacggatcggtttcactagaaaacggcgaaagggccctatcgaaaaaaaaagtagtagtagtccacagcccggcccaatacgcatcagattctaatcggagacgaaatccgagccgacttcgctctctggctctcgcaccgtcgcacgaatttgcctattatatctggctttttctgaatctgaaggggatcacacagcgaaggctccaagcacgcgcatgtctgacgagagacaggaggctgttgttgttgcggaagaagccgagcagacgaaggagatggagcgcgtgcgaggtaatagcagcagcagtaagcgctcagagcctgtggatcttgtcaaggaggaggaggaggatggggaggactggttcgatgcgttgttgagaaaactcggccaccccttcaccgtcgacgagaagggcaggtccgtcccagatcccgactggtgtccctacgcccacggagatcccagacacgtgctctatgttgataggagaaacacccccgacgtcgatatgttcgctttcattctcggacagatgtacgtatcctgatcctttctttctaagttcttgcttttattgatttgggttcataaacctctcgtttcatttacatatgctattaatcatgtttactctagctagctatagtattactttctgtcatagaatacaaggaagtatgaatttggtagtatgtcaataataagtgttctaacaaagccgggctggttggtatgatattatttggtttgctttttgtaaagtataaaagtcttactatataatcaaaaattggttgctttgtttatttttcttggcttacttataagccatagttgcaacaatgagacattgacgataataactatatcttggccgacgtatttaggataaggtcagtgatactattgtgttaatttgaaaactattgctggtcatgggcaatgggcactgctctagtagagctaactataaaaaccatcatacatatgaaatatgcaatgctcatacaatttatagcatttgcattactttttttttcttaaacaagctgacaataattcataagattatgtattctatagtttaaagttccatgcatgtttaattaattagtgtaactgccaattcgatatagtttacactttgctaattatgattactcttcgatgctagacctgtggatgatgctgatgacagggaaaagggcatctggaatgcttctatggtttacatgagagctcaaaacatggtaatgcatttagttagtgcttgggatacctttcttgaatttttatcatttcctttgtcaataataaaatcaatgtaatataatattggagtaaaaaagaaaaacggatatagcattcccaaaagatcgatcggattacatattgcattcactttgtgatagtgctcttacctgatttacccacaatgcaactaccaacatgtatatgcaattgatgctctttgaccagttgaccatagttagagaatttatgcaactgcaaactaatttaaattcttctacacatgcatgtcaaattattcagagtcatttgcgcatggaaagacacaagtcataagataatattattataaataagtcgagaaaatgttaagctattacatttctttttaccagatgctactacataaatttgcatttaatagcatttaaccattcaaaagtcaacttcttttgacatgctttaatttggtgaactagcaaaggtaaaagagaagccacattatttagttcatctggggcaatatcattgcttgaagtccataaaactttttggggaactatttcttctggatagagtatgtcctattatgttccttaggatttttagtgtgtttcatctagttatgacttatcagaagacaaggtccaagaaaataattccagaaaaaattctcctaatggtggtgctagctccactgaataaaataaaagaaagaccagacggttcttatctaatttgaaacaaatttgaataataatcagtgttggatgtgcttgcagtcatagttgtcaattggaaccaaatattcgtcataaattttttatttaattaaggtataaaccagaagaatttgtggatcttagtttaaaaattagtgtttgtggcctcgtgggaactactggcaagtggaaaccattcaattacataaatgggatatccaacgacctttctggaagttattataaggctagtagaattgtgttacaatttgttcctcccatacaatatgccaactcatttctggtttatgcatatgttacattcaaaattctgacttctaaagtgctagtactaattattatattttctttagtcgtcagagtatgatatggttccaaacaacttggtcttgtatcctatgatgtttgagaagcgccgttggtatcactgtaacatcttgggatgtaaacgtttaaacgattctacgggggaacactccacacaacaacggttttttgttgagcttatcattaatggtggattcatctaccatgtgctttcttgcaccaaagttggtatgccatttcttcctttttaatctgatgttaatgtttcatgtcataattccatcattttataaatttgtttttatcaaatttcccttttgtagatggtgacatcgacaacaatctatgtatagcttgtccgcccaacagtggcatagtgcatccacctgcaggtggatttatttgtggggtttcgaaagatcagaagatattcaaggtccccttctattaattagaatttagattttagagcttatatagcaatagtagaattagttgggccttttttggttgttttctatttttcagccttagctttaagtagacagctaagaatagaagtacaacatgttttgccctaatattatttttttgttgcttgcacttactgtctttgccttataagttgtaaaaaaaagctaccaatgtctttgtggaaactctatgatgtatacgctgtcatgtcatgtaacttatatgctttattttcctatctattattctcatgttggatgttctaccagctgcctgttggtacaggtggcacaaccctattttttgacgcatgtactattggcggctgttaaataccaaattcacgccgtcaatacctgcataaaactgaaatataatataaaatatccaacatagtagtagggtttatttctaacaaaatccacaagtgttggcgtatatttagatgcaggtgacaaactactagagttgagaagaaatatacataaagaaggaagataatcaaactcatattcaagcctatggagttttgggggccacaaacctaacgaaacacgttcaaatgggcccattcaccaaacatatgggttgagggattctccaccagagcccaggagaaaaggctgggtcaaatgggccagccatggtttggtcgaaccgacattggtgctgttcgccatcttcttccacgtggacgatctagatagcctcctaatgacggtggagaggtagttgggacatttccaactgccaaaccgtcatatgaaggctataaaaggagctcacatgcttcatttcaatacacaccaaagcatgagctgaattataagaggctctattgcatctttttttacattagaatagggagaaattaaagaagaaagagtcagaggaattccagagttgtcggtactttcctctttactttgtgtaccttgtcaagtactcagctttaattgatattatctttatcgagtaattgagatttgctttctgaggattatctcttagttcctggatcattgttcactatttgtcaattaatagataatgattactttagtgtttagataacgctagagtagtaattaattgcatagatgcgatgttaaggttgttaattaccggtgattgttgcgtatcccacagttcgttagaagttggtgtagaggtggtgacagcccttgagatcactgcagtccttcttgttcgggtacggagtatagtgcgttctggtagcagtgagcaagctagtgcctgaagtattgcgatagaattgaataaactttctatagacaatgttcctcactaggaaatcctctctaccctttgcctatttttgctttgtgtccttggatgaagaggagctgaacacacatgttccctattaaaattcgatatcttcgtgcgcttgcggatttcatctgtgaccgtaagaaatatcaacatgtacgagtgagcgagcccgagctagcttaacgccgcctgtacacggttgcgcatggctcatgcagcatcattagccaggtgccacacatgattaaatggactaggtagacccacgtaggaagaaagaaaagatgaaaagattggtctatcactatacgcatttatttggatacttatgtttacggcataattttgacaaattaatccttctataaaaattattttaataataaaccgtgtcaaaaactaatttcaaaaatagatcgtgacctcagtgctaccctgataatgctaaactaaaatgtctcagtgcacctaacgtggcacaaattagacatgtaaaagtaactcagcgtcactatacattacactgacatcttaatataggtttaaaatatacggcatgtgctgaaatcatgagtagtattaaactttatccgttttataaaaaagtgcctataagtaataaaaatagacaaaacaattttaaagttaagaagtgaatttaaatgtattcgagtaattcatagcacatacatatgtaattttcagttattaaatagaccaagattagtattactatgttttaagcatatggttaaggttatagcatatatactttagaaaagtgctatcacgaattgtgtgtatcgttaggtattcttgcagaacgcaattaatcctagaatgagttcatattggtatatgtatttctccctgaaaagagaaaatgaacgtgcatttttccaaaaagaaaaaaaaagatatgttcaaagtgcttaaatacaaaacgtgcaatttcattaaaaacaatttacttattcacccaataaaacctagctagcgtatgttactactctttctgcagtcttttactaacacaaaattaagaaaaaaatatttaagagttttgtggattgtaagttttctataaacaattaacacgaaatgagtttattcatgtaaaatcttatgtattcttacttgacaagagaacataaatagcatgtttgtgttatataccaatagatctgttatagttttgttcatcgtgtattttaaacctaaattttaaaacccattaattaatattacaggatataaatattgcacgcgccaacgggcacatcgattttctagttatgttccattatgggggaattccaggaaattggaaaatgaaaatatcgcttacttctcaaaaaaaaaacaattgtctctgcaatctcttatttatcaaagccattttgtacttataccagatatgcggataatccaaccattatttgacatgttaagttttgaacactcgaaccgattaactcctcatagcacgatgttcaatgttactaaaaaaaattgtattgatgctggttgcgaaacccccataggtgccgggttttctagccgacacccctcaggtggcaccgatgacaaaagccatcgactagcacctatagcatatagacagttgtaaccatgaaccgacacctatatattgttataggtgccagttcttggcccccaagcgccatgtggtggttgttgtcacagcctgattttcgtttcaggatttataaattacttaataaattattaatagaatttatattaaatgttcattaatttacaagtgaagttaaatgtgggaaataaaatttcctaaatataaagcatggctggatttaatttttattaaattctccatgattaattatactctttgaaattttctcagatttttcagagctcaattcctaaatgatacaaagaacagttcaataattagttaatcaataatcattaatgatctagttataattatgttaaatgcttttctcgtttaaaaatccttaaattataaattgtggtttaaaaggaattattagaaatgatcttaaaagcctaaaagagaagatctaattttaatttgttaaatctcaatataaaagtgggctagataaaattttgttaaatacttctcttgtttctatagttcctagatttttctgggatttatttgagccaaggaagtatttttaatcaatggaatatcatttcatgaataatttaaatataaaaaggttttaaatctctcttttagctttgggccgaaagtcagcccaagtctctctcaccctcctttcagcctgctcgcgcccggcccaagccggcccagaccgccgcgcccctccctcctctcttccttttgctgacaggtgggactcacctgtcagtcgtcttcaacctccggccgcatttagccgcgccgcaagccgccgcctccttccaaaatccggccgcccctttccttctccggccaaatcaattgaggggaaataatctcctcgatctcctcttccttttctctttaggaatcccgacctaattcgtttggaaatcatcggattcaatgccgatttggttagcttctctttccaaaaccctagaccttccatctccttgccgccggccatgggcctccatcgccgccccctagcccctataaaaggacctccgggacctcctctccacatcaccatctccacctttgactgccgccttctctagcgccgcctctgtgtggctctttgcgtcgtcgccgccggcgggtgtccagtcgggcgccgccgtcccttcgattgtcgtcgtcggacgccgtctccttcatcagcatcgcgaggtcatcgccgtcctcgtcccgtcttccgtttccgccgcagatcaccgaagcgcagccgacactgtcgacccgaagctctccaccgtcgccgtcggtccagccgtgccgtgccaccgttgcagccaccgccttcggtcgtcgtcgccaccgtcgggatcacgaggaggagcagcacctcgtccaccccttcgttgccgccgtttcccaccgaagcaccgccgtcaccgccgacccgaagaccgccgtcgtcatccatcgtcgtttgccgtcgtccaagccactggtgagttcgctgagccgagctctacgcgttggtgccctccgtttgcgccgccgtgccgtcgttcgccggcgagcacgaggtgccgagccgccgccggagatgacatcatcgctgatgttagcactttgtcagccgtagacccgtggtagaccggatcgatctcggccgttcgattcagtcaattttaggtcaattagatcttggccgttggttccgtggaccgcttctgtgaacccggtttaccatggaccgtctttgatgatgcaataaatctattttccttttcaaaaataattctttattgcgtcataattcaatttaaaatccatataaatgctttaatgcggtttaatctttagaaatgcataactaattcattgtaactcggtttaatgtggttcaagttgcaaaagttgtataaaataaagatctatatattaaaattatccataaattgtgttaaatttatttaatcctttttaaatgggctttaattagattaaatcttgtacaattcgtaattaattcatatgaagtcagaatgaggccattcaagtctcataattcatctaaaattatgatctacatgtttgtttactttatatgtattgtttatttggagtttcttagtctttttcctcgttttgcgtgttagcttgtcgtttccgtcattgtgaaggttcgcgagtgtgtcggaagtgttccagaagacaaattgaagacccattattgcaagtcaagtcacacagatcccaaacataattcctttgagcatgttgatcctatatttaaattctctatttatttcaactgtgcattttttttcgaatgtcatcgggtggtgtgaacctattcctttgttatggccaatttgcattgattaccctatttcttgattacctcgggttataatttgactagttggatttatatattggttcaattagatatattagatataattacttagtcatgcttagaaacattagcacactattgggataactaaggtttcactattacttaatgatgtacatggcaaagatagctcatgatggtcaatcgtgattggttaattaattaatttgccaactaaaacttgataatggtgggttgtgagcacatggttttgatgatagtgctcatgaaaattaaggaccggttcacaagtttcggttgtgaaacattaaccatgccaaccacaagccagaatgggcaacgactggacactttctatagcaaagctcattgtggtgtgccagactgagaagtggcggagataagcccacgggggtcgctggagagtccatgcctctggtttttgagggggtgactatgatccaggaaaggtgtgctgctttgagttgagctatgcgaggggtcttgtcacaactacacaaatggtgacatgttcagcatgggcacataatgatatggtgacatattatggagttgtgtcttgtgggtacagtggtacacctctagctagagtaaaactattcgaatagccatgcccgcggttatgggcgggtctaacaatgtctttcgtgattagtcctacactactcattaataataatgtggtaattgatggtaattaatttagctcctggtttggaatgacacatccctggtttggagatagatctgtacagccgggtatggttattcaggaaggttgggcctgtgcagtatggatgtgctattcagtgttgataaatattgatgattaattactctactgttttacaattctcaaatgtttgctaaatgctgcttttgcaaatgagccctatattatgccattctttggtatccttgtgcacttgcatatttgctgtgtggcttgctaagtatgtcatatgctcaccttgcaataatcaatcaaacctcagttgaagacaagttgcgaaggagaagacgtttgacttataccccagttgagttgcctgtgggagtggagccggagcttcgctagaccgtaattccgctgctattttcttttcttttgtaagtatgtaacgttattattatgatgaatctgtatattaaattatctgtttgtgtaccttggctgattcctggacgaggattttatgcacaaattggttcggaaattactagtgaatttctgggcgtgatagttgtcaaaggtgtcgtttctacgtaacatttgacacctataagaatatattggtgttggttatcgcttgagctggacacgtggcagcactataggggtcggtttttaccaacaactgtcacctatatgccggtatgaaaaaaaatagtagaccttacaaatttcacagaatcataaaaaatcacagatcatacacgatacattcaaagacacaggtacacatccacatggacaatgcattaaccatcaatacatatatctcccaaaatccctcgcaaagttcagtttgaaacattcacattcaacacacaaatatatatctctactattataaaaattgaagatgtttttatcagtactttggtacgtcatccgtatttgagttggttttaaagttcatttcatttggaaatacaaatccgtttttgagttgtttgtttaagttcattcgttttacaaatacgggagacatataagaaatatcttttaagaaactatgcatgctacctttagatgatcggactccgatcctaattgcagctcatgcgaattcccacagtgaattttaccttagttaaaccgtacaacaataataaaattaaaatagtcttcactcattacaatgaacggatattttttcctaatacatgcatatatgtatgtatacatacaaatatagggacataataaagcgcacatacggtgcacaataactaaaatgctcccctcacctactctccccacccaccaaaaccccccacccccaccccaaaaacaaaaaacccacacccctccccaatccaattttttccgtctgcactccgttccccatttcttttttttttgtttttttccttctgtttacttcattggcccatgggtaaaaagattactagctctactatcaacctacgagtaaaagtattactgagagaaagaaaggccattagtaaacccatgtacttatattattgagatctgctatacgtccgaccaagttatacgactagcgtacaactaaaacagcgaacggtgacggcgtgaagtgatgctgtagattggacctgtgccacaagcccatacactctcatatcatatacataggcccatgtacaagtctaaacccacaatatcatgtcaacatggccgcatgatgcttctgccgaagctttaggtcaatctgaaatgctgaatccactcactgtcaacttgatctcaacattctagtattattttcagtgtagcagatgttaccaagaccagttcatacaactaggtaaagcaagttattttttttattcttttatatagtgtaaccaccaagatcagtttttataactagcttatcattattgattgcgcttatgtcaacaattaagctatgcatgattaactgagggccataagcatttgaatagcatgtgaaaacccacttatactgtcacagccgtaacatacaaacaaatcgtcttaacggacttgtacaatgtaatgatatgaatagaagaaactaagaaaataattgaaaattagcacctgaagaagatccattaaaagctcatgtaagacggtgattccacgcacacgcgaatctgttagtagtatttgtttgttgctgattgcacgaacgcggtcagacatggtagttagccacgattgtgactggcttttggaaggcccaacgagaatgagattcggatcacagcccaaactggtcagctcgcagacgtcacatacgccgtcaccgtggtcgtacgagagttggacgctcgtgatcgtacttaaagcattttcctttttttcttttgggaatttgaatggtaaaaattgctctgaaaattggcacatgatggttctttttttgagcctcaaatgggagcatcgattttattcatctttagtaaaagatggagtatatatttacagctcttagttcgtttgggatggttgggaaccaaactcctccgcacggaaaacgaaacaatctattagcacgtgattaaataaatattagctattttttttcaaaaatggaacaatatgattttttaaacgactttcgtataaaaactttttacaaaatacgcaccaaaatagcagtttgaaaagcgtacgcgcggaaaacgataagggagagttgggaagcaaagtgttccctaaaaaactgatttgaagttggtgagagaacatgacaaacatacttcgacatgtgggactttgtctatagtctgtgtattacagctcatgtttttagttcatataatatcatgtatgccactatgattaggctcctttgacgcacgttgcagggacatgtgcctccaatgtgtgggaccgtgaaggtgagccccacatcttagggactcacgcccctatgtgtaagaggagctgatttcaagccattgatgaccgaattacaagcctcatctttttcttatgcctatgcttataagccagaatttaaatttttaaccttcaatttagagttgattttgggtttttttgataacatttattcagagccaagcaatacctaagttcatccaagcacgatagaccttccaatcaatacatctgaatatatgaaaggcacatagaggacggtacaatagatgccgaaacagctaaaatcggcacctatagtactttttccatccacacaggtacccgtgggggcgtcaaacgaaaaaaccacgtcaccttccaatggaaataggtgctgcttttttaaatagaaccaatacttatatttcctgtcagagataggtgccggttccatataaaatccaacacctttgacatgcatcccatcagaattgttggtcgtgaggcccaccctataaccggcacctttgaggctgtcatagaaaggtgtccattcttagctagaaccagcaactttgactctaccacctagctagtagccattgaagggcccacacttaaaaattggcacctatatttttgttagagatatgtgtcgattctagttaaaaaccggcacctactatcacaatatataccactttcctgtcccctcaagctgatcgagcgaagaacagagcggcacctcttgttcttgcttgaccagctataggaggagggaggttttgctctattttttttttgtcttgttggagcttgaagcatacaaggttagttttcattattatttctcactccatttcactcttgcatgttgaattgaatcgtttgctacatacacatataaagtgcgcaaccgaaacaaattatttgtatttgttttgtaggggaaatatttttttatcatttttgtgttcatttaattatatcatcctcagatgagaccacatgctaattttgaattgaaatattgacatgagagtatgtatttgacaggactacacgacaaagtactccacctggttggagcgcaccccacatgggcctcacttgggtcggggttccagatgaagttacaagcaaataggcccatcataggtttcgcaacacattgtttctgtgattgtggatgactgagataaaatttggcgatgagactggattcgttggaaaaaggactgtgagagcttttcatcaagtacacatggaccaaaaacggagaaggtggacgaattggattccagcacttggaggacttgatcatgatgtcattttattgatccatgatatgaacaacaattatattcatagtagccatggtcacatcaacatcttattgttattacaagtgcggatatttttaacccatgatgaaaaaataaaggaaaacgtactccctccatccacaaaagttgcacatattacttttgacaccaagaccaaggagaaattaaatcaccttggatgttacaaaatcaataagtgaatccaagcatgcaaccaataagcatttagatgactccttgggttctaataaaacatttaatttatctcttcattaagtcttgaatgcataaagactacaaataggaacaacttatttggaaaaactcaaatatgtaatatgtgtaacttttgaggatggagggagtacgaattagccctccgaactatcgcggtcaaccaaattaccccctaaacccgaaaaccagacatcgttcacccagaacttttaataacggacaaattatccccctcaaaccaatccagaatggttttatcctacgtggcgtacacatggcagaccagtcactcttcccctctctctcttctctctcgcgggtcggcggcaggctagggacacggagcggtggtagcgggtgacgcagaggcggcaaggaacgaggaggtggcggcggctatggccgcggccacgacgagcagccgccccctcggcatggggatggatggcggcgggggcgggcggagggcggacgtggacggcggacacggagaccctcctgcaccggagggagttcgccggagctccttcctggagttcgccgctccctcctctctgtcccgcactgtcgccgcctccacgttctgcatcgccgcttcttcctcgtccccggccgccgccgcctccatccggacacgcaggggcggtcggcccgggaatgggcggggttgcggcggcgcactgggggtgggcggtcagcgcggggacggacggtgggcggcgacacgcacggcgcgcccttgcctcgcccgctagggcaaccgccgccgtgtgccgacctcccccattccctcgccttttcaccgtgcccctggctcgcctgccatgggcggcgtcatgcgccaacctcctccattccctttacctgtcgggttgacggcggtcacggtgctcgcctgcccatccacaggcgcttgcacccaccggccatctcgattcaaagtggtcctccgattaacgtgatacggggcgcgctctggcctcccccgctattgaatatcgaatgcgtatcgatctggactgtggcatccttngtcgtgaatgaatcaagggtctcgcccccc

SEQ ID NO: 69986 - DNA, 17836 bp, Oryza sativa
  unsure (1)..(17836): unsure at all n locations
agcattggggggttagaagtttatgcgattaaganataaaggnaacttccccttccccatcgacctcccccatcccctccacctccccgggcgcgtttgcccgcccgtccatgagcaccaccacacgctcactgcccgtccccgcgcctcaattaagagagagagaaagagaagaagaggggaagatgataggtgggtcccatcttttttttaaaaaaaaaaaggtgctgactggattgccacgcatacgccacgtaggacaaaccgctatagattgagtcgaggggggtaattcgtctactattaaaagttgaaggtgaataatgcatgtctggttttcgggttaaggggggtaattcgatcgaccgcgatagctaggggggtaatttgtactttttccaaaaataaaatccagttgttgaaaaaaaaaggttttatattgtgaaatttgcaagatttggaagggttatttctgtcgaaagacaaataggccgacctaaacataactgtcgtgattacggaagtgctaatgggcgatcgatcgcccggcgacaagggtagcgatcgatcccccttcccccctccctccacctggtttcctttttggcaccgcattactttcctattttagtaaatttatgtacctaaagtttatacacctcaagtttacacatctaaagtttatacacctcaagtttacacatctaaagtttagagaccaaaagtttataagtcaaaagtttatatatccgattcaaatttgaatttgaattcaaatattttttatatatagtatttctatacatctaaagtttatagagctgaagtttatagacccaaagtttataagtcaaaagtttacatacccgattcaaatttgaatttgaattatgtcgggaatcaaatttgaatttgaattcaaatattttctatatatagtatttttatgcatctaaagtttatacaactaaagtttatagacccaaagtttataagtcaaaagtttacatacccgattcaaatttgaatttgaattatatccgttcaaatttgaatctgaattcaaatattttctatatatagtatttctatacatctaaagtttatacacctaaagtttataaacccaaagtttataagtcaaaagtttacatacccgattcaaatttgaatttatattcaaatattaatttatagacccaaagtttataggtcaaaagtttacatacccgtttcaaatttgaatttgaattcaaatattagtttatagacccaaagtttataagtaaaaagtttacatacccatttcaaatttaaattttaattcaaatttatatggtgtagcagtaagagaagaaggggaggtaaagtagtaaaggggaggtgcgggtgatcgcttggaaggggagggagcgatcacccgtccgttaggagtaccctgcagactagttcaggataaaatagtgcaggaggaaagcaaagataaaaaagacgggggaaatactacgcaaggaagataatcaagaagtcgtgggctcgtggctatatccttgccgtttacgtgaaatcaacaaggccaaacggcagagaatacgtatcgatcggggtggtgaaaaacccaacctcccccgccgtacgccctcccgaactgatcgacgccggcgccgccaaatcttttcactcctcgagtgctcgatccgccgtgatcatccccgcaattcgcctccgtgctccgcgcctccgccccgctgtccgctataggtaagccgccatctgtaaagtctcattggaagcttatacgtaattcacaaaggtatacacgttattcggtatcttcattcgtttttctccttttattttcttaataatgaataataaatccagccctacatggagatgaatgtacatgggctccttttattttcttaataatgaataatcaatccagccctacatgtctacatgtgagatgaatgtacatgggcacacatggccaatcatcatttgttggaatcgtatgctttgagtttcagaattagtgctatgttttactagaacatgcatctcatcagctgcaaatataatgcttctcgtgagggggagaaacgtttaagcttggtggctcggttcaaaattaattgctcccatgacttggttgctccgactgatctagttttctttttaaataaaaattatttaattgtgaatgaaagtcgttttcacctaggctatgctcgttagtttgttagcaaaaataatctggaatgatataaaaaataagcaaatcataaaaaagttaaatctgatgaaagctcgacaaagacctgatcaagctttttttttccccacaatgttgctactgaagactaattttctatttattcagttttaactgaacttatattgcattcatggttcaaatatcttacaattctggttgaattatacgtcttctagtccagatggttactactttatctttcgtgtcgttttggttcaagaaaagttgttctgcatgtactttattgagggggtacgttttttttcagtactaactagacaaaattgctttgtttatatatactccagcacaggaaaaagtgtcacgaactgttgatagctgatgcatggcaagttcaactccacaatggcaaacgatacgaacaacacctcctcctctgtcattgctactgaaaccacgagcgcgtcacatgtaatcaagattgatggatacacagtaactaaggatctgatggagaatggcgaatttgtgtcatctatcccgttcagtgttggggacttcctctggaacgtcagatactaccccaatggcaactgctcaaagaacgcagactacctgtcgttttctgtgtttcttgagtctcactgggccgaggacgtgaaggcaaagttcagcttcaaactgctggacacgaataataaaccggtgcgatcgcgcaacttcatctccaatacgcacaatttcagcagaagaggttcaaactggggctactccaggttcatcaagaaaagggatttggaacaatcggagcatctaatagacgattcatttactatcaggtgtgatcttactgtcatgaagggcttctctagcaaaggaagccactgtaagccgtctgtggaagttcctgcaggccgtctggacctgcatttgggcaacctcctgagtaataagaagatgaatggaaaagacgtcacgatctacgttggtaaggagagattcagagcacacaaatgcatactcgccgctcgttcgtctgtcttcagggcgttgttcttcggtgccatgattgcggaaacccctaggaccattgaaatcgaagatatggaagctggtgtgttcagattattgctacatttcatgtacaatgactcgctgccagagacgtggtctcaagatgcaatgatggctcagcacctgcttgtcgctgcggattggtacaatgttgggaggctgaagctgatatgcgaggagaagctagcaaagcacattgactgcaacatggtggcgaccactttggctctagctgagcagcatagctgccaaggactcaaggaagcttgcctcgaattccttgcttcaaccaaccaatcttgagaggatgatgagaactgatggttataagcatctgaaaatcagttgcccaattgttctcaatgaactcattgcgagattgctgcctcctaacttgaaagcagcaagacagatagctatggatcttcggtagtgttggtgaacttttattattattatagtagtttgccttgctattattattattattattattatagtttcatcggtaaagataccttgccttgaatgtttagggagaacagaagtaaagttagaatttatctgatgttgcatataacgtcacaaaaaatagttctaacggcaatccacgtcaggattaattttcctgactgataagccagtcctaatggagtaatggtaccccattaggaagcattttcctttaggcaattttacggttcttaaagaggtatcatgaggtaccaaattttacactaatatttggtacctctcatggtacctcatagtacctagctattaagaggtatcaaatttacaataaaaaaattagtacctcatggtacctcctcaagtaccataaaattgtttttttcctttatgtgaatagtgtttttcctaacggtttgtggctatcaggagtaatccggtttgtagtagcaaggccagatgcattggatttgatatgcaactcgtcagttttatttttatacatgcaatttatcaggggcagagctagtggataatagggggtgttcaggaacccggtcaagaaaattttttagctatacctcatctattttcaccatgtatgcaccccttcaatacaaacttaagcaccagcattaacttaaactcgatttaaagtagagtaaattaagcaagtggcatcaccctccatttcgctctagctccgccactgcaatttatattttatatgcaatctttacctacttaaaaaattgatgttgcttaggttcctgtctgtcatatctgcccgactgtgattcgtgcgttcagttcgtaggcagagcctgtctctgaaattgcccgggtacgtatgggacagaacgcaatgggcaagcgtgtgcgttcttgaaaatgcgatgggcttcggttatgattgatcatttccacccagagcagcgtggttccgatccagcatctatcttatgcaccccacgggcatggccgcccaccaggatttcaaattttgaaattagattttctgtcgcgggttgggggggggaggggggaggggcgaaattttgactggttttaaataaaatttgaccaaattcataaaaatcaaaagtttcggacgagatgtgagcattttggttgggggaggtgggtgaaattaccgaaatttcaaaaatttcagaaatttcgaaccgaaatttcaaaccctgccgcccaacaacaaactcaatgcgcggtatccccttgctgtcggggcgtgggctcaacgcaaccagtggcgggagggatagccggaagcatggcgaggagtggctgcgccatggcgacaagccggcgtgcccgttgtgctgtcgatgttctaggtcatcatcgaacatcgggcggtctagctgggtgatgtttccaggtagccttagttcatggcagtggtggctatcatggcggacaccagcgtcaacacattatgcacatcattttcttcccaaaacaccaaaatgggatccccacatctagggacacgtgatgctcactctttcctgtgtcgtttctaactttccatgccgaagttatatatcaatcccattcacaacgtcgttatagttgtagatctagaacttgctttctgaccaactcaaatctttcttatctgagtacgccatccaaattcgtttaatattcggctcgtttactgtttctttgtgttttgtttccttgtagggtatgctagatcttcatcggatgtagacctacactaaaaaaacggaatgtccttggcggccaaaaaccgccaaggatagcatataaaccgcctaggataattattccgtcggccgaccaccaagaaactaccaccaagtctagagtgccaaggatatttaaatttattggcggctaaccgtaagtaaaaatattcatggcggtcaaaccaccaagcaaattaagaagattgccatctttcgaaagcgtcaggaaaaatagccttgtcggttttccaccgccaagaataactttaacttggtggctgcgaaaccgttaagaatactaactgaaacgtcccgcctctcttacatctagcagcttttctaggacatagactgccctcacaaaccaacacaagtattttctacacaatatgtcctcactcgcttaacctcagagttctttggagatcaacttcatcttgttacaaatacctgaaaccaaaaataattattttttctttcacaagctctagccaaatttttttttattagtacaaggctatgaatgcacggagcaacaggctaaggtcttccatgccgctggccagctgcggcatggcctccagcttctcctcctcaggctcctccatggcgtcctcctcctcctctgcgcggttcagccgctcgagtagcatccacctcctcctgtggcgcccatcgggacggcgagccgggcccgaaccggtggcaccatgttggcgcggacggcacgaaggcggtgccccttcaccgtgatggtgtcgcggtgggcggtaatcctggcctcgatggagcggatcctcgcaacggcggcggcgacggcgtgctcctgcacaaggtgccggaactggatctcctggcgcgcgtaggcggctagcgtggggctccccaaccagagaagctcctccacggtgtcgagcgcccgcgggacgacggaggttgtggggggggggggggcgacagcggaagaggtcgatgttgttgaactcgtcgatttggtcgaagcacgcctcctcaacaattccggtggtgtggggattggaggagaagaggatggagtggggaagaaaggggacgagaggatggagtggggaggcagttgccattggatgaggagggaatggacggttgggattgagatcacgggaggaggcgcggattgatgacatggcatgagggcagatcagtgatttggcaggatagcgggaattttcgtggtctgagaggcggccaactcaaatttttgacctgcaggtgcgcgaccctggtaatagggagttggaatttatattgacagttttgcttgtaaccgccaagcaaaatacatatttctttgtctgctatggaatagccgccaataaaatttctttatgcttggtggcaagtttgaaccgccaaattaaagtgtaatcttggcggctgatttcagaccgccaaaaaaatcgcatggccgctaggggcattcctttcttgtagtgctgcggcatgaccagatgagccgggcagtcttattcttattgtgtgtggggcatgttagatccgatcaaggccctattatgcatgaatggcgtaacgagtacgccctaggatggtgaccacgcaaatgccatatatattaccaccgtcacccttggtcgtcctacatggctgcatgtatagctatcaccatcatgggtagcagtgatagccgatgctgatcaagtgaaagaacaatctaaagaaacatgtgcatgcttgagatcgcacttcccacgatgcaaatatgcacaatccggtgaatccatcaatagtaataaggaatctgatcaacaagattgctcgagtggtggggagaagagaggagaggccagggctggctcaacattttcgagggctctaggcgaacttcacactataggcccttaagaattaaggctatttcttttaacttataatatatactctataaagcacctatactatagtgatataaataaacatttctaacatggtaaataataaatcaagcagtttgcaaattgcaatatagtaatttgttctcgataaataatatcgatagtatgattgacaacttaaaacactacaccggattaggttacctctgatggctccaaaccaacactacaccggattaggttacctctgatggctccaaaccctcaccattgacaggtttgggcttggtaacagattagtggtcactagtgaggaccagtcacctttgacggaggaccgtcactggtaacagtcacctctgacggacaagaactctatggcccgttaaaggtaagtgtctccgctaacccatggcatgttacaacccgtcataggtaactcatttgtgacgggtcggagagtaaaaaccgtcacaggtgactttcttgtgacggcatgtatgtgcagagccgtcacaggtgacatcacaagtgacggcttttgcaatatcaaccgtcggtgatgagcaacatgtagaaaaaagtttctaaagattggctagcctcccatgccctctaaaagaatagaatagtcacatgcattcaaactaacatcacacatgcattccaagttgtcaccgaaaatcaacaagaagttaatagatcaaatgttcatcaaactagaagtataagcgcggcgtgacctgcaatcagaaggatgattaacagcttaagcaaagcaattgttaaacatttgtagcttctttttttcaaccaattcccattctccagacaaacaagaattaggaccatgtctcttacattcgtactgccaaaattgctcatagaaaaagaaattacaaattcaaaaattagaaagtaatgatgccatatcagaaaagagctcttttgagttttcaaatatagagacatgctaccaggccaacatcatcaagttcgagaattaatataaaactcaaagaacacaatggcttgcacttagaaaagcagagtcattcaattatctgctatgtcagcaactccatagtctatggagcacctatttacctgcaagcaaaaagatggcactgaattagtttgatatgagaacaatttgcagaattaaataagatgaataactaaagataagcaaaggagaataggagtggaagatattagctaggtaatccatagtacgtgcaacctatggaacaatagagatcatgtattctatctgagacaacagagatatatttttcaacaactcttccaggacctatgcacatataatgagatacacggcacaaaacaatttatgatcgtcaatctactaaattcaagaaggcatgtggataagcaaaaggattgcagcaaacttgtacaccaccttatgggagaagaggatcttgcagcaaaattgattttctgtaattcctgcagccatctcatgggagaggatcttgaatctctgaatctcaaagagctgcagcaactggagaagcagctgaaaaatacatcgaaacatatcagatccagaaaggtactatttgtcatgagaacctgaatagaatagtcaaatcagttctgcaagaacattttagatcatgcacataggtttgctgtatttgacaaacagattcagatatatcacttcagcgcaataggaatctacacatcattcagaggatcagagtatgacaaactgactagcagcttatttaatgctcaactcaactaaaatagaagcagcaaccttatttaagcgtggatacattcctacagacaacaaatttagccatgcaaagaaagaaaaaagaggataacacagaagctcacctccaaagatgtctagctaatgtagccggtaggtggtgactgcacaggatgaggagaagcacatgctcgccgtacagccgataggccttgacggcggacggcagcgcacacagccgattggaggagagaggagacgccatccactcaccatgagcctggatctggcgctgttggcgccgaaggccactggatctggagtacccaaactcgggacagctagatccacagccccccgagctcgggttgtccaaacttggagccctagccggcttgtggtcaccggcgttgcacctccacaccgttcgccatgaccgtgcctctcctcctgctcctgttagatctggtggaggggagggcgccgccgccgttgggccgccgcacgctcccctctgtccctgccaggccgccgctgcacacagagagaaagggagagagagagaagtggagaaatcgaaagaaatggagagagagagagaagtcggccttatctcctccgggagtgggcaccgccggaagaagaaatatctccttcggtttgggtatatagtggcacaactcaccggacgggttagtgcttaaatccgtttgaggtgagtaacctcacttctgatgggtcatccggttacgacccgtcacaggtaactagtcacctgtgacgggctggaagtagaacccgttacaaagtactatgacctaaaatcagtgagggaaaaatctatataatcaagggcctaggcctaatgaaaactaatccaccatataccttaatttaattaacttatggacttatggtgcactaaatggttgtatacttgtattgattcctttaacggttgaacccaaaacggtagcaccctaagtctctaatcaaggtaatttaatggggaacaaaaataaattagaagaacagatcaattctaatcagtgagaaggatcgatggattggatcatcaattctaatcagtgagaaggatcaattctaagctattgggctaaatacctatacaggatatatacctggatcggggctccgattttggctgggccctaggccatcgcccttatggccctgctccaaagccggccctgggagaggcggagagggagataaaggagttgacgagaagaatcggggagatattttcttttcctcccatccatgcttggctcagctcaatatgtgatggttctttaaaacaatctgacacagatatttataggtgccaatttttttataagatgctcaagatgaatgcgaaatatcttatatgtgtcatttagagcaactggcgcatataaaggtgtctgttgatgaaaaaaacacatactggtctaagagatttgctttactctaatgcaggtccaaatcttaattactttcgggttgagagcgtgccaactggtttaattctacagccagcaagaaaaacaagaagcaaagttagatgaacaatagtcgatcggctagtaagccgatgtcgtatcgtcaagaattaagccaatgcaatcagatcgaatcagctcttgtatgatggattaaaaagagcaaaaccctaaatatgattcattggctataatattaatcatgtagtttaatcaatattggaaaaatcaaccgatgacccaatatttagagcaatgtattactctaatacaaacttatataaaagtgttgatcaaatcaaatgcaccaaatatgccccaatcctcagatatgatgatctgagctagattgaatcatgcttgatatatttaaaaagacaattctcttatataagtggtagatacaattatcaaacaagttaaaagataaattcaactgtatcaggtaagatcggttgaaactccgatgctatccttatttttaatcaattccagattagtttttagagttctagacaagagtagggttgatgcaactcaaagtatgtaaagaaaccttgattgagctacgattgggttctcattctcccacgtgtcgctctagcacatgctgtatggatgcatgctatggcggcattctggcgatttgtacccgaagactaattaaaattgcatccaaaaaacaaattagatttggattatgagtacagagtcgcgaagcataattttgcattcgattaaggattccaatttttaaaatatcagtaaaggaccttcggtccatagattctaccgacccgcctagcaatcaagctcttgctgctctgcgagactgggttttttggaaagttggaacgacatacaaatgttgttaaatgccgcacactggtaaaaccctccaagcttacttccccctaccaatctgaatgtaaaagaagaactaaatactactatccatgagatcatcataacaaaaactagaattgcccagctaaataggaatagaaataaatccagggtaagaaagaccctttctctaaaccctaaagctttgcagaagtacgaatttgaaaaggaataggtcttgcttggaagaaaagggaatttggttgttgcaaagcaaggggaaaactcatcctcaagtaaggcaatagttgcttgcacagaaacagaaccatggggaaagtgatctctgaccgcgtgcctgttgaagaatgagctagggtcaaacctatccttggtttaggcaatgccaacctttcctttcgaacaacggtacttactgcccgtaaaacagatcggcacctatcctcggtctcggctatctttacgccttagaattcattcataaaatgacaatgaacagtctttatggctgttttgctatatcgcctgaaagcactatgaccgtcggtgaaaaagaatcaaagagaatggtccatgaattggtggcaagagagcgagttcgactcgcgaacgacccgcaagtgaaggaccgatcctttaacgccagtagtgttgcgagactggtacttgggggctcacgagcaacatatagactaaggttacccatcactccctcgctcctttttgaaggcccactgctccccctttctttaagcatctatcccggcttgcattttgggggcgagtactacaattcctccataatcacacagaacgcccagcttcgcgggctttgcctgccgacgttctaataaagaattctggctcggcccaggaaagtgctggcaacaacataaagaaaggcaatgagcaaaaatgtcactcaccggcctaaacgacgagcaaacactcgaacgtgagagcaagggatcacccaatgaatgggcgacccccaaggaagggggagagagggaggcaagaaccatgctttcagagaagtggcggtccgaatccactctgtcaaaaaaaaatagcagactaagccgtgccgagatttttacccttctctaaaaagaagtgtctctatttagagatttctctacttagatgaataaatcatactctagatatattattaacgaatatgtatcccaatccatctcgagtaatttgagaatatgcatttcgaaatgaaaagctatccccagaaaacaaagaaaacgaataggggcgtagcgaaggcacgtgacgaggcacctcgagggcaattagcagatagaatatctcctcctttgctgtatctccccagcaaaacacgtgcacaaagtaaacaatccagcaactgactaattttcagaatggtagataccttagctaatctaatctagcaagataatttaacagataccagttgtcgacgggcaataccgtgactacggtattttgcatagtatggggatcattggtaccaggatatatgcgagattgaagtaaaagagatggagacaaggttttttatacaggtttgagccctttacctgacagataatatccctactcctattgtctgaagcatgtgttgctctttattcatcataaccacaccagtacaatgtttgggataacctatctaaccgttatcgacttggcggcctagaatacaaacacgtagtcagcaacagggtagtttttctcctcgaatccgtacttagcgagatcagagatagcgctagatccttcttgccggcctccacagacactatctagggcttgtctaggcttactctgacatcgatatttggcggcttgttttggcgtgtgttggcttgtattggtctatgtatgttgtgccttcgtgtgtcctctccccctcctcctagggggtctatttatacgcataggtgtccacttaaccaagtagaactagggagaccaatatagatacaatccgagtagtccatatagtttccatattgaactctattcatccttccttatccggaactccttgtatattcgaggtatgattccgtataagattttgtcaaggttatggataccacatacctaatagtagttgactaaatctcggcaagacccaccacataccatgtcttatacgggaactgacttcagatatggagggagttccggataaggaaagacgaccagagttctacatggaaatgacaaggactactcggattgtatccatattggtttccctagttctacttggacaaggggacacctatgggtataaatacaaggccccctaggaggagaggagggacaatcaacacccaccatagagaatacaaaacaatagatcaacacagaagatcaacataccagccaacatacgccaagacaagacgtcggatatcgacttcagagataggcacagctagtcccctacggtgtctccggatactaggagagacattgcgctgtctttgatctcgccgggcacgaactcgaggaggaaggctaccctgttgtcgactacgagtcagaccttcagaccgctatgtcgacaacagttagataggctaccccaaatattgtactggtgtgattattgtgaataagagcaataccggcttcggccaacaggatgtagggttattacctgacaatgcaggggcctgaacctatataaaaaccctcgtctccgtctcttttacctcagtctcgcgtataccctagcaccgacgatccccatactatgcaaataccggaaccgcgacatcaaacgtcgacagatttggtatatggtgggccctaccgagcttagtaaactactattaggtatatgatatccataaccatgacaccagtataaacctgttaacaaccaaatttggcagtatcaacatcggagatggagattagatcgaggtggaatcgaagacgaagatcgatttgggaacagagtaagagtcggctggagtccaaatcggctacgattaggatcggctgagtccgagtcaggctgggtaagccgatacagccgattccggcaagatgacttggtgtacgacatcaggttgacttgatatgcttcaagatgattgccatgcatggatagagtcctgagaaggcaattatatctattaattaggatattttatgtaattttcttagagatatgtttgggcaaaagtctaccataaagacttatggtatcttagagtttgttagagataagaatcgtgtccgatatggacatagtttgtaattatcgggtacaaatagaccccgaaccccatgtaatcaattaacacacacgttcgatacaatctcggtgcatcgccacccttcttgctttagttttatttcgacaagttcttgtttttgggttgagctgcatcggtttcgatcttcaacaagaggtaaaacttgttatgacggcatgtgttctcgggattagttcttccatcttatgatactctaatcttgtttatgtaaatccaccgagttatcatatatgttccataatctctagcaatatcgctatttaacctacaatcgactaacatctgtcagtagagggcagccaattaggttaaatatcgatgttgatttagattatataagatatccaccactctatgaaacttccggcggcttgattatctagatattgttcttcttttcatacttaatgccgcattagttgagtttgatctattaagtcgtgcttggaatatcaatctctaacctgccttctggttgccgattagggtagtatcgggatttcagctgatcttatctgatttaactacatttgctctatatgttttattgacatgttaaatctgccctttatgtcaagatcttattgcatctaagtatattaagcttctgtttggtacattctgtttgttttaatatcttaacatagagtcgtattggagtattagccgatacatgctagatctatctgatcggctatgctatgaacatatatagtcttgttgttaatatatatttcgatctaagtgatttatactgtctcggcacggtgaccgatctatcccaatcacttgatttaagtatatatcgacaccaggattatatattgttaatatctacagccgatcgagtagatttagttctttattatctatttataattgccgatcgatttacatatgacatcggctcaaagataaatgatacgtcatcggcacctagccgatcggctatcatttatggatttaactacggtttttttgtctttatttcttgttgattacaggaccaaatcaactggcacgctagcatacccaaaggcgagttttggacctgcactggagttaagaagatctcctaggcctcgtgtttttcatcaacacgcttttggcacgcctggtgtgacctgataagaagtcagcatcgcagcagcggtttttctccatggaggaaaagccactagcatcaccatcctcggctagcccaggttctgttaaagagaagatctagcagttgggcctatccgaggttaatgaaggcaacattgtgaccatcactccagacaagctgcacctgatcaaaagaaggattttgaagtgatgatgcagcaagcacggaaccagtttttaagctcatttatgcaaactcgcaagggaatagtggtgcagaagtataaggtaaaggttgtcgctgatgttcctgggactggttcttctaaggatggagaggtgaaacaagctctagatggctcggctcaaccgagtgataaaggtgctacaaatggttctcaaggaaatcaaggtgacaactctcaaggagtacagggagttcaaggtgatggtgctcagggagttcaaggtggaggtgttaatcaagacagcaatacaacacagttgcagttcaacaacttccaagatcaggttgactatgctgtacaccatgctttgatcaatcaatctggaatattaaccaatactttggcaaacatggtgaaatcaatggttgatggttcaatggctgagtataaagctacaggaccagtttatatactaggaggagtgttcccaaattataggccattaatcactgacaatcaaccagttgtccagtcaatccctctcaatgcaccatcggctcagccgacggcaccaataccggctcatgcacctgctgcaccgtcatcggcgccaggccaattagttaatcctcggttgctggtgagagaacaaccacagcacagcggacagaatgtgaatcggctaacgcaagaccaggttgcgtctacgttcttatctccccaacacactgctgatccaacccagcagtagctgattcagcaaacgccaccaaggcagcaggttgtgcagccgacccaaaaaacacccccaatccaacaggtcgtacaaccagttcagcagacgcttcagagatggtaggttttgcagccaattcaatagacgccattaaggcaacaggttgttcagtcgattcagcagcaaggcttaatgaatgcatcagctgggtttgcgacacctgatggtcagcttgtgcagcatgctgcaaatcaggtcgtcccagagcacttggttcatcacgtgcaaccggatggcacggtgatacctcaatacctcaggttattcctgagcatttggtgcgcaatattcagccggaccttcagaattaccaggggggcaatttgagttatcagtatcagccgccatccccgcaagttcaataccagtaggcaggatcggctcaaccccagtttgttcctcaatacaatcaattcgagcccatgacacagcaacctcaaggaacacctcagcaacgaccatggaccgatatgattgcggatgtcatgaaggagcagtttgggcttaggccgaaagatgctggaaatttgtatcgacaaccttaccctgaatggtttgagagtgttcctctacctaatcggttcaaagttccagatttttcaaaattctcaagacaagatagtacttcaacatacaaacttgttagccgattcttagctcagtgtggtgaagcatcggctgtggatgccttgagggttaggttgttccggttgtctttgtctggatcagctttcacttggttttcttctttgccatatgggtcgattaacagttgggccggttgggagaaacattttcacagatatttctatagtggggtactttaaaaacgtcgagcctggtaaaccccaggcgatcccaaacttaatcaccttgtggaacatccccctttcgctatagggcgtg

SEQ ID NO: 69987 - DNA, 35834 bp, Oryza sativa
  unsure (1)..(35834): unsure at all n locations
ggaggatgantttcgataactgatgtaactattccatcagcccacagctgaccantggtctgcatttttgctagtggctgccttaaatgggctgcttgttctaacacatctacagtggaagttgtttcatttttgcagcaaatgaaaaaaaaggggtggcgctagcctaaaccatttttgaagtagtgaacgtgcaaaacttgtgcagaaattaaagaaacgtattatgtgattgttcttaacagaagagtttaattattgtcaccattcaagggagtaaatacaaggtttgtctaggagattgtctatctgtgtgaaatcatgaaagagtgagtgctattcttctgtcagtatcttgaaccactatctttgatcatggaccagcttagtacaatgttctactgggctgaaggtaaggggatcctgctgatgaggtgagatgtcctagtaaaaaattgagaagttgtgatggaggccttcaatgacatgaaaagtgatgccaaggtaatgtttccatcgatgaaagagtgttgtggacttagtgaatgcattacatgtgtcacgtatagttctcttgtatgttgtatggaacccgtatgttggaaggtaagggatctgccgagcttatagaattggtcaagacaagattgtgtacacatacaatctaatcatagaaggaagaaaggagagaaacaaatacgacagacaagccaagaaggatcatatgtatcaagcttgttacaaagaagtgatgttcaatgacaagatagaagcaatggcatcacataggagctcaaaggcatgtttgtgttgattcttcattttcaatgcctgtaaacttagagctaaatcttataatttgattattatcagattaaaatgtcatttcgattcatctgcaacaaaaatgtttgtaatcttttcatgttgtttgtagaagtagacatgacattttctaagattcatcaatatctaaactatttgcttctctagaagagaagcacctggagcccagctaaacagtttcagctccacctaaaataggagcggagttgggtggaacactctcacaaaataaactaaaaatgtggagcatgagttcagcctactccactatagacctaatggaacaataaatttagaagttgaagctttaataaatagccccttgctattcatacttaaacatttaaaaaaatctttaaattgggtatatactcaatctgaatgttggtgccccagttaattttactctttgtgtgtgtgtgagtgtgtgtttgtgtgtgtgtgtccgtgtgtgtgtgtgggtcatctttgatgggccaaaaatatcatgttcaaaatatggttactggggaggacccatcacacatatgaggtcatctatgacgtgtcgtagttgtaacccgtcatagatgatttgtgatgggtgacaaccatggctcgtcatggatgacatgcatccctgacaagtgtaatatcatggactatcatagatgagaccacttatgtatgacgggtctttaactgacacacgtcatagataaagttatctctgaatggatgctagctttacgacccactaatgatgagtgaaaatttaaaagtttcgaattttgcaaaagaaaaactcagattgagacatgccctatataaagttgtagttctcaatgatatctacaactttataactaacaatattttcattacagatcgtttacatcctcgggtaagaattacaagtgatgagatctacttttaaaaacaaaattttgagttttttcaaatgacctggatggaaacatgccccatatgaaagtcatagagcttaaacagatctacaatattataattgacaatattttcatttgaaatagttttgcatacctgaatatccattataaggtgtgatctattttgaaaaatgaaaaattttatttttcttcaaatgacatcggatgaagatattctccatgtaaaagttatagaacacgatgagatctataactgcttagttgataatgttttcatttgatgtcattttgagtattaaataaatgttaaattattcgaacattaaatatctgttaaattattcgaacatttatagaaaaaataataacaatgaatgagtactcaacatgtgatgagtaggtgagttggtaagggggttctttgtggatgtggatgtcttgagtttgaaactcactatacacatgcatgtctatattgtgcggaaaattgtggatttgtaggtagtgatgtgtgaccatgtataggatggctagtaaaataaaaaaatattttttttgagtttttttgttgctttaaaagttcaaaaatcgtaattcttgctttgtcattagtgatggatcacaagttacaacccttcataaatgagtcatcagcgatggacggcaagttacgacatgccactaatgactcatctgtaacgagtgacaagttatgactcctcaaagatgacttacaaacctgtcagagatgagttgtctatgccaggtgttcacccgtcacatgtgagatttcgtcatcagtgaccacttatctctgacgagggctgaatccgttagagatgacggtttgggcctatcagtgttgacctcgtccggcgtagtgacaagcatgattaaagtttcttcattgattaaataagtctcaactaaataagtaacacttatatactttttctaataggacgaacagtgaaacatcatgttaaaattcaaaggtctcatccatttaaaaaattgaacggaatatgtgctgctggcattgacctagataaccgtgtacttcttcatgtgcagcagggtgaccgagtgtccggccatgagaaagacgacctgcagagctctggagtctggaggtctagctctttactgaacatgttgtccatagctcaaacgctgaaaatagcaagaggtagtactttactggaggtctagctctttactgaacatgttgtccatagctcaaacgctgaaaacagcaaggggtagtacattactatcaattttcagtaaactgattactgaaagcatctcgaggtgcctctgctcatatttttttcgtttgacttactctcctacattcagatcggtctagcttaactcatcacgcctctactattaaacattgcaagaccttcagaatgctccatccatctccagaatcacatcctaccttcagaatgacagacaactgcaacactttctccaccattgtcgcggaggccgtgagcgggtcacatgtgatcaagatagctgggtactcaagaatcaaggtgttactccgcaacggtgagtccctgacatccatccctttcagcgttgcaggccacagctggaccatcagattctaccccaacggtgattccgcggagagccaagattacctatcgttctatctgatccttgactccgccaattcctacgacgtgaaggtgattttcagcttcgagttgcttggcaagaatgggagatcagtgtcgtcttacagcttcactacagatctccgcaccttctcctacaaaggctcattgtggggatacaacaagttcattcaccaaacggtattggaagaatcgtcagcccatttaagagacgattcgttttccatcaggtgtgacatcaaagtgttcaaggagatctacagccaagaaaccaagggtgttcatagcaagtttgtggaggttcctccaagcaacctgcatcaacatctaggcaacctcctagacagcatggatggatcagacgtggtcttcgaggtcggcgaggagagattctctgctcataggtgcgttcttgctgctcggtcatcggtcttcaaggccgagcttcttggcaccatgaaggagaaagccgatggagccattcaagtcgatgatatggagcctggagtgtttaagtctttgctgcatttcatttacaccgattccctggacacgatggctcaagaagatcagagcagagacgaagcaagcgaggaggaggatttggtgatggctcagcatctacttgtcgcagcggaccggtacaacgtcgagagactgaagctgatatgcgaggagaagctatgcgagagcattgactccagcatggtggcaaccagtttggcgttagctgagcagcacaattgcaatgggctcaaggaagcttgctttgagttccttgcatctccttccaacctactggagatgatggcaagcgatggttatgaccatcttaaaaccagctgccctgctgttctcaaggagctcactacaagatttctgcctccggaaacgaaagcatcagaagagataaccattggtctatataattagttcttcaagtatgcttattttgattgtgataatcgaaaagaaagttttttttagtgctaatgccgtggtatttctgcaccttagaaagctaccaagtttatctttcctggaagtaatggccttctatggatcaagtttttcagttgtttctgacattttttttccttggttttttctgaagtgcaaaatttgaccatgtatagttagtccctctatactgatatgctattactctatagcccttagaaattccatgcgtactatcatatctgaaaaataattaattgtgtgcatttcaatagtcctatttgtaagaatttctttgtttagtagatctaattccagaaactaacataccgtgaaaaactatatatattaatatcacagtgcttttacatgtatatttccaatacgatccatgagcacagaggaattttagagaaatattgtaggatcgaataacaagactaagccttccagagagaggtgaatggtcccaacaccaaaaaccgaaaacttttaactgaatgaaaagtcactctcgaactgatggagatcggtctgaccggagttgaggcgctggtctgaccgcacagatgcatccggtctgaccgctgtagccgctccgatctgaacgtccgtggcattgccgtcgtccattgctgctgaggtgacgccggtctaaccgctagtattcctctagtgtgacaaagttgaaagtagattgatttttattacttctatttgtgtttacaaagtgcaacaacaacactcctcgcacaaacccttctccatcggaaagatttatggaatggatcagtcatgggtcaggcttatccaaggtcactgccggacccaggggttccaggtgtgcaccggcatactcaaaacttccgaagtaattgtagacctccgtttttcaatagatggcactgttgactttttgtcgtacgtttgaccattcgttttattgaaaaaaaatgtgagttgttttatcactcaaactactttaagcatgatttataccgtatacatttgcataaaatttttaaataagacaaatggtcaaatatttgttcaaaagtcaacgacgttatctattaaaaaatggagggagtacgtatgagtagtttgtagcagtgggctgaatgatcaatgttcgcaacaaagacttcattgactttttaggccatgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccttagtccttctaggacaagacccattgcaggaaagacttcattgacaaaacctattccataatcctgggactaattttagtctctgtcacatcggatgtttggttactgattagaagtattaaacgttgactaataataaaactaattgcataaataagagctaattcgcgagacaatttttttaagcctaattaatctataattagcatgtgtttactgtaacatcacatatactaatcatggattaattaggctcaatatattcgtctcgcgaattagtttagggttatggaacgggttttatcattagtcaacgtttaatacttctaattagtgtcaaatatccgatatgacatgtagtcccttgatccaaacaggcacatagtccattcgctgatttctgaccatgattcccaaacggaggcacgccgtggctcaccgccaatcgggtccagcaaagtggcgatgtagctcaacaagtctttcacatttttacaaactttacttcctgttggggccaaggttatattcagtggcaaaaatgttcagtagtgacctggcagaggtctttcatatgccactctcatatcaagattgtcaggaattcctgaaaattagctcggaaatacaaggcacggtgttaagctccaatgcagataaccggagtactggacatatatatggggtcgacacatattttttttatgttttgaacttttttattttttaacttaaaaatagaccctgcaaaagttatttccatattatgatccttttggctacgtcattccatctgacgtggcaaaacattactgacacgccacgcatagcgggcaaaacaatactgacacgctacgcatagcgggcatgatagttctattttgccatgccagcgagggagacgtggccaaataacgctgccatgccaaccagatcggcgtgaaactgttgttttgtcacgttagtccagttcgcgtagccaaaaggttcgtatcttgaaaataagtgttgaaagggtttatttttaaaattaaaaattgaaaaagttcaaaagataaaaagaattcgtcgacgcacctactcaaagattgtgcaaattcttcttcgctggaatgcaacctccgacggggtcttttgatatggaagaaaaggtgtataataaaaataaaagttttttggctggttattgttcaatgatcagctaaatacaagagaaatgatggatctcgaacattgtgcatctctaaatgcaatactcacttgttctttgtgtgtcactgcatcaagagaaactagaacctagctgttctttgactgccctttcagcagggcctgctggagttggataggaatgcaatagtctctaaacttctataaaatcgttgttcttgtgagattgacactgttacagaaatgatttttctggatgcccgtcccggtagattccagacgggttgtaagtggcaccgtctggaaaaaccgggcgaccggtgccgggctgtcgcccgtacagaaaaatgcattatctcatgtggtcgacttaagaggaccacacggaaaaatcaattttcgcgtgcgagcctcttaagtgaaccgcacgggaaaatacatctccatcttttccctgtcacccacttcaaattttcacatcctctctcttccttttccctctcaccacttcaaatttttcacatcctctctctttcttttccctctcacccacttcaaaatttccacatcctctctcttccttttcccttttattctccctcactccctcctctctctctccttttcctatcctctccccctcccctctctctctctcctctctctctgcctctttcctctcgtcgaagacgaatccatccaaagctaagctagcctgcatgcacttggtcgatgaagtacggggcgtcgccaccaccaccgctgatggcgcgggaggaggcgcagtggctgctggcagaggcggcggagcggcggctgttggtggaggcggcgtggcggcgacggcggatggtcacggcagaggccgggagcggccgcggtgcaacgaccagcgacgacgaggacgacggtgaccacgagcggtagcgcgacgacgacgaccacgagcggcggcggcgcaccgacggtgacgacgacgggagtggcggcggtgcgacgacggcgacgacgaggacagcgacgatcgcgagcggcagtggcggcgggaggagcggtggctgcgcgaccacggcgacgacgacgggatttcttcgattttatttttctcggtttcttttatttccgtgcgggtggtataatttgtccgcacgggataatcgattatctcatgcggtcaacttaacacaaccgcaaccgcctggatgcgaaaatattgattttcgcagacacctgggtgcagacgggcaggacctctgtacgaaaaaatgcattttgaccacacggagaaatcgattctgtagtagtgtgacattcaggaggaacggatttatggaaatagcactactagctttgctggcatttcggaaacaaagaaatgctcttatctttcagcagattcagcctaatgttaacagatggtttgactgcttcagaaatgggattatcttgcttcaggatgaatgagcaactatacaatatagtgctgttacaatttctgaaattgttctgttttcctcttcctttttcttttgtacttaatgttttctttctttaatccgtaatatttaactactgggccttaccagtaatgttcccttcaaaaaagatcatacttcaaacaaagtgaaaaattatatttattagcaaccttttgaattaggactagttgtttagtagtcaatagaaagctcaaagtacgaatctactactaattacatgattccttatttttgatccaaatcacaataacttggaatttatgaagtaatgtatctggtatatgtacgataaatttttgaaaattaataacatcaataataacctgagggagtagtatttacctaatgtatagtttctatacgtgggaccaaatataataaatttatctattatcttctcttttttgtatttattgatttgcctgccgatttgtgtcatatacacttttttggggaaagtgtcatatacactattttgatcctagtacaattttacttgtttcttttttcagtacaatcttacttgtttcttttcttggtgtactcggtgtcttggtaaaacatagtttatatttttcagacctcactaattctcttgtaaaattgtctcgtgccatgtcatttggagtttttttactacctctcgttcttaaatctaatgatggctctttggccagcctccatatccatggtacgattggtcagccattctgaaacagggcaagcaaatcacaaggtttgtcttggagattgtccatctttggtgaagccatgaaagagcgagagcttgtgttcaatcaatgtcttgaaccactgtctttgattatgcaccagcttagcacaatattccattggactaaaggtaaagagatcctactgatgagtggaaatgtcctaggaaaattttgagaaactgtgattgaggccttcaatgacatgaaaagcaatgccaatgtaatgcttgcatcaaccgcggagtgctataaaggtattacacttgttggggcatcgcatgtagttctccttgatgttgtatggaacccttatgttcgaaggtaggtaagcaaccaagcttatagaattggtcaagagaagattgtgtacacatacattctaatcgcagaaggaacctagtagaaagacaaataagacaaacaagcaaggaaggatcatatgtccaaactattgttttcgaaagaaccacatcaataccaaagcctgcaggatttcaacttgtcaaaaaaagtgatatccaatgataagatattggaagcaatgacatcacaaggggagctcaaagacatgtttgtaaagattattcactcattgcctgcaaacttagagctaaatctagtaatttgatatttggaggttgaaatgtaatttgatcttttgagattaaaatgccagttcggttcatttgagaataaatatttatattttttttattatgttgtctgcagaagtagacatgatattttctaagattcatcaatatatgaactcttggcttctccggaagaaaatatccagaatgtggagtatgataagctcaggatgttgatctggttaaattattcattgtcaggctatgtgttgattgcttcaatattaaaactaggactatttgctcccgtgtaatataatgatttgctctctttcgaaaactgttgcaatggaaacatgaagtttccatatcgttggtaactggtaagtatatggaatggcactatagcacatccatataagtgcttccaacactagttgctcagcatctacatcctttaattatctcaaaatttatgaaagcagctacttatgtgtttcttatttagagatgcaacagagcatcttatctgtggagaagaaaatatatgtgtgcacctccattctatcaagatggtgcttcatcgaaatttctttacattatgctcagataatttaatagaaatagtagaaaactaagggtagtttcttcctgattttggaagaactgagattatggtaattctcttaattgcttgagctccagggttcattgagttcttaagctagatgcacgaacggatgactcttgagatgatctgttcttaaacatgcacgatggattgatcacttgattgtagcatttttacaataactggttggtgattgtttagcattttacttttgcattctggtcatcgtaataggctgatgcatgcagatatgatgctggagtctgtgctatccatttcacctgtgtggtggtgtgtttgtgttgttgttgccggtttatatgcaatctaaacttatttggtatatgtatataataaatagagaaaatccaagaaatgcctttgacaagcgcccaattctaagaaactagataattccccacgctttgctgaggaaattaccaagtaatttttattttttaataatcgagcaaaaagtaaaaattatattagttattaacaacaaataaaactggtttgtcaaactacgttaacagagaaataaatttagtagactctgtatgagattgtagatgaaatatgatatcccgcactttgattatatggatgaatatatgttaattattataaaaatgatatatatatatatgtgtgtgtgtgtgtgtgttaaaaatattgtgaagaagatgattggatgttgatttgtagaattcaatgaattatagatgatgttgcatgcttgtataagttttatatgtaattattgctagtgaatgatgaggtgacatgttttcatgttgagtttttatagatgatgttgcatgctggcataagttttatatgtaattattgctagtggatgatgaggtggcatatttgcatgttgagctttagaattagtgggttataactttatagtaagatatgacgcattgataagtacgagttccatgaaatatcattgtataagtgactatgtcctagaagtgtgatcatcgttagagttttgttagtaaccctccgttaagtgttataggataaacagtgctagttaagtgttataggatgaacagtgcatttaacagggtaggatggatggaaccttaatggcgatgacattttatggacaaagtcgcttgtacaatggtattttatgaaacttgcactcttcaatggtatttcttggacttgggcatttgtcaatggtatttctggcattttctctaataaataacacgtctcattcacaatttcatttgcatatccctgtttgtaattctagaactcaatgcttcaaaaagtagcatttaagtgcacgaaaaatttttattttaatatgtaaattgcagatatcgtatactttcttgtctgttttacatactacatgattgaattttcctgtcagactgcatatttgaaatgtgctcacacggtcataccgctcagaaagttttcgatctccttaattgctcgttctagtttgctgctaatatcacccaattcccacaacaatgatgtatgtggtcgtggattttgccataagttcaaaataaacagggagaattgcaaatagatcccctcgctgcctcctctctcctggataagaaccgatcccctccctctcactgcaagaaagggatacagggtagcggtaggtacttcgtcggcggcaatgcgcggcaagcagcagcagctcaggacagcgcagcagccagcaactagtgggtaggctggcagcggcagcagcagctcgcggcaagcggcaacagcacaaggcagcaacagcagctcccggaagcggcagcagcacgagcgctcgcggcaagcggcagcagcgtagcagctcgcggcagcagcagcaggctggtcgtgttgagcaggcgcaggaagcagtagcgggaggcatggggcatccttgtcctaatttttatgagaactcacattctcacggtgttagtttgatctgtcagtttaatggcaagtattataggttccaaccatttttggtggcaactaggcaattatgttttttataatggcaaatccacgataccgattcaaaccaatggcaaatatgtaattggcccaaataaaaaccaagtgagtcaatttgcacaaatgtgatgagacggtaaaaagatagtgatactgggagtgcctttcatctggtgatattcacatttgagcgttcaaactgaagcacaagtacttaatagattaagcagacacaatagagagatggcaacaaacaagttgcagcagtgaaaaactggtctggtgccaatgagctcccatgtggcagtggggtgtgccacagaatggaggtgcgggtcacgagaggaggtaagggcggcggtggtggcagccgctagattggtaggggagggagatcagagttaggaggagtcatatatgggaggccgtcaaacaacctaaatcgttgcggttggcaaagccatcctacatgttcccctgtatgcgcaatcgctagaaacatgcacacacttgttcgtctaatatcccttcacgctacaagtgtggtttgccatatggcaaaatcttaagctcatcacgtgtctggatgggtactccgacctggcaaccaaccaggtgggcagacgctagatgttcgctagaaagccagggcaaaatggtatttgatgccgcaatctgccttgtttccttgaggatttgaaaggaaaggaatgcccgcatcttcaacatggtgtcttcctcgttggcagaagtagccgattagataattgaagaatgttgcacttggcgtgtggctggcctagcaggtccggttgtagatgaccatgaaggcgtttgtttgtatatgtgtatttccttgtgcattacatagctccatacttagccgcatagaagctcttgtggagctgcggttttaaccttcagtgcatgttgatggcaacccaactatcctgttggttttctgctttgcaactttttttttctccaaatcttaatgaaaatgatccacgttccatcgcaggctcggcaaagaaaagagatgggaggccctggcccagatagtccttgtgattgttgggtttggttgggcctttctgcgtttgtaagttataccataaatggtaggcacacaatgacgtaaaatttatctagtgataaatggtaggcacacagtgagtcagcgaggggtagggcgccgtaatggctaattagcgaacatccgctaactagtgatctagcgaatggatctactttcttttttccgattattccaattatcactaataattgcctatttctatttttggcaagttaatcctcgtaacgtacgcatgtgtatggggtgtggctgatcggcgaccagccgcgcgggcccgtactcgcgccgttcttagtccattagtacaactactactgctacaataataatactactactaatactactactaagtacattattactactactagtaatactagtactactataattgtttttatatgtatatatacacatatacaaagtttatatatgacgtatacaaaatttatatacgcgtatacaaattttgtatacgtgtatttttggttttttatacacgtgtatatatatatatatatatatatataaccttgtatacgcgtatacaaagtttgtattaccatatacaaactttatacaaactttgtatatgcgtatacaaaagttttgggtttttatatacgtgtatgtattaaaataaaaaaaacacatatataaactttgtatacgcgtatacaaagtttatatatacccgtatacaaactttgtgtaggcctgtacaaagtttgtatacgtatatataaaaccgaaaataactgaaaaaatatacgaaaaggaaaaaaacagaaaaaaccaaaaaaggaaagaaaaaacagaaaaaagaaaaaaaaccgtccgccagaaaaaaaaattccacacgtcgtcctctgcctttctccccgcgcgatacgtgtccggtcgcgtgggggagggggcgcacgactgaacgcttattagagttctcgctcgcatgtgtatgtgcaatgtacccactgcatgcgagttttggggccctatttttcatgggccagtttaagcccaatacaaagctttcatctttaaatttgtttttaaattcgtttagaattcatttccaaagagtttctatatctaacgtcatacgtggaaagtctgtggatataaactttgcatgtataaagtttggtcatataaagtatgcacatataaaatttacaggtcaaagtttgtgtgtataaagtttacgcgtgtaaaaattagacatacaaaaaatttgtacgtaggtgggctagaaggcctacaaaaataatacaaaggaaacggttgaaatagaattttcgggaataaggggcctagcttgaaacttctttgtgaaagtaggctatattttgacacattcacatatggatcctgtattatcctccttgggcatttcccattcgttttgttccttcttacacacatgaaggggttggtacggtgcatgatgcagccattcgcaaggtgtagcgcgcgcacacacgcgcactagactcacccggggaaggccgcaactgcaagacaagttttacccagtgctccctgctccggtaattttcgttggtgaggacctcaagaatgtcgccgatgttgatgaacgaacgcgaccggcagcgagcgcaccggaaaccactggctgtcatattgctgacctgcagatcaaggggtatcgtcaacgtggagtagcagctctaggcttaggccatcggagtgcggcgtgatgcctgtcaccttcagtgggtggcggcagggaggattgcagtggcagtgcagagccatgctctgtcgcacgcttccttgcggaaggcggtgagaagcgtctctcgttcaactccaaggacggtgaccatggatgctagtagtaacgccgttgccagattccacatctctgtcgcgtgtttgtcaagcaaatccgtgtatatatactaatataggccttgtttggatccttcgggctattaaatagccctccgaaattttactatttaggagtattaaacgtaaattattgacaaaaccaattctataacccctaggctattttatgagacgaatctaacaaggtatattaatccatgattagcggatgattactgtagcattactgtagcaaatcatggattaatatacctcgttagattcgtcttgcaaaatagcctaggggttatggaatgggttttatcagtaatttacgtttgatactcttaaataacaagatttcggagggctatttaatagctcagagcatccaaacagggcaatagagtactataagcttaagctatatgtacagatgaaactgaatcttcttattgttttttgtgaatagcccgtactatcctttgagtttcactccggggttagtttaatctctgatgtttcattttatccaaacaaaccgttgaaatctagcatttggcttaacgcggtcgttaaaccgaacaaaaaaacaccacgtggcattgccatgtcatcctcgcatgcaaggacaacaatcaaactaccattccatccttatatatacaccatattgcagaaaaaggaaaataagtaacaagccagaaactcatgacataaataatatcgggtgggctttctatgattttaccttttcacgtcatttttttcttgacaattatactcctcaacgtgtttactattatcaaacgaggtggtactataaatagatctaaacccttagataaaattaggtctacaatttagattattttttattactagtaaagagcatcatagtgtaccttttaaaacaagcatgtcctagctataactaagatctagagaaaatacttaagctgttagggtgcgcccggcccattgtactatgggccacccatattacattgggcttgctccaccacagacccaactggagccacaactttagctcttttctcgcaaaattaggaagccacatcaccggagaaacatagagcatttgatttcagctccaaacgatgtaaaccgttggatccttaaattcgtgaaacttactcctgactcttgacgaaacttcttttgcaaagaagacccttccgcatcctcacgtgagagaaaaggagaaaaaaaaagaaggaaaaaaacttgctttccttcgtcgcttccgctcctaaatcacgccgcatcctcttctctcttctcctcatcgttgtcgccgccaccgccgcttcctccaactcctccaatgcctctgcagtcgccactcctccttgtcatccacgcattcaccatccacgtcgcctccgtatgcctccctccatgcctctggtgactggtgacagcacggcggtggtaaggcacatcgcccctccatctgcattgccacctgcaatctgccattcgcttccacagaacaaatggtaaggacattactgaaactataaagggtcactggtgttccaaatcactaaattctccatattccaaaatgagcaaacaacaggtgtgtttctagcatgaatttcaatcatccatccaccgatcatcatatttgcaaaccaccgaatcagtggtgtacacaaataaaaggtgactaatgtagtaatatttataataatgatgatataatctgctggttcaaacatgaaaaagacctgattatggacattgtctttccgttctttacatggtacatatattactcaactcacaaaagactaatgctctgtgcagattataaaagctcttctggaggaagaacaattaattattcttgatgagttagtgcgtctgaacaatcttaacatcgacgtacatttatgatagtaattcctactccctccgtcccataatataaaggattttaagtttttgcctacaacatttgaccactcgtcttattcaaaaaattttaaaattattaattattttatttgtgacttactttattatctacagtattttaagcacaactttccgttttttgtatttacaaaaaaaaattgaataggacgagtgatcaaatgttgcaagcaaaaattgaaaatcccttatatttcgggacgtagggagtatgttgcagataactacagtgccctccaagcaaatgttgcagattagaatctgtaatgaaatgctctaagttgttttaagactgtgtcatgttagagttagaatctattgtgtcatgttagagttagaatctattttctgcagtcgacctcatatgtaatcatttgtagtacaataagatatttaatttttaatgttagttagattccaaatgaaagtatagtactaaattaaatttatgacaagggcatgcatgttagtatgttacataatgtaattaagaccaaatttgacctagaattttctaatattatcttataagaactaattcacctagagttttctatggaagtatggatgcttttaaatcttgatgacagagaaggatgtgcaatatctgtacatcttagatagctaccttaatatctttatctaaaaaaaagaagttcagatgaattctgcaacttctgactgaatatattttagttaaatttgaagaatcgaatagcaacaactaagctaaccaaaaggggggtgaatggttgtagctacaatagtcctcacatcaaacctagaaaatattgaggaggagatcatcccctttttgcagctcaatactattctgatgatcaccatccaattgaggttcttgagagattaatttgaattgtgtcatcaagattcagatgccatggataataaccattgatgccatgaaagggtgatcaacattggcccgagtacagatttcctccgaattacatggcattacatcgtccatcgttttttcttagtgaaaattgaaactgatgcaagttttttagacttgaaattttattttgtactgaactgggcggtcaccacgcctcgaaatctcaatgtatactgatgatgcagtagtcttcatcaacccaaagaaggatgatgtacaagcattccctgcgctccttgaatgcttctgacaggcaacaaggctttgcaccaacatacataaatctcaggtgatgctaatcaggtatgcctgcttagacctcgacgatgtgctagaaggcacgccggtgactagagcgagcttccctatgaaatacctggggctacccgtagccatgacaagactacgtaaggcagacctccatccattatttgacaaatccgttggacgcctagtgaggaagaaacattgggatagtagggcaaacaactctagtcaactcaatcctcacatcgcaacttgtctacttcccgatacccctaaaatttacaaaggaatccctagaggtgcttgagaaatagaggaaacggttcctctgggcaggggcctgatagcatcacggacgaaaaatgcaaggtcaactaggcaagaacttgtatgccaacaacttatggaggactggggatgctcaacctggaaaatttcatgagagcgctgagggtaagatggatatggcacgagtggaagtaacaaaaaaaaggcatgggtcatctagacactccatgcaaaatatcttataggctactatttacgacagcgacagcaataacaactggagatggggaagtgatcctttcctagaactcggcatagatgcaaggaagacgcccaaaagacatggcgccaaaagtctacgcgatctccaagaaaaaataggcccctccgagaggccatcgaggacaacacatggttacgggatctcaacttatctcaacttatcaactagtacggacatgacggtggaactcctagaacaaccagtcaccatctagatagcagtgcaaaacatcaaactcaactttaaggaaaagaatgagatcaaatggaagctcatatgccaaggagaatacacagctctttcaacctacgaggcacaattctttggcttagtcaatacgaattatgagatgttgatctggaaaccatgggtgctgaaaaaaatgccagattttcacctagctagttgtccagaatagagtttggactttcgacaaacttgcaacacgtgagtggccaaacaactcctactgtccactctgccgccacacgctagaaacatccttccacctcctggtggactgcagatacacaagtaaaatttgggagaccttagcaaattgcgagcagcacaagccgacagagtggagtgcaaccacaataatccatgactggtgggcagagctagcaaccaccaaatgactattgaaaaagggagtctacacctaatcctcctcacggcatgggaagtctggaaggaaagaaacaaaagagtcttccagcataaggagtttatatccatcagatccttgggagcaaagatcaaggaggaaggcaaaacttgggcctcagcgggagccaaacaccatgcgcttttaattccttaggccttttccctattgtacaattctttctttttattctacatgtaacttttacttctcctatattcaatgaaattggcacatcctgaaaaacgagcgagcatgtagtcttttatcatgtaaatatcatggcatgagcaagttgatatgtggctacagtggtagcagtgtgcacttgttagggcatgtacaataagtatatatgttataacaccgatggcagaagttcttccacatatattaagaataagagttggctcagtttataaggaagatcgggccaaaactatacaactagacggttaattgaggggaactatcaaaacctacactgagggcaaaaggagaaaacaaccttctacaacaaaactactaaggcacacggctcaaataattgttgccaagctcatcaaccgatgagcagcaccgacttctcaagatgggccacaacctccaaccagacccatacaattaaaaaccattaaccatggcggatggcttggcagctgagtgatgccacgtaagataggaatagttttttttccttttttgtctttttattcgccgctcgccatgcccaaccattaaccaagcttcttggtgggtcgtggttgcctctggtgttgcgagtagtttgcctggccaatggcgttgcgaataagtgtagttgcgcttggccaatcaccgtcattagatgtgctggccctaggagctagggatgggcgtggtctggggtgggctgacccaaactcgtcccatgtgacccaccaattctacaacaacactagttccaatgggtaccatgggtcgacccatgaaaattgctagtgtactgaatttagaagacactcgacagagcaaaccaagtaaaagaaactaggtaaaaccccgcgcattgctgcgggaatttagtatgataacaataaaaaaaataacgtgtaagatagctagataacatcagattaagtaaattaatgtggtttatgataatttaaatttaaatagtatgtagaatgatgagtcaaacgtaaaaagtaaggtggtatgacttcatggaagaagaaaagtagggagatagtttggaccgtagattaatcatctaaaggctaaaaacaattaatgtgatatgacttaattagaggaaaagagaaagataatttggaccatagattaatcatttaagcactaagtgaggatgaactatattagtatataggatatcataaaacgtaataaagatatacattgaaacattatgtgaattatgttggatgataatttaacatgtttgtatttgaaaaagctcttaaattataaaaactataaagatatagcatgtttgcatgatgtttaaatgtgatgattgttagtggatgatgatgtggcatcttgttaattagtgaatgatgatgtggcatcttgttagtggatgatgatgtgtcatctttgtatgttaagcttaaggagttagttagaggaaaaaaagagaaagataatttggaccatagattaatcatttaagcactaaccaagtgaggatgaactatataagtatgtaggatattataaaacatagtaaagatatacattgatacattatgtgaattatgtgggatgataatttaacttgcttgaattttaaaatctcttaaattataaaaactataaaattatagataatataacatgtttgcatgatgtttaaatgtgatgattgttagtggataatgatgtggcatcttgttaattagtggattagtagatgatgatgtgacatcttgttagtggatgatgatgtggcatctttgcatgttaagcttaaggagttagtgggggataactttatagtaagataggatgtgtacgcttgtattcctttgtgaactatgaaatcaatgttatgttgaagcaatcgtggaagcaaaaacaaaaggaacaggcttttcattgtttcactagacctatctaatttcagagaaccaattaaggaagtatcatgagaaccaataacaaacaaaccggctatgaggatttgggtgaagggagaaaatgacggtgccgtcgcgtgcctgatgcaagggatcgatcgatacctactgaagcagacccaaatacccacttgaaccggtctttttagtttgggccgggccacatacccattaaagccaaatttatgggacaggccaatgaggctcgtgggtagacttggaccatgccaatccctactaggagccaatcacatcgcttacatggggccattagattagaaatactaataatatagagggaaataaaaaaaaacccaacatatacgcaggcaacgtccatgctcctctgagaataagaatatatgaattggcctatagttcgatatgccaactagaatcactatgagatattccttccctcccaaaaaacccaacctaattagggatgagacacaaatggtacaacaaatatggatagcctgttcagattcgttgtcccatgttgtgtcccattctctactagcttaggttttttgggacgcatggagtattagagaggagaggagaggagaggagaggagggtgagagtcaactttttgcttaaggaaatgttggagttgcagtagcaggtcaggagtgatgaacatggcgcgcactgcattaatgctctaagagtcacaacataagtaggcgattcttcataaattttgataatttgaccctttgcaaaaactatttttacaaactgaatgtacgttggcacgctgacttagcctcccatccgcggtggcacggtattcagcgccacttgacgtggcgctgaggtgtctaagttcagcgccacatgatttggcgctgaaaaaggggtcattttttaaataacttttggcggcagttcatttgtaaaattagttttttcaaagggtcaaattgtcaaaatttgtggtgattcttgatgcacatagctgcctgtggagattatgggtaccacatgcccacacggtatggttatccgactggttataggggataacttatatctatagaatatgtaacagatcatgatttaggtattacgtttccctgtatattatggaacggcctaaagtcctgatttgataatattgtaaaatagatttaggaaactgataccgtatttgttaaggtttttatcttgtaatcccgccctccatcctatataaggtgggcaggagtccctctagggggcatgagcacatatgatcgtcagatctatactacacccggcggattcaaatccccaaacatgagtagggtattacctctcattgagagggcctgaacctgtctaaatcctttgtctccgcatccatccacttttatgtctcgtgcgctacccccttttattattgccgaattcatgtttcgacagttggcgcgccaggtaggggtacgccgagtttcctattgaggaatgcgatggaatcaattttatgagccgccggcttcgccttagcctcaggagcttcgacttcgtcgccaccgacaacttcaacaagcctcactctttgactttgattcaaatcagttggagaagatctaatctagctaaggaggataacaaccactctaccacgttgagtttcagattcgatctactatggccgccgccagcgtcaccttcatcagcaagctttttcgcttcagagagagaaactttatcgtcaggagaataaccggatactactgtcaacaggatcgtcaatagcatgggccgcatgccttggacgatacacggcatgctacaaagtttgcagtcctgatcttgcgacatatgtggtgtgcggttggctacgcacgcgcatcatggcccggccgactgcttcgatagccaaacagtccggtcagcatctttcctcgatctcacagcgacataatcaggggcttcggagcagctctcttattacatgcatctactcatcatcaccatgtattgcatggctgcctgctacaagccaaccaatcaagattccttaatctacaggctgctaccaacaatcgcaggcttgagaccgatcgtccaataagcatcgatcagtgcatatgagtcaattaatctactggagcaaatacagatgcatgcttgcacattcttttatctcctaatcagatatgatttgtatttacatgtccgactatgcgacagccatataacaggcacgttgtttccgatatcactgacacgatcttcatggacatggacttcatcgctgactggtttgttcgtcctcacggccggcctactacgttgctactgatagcgacatcatcttcaccgaccgtctcgcttccgtcgctgctgccgactggtttctccgcctacacggctggcctattatgccgccgttggtgggcatcgctttcaccgtcgaccgccttcgtcgccgccgattggtgtcttcattgttattgatggacgactttgttcccacattggccacctctgccatcaccaaggggaatattacaaagctaagtcatcattatttttctttatatgatatttttcttttcctctacctcactacatcaattggttcgccgttgactagtgagtcgggggctacatatgttatatcatattttttaacaattttcataatatttatcttgattgcttgcgacataatctgagtacaaaagtgcctatcgagttatggagttccatcttcctatgctttccgtttggtttgccaatggatagttgcctttgggccgattcctagcacccgggggctcgttggatggaccgaataacgcaaggtgcttagtattactcggaataattaaatcagaagcatagagatgagataaatttattttctgctcttaataattgcaaaagtacccgagtagtaaattctgatccgtgaaactttgttccattaatgacgaactcatgtcactcatatgcatgtttgggaagtacttaggctgactcccggtgcctggtggctatgactagtcgggcagagtgtttaaacgtaatgagtcatttgctcgtggaaatcaaaattgacaagagaagaaatacatatttataaatattttaaagtacttgaattttcatcgaggactgtttttacatcagatactactcatcctatatgtttgttctgcaagatccagatccagatatgcacaaaagggattcatggctttaagcttatctcttacgctccaggaatgaatcagtcagaacatcaccaccagcttgccgtcgtcgccgccgactggtgtcttcgcctatacggttggttggtcacaccaccgttgttgggcgtctacgtcttcaccgaccggccgcctcatccgccgccgactggtgtttccgcctacacggctggcctattatgccgccgttgttgggcgtctacgtcttcaccgaccggccgcctcgtccgccgccgactggtgtttccgcctgcacggcttgcctattatgccgccgttgttggatgtctacgtcttcaccgaccggccgcctcgtccaccgccgactggtgtttccgcctgcacggctggcctgttatgacgccaactgatgctatcttcttcacggctggctacgtcgccgccaccgctaataggcgtcatcatcttcaacgcaagctgtctacgtctgctgccgactagtttattcatttccatggctgcatgattctgccagtgttaattggccttatcttcttcactgccggtcatctcgtctgctgttgactagtgccctcacctctacatatggtttataccgctaccactactgatggacatcatcgtcttccgtcgccgactggttatgccaccgccgactggtgcttttatcttcacaactgcgcatcttcactaccggtttgcttctgttgccgctgactcatgtgcaacttcattactgctatgcaactttgtcaccatggtggagcaacttcatcttcatggtcttctgcaccggcaatctctattgctgctacttcgcaagttgtgctacttcaccaactacgacgtctacatgagcctcgacatattggcatgcgtcacgaaatttgacgtcgtgctaatctactactacaagtagttctataattttcaagacttatactcggacatcttcaacatgtaacctcacttaagcaatgagtactcgacgacaagctacagttctcgactctatgttcagttgtttcccaactaaccaaagagtcggaggctacacaaatacaagactcaaaatccgacaagttttatgtcaagataaagcaatcaatcaatcaaggagtcaactttaggagtcattatcttcgtctttacttcagagcagacgttctacttcagcaactcttattatttcactggcaattttgacttctggatgccgccacaatctgcttcaaattgctcaagtgtcaagtttgagatttaatatacatgtccgggagtttagagttatcaatcaatcagctcagtttcgacgagttggacaacaacatctacattcctctaagtgaagcttctacaacagctataacatcaagttctactgtcatttttataaatcaaggggcattgcatcatcttcgttatgcacatgctcgccgttacctatatatacttcatcggccctgacgtcttcgccgttgctaatggctattatcaatggacaattatgactacgacagaaggataagctacatgcataggggctcatcaactcaagcgcgagaattatatcttcaatttggacttgttccagatacattcaacttgaatttatggtcatgagtcgatttcttattctcaatgactggattattcattattccccgtaagggctatcaaccgaatacttgtgccagtcgggatttaatttttatatctattttggagtatcccatgagggataatcactcagatcagaagctattcacatgagctacacttggtatatatcacccagaagatttattacttaggagcatgttatatgcgtcatcctttaaagggtgtcgaaggcatattttttggcctaggcctaatatgtctgcagcccatattttcaggtgtggcctgtcacgttattttagggacttaggcactttttgcttaggccaaagtgcacgtgatcaagtgcccaataccttaaaatccttttataccgcagttgctcaactttttaagagttggtacaatgcatcttaaaaggtacccaacggtgaagtttttcatagctgccccgctgacttttttatatatagtcaaggcgctgtttgggttaataaagcaattgattggatacgatatcattgctttttggcacgtaagtgtgcacttttattgaccaatattatggcttaggctgattatatattgtggtaattttctaggtggttggtaaatcatttatgagtttatttactcggatgttacaccacatatgccatatatttttaggtgtggtgaaaccatgtgtcttttagggacttaagcacatctgttaaagcagtgtgcgcatggcgtatgcccaatactttagaaaattctttattcacagcatacaagcttctttatggctattttgctatgtgaattttcaatgatgtagccaactttaggttgcacacatcatattttacaaagcagtcggtatattactcggatcatattattcggagattcacaccgcatatgctatatattgatatcaattcacttggttgattacaattatcaaagccactcggttggttgaattatttattccttgactatatgcttagtttatttagctaaccacatagtcgggggctacacctattaggtgcgtctaatcgatgcacctgactttatttttcagccctccacagtcttcatatttggtaaaagtactcgagagaccatggcaaagataattgaagcatttggctttggagtaatctggttcgagagaagattgttttttgactgtgaaggtctcaggggctactatggagattatgggtaccacatgcccacacgacatggttatccgactggttatatgggataacttatatctatagaatatgtaacggatcatgacttgggtattacgtttccctgtatattatggaacggcctaaagtcttgatttgataatattgtaaaatagatttaggaaaccgataccgtattggttaaggtttctatcttgtaatcctgccgcccatcctatataagatgggcaggaggccctctagggtgcatgagcacatatgatcgtcagatctatactacacccggcggattcaaatctccaaataggagtagggtattatctctcattgagagggcctgaacctatctaaatcctttgtctccgcatccatccacttttaggtctcgtgcgctaccccttttattattgccgaattcatgtttcgacactgccagttgttgaatatatctcacctaaatcaatgtcaaatttccttggttatttgatttttacaaaaaaaaaagagatagtacaaagttggatgccgctatatatatctcagctgcataaaaaaaagagcaaatatccagcataacgttatcatttttcagaaaagaacgcaacactagctaacacatgtgcatatgttgacatgttgatgcgtggtgtgtgctttagcatatagggcttaggagaccttgggaactagttatacggtgatgcataggagagtatttcctgattccccaagacctgtgcttgattgtaacctgcttccagctcagagtctgtgaccaagtaaagcaaatgcagaaggaaggagggttacatagagcctcatcgattgtcataataggctaaagccaaaatcaaaatttaaaatttcaaacataattttgaaactgatataatgtagttcttttagcatttatttttaactcgtcaggaacacatatataaaaactttacttataaattaatttttattttataataaattaaaatagcttattaggaaatatgggtaatcgatgaggctgatatgctactactgctgtcggccggctggactagctgcaggcaagttcgtttcttgcacgtcatgaccatatttcagcaccgcgcgtgcggagcaaacggtcaatgactcagtcggcctcgtccgcattgttttacttttttgagaaataaaccaacggtatatttgcaatcgaaaataatttgtaaaatacatgttcttaacgatgtaaaaataaaagctaaaaaataaacttcgatgaaaataactcggttagcctcagtacgcaatgtttttaaggttaaaaataaaattttagctaataaacataaacattagcgaaaagatgaggttgctcgctatctttcgctgtcgagctacactcatcttctaattttacaattacttgtggtgtaaccaatcgatatgctatctatgtgtgaatgattgatcaatggatcagtgatgccgctgtgcagtagaacagaggtgagccaggggtactgttgggatacccgtaggttacgatagcttaatcaaaattttatatcgtgtaaatcaggaaccatacaagtattagatcatagatcgttaccactcgacaagctgcacagcggaagacgctgagaagttgaaggaactctcgcgaagtagcgggcgtcgatgtagaggaagtagtcgatcacaccggctcgaccttctcctcctcgtgctcgccgtactcccacgccgatcagcaccgtaaaccagcagcgcctctatcggtatccacacgtacagggatggaacgccacgcgcagatgtgctgcaccctcgtgcggctagggttctgctcgggaagggagtggcggctagggtttctcacgtgatgcaatatctccgccggtcacactcctcacgaatatataagatccattactcggacctccaaggcccgtaggactcatatttggattcctatccgaattaagctcatattagatctccatccaatccccttattccggcccattaagcgtgcgaccctataggttcatgtacactcggctataacccgaaaactctttttcggtccacgcatcaacagcggcccctagcagaacatattgagccaccgggcatacaaaaagatcatatcgactgaacctctagtgtatacttatatgaacccctttgcctcacgatatcgattaagctcaaggctagatatgtgccatcctctaatagctcaatcattcactcgaacctgttgatagattatataactcgtgattgactcctcaatcacctttggcatggccatgcatttccataatctacaacatcgaagggcccagagatatttctccatagaaggggcaaatcccatcttgattattcatattccactacatatttcatagcatacccgaaaactagttttataactacccaattacagagtagcgtttagcaatccctaagtaagctactacacatgttagctaggaaccatgataatctaaggattcaacaccaacactaaatgagatcactgatgacacaacacatatggctcttgcagtgtctcatgttggatctatccaacaacatgttcaccaacatgtgtccacattattaatttgttatctctataccatgatccatgagacatgatcattaattaacatatgtgctgatcatctaaatatatttgttccacatatgatatttgatcaggaatcctttagaaatagcaacacacaacataaagagtctcatgaaagaatcacatatttattaaccaataatgagttatctatttcaagaaataaagtcggataaatatataaacatagtatgtgatacaatcatctctatgattgcctgcagggcatatcactgacacttcggtccttccattccacggatcagctgagaattgattatttcaatcattaaactactctgaaactttacccttttttttttcttttgacaaactcacgatcggcaagttccgtggacttgtgcttgtggagtagtaaatcgcagcgacataatcttagtacttgcagattaattagggggaaggttgatgataatttaactttggcatttgtacagtacgctttctcaatatattgagctggtggcatcttaatatgtgaaagcaccaaagttatctcaaagagaatgagccacatcttctaaaatacgagtaacgtttgataaaactgataaataaaactacaccattagatcatatatgagacatatattggactaatcaggaggctcgcacaacttttatctctactctttttaatattatgtttgattaattaatcggttgataaataaaggaaaaagaataaaagtgacctcaaccttgaattcataatggagttattaatccctgtgattatcattaataatgtgatttgctgcaagattaacaagagagtttatttccctggatggagcacgtacatatgagaagtcgtatattgtatatattgatcactggacgtcaggtttaaatatatatgtatacgtttatgtgtaattttcatatgtttccaatttacttttatagatataccagctataatgtataagcgagtttataaatattatattactttcggtggtatgggagcacacaatagcagagtgccatctatcattgtgtcaattttattactccttccatctcaatatattgctgcctttaacatttaaaatgtgtcctaaaaatatataaatagctaattcacatattccctcatcccaactaattacaaccatcaagataaaaaaaactacttacaaccatattatatttatttctttttgtctattagttttttcagggcaattgcatttttgacgctattttgaggactagctactaatttggcccttcttttttgagtttgacccatttgaccctcttttttacaaggaaaaaagtacgaattacccccgaactatcgcggtcatccgaattacccccgaaccacaaaaccggacattcttcacctccaactatgcaaaccggacgaattacccccctcgacccaatccgcggtggttttggtctacgtgacgtacacgtggcagtccagtcagcaacttatttattaaaaaataggtggccccacctgtcggtttttgtatctctcttctatctcttctatccctcactcactctctctctctcttgtccttcagagttcagacggcgacggcgaaggcagcgagcgtgggcagcagcgaggtgaggcgaggcggtagccgccagggggctgcgcgccgcggccgcgtcgaccacaggggcctcccggtggatggcggcggcgcgagacaagggagcggcggatgggcggacggcggcgcgcgaggccgggcagtaggcaggcggcggcgcgagatgagtgggtgggcgctggacggcggacggctgcatgcagcggcgcaggcgtcggtgaatggcggcggtgcgagacgagggagcggcggacgggcgaacggtggcgtgcggggcagggaggtgggcagtggcgagagacgaggcggcggcgcgagacgagggggcgggagctggacagcggaggctgcatgcggcgacagcgagtacaagcaccgccgcctcgtccgctcccgcggcgccgccaccaccgccgtggccggaatcccggggttccacttcgccaccatcccggacggcctaccggagtccgacgccctcgcagctgcccacgctcgctgcctccgccgtcgcccctctgccgtcaccaccgctggacctggaggaagaaggggaaaggaaggggaggagcggctgcggcgaggggggagcagaccgcgagccacgggaccccgcctccggtgacgccatgctcgcctcgcgctgtcgcccaccgcccgccccttcctcacagcgtgccgccgcccaccgccgctcgcgctgccgctcatgcgcgccccgtgagagagagagagtgaagagagaggaagaggggaagggtatgtatgacatatgggtcccacaattttttaaaaaaaaatgctgactggattggcacgcgtacgctacgtaggataaaaccgctctggattgggtcgaggggggtaattcgtccggtattgaaagttcaggatgagcaatgtccggtttttaggttcagggggtaattcggacgaccacgatagttcagggggtaattcatactttttccttttactaatgaagatgagacttggccctattccatgaagtcaacatgacggtgttaactcaagacaaatatgtcatttatacccttgtgaatttaacctggtttcttaaagttttttattcaatgcagttttgtgcactaattagtatatattaaattgcctcaaacagaaatacatggcacagatttatgtgtaccaaaaaaagaaaagaaaaaaacatgttgacaccgcgccgccgacggcaaactctcaagcccatccatgcggagcagccgcttccaccaatcctccctccgaccctccgcgagccatcgtcgcctgcctcaccatgcgccgccgccaccggtgttccctccctccccgcagaaccgcctcctccccaccgaagtccgccaccgccgcgccgccttcgccgaccgctggagccagatccatcgcatgtgcgtctcggcgccaccggatccgtcgcctcatcgccgagcctttgccggatccaccctgtcggcgtcgcccctcctcctcctcgtcgagccaccgccgccactccttcgcctcgttgagccactgccgaccctcctcctcatcaagccgccgtcgctcctcctcttcgttgagccactgccatccctcccatgccgctgtcgtcgcagccactcctccacctcatcgagccgccgccgaccgcagcgcggctgccgttgcacaaggagggcagcgggaggaagttgctcttaggccgccgacgtcgctccctccctccacgagccagcgccgtgtggattcccccgctccgcgccctgcggccgctgccacggccgctccctccacgagccgccaccggcactcgccgagagagagatagacgagaaacggggagagacaggatagataaggatagggtttgttcgatggtattttggtcattaagaaaagtaattatatttcattcttttttttaaataaaaacttaatggtgctacggaaaaagggccaaacggagtgtttgttttaaaaaggtagggtcaaataagcaaactaaaaaaaatagggtcatattggtagttaggctttaaaacagggtcaaataagcaattgtcccttgaagataatattatatgtctaatcaattaactattttataaacttgtaatttttacttttgcttttaccttttataatagagtaaattttacaaaactacatgatttatggttcaagttgaagaaaaccacacacattttgacacttggcacttaagtacctatattttggtagtttagtttcacaaaaccacagtatcgatgaatggatttacccatgtgatgacgtggttgttacatctaggatgatgacgtggcatatcctattaatttcgtgcgatggctgataataggatcacacgtcctcgtcctatgtgaaacaaccatgtcatctcgcgggtgaatccattcattgatagtgtggttttgtaaaactacactaccaaatatatgtaattaagtgctaagtgtcaaagtgtgtgtggttttctacaacttggaccataaaacgtgtagttttatgaaatttactctttataatataattacaacgcacatgctttagcttgtacttagaggtaaaatgcagggtacgtgatttcgcccttaataagtcaccgtttgcccctagtcaggatggcagctctgtgggtccaaaactatggaattaaagaaatgataaagaaagaatccaatgatttacggtatatgaattgacctttctatccctagttatatctctcacccaaaaccaagtgtaaactgttcgggccaagtgcggggacgagttaattccaggttgctaatgttctttcacagaaccatcttcatttatctcttttcagtgctacctgtgtcctgtgggctgtggtcgtacgtttggagttggggcttagatccctatgttttagtgttgtttgaaactgatgaagagataaagattaagctgacgtacgtaaaacgaaaaaactttaacacatgattaattaaattttaattattacaaacttaacaaatggatatatttaatattttaaaacaatttatagatatttttcgcacgaaacgtatcgtttaatagtttgaaaagtgtgctaaagaaaatcaagaaaaaaatctttatctcaccgagataaaatttgtctatgcgctttccgtctcagttggtagatattttcgaagaaattaaactaacaagatgcgatactcaatactcctatctgcagccggcagccccgtaaagaaaccatatgtctagtattaatccaatctgcaattcaggctgaaagttaccacatatactatatatatatataggagaggctggtatatatgctggtgctggtgctggtgctatagcgtatagggcttagaaggcatcgggtactcgacgtgtccatgaagatatgtttggccatcgcattttttttcttccataactctgcgcttctagtaggagtacacgggttgtggcatggagaaaaaacagattaggcaaaaaagaaaaaggttaggaaagagggcaatatattttccctgagctgcaggtgagtgtac

SEQ ID NO: 69988 - DNA, 12806 bp, Oryza sativa
tcaccctcttatgctgccaaagatgcaatgctcacaaaatttgagcttcccgatgctttgtccatctagcaatcctcgcttgcttaattctgccaaaccaatttcactcatatgcccaagacgcatatgccaaagattagtagcatcggaattatataatgaatcagaaactgcagcaatattacctaatatagttgtacctcgcacatggtacaggttggcagatttaatatcagctttcatcacaacaagagagcctttagttaccttcaaaattccgtctccaccggaatatttgtacactttgcgatcaagagtacataaagagatgagacttctcttcaaatttggaatatgccgcacatctgacaatgttctgatacaaccatcaaacatcttgatctgaactgtttcaacacctgcaacctcgcatggtgtatcatcacccatcaaaacagtaccaccttgcacagcttcataggtggcaaaccaatccctattcaggcacatgtgataggtgcatgcagtatcaagaatccactggtcactagtttgtgcacaaccagcataagcaacaagcaattctgcatcagacttctcatcagtaacaactgcggctttaccttcctcttctttctttccttttggtacatattttccggttctcttgtctttatcctgtagcttccaacactcagagatatcatgtccatctctcttgtagtatttgcatgacttatacctgcctctggactttgatctcccacggtagctacttgaacttttatctcttgatttgctgtttgtgttcttctcctgttgcctgccccgaacaaccaagccttctgcttgtgaatttgaaccttcagagggtaccatcttctttatcttttctttggcatgcaaagcatcataaacttctttcaaagttagagtatcacaactataaagaatagtatccctgaagtttgcatatgagctaggcaatgaacacaatagaataaggcataaatcctcttcatcatactttacctccatagactcaaggtcagcaacaattttcttgaaagcggagagatggtccattacagacccatcatcttgcaacttgtgcaaaaataacttttgcttcaggtgcatcttactggtcagatccttagtcatgcatatctgttccagcttcaaccacagcccagcggctgtctcctccttaagcaccttcctgcaaaatattgttagatagatgaagatgaatatatgacatagtcttacgatcccttttcttctcatcgttggaccaatcctgagtcctcttgtcaaatccagaaagcgcatcatcgaggtcttgttgtgcaagaacggctcgcatcttcacttgccaaagtgagaatcttgtgtctcggtccaggagcggtagatcatacttcaaactcgccatgggaattaatcctgaatttgctagaaagaaattagggtaaatctagcaaaaaaatgcgaaacctggtacgcttctcgtgtgcacgtagcgtagatctgaaacttcctggtacacaagcttgtgtgcgcgtagcaattccacgtgaatagaaaatcacgtgaacaggaacctgatcgcttccatcgttgacttccttttcagcctcgggaaccgtgcgatttagttggatgtattgacgccgctgctactcctggacgtgcgcgtagacggcttgctgctgctgcttgccaatcttctgatgcgtgcgccgtttccaggacgtgggctgctgctgccctaatttcgcgcgggcggtagggatgacgccgatcagatcgatccggcgcctcgacgaaccggcggcggctgcgtgacctgtagatcgatctccaaagctctcataccacttgttatggaaatagatgcacaatggagacgcgaattttacgtggaaaacccttgcgggaaaaaaccacgggcgccgaccggcaatgatcactatagaggagttgattacagacgtaggggaatcacaatgggaacgtcaccacttcccgtacggcttacaagagtatatatataggggataaaagaaagacatctaataggactcctactaggaaactaatccgaatatattgtgggcctaaaattcggatcacatatttaacaaaaatgattcctatgcacaagttatttaaaaaaacacataatgtatttttaaattttataataattaatacttaattaaccatgtgctaatgaaattaatcatatgataatgagaaaataatgagttttctcgtttcttatgcgctgaaaatatccctatgtaccattgaatcgaacggagtcgtcggcactggagggataggcacatctagttccgtatcggtgtgtctagcaagccattggaactcaccctgcagggatcacatcatgtggtgtgcatgtagaatgaactaaagcacagttttcagtggcagtgtgaatctgcgaggggctaacgtgagcagtggttgggtaactggtgccagccaacaccaatgctgctcatctcgaattctcggcacatcccattctcaaagacatttgcatcgttgaatcgccgagacaaatgttctaccctctcaccgctgcttttccacatatagaggaaggtgatggccaaggtttacatttactggtagtgctatagttcttctcaacctgcgctagtttatttataggcgcttgacgaggtacactagctagcatgcacttaaagtaccacaccaaccagatgagaggctttgatcgaacgatatcactgacaagacatgaagtcagatggattactcttctgtcttaaaattaaccaaacttacaattagatgagacataatctaatacaataaatttggagaagatcctgtttagattcgttgttctaacatgccatccaatcctgattgatttatttgggacatagagaatagctgatagtatctgattggaagtttggaactgacaaatcatggacaactcacgaagacaaagaggtacatttgtagcgacatgcatcatccattcataataagtgaaatcgaaacgatgattcatgtgagaatatatcatacacacacaaaatctaaaaaaaaaaaaattcagggaataaagtactcatagagtttgagtttcacaaaatcttgtgcccaccagttcatcccgattgacattcttctcaacaggacgatcaacagatgtgtttgaccttcggtgattattggttttactagctgttttctcgttcaaaagatgaaactttgctatatattggactctatggtttagtagaaatgatataatttttgacaaatcctcaataaaatcttatatgtatgtactatttagggcaacgtattggttccagttctgagcacaactataaatatgtgacgaggacaaggaacaaactgcgtgccgaaatttagagacgtcatgcagatatttgccaatctcggatggaaatttacaaacaaacttgaatagtgttttctctattttgtgttggtattattagtcattgtttagtcatttcctggtttttatatgttctttattgagtaaagtatgtaataagtggctctaactttttttgaagcaaaaatgtcagaattctttccattatctaaaacaaggaactttgcagattggagaagaatgaagaagacaaatctcttgatgatatcgccagcgagacaaggaccaccgagtagctattatatcttattggaaacctggtttagcaattttgtatttgcacatttcaaagttaagaaaagttaaaattttcagctacatgagagtgtatatatcagtacccaacatgcaattctcatatacatagagaagatcagaactgaagcacatcccaattaagatttgatatggtcaaattaagttttccttaacgctatatgttcacaaatcacaggaaacaaacccagattggagacgataggatcacaagatgcgtgtgcctttgcgagaggatggttcgctggataagatcacttgtgcacggctgcacgctagttgggcggaatcccctactcctgtttacccagcaacgccagcatcaccatacgttggggcctgaggttgcacgccacacctacgtactaatttgtccaatgtgtgcacgcgacgatgcgctggatgtcgcgacgacgatgctcgtgccgatcacatcgtatgctctgcacacagactgaactaaactagagcacggccatctgcgacatcacgaatctgtgagaggctaacgggcactggggtagcaattggagccaatctagatcaatgttgctcatcttaaattccccacgcatcccattctcaaggggcatcgtattgtctactctttctcactgttgattttccacttacagcgtttatatttactatgtatggtattaattgctatagttctttctagatggtagagtttatttataggcgcttgacgaggtacactagctaatatttcagtgccacaccagctagatatcacaaacaaggagtgaaaaggactacgacattcatctcaaaatgttgctacctagtatagcatgtgacattttctagtataacgaatctagacagtaataacaatattttaagacggagatagtagctgatatttgattgtaagtttggaactgataaaccatggacaaactcccaaagatagaggtacatttgtgcacaacactatggctatatgcctatattgcgcgtctagccacggacatggctcatctgtttataacaagtgaaatggaaacatggtgcatgtgagaatagatcatatacccacacacaatccacccaaaaaaatattgcattctgagaaagctgaaaattcatggaagaaaatgctaattaatatataatgactccaattggtacagtgcatcagaactgctcataaagtttcacaaaatcttctacccacccgttcatccggattcaccttcttctcaacatggcgatcaattgaagcgtttggacctcggtgattattggtcatactccctcccactagttccattccatgacacttctcgtccaaaagatggaaccttgcaaactggagaagaacggaaaacgcaaatctcgtgttggtgatatcgccggcaagacaatgactactgagtagctattatacttctaatctgattgaaagcagggtttagcaatttcgtcttgcacatttctgttaggtgatatttcacttggatatcatcaggaggagatggggggtttgtccaataataacctcgagtatgttttgtttatcttttctttcttcattagctacgtgtgctcctgcaatttcaaagaaaacaaaaaaagtggatcctcctaaaggaaaatttcctccacttttgttgtgtactggtgtctatctctctctctctgagagcttctgagatggccaatgtcactctcaccggctcagcctgagaaagaccagacgaagcagcagcaccgcccgcttccggcgtcgtgcatagagaacagaagggacccgtactggactgagaagcgagcagctaacatgaactggaccatactgatgtcaccaaagttcatctccaattccccatgactcccattcttattaaggcatactatcacattttgttgtcgaaacgccggtatatgttgtgttgctctttccactgccaatctcttgtagatagatgaaggaggaggtcatggttttatagttttgttttaggaagaaaatagaattatagtttggttttggagtgctgattctatatcataggagtagcatctatcttatttataggcacttggtgaggtatattgtatcatatatatacatggagtggcccgaagttggtagcacttgctttacgagccctttggagaaattgaaacaaaatattagtaatacgcgtataatttcttttagaagcgtagtacaaatgtaagcgctcataatgcactcacacccacccctataaacgcacacatgcctcgccctatcccaataagcatccaaaaaacctggaccgatatatattgagattaacgaagtcatcacggacatctcgttgtcgatgggtacgtcgtctaccactgaaagaataattagcaataaatgtgagcacccgtgtcaagtttaggactataacgcgtgtgggttgatttcatcacaagaaatccaaccagttaagctaagctcattttataacccatatgtttaatttgtcacgtgcatacaatgaactcatgaagcataacaaactatttatatttcacaatgtagtgggaggaggaaaaaatggacgctgtagttaacttccacaacttcttttctaatcaaaggactactctagatttcgagatcaccataggatgtgtgtgccttgcgatatgttggtttgctttatatactacatcatctcactcgaggtgtgctcctgccttacttttgtttacctagcacagcgctgccatttatttatccagagcaacatcacgcgttgtgaccacatgcaacaagtggcctcgcgtataggcggcacactcactgtcctgggcaagccgagggaaagaatccccgtgtctagtggccgatctagaaaactgattcgttagatgccataatatatctattgatgtattgttatagcatgtcaattatatttaaattataatgttagtataatttatggatagatccgctccggttagggccgatcgatcacatcattgtcagcatatgctcttcacacaaaataaactagaacatgatctcctacgacactgaatacgtggctaacgtgaccggcggtgtgataactggagcatcaacgttgttcatctcgatttccccatgcattccattctcaagacatgatatcatcgaatcgccgtgacaaatgttctattctttctcatggttgcttttccgcatatagaaaaaggtgatgggtacggtaaggcttaaataaatgtgacagtaagattttatattttctagtgctatttcttcgcagtagagaagcatcagttagcttatttttatatgcgcttgacgaggtacactagctagcacttcagtgccataccaaccagagatgtttggagaaattaaaggctcttaatgatatcaccggcaagacaatgattaggagtagctaattaatttttcctccgttcctaattaatcatcgtattacatgagtgaaaaaagaacaaggaaaactaataactctcactatatttactcggtaacaaatttgacgcattaaaaaaacaaattcgatgcatgcatcatccacatttcttcccagccaataacaaatgaggacattgcatgaaaaaagattgacgattcgaatcaaaatcgaaatagcatctacaagatgcacgtaaattctcagctgaaaattcattgaagaaatgatgtcagcgactagagtttatttcacttctagcattcaaaatctgttccaaaatacaataatttctttacttatttcttgatcacatatgtattatccatgctcatcgggaatgtagtcttttctcaacttgtgatccaggtgctagacctacgcactctgattctcggttagtttggccctcttcttttcgattaatatatagatttatctttattttcattaacatgcttttcaagttattaaacggtatattttgtatgaaattttttttatagaagttgctttaaaatatcatatacatctattttataagtttaaaataattaaaacttaattaatcatgtattaatgattttccatagcacattgaattgttgcagctcttggaatctatcgcgactaataaatcgaaacacatcccgatgcttgggagggagctggcttcccgaatctcagaaacaatgatcatggtagaaacctagaggaagaaatccatgaaatcaacaccaaatgtgacaacatacgagtacaacatctcgttttgagcgttgatattgcactcatcttgtatgtgaaatcccaacacatcccattcctataaaatataatcatcgcaaccatcaaagaaaataaaaaacaatcgctatgggcaagttttgcagttcgcaagtaatgctgatccttcaagggaacgagcagtagtagaacggtgaactattatattaatcgagtattatttactataaacttgaaaataaaattatttatttattgaaagaactttagtatagatttttttttcaaaagcactctatttatcgttcggggaacatgttaacgattaacgagagagtcgctcaaagcagtacagtcgaaacgaatgggcccttagggtgtgtttgagaataaggggattgaggagattgagaagatacgtaaaacgagatgagctattagctcatgattaattgagtattaattttcagtggcaacacttcccttaaaaaaaattcgagggctgcaacaatcatgtgtggtagggacgataaaaaatgccgcgtgcccgttgcaagccaagcggacaggagcattactggtcactgatgagctagagcacacggtaccactccatcacattgttggttcctgagaggctaacgtcaccagtgatgcctcctctagagcctctctatgtcgaattgtcgaggttgtttgtgtcaagttcccaatgcatcccattcttagggcaccctcaatggttatctatatgctatctacaagagatccatgtcagcatattttcctacttggaagagattaaatgaagagagagagcaaagttatctactaacttagagatagtctatagagaaaaacgaggcaatgaattagagagctatagatacccatgtagacataccattgaagtgatttactattaatctagtctattgctgagatgtacatgttttatagatagcacattactttaccattgcgggtgctcttagagatatcgcttataatgttctatctactctttcttcattgctgctttccgacagtcgacacagaaatgtgatgcatgatcagggtttacttttctggtgctagtgcatagaggagtactccctccatctaaaaaacccaatcctgaatttatttgaatctgtccagattcaaatattgggttatgttttattttgggacggagaaagtaccaagctagcacagtatatctgtatatgggcactgacaaagtactagcggcacaccaaccagatgagaggatagagtctccgtccccatataagtgcattctagaagagaatatcagttcaaattcacagtcctataatatgtcacatcctcttcaaaatacgtttatattgggatggagggagtacattattttctgaatgatattggtatcatccggtaggacaaagaggtaagtgattcaggaaccaagctacatcagagaaaaatcatgcggtgttggtccgttcgatccacatcggacggaagctagcgagagcagccggaatcaacggcctcaccttggcccacggcaacaaaattgccccacggatgcacaactcaacaagcacttccaaacttcacgatgcctccttcctcatctcttttctcaccttgccccatggccggtagccgcgctcgccgcctccacgagcctcggtgtgggcgcagctggagcatactgccaatgaagcccctccaccacaaccctcctccctatctcttgtcccagtggcctcgccgtgtgacaatatagagcactaactagcccaaactttagaaaataatgacaccttaattagaacccaagtgttacactgagtcaacaaccatgtgtagttgattcaagtgtaccatgtgtagttgttttaagtgtacaatatagtataatatatgagaattttatgtccttgaggtactaaattttacactaaatttttgatacatatagtacctcatcaagaactgtaaaattgctcataatatatattgttcatcatagtgtgaattattgtgaatttgtgattgcttgatagtatgtagtgcattacttgtcatcaactttagtcatccatagttatatggggcctatggcaattctcaatatctcatacacaacatgacggatgctgatgaggatgatccgtattccgtaagtaacctagcatgtttctattgtactcattcttcattggaagttctaagattgaagcataccccaatgtcaattttgcatggagcgtctcgtgaaaggtttttgtcacgccctgaactagccccgaacggaacttgcccgtgacgctccaaattaacctgttaatcgataccagtcccaggaaacagtgctgatatcacaggaagacagaatatcacagcaacagaggtctctttattacagagtaggagtacagtcatgttgggctgcggatagatcccgagctcacaactgcattacaaaagggaaagcggaagccaagacttggaccaatcatcacaggcgcgacttgggaactagaccgaaaccctaaaactcatcgtagccgacttgctcctggaagaactcctcatcagcgggatccacttcatcctcttcagcgactgggggggtattatttatatagagcaagggtgagtacaggagtactcagcaagccatgggaattaagtgtttaatgcaggcttcaaaggaaaggctgttgtttttgcaattgattttatttaaactcctttttgaaacaactaagcgagtgcttctcaaacgacacgaatgagacagtgcgtcttgtccggtcggagtatgtgcagtgtatcagtctttgaattgatcaaggttggcacccggccaacagctttcaaatggccacccaggcctagctgatcctatcagccgcagattttccaaacatcgatcccattccacaacagcaatttcacaaagtagtagtcaaacaaaactacgctaggaatcacctcacatccgcccatgaccgtgggcacggctgttcgaacaatttaataacctctgcagagggagtacactttacccacacgacgttactagccttggtcacctagcccgtgtggaacggccacgtctggagaccttgaggctttcatgacaaggcatttcgaaagccgacacaggttcaccatatgccaacgagaggggtcctagaccgacatcaggttaggtcccagaccatactgtgccaggaagcccgggggttctccccggcaccaccccgttgaatccacatgtctcttggcatcatggctcccctgattagctaattactcagccaggggcgtcccatttcacccatgtggtcgcacttgtcttatgttcggatgaaattcctagggaaacggtccttaagtgcaagaacgggaaaccgtactcccggtacgtcccccggtctgcggttttggaaattcatttagttcgcaagcaccgacccatgtgtcgggttttccaagtcttttgtaaaaccccaaattttacccatagttggatattttaaatttgaggggaggtgttctgatgcccgtgcccgaaggcccgtgcatcgaagcacaacagttgacaaaggaggttcaagtgttcaataattcacggagggtaattgcagcaattaggattggggccggcaggctatctcacaagccgcggccgaattacttgtgttaaacctattcatgcaacatttgcggaaaagaaatacttagatttaaattataggtgcaagatgatcaaaagtgacttgccttgctcgagatcttgagcttgatcctcgaaatcctcacactgcgggtcttcgggctccgaaactacacgcgaaatgggacaactcaacaaacggcgaaaacaaagccctattattgacctctaagcgtgccattagatagatcttgagatttgaggaattttggaagttgaacggagtcaatcggatgtacggttgagaagatattgaatttctaagattattggatttttgatctaaaggaaaaaggatttaattaaacccttttggaaaaagaaagaaagaggaaggggaaatagacttccctcgggcggctagggctcggcctgagagaaaagggcggctcggtcgagctaaatgggccggccggcccgagaaggcggcccaagggcacgcgcggggagagagggagggggaaccggtgggccgagtccaccttgcatggccccgagtgggacccgcttgtcggcggcttggctcaccgtgagcggggagcaggcagcgcggcgctagggttcggaggggggcgcagctcgtagaggacgcggatgcggcgggcccacgcgtagcctcacggctcgcggtggaccgcgggcgcaagcgatgcggaggggagcggtgggccgaggtcggcttgacccggtcctggccgaggtggcgccgacgtggcgcctacgtgactgccacgcgggccgacgggaggttgaagaaggcgtcggccggaacggacggcggacggcggctgcgaacggcggggcgaaccacggcggtacaagcgaaagagagcacaccgggaggtagcacgggttgagaggggacgagccaacggcttggattcggcaggggatgctcgatggcggcggattgcggcggcggcattcggcggcgagaaaagggggaaacggcgacggcgcgacgggaggtcgattccttcggaacagagcatctacgcggccaacggagtccgtttctagcgtcggattgggcggagctaccccgagcgaggcccgcgacgagaggcgctactgagctcgg

SEQ ID NO: 69989 - DNA, 12558 bp, Oryza sativa
ctgcgcccatggatgcggcggcgcggctctggcacgcgcgcgggctcgcggggcagggcgcggcagagcagcggctaggcggcgcaggcgcggcacgggcggcgaccgcgcgggcgcgcgcgcgaggcaacggtgcgcggggaactcaaaaacgcggcggggagcttgccagggatggagtggggagagagaacaagagagggggagagcgctcggctcggcgtcggctcacgcgcacgcgcgtgcggcgcacgggtagagcgaggggaaggctgagggagagagagagagagagagagagagatgggccgagaggggaatcgtcccaccgaacctgagggaggcaaactagacttttcacttgattaagcggctcccatagccttttcattttctcggactcccagaggccaactgcccagcagcacaacaatccgcttccactcgggaagcctagtctatgatgcccgtagacatcccgaatcacacagattcgtttcttgaccagtcaggtcatctatctgccacataggctgattctggtaacgattcccacaccacaacaacttttcacaaagcacacgcaaacaaatacgattttcacaaacgcagaagacttaggtggtgtattccagctggtatcccaactggtctaacaccttaacacggactaccaaacaaaactcacgcacgcactagtttaccaccactcctaccgagcgggtgacggagctaaggtcttcttatcaatggggcttaactaagacacctagaggcttgagcacacctttcttcaactgggtgtgaagacaggtttattctaggtcaaaagtcaaaacaaatgactagcttctaccttttggacacgaaaagatttttcacaaaattggagctaaaggggaacaacgacaccttagttttcacaaatagtttttgtactcaaataatgccatccttttcaggggtttcgatcctagggccaactaatgctctgataccatctttgtcacaccccgatctggcaccgccgtacaacggcacctgacaggagcgtgtcgtaggaataacggcgcgaaccgctttctacgaaaccgcgatctcagtaccagtcccaggacatagtgctggtacccacggtgacaaacatgaatcattgcaaatccttaaaataaatagatgacttatttaccttaacttaggttgcagctcagaacagcccgagaatgcaaccgacgacacagacgaggaaacaccaataacaacagcagcagcggaacaaacgaactaacacccaacaccacaggcgacggctaggaaccatgacgaaaccctaatcttcactttacttcatcttcagctttaggacggaggaactatatatatttatatagagcaagggtgagtacttttgtactcagcaagtcacgggaacttaggtgtttaatgcaagcttggaagagaggcaaggttgttttgcaaatcttttgttttgaaatcattttgaaatcactaagtggtttacttctttctaagtttgggccgaaaagaggcttgtgtctcgattcgactttaagagatgtttttcaacaactcaattggtaatgtactgaccccccaggtcagatcattacttctcggctctcagagcaatttcacttgattaagcggctcccagagcctttttattttctcggactcctagagtccaactgcccagcagcacaacaatccgcttccactcgggaagcctagtctatgatgcccgtagacatcccgaatcacacagattcgtttcttgaccactcaggtcatccatctgccacataggctgattctggtaacgattcccacaccacaacaacttttcacaaagcacaggcaaacaaatctacgctacaggaaacacctcacatctgcccatgaccgcgggcacatctattcgaacagttagttaacctctatagagtgggtacactttacccacacgacattactaacccggatcgcccagcccgtgagatcagccacgtcgggagaccctaaggctttcatgagaccctaaggatttcatgacaaggcatttcgaaagccaacacagggttgccatatgccaacgagaggggtcccagaccgacaacaggttaggtctcagaccatattgtgccaggaagcccgagggttctacccgacaccaccccgttgaatccacatgtctcttggcatcaaggcttccctggtttgctatttactcagcaaggggcgtcccattgcacccgtgtggtcgcacttgttatatgctcggatgaatttcccacaggaatcggtccttatatgcgaatacgggacaatgccacataggcacaactcccgcatcgcgagttttcacaatttattttattttcaaacacgccgacaccacatgtcgggtttttcaaggtttctcaaacccatttcccaaattatcgacacacaacggtgtatgtggaatagttggtatacgcgctcagagagcacgaataccgaagtaccacaaaggtggagcgacaaggaatcacggtagtacagccgacaggaattagtgcgattactgggtaggtctatcggtttggcacgcaaatcgaggccaagcaagttaagtgtgtgattctaataatgtaagttgcaaacaaaataataatgattttccaattataggagcaattggtcaaaggctgacttgccttgctcaaggtcttcacaaagcttcacgtatcttcgagaaaacccgcgatcgacaaaaatccggtaaccgcaactatacgcaaacaatcaaaacctaaacaaaagaccaagaaaaagatcctatttagactaaataatagtgccattaaatagatctcgattttacagaaatactggaagtggaacggggtcaatcggacgaacggatcgagagatatgaattttggaagtttaatagggttttctggacaaggagatgatttatcggaattttctggaaaagaatattcccaagaatattctttaattactcattgacatgtgggaccaacaagggaggaaagatggacttatgtgtagggaagctgatttggtggagggggaaatatggacttgttgcatgtgtgttaggctcggcaaggaggcaggacatatgaacttcctttgtctcaaaaggccgaggaggggggggggggggacggctggtgggccgagcccatgagcgggggagagagaggaggcggctgaccggctgactgggtaggggcgggcccggtcaacgccacgcgggcagccacattggatggaggaaagggagccaggatccaacggctcgcggcggccgagaggcgccgacgaacggcggcgaaccggaggaagcggctggcaccggtggcgagaggaggaggaggggaagccattccacggcttggatcggggagaggatgcgcgacggcggctggcggcggcggcgaagctcgccggatgccggacgcggatgcgcgagagaagggacgagggggcgcggggtcgggcttagccgaaccaattcgtagttgcgacacgggggcgcgggacccaatggtcgccgcgttcgaactcgcggcggcgctatgcggcggcggaagaggcggcatggcgtgggagcgggtggggaggccggcaactggggcggcagtctgggaaggttcaagaggacacggggagggtcgcggcgcaaggaatcggcgagagaagggccgacggcggcggattgcggcggcggccatcgccggcggagaaaaggggaaaactcgccggggcaacgggagtcctattcactggggaaggagcttctacacggctccgggaactcgtttcaagcgacgggcggcgatgagctagcctagggagtcatggcgacggcgagcgacctccggaacagagcaaaggcgcgcggtggctacgacggcgacggtggagccgagcgagcgtctaggcgcgaggggacaaggacggtgaagtcgcctagagcctagggaggggagaggacagggggcgctcactgacgagagaggagcggcgtcggtggcgggcgtggcgcggcgagcgatagtggaaagtggttcggtggggagctcaccgacgagagaaacgacgtcggtggagtgtatggagtcgcggcgaggcggacgcgatggcggggcggcgtggcaccgagggtgcgcggccggggaagaagggagggagaggtggcgatgggcagcctggagctcctcgtcacgcgtccacgcatgcaccggctcctccggtgctcggcggcggacggcgacggcgagagaggggcgagcagcaataatggcgcggcggtgatggaagttcggcggcaatggcgcggtgggtgtgaggcgagtgaaaacgagagaggaaggggtttggggcggcttgggttttatagatggtggtgaagtcggtttggggaggaaactgacctatgcggtcaaggagcgggagatggtggtcgcgctagcttggctggcggtcacgggcgacgcaagagcggcagacgacgaggatgcaaggggcggcaaaggcggtcgatcgggcggtggaaatcgaaccgcgggagtgagaggagcagcgcgggctggcgcgggggcgagctggcgctcggtgtccatggcgctaggtgccacgcggtggagacagggcgccagtccgggaaggggagaaaggaaaaaggggaggaaggaaagggggctctgcccatgccattttgggagaaaggaggagggagagagaggctctgcctccgggatttgaacgcacgtggcttggagcgaccgagcatgggcggctgcggggcgcaggcgcggcggggccgacgcggcggcgaccgggtggttggccacgcgcgagcgcgcgcgcggatgcgagggcgcggccggattcaaacggcgacggcgggaaaccggcgctggtgggagagctcgacgagagagagaaacagagagagcgagagagagagggaggcgctctctctcggctcgggcacgatgcgcgtgctcagcacgtgcgaaggggaggggaaacaggctgagaggagggatgggccaagggagaggaattcggcccacaaaaacaaagggaggcaaaatagacttttccagaggaattgaattggagagaattggagagattcagggtttggattcgaattcaaatttgacattcgaactcgagggtttagggaggaatcaagggagactcgaggagaagtcaaggaagagattcaaaatgagattttgatatttttgggaacgaggacaagtatttggcgaggatttaaaggagacgtttaagtttcggagacttgaattggaaggaggaagtcgaggtggaggattttgatggtgacgagggtgaacaacgggagatagaattgagatccatggcacgacttagactctcacacaaagaacgaaattttcgcatataggattttgccgaattagttttttaacgtttcgcagaagcgtagcgttacaccactacaggtattaactcctataaagctaccctattgagatttcagagcccactctattaaaaacttcttgaggtgaagccacgtcatcgttattttacagtcgtaggatcaagtgatatgacgctagatcaagtgccatctggatggatacattcaacagccatgcacacaaacgttacgatgacccatcatgatgtacgacgagatgggctcccagcctcccacctatgacgttaatctccctgcccacctcctaattaatcgcgtggttagccggcggttcgagacgacaccacccctccacctatgcgatgccaggacctgctactcattcgcgcagtggttgatggcatacctcaaccgcgtggttcaagacgacgacggcggcttcaggtgttgagatccagttcggcgtgctgagatccagttcggctcacctcatccagtgcagattgcagttggtgtccagaaatgctaattttagtttgaagttttctttgttgctgaatttcacactaaactttaagtgatgtgcttctatgctcctcagaaaaaaaaacgcacgaatattaaagatggtgaatggtctatattaaaaggtgattaacaggctaaacgttattaggaagggcaatttcgtccttgaggtggttacccgtatcacgggcgttcaatcttgacgcagcgccgcctcgcctgtcgccgcactcgatcgcaagtacgagagaagaaaagaaggcattccaagattccaaaacagcgaatcctcctctgttgcagctacacatgtgcatcacctcaatccaccatttgattagcatccatgttcaggctacggttcttgccaaatcaaaaaatgagatgggtagagataagaagcatgacaagaaaaatcagaaaaatcagaagtggacgaaggcagggagcacgccgcggtagactaacgggaaaggcggtgtggcgagagaagaagggggtggctcagcaattagaatgccggcgatacgagtcatcaatttgtaactcctcatcggctgatcgagtatgtgataacttcatccaggacaaaactgccccttcctaatgacttttactctgttaagcaactttttaatctaaaccattcatgagctttaatatccgtgcgggttgttttagtgaggagcatagaagcataagtgttagttcatttcatatattatccttaagagcttcatcaaatcaattctattaaattcccaccgcaacgcgcggggtctcgtctacttactagcactttgatgccacaccaatcatccatgaggagaaggggaaacattttagtttatgaacattagagaggtgaatctaactagtatagacccacttgcctataaaagcaatgaagtaactatataacatttaatatttttttatgaaaaactttcaaatatagctatattataattttaatataattacattgtatctagcatttaattagattgcaacttgtatgtaactcgttctcatctatgataaacatacggttgtgcgcatggctaatgctgctagtgtgctagcaggccatcatgggttcaatcatatcttatttttctcttcctccctaccacgaatcttgaatcacatatatatgattgtcaaaattttagaagttttaaggggaaacaatctgccaattgccaaatgttttttctgagattccgtagaagtaattgtaatgtgaagattaattaattgattagccattgtgaatggttcatgtagagtttatactactatgaccttttacaaaagaggaagggagcactacatggatgaacattgcatgagcctttgccttctcgtctttcagcacagagagaatgattcagtcatgcagctgatcgacgaacttagagaagttcttttttttttcacgctgctttcttcagtcttcaccaactcagaagcaaagcttagagaagagacaacctgaaaaaaataaaccaacggatcatctgcacgagtagaccacgcagcggctgaatctcttggccataaattaacgggctcagcataaaggtgttccgttgatgatcaattaatttacgagcaattctacggtttttaagaaggtactataaggtacccaaaaatttagtgtaaaatttggtacctcatgacatctcatagtatctagataccaagaggtaccaaatttacaataaaaaaagtggtacctcatgataacttctcaaagaccgtacaattgctcttaatttgcaggtcgaagaagctgcgccttgcaagccaactggacaggaacatcacttatcactctgcaatcgctgcgtacatagtgaactacttcctccgtccaagaaaaaagacaaaccctgggtttccgtgtccaactttaactgtccgtcttatatgaaatttttttataatttgtatttttattgttgttagatgataaaatatgattaatactttgtacgtgacttgtctttttaattttttttatattttttttaaataagacggacggtcaaatattagacatagaagtcagggtttatctttttttttttacggagggagtagagcatactactccactatatcgttggttcctaggacgctaacatgagcagtgacgtcttgtctgaagcctctctatctcgagattgttcgtattggattcccaatgcatcccattctcaggacatatcgcatcgtcgaaccagcgagagagcgagacaacgttctatctctactcttttctcgttgctgctttccaacagacacagaaaggtggtcagggtttacttttttctagtgctggttctgcacaaaggagtaccgagctgtagcctaatttatgggcccgataggacaacactcctaaaaactaatttcccacagtgtaaatggcttcaggtggtagtctcaggctgtgtttagttccacgccaaaattataagtttaaaaaaattggaacgatgtgacggaaaaattgaaagtttaaagaaaaaagttggaatctaaacagggcctcatattttaatttcagcccctggtgttttttattttagtcatcacaattttccaatttatatatagaagttcaaattttaaactgaacacccaaaaatccagaaattaatataaaatctctcctccctccctcttctccccaccgacaccccaatcctccaccccactcctctccatctgtcgacaccaatagcgacacaactacctcgagctccactcaccggcggtcgcctctcctctcccatcccctccccggcagcggcggtagctgcattggcagcgatgcctctctccttcccggtggggcagtagcgtcacaggcggatctgtggtggagcggggcggcggagcgcggcagaggggagcactcgaggaagaggggagcacttgtgtcggtggctgatgggcttcccggtgccgacgcaaatcgatgcgtcggtggccgacggagcttaaaggcggtgtcttcccttgacaaaggccaccacctctatacccccatcgtcttctcctccctcgtcggccaccgtggcatgaaatctcttcccgacagagaacggaggtgaagaagaagaaggaaaagggctggatggggatccatcacaaggagacaacctcgccaacacacttccccaagcgtgccttcgctgttctcgagaccgggcgagtagaggttgtcacgccccgaactagtcccgaccggaactagcccgtgacgctccaaattaacctgttaatcgataccagtcccaggaaacagtgctggtatcacagggagacagaatatcacagcaacagaggtctctttattatagagtaggggtacagtcatgttgggccgcggacagatcccgagctcacaactgcattataaaaaggaaacggaagccaggacttggaccgaacaacacaggcgcgacttgggaactaggccgaaaccctaaaactcatcgtagccggcttgctcctggaagaactcctcatcagtaggttccgcttcatcttcttcagcaactggggggggattatttatatagagcaagggtgagtacgggagtacttagcaagccatgggaaataagtgtttaatgcaggcttcaaagaaaggctgttgtttttataattgattttatttgaactcttttctaaaaacaactaagtgagtgcttctcaaacgacacggttgagacagtgcgtctcgtccggtcggagtatgtgcaatgtatcagtctttagaattgaatcaaggttggcacccggccaacagcttttcaaacggccacccgggccaacaactttcaaacggccacccgggcctagctgatcccgtcagctgctgattttttcaaacatcgaacccctttccacaacagcaatttcacaagcagtagtcaaacaaaactacgctaggaatcacctcgcatccgcccatgaccgtgggcacggctgttcgaatagtttattagcctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccttgataagctagttactcagccaggggtgtcccattccacccatgtggtcgtacttgacttatgtttggatgaaattccaaggaaacggtccttaagtgcaagagcgggaaaccgtgcacccggtacgttccccggtccgcggttttagaaattcatttagttcgcaagcaccgacccaggtgtcgggttttccaagtcttttgtaaaagccaagttttacccaagttgttatttagattttaagtttgaaggcatccgtcgatactcgcacagagtgcacgagcaccgaggcgcaactgggtggttacaagggaacatggtataacgattaacaaaggaaggatcaaatgcaacaaattaggtaggtcccgccaatctgccttgcagacgagacaaacagattaagtgcgatcctatcaatgcataatatttttcaagcaacataattaaattcaaatataggctcaagatgttcaaaggtggcttgccttgctcgagatctggagcttgatcctcgaaatcctcgcaccgcgggtcttcgggctccgaaactacacgcgaaacgggacaactcaacaaacggcgaaaataaagccctattaatgacctctaagcgtgccattagatagatctcgagatttgagaaattttggaagttgaacggagtcaaacggttttacggttgggaagatattgaatttctaagattattggatttttggtcttaaggaaaaggatttaattaaatcctttttggaaaagaaaataaaagaaaggaaaataaaaggaaagaaaagagggagggaatatagacttttctcgggcggctagggcgcggcctaagagaaatggagcggtccggccgagctaaatgggctggccggcccaaggcggcccaagacgcgcgcgcgggaggcgaggagagagagagcgccggtggaccgggctcactgcgcacggtcccgggtgggacccgcttgtcggtgacacggttcaccgtgcggagcgagcacgcggcgcacgcgcgcgggcgggggagggacgcggtgcacgcgcgtggttcgcggagggacggatgcggtaggcccacgcgcagcctcacggctcgcggtggaacgcgcgcacgggaggggctgaccgggatcggcccgacccgatctcggacgagctggcgccgacgtggcgcctacgtggcgcctacgtggctgccacgcgggctggcgggaggaagacgaaggcgccggccgcgaatggacggcgggcggcggcggtttctccggggcgccttgcgacgatgaggggcgacggggcgtacaccgggatgacgaggaagaaggagagggagcgagccaacggctcagattcaccggagggagtccgttggcggcggatttcggcggcggcaaccggcggagggcaaagggggaaacggcgacgaggtcacgaggggccaattcccggcggtgagagcatttacgcggccacgggaatccgttgctagcgtcggattgggcggagctacgccgagcgaggccggcgacgagcgggtgctacggagctcggcggcgacggcggcgagcacacggcgagcgacggcaacggtcggggcggcgccggctagttacggggaggctactcgagctactaccgaaaactaagggcgagagatggagcgaggaggacgaacggatggaggcactaccgagatgaggaggggcgctgtgacgagaggccgacggcgtgggagtaatctctccggcctcgggccggggaagaggaggaagacgagcgcccggagtccccttccgcgtccacgaacgcaccggctctcccggcgcttggcgatgaacggcggaggcgagacagagctcggaaggcggcggcaacaatggcgatgggaggagaagagagggagggcgcctgggctttaagggcggcaatgttggtttggaaccgacttgggcggtcaaggcgtgagctggcgctcggcgctcgcgtccaattggcgacagggcggagggaggatgacgccggcgggaggaaaaggggaaaaggagggagggaaaggggggctcgcccctttcttctttgggaaaaggaggaggggcgcgggggcgtctcggcagagggaggagggctctgcctccgtcccttggcggcttgcgcgcggagtggcggggccgaggcgatgactacggcgatgacggcggggcggtgtggagcggggcggcgacacgggcgacaagcgtgggcaggcgc

SEQ ID NO: 69990 - DNA, 52313 bp, Oryza sativa
agggctcggctcggcgcgggcggctcacgcgcacgcgcgcgggcagagcgaagaggtaggggcgctcatcgcgggcggctcacgcgcacgcgcgcgcagcgcgcgggcggagcggatggggagaggcagagagggagcgcagccgggggggggggacagggccggggggagagggggagatgggcggagagaaattcggcccatcgaccccgggggaggcaaaatagacttttgcggaggaatttgatttggaaggatttggattcgggattgaactcgacgatatatcggggatttgagatcttgagatggcacggacactagacaacaagcaaggaaacaaatttcacaattagggtttttaagagataatttttccgctaggcgccacgacggaacgggcgctacagaggtgctcggagccctgcagaggtccgtgattctttgtagggtgatggcccctagccgaaaagtggttcggttcctacctggcgagctagggataccctccacggtggagcgttggccatggcctgaggagtactagctagggatgcagatcctctgcagtactgctgatgcaatagcagacactgactcgtgggtgtactgcagacaatccacactgactagctagcacttactgaaacaataaaactttacaatatttcctaatggtaatacatgttcgttttttggatgaattgagcaagcagattaatctagcgagtgatacatgtttgcacacaacattatggctgtagggagaaatttgatactgtaccattgtctcaacaggatttcgttggatttccactccctaaataggtttcggtaaactgccactttcaaccaagacgtctacgctgaagtgccatttcctccatttcttcccaattaaaatcattctttttccttttttccgttatttgctaaccaaaatacccctgtatgtccactcaatatgtataaacttgtgccattgtgatcaatgctaccaatattttccagccttttcgtatctatttaagatgcgtgcaaatgatgagtacaattgatcacaatggcacaagtctatacacaaacattaagactgaaatcttctataattaaagaaacaataaaattagattattgtgaataatacctctccagcacaaatataatttgttatttttgtttctttatctgtaaattgaatttcgatgtgcatgtttgtatagtggttttgtatcatctttatccatcttatcaaattttatgaaatatttacataattatcttgtaaaaaatgctttcccagtttcgacagttttcatctaaagttgaggaccaaagcacatcccaatgttttacagtgtggtgaagtttctcgatcaatgtggccttctctgcttcgcaaatccatttttctttggagaaagggagcaaagctctcccattttttgagggaatgaacagactgtttaataaataacaaccgacaacatccaaattaagtaaaacaaaactgtcattttgtttgatctaaaccaaaaaccatcacatccagtagacattgcaagtagagtgctgacatctaaccaacccctatcctcttgacttgcattcgtctccaggcaaatcttgagctgaaaacttcagcaaccacctgcagcgttccctcttgcaactttcttcgatcctcttccttgatctgtaggatggaccaagaattgatccaatatatagcatgcatcatgcattagttcagtggaggatccaaagataatttaatcaacgtagtagaaagcaacacatggtttcggcagcaacgctgactgacctgcggctcaggtttgctccggcgagcggcaccggcgccggccgtgcggatcactcacatcgtgtcagctcgcgggtgatgtgaaagagagagaacgacatggagcatagtagagcacggccgcaccgggctgtgatcagctaccatgtgaaccggagcaaatctgtattggtgttgttcatccctgattccccatgcatcccattctcagggaagaatggcatcatatctcgtcgaaccaccgatcgatgcaatgttctgctccgatcctaacagcggatttcttaccaacagagaggaaggagatgatcaggatatttacagttttggagcgaggcgagatcaggatttattgttttgaattgttgattcctgcctagaggattttgcctcaaaaagattctgtctagacgagcagtagctagcctgtgcgaggtagagtcttatattcataattttagtataaatatgtgaaatataaggtaaatttatagtttatcttataataaaacaagccgtaacaaattaaataacattgatctatctttttagtaagatgaatgattaaatgttatgttaaaaattaacggcctcatacatttgaaaacggaggaagtaatagctatagcactttcagtattcagttcagtgccacaccacccagacgagaggtgatcgaaaggaaaacactgcaacgctatgactagctaatagtactatctggttggatttaaagtttggaactgacgaacgatggcaactcgaccacgagcaattaagcagataagtcaatcgtgtcgttaatcatcgacgctaggtgtaccatgcacgagccactcttgttgcgttgtgtctttacacatgcagacagtattaacaaaatcagcatcagtactatctgacgctatttcaacagcaaactttttgttttttgaaaagattagacggcaagggcattgccggatatattagaagagaaatagagtataggctacaagcagctcagttttcctgggaaggagaaaccgaaaggaaccgaaattacataaggtataaattctccctgatcaagaaggctacttgcagcggcgaaagcgatttttgttggaagagacgccaatttcactctagccaaacatgccaccaggaaattagcagcatccctacaattttcttacgttcacttgttggtctgatggtagccagatactccatccaatccgcaattgattgggaatcggtgtgcaagtgttggtagccatgcaacatgactagtagaaacttgtgaggggctaacatgactagtagttcctcagctggagcttctgtaggatcaggttgttcgtttcaaattccccatgcatctcattcttagggcaccactggtttctcacaaatcagagtaagggaatggtctgagatttgcagtttccgaatgcctggtttgtccagagtagtagcagccttaagaccccctgatttatagatgggcaaatggagctgaaggggtactagtacttcattaccacaccaattaacaaataagaggagaaaggaaaacattattagtctctaaatatatactcccttcgtccctaaatatttgacgccgttgacttttttaaatatgtttgaccgttcgtcttatttaaaaacttttgtgaaatatgtaaaactatatgtatacataaaagtatatttgacaataaatcaaatgataggaaaagaattaataattacttatttttttaataagacgaacgatcaaacatatttaaaaaaatcaacagcgtcaaatatttagggacggagggagtattattagtaatgcacatttttttcatgtgtatataaccgaagtatgaaggatatgtatcaaggtttcgtttttgctatatttctaactactggccaaagatgaatgctcgttcaggtgaacaaacatcaatacacacatgtggagatgagtaatagggtgaactaaggctgaatatgggaggtggagttcacacggaaaatggtgttatccattgaggcgtgaatttaggggtggatagcgagccggctcggctcggctcgttatcctaacgagctagaaaaccagctcggctcggctcttttgaaagctcgagctaactcgttaggctcgcgagccaatccaacaagacagaaagaaccaaggaggaggggacctgcgaggctgcgagtgcgagtgtgcgacctgcgccggctggggaagtgcagcggcggcggccctcgcgctggctggggaagtgcgatggcggcggcggtcatagtggcttgcggcggcggcggcgcgagctcctggcgacgccggcggcagccctagcagcttgcggtggcgtcggcgcggtctcatgcggcggagccagagagagagagagagatgcggaattgcagatgtgcggtttcgacttctcgtctcgtgtgctgcggcggatgaggattgaccgagtgaggagaactagggttttgcacttttactattgtcttaggcttgggcctgtgctattgtattgggctgggccttcgcggttgtctgatgaagtcctggctcgttaaggctcgcgagccagctcgagctggctcgttatccctaacgagctaaaatgccagctcggctcgctaggaaaatcaaacgagctgagccgagccgagccaagcctgtcacgagtcgagcgagctaacgagccacgagcttcctgtccacccctacgcgtgattaattaagtattaacctaaaaaattaaaaaatggattaatatccgattttttaaagcaaatttcctatataaaaattttacaaaaaagtaccaattaacagtttgaaaaacgtgcccgcggaacgagagagatgtgagttagaaaagaagtgagaagaacacaacctaagtagcatgtacgctaaccggtcactagttattcagacctgataatcttcatgtatcacataatcaaagttgtgactttgccgtctgttattgtagatgtgaaatgttgtgactgcttgaaaatatggaatgcgtttcttctcagtgtctcaaagacaaacgtaacaaatgctgatgagaagagtcggtatctcaatatcgaccatctcttagcgatacgcaattttcatctacaggtttagaagttagaagtgaagcccatcccaaggttttacatttttttttcatgttatcttcacaaatcctagaaggattgtacataattcctagtttttagaccccaatcaaaatcactggactcgtactttccaacgcacagtacatttcattcatttttcctctatggaagatgaattacatctccgtgtctgcatcatatccaaattaaatcaatagtgagatttttgttttaataatggacatttaaattaacaatgaaatacataagctgtataaagtaaactaagtttgagtttgaagtacaattatagttgtttggcggcttgaaaaacagtacggatcattagcacataattgtacgctgtaccataaatgaagtcatagggtactcaatttgcactagaaattttggtaccacttaaggactttaaaatttctctcaaattttatactattttttttatttgagatagaaaatatgatccctccagaatgataaaattactcctaaagacgaacatagatgcaatgatgcagataaacagccgtagagtggtcggaactgccatatttattttcaccactacagaacagatcggtagccagatctctaatatctactttcaattgtgtcattaaccatgttaattgtatctctaacaatatctctttgttgagacgtgtttttacacatgtagatagtaacagagttggtatcagtaatacctcagtgcttcaacagcgtgctgtttttcatttacaggttcagaagggccacacgctacacggcgatgttatcctcacaaatcgcagaagcaattgagcaacgaggatagactgatacaaggagcttggtggctttttcccaacctgccaccgtttctctagcaaggctagaaattcagaccacacgccgataatttcatatgcttgatctgcagacaaaatgatctaaagcacaacacatgtcgactggatagtgaattggtgagaggctaacatgactactgctgcctcagctagacattatctaggatcaggtggttcgtttcaaatctccaatgcatcccattcccaggatattgcattgcattggtgatgcatagcatactgtcatactgagatggccaggatttgcagttctctactgctggttttgtgtagatgagtatatatataattcactaacttagtataattcactaagttattgatgggctcttggattagagagaggcactcattgccacaccaatttagacaagatgagaaaagaaaatcttacaaccgtgctatacatacgacttcagtgtatgactccatcccgattcacacatctaatgcaccccgtactaccatcagggcataggggttatgggcaaaggattaattaatctacgctggagatgcattgtcgtacgtctcagtcagacgaggcaatcatatgtgtagcattattcaaaatcttattagtctttgaacatattagctcacagtttgtcatgactatataacagaagtataaagaaagtattgaagtatagtttatattcctagagtgaattttatttctctgtgtagaggccctaacgagaaatattactgggaggtgaaaaaaaatacgttcgtttttcctgtattgctcctagccaaagatggatgctgtactacggatttcacagtctcgatcaatttgattcaggcgaacaacatcaattcaggtcctgttttattgatgcaatcttcacttggacaaagtctggagtactagtagcttgctcataggtgttgtgaaggcacatttggacccaatcacaacactggaacctatcgatttattttgaaaaacaaaattacatatgaagtcattgtttgaatattgtcaaatcactatgatttcttctccttgttcgtagcatactccgatcagaaccaaatttatttgtcgatcgaaccaatccacgaagcaactatgaagatttctttttttttaagatagagaggtcgaagcctctcccatttccattaaagaaatgtacggtagttttacagacttgaaggaaagcagcaaacggaaaaaaagaagaaaggttttaattgctaacctctagtggaatgccatcccatcacactttcagctgcaagaagaaaacaaaagaaagtaattaactgaataacagaagctgctacatgcgactctgaagattgcttcatgcacaacaaacgacaaaacataactctctataatggcatcaccaatatatatggcaaaatgatccatatagatgagacccacataaatagtttatctctatgtcaatgttcacaatgtatatagatacaaggtatcattaggagaagagagaggagtaaagatagataatataatttattccatatatatgggtagtccatatgcatatgggtatcttttgttattttttttatatggactagttgtacaatggtaataggtggctgaatggaatattctattgcttatggactacttttacaccacattgtggatgccctgagacatttttgcgacagcaaacagcatgtcatgtgtttccggcaatttttcttctcttgcaggtgaataactgtgaagatacaacatatttctctagattttctagatgatcatgttaagcgtttggaacgaattgaccaatagataatagtctgctattggctattaacaagaacgataccacaaattaaccaataaccatgtcatcaccgtccggtgcaccccgtttaactcaaattcccaatacatcccattcccatggtatcttgtctttcccaccccaaatactcccccacttatatattagctctctgccattacacaatcaatatgagattatttgatgatatcccccttcctacatcagtgcattgatgagctttcacacaatgtaaattctacgtgtggttttgatctaaaatagattgtggattttagatcggctagcagttaggagggatggccatacagcgagacatgcccctctgtcacaggacaaactgagttagcgagtcgtcttcttatctattaatgtatatatactagaaggatctagagcctgattgccgcctgggcggcctacaagcaactgctacctggtccattgatttggtgatttaattttccaacttgtagatgcattgccgatcgattgcgtactaagcgccacaagatcatgtaaccatcggatcgtatcaacttcaagtctggaagctcgctcagctcgtattccacatgcatccaattcttaaagcattgcatcgatcgtcgaatcactgaaataacattctactatttttatttttatttttgcagggaacattcgactcatttttacggctgctttcacatcgtcgaatcatttgaaggcaatcagatagttggggtttatatagttttagagggggcacctagtcggcgcgtgtgcgtccccggtgcacgttttccgggactaaaaggtagttaactaatcaattagttttagataattatagtttgagataatgatagtagtagttaggattttctttttccacgagatttttttaactaataaattgaaaagaaatctatatttgaagtcaaatttttaaaattttaaatccagatttaaaaattttaactcgaaatttcaattttttaagtcaaagtttgaaaactttcaacttttcatctcaaatttgaaaaactttcaatttaactttgaaaacttttaaccctgatttgaaaactttcaactctgattaaaaacttccaaatcggatttgaaaatttttaagttaaaatttgaaaatttttaagtcaagatttaaaagctttcaactcaaaacattttaaaaagccacgtgtgctaaaaagattaaaaaaagtaatcagaaaaacacgaaaaaaagaaaaaaacgaaaaaagcggcgtggggaggagcgcgcgccagcatacgtgcgaattagctctcgcgagtttccgccgagaggacctagtagcatgcagcactcgaggaggtatttagggcctgttcactttgatgccattttcaaccttaccaaatttttgtaaagttgccaaaaaaatagctacatttagtttgctgtcaaattttggtaactatataagaaatcctaccaaaattttggcaagttgccaaaattataccaaaattttggaaatgccaaaatttggtaaagtttttttttgacatcaaagtaaacaagcccttaattaactagtactcggttagcataggccgcttggtttagctatagctcggacgaagtggtgatttcaaattgtagaactgaagtgtttctttttgttcatactgtaattgcgaaaaataaatattataagatgacgataacaactcagcacagtatcatctcggattggctattgggcgaacgttcggtacttgtccatcacgcgaacgaatcaggcaggggaggataaaaacacgtggcgatgcgcaacaggctggtgcggtgtgtcgctacgatatatatttcttttcctaatttcctgttttcttttttatgtgattcttttcaatttcccgttctcctttttttacattaattaattctcccgtagcggtatgtatcaattttctgtttttccattctttttttttcaattttttttcttatagtcatttttagcttttttaatggaaacttttttatatgtactattttcatggaaactctctgcaagtatgctttctatatataaactttctatatatagactttatatgcataaactttatatatatagactttatgtatataatttatatatatatatatagactttatgtatatacgctttatattatagaatttgaatttataaactttataataaattatatttgtatgtataaatttcagtacaaataaaaaaatataagcatcactagattttgaaagagatttttttcaagaaataaaatctagtctgaacaatttgttaatagggaaaagagattggttggtcgctaacagaaataacaaatactactatatacgagctgaaacagtcattagaacgaataacgacaaaacctattaaactgtccgcgagatgcgaacgttcgacgattagacccaccctcgtatcatctccttgacggatgaaaggtgaaatcctatattgggccactgaatttggacagctccaaattagcccatccagttatggctacaacctgtagagctcagcctagtcctgccgtcctggtatgtttgtcaagggaaaaatgtccacttgagatctctcaaataggagccaagttttcagaaaaaccgaatattgaagcatcctcaacttctaaatcagcgcaaattatattaagtcccaccgttattttggacggtggttttcgctgatgtgacgtgttgacccaattatgttctacgtgacgcttacttgcttacaattagggggggatccatgtgtcattgacatctaattcttcctcctccatcccttctccccgccaggggatgcatcaacgatctacgttgtcaatacccatatacatacatacgttggaacttgctgcttgcattatcgcatcaagaacatcatattggtaaggtttgggatttttgcgatgcttgccgtacatcctactccggcgagcggcggcggcaacatgagcagcagcaggagcggcgcggcggcagcgcgagcagcagcaggagcagcgggacgacagcggagtgagcggcgcggcagcagggatggcgtggagcaagcggcgcagcggagaagagagagagaggggtagaagatgtggaagagagacaggcagaagatgagggtattttcatccaatagatgtaaaatacgtaactcgtatctcagtggcaccactaagaatacaaacaagtagcagtggcatcgttacaaatatcaaatagtaatggtatatatatttcaaaaccacaaaatttttaatggcatggatctaattaacccttttatgtattacttttcttctaatgccacataggcatcacatgagatgaagatcagatcaacaagacgccacatcagctaaaaccatccttaatactgtcgacttgatttaaactagtattaataatcaaaagacttactatatccgattttacggttgaaagagaaatgaagcttgaccaatattttaggagcctaaagtggactcttctttttctttgccaaatgaaaatgaggcgcatctagttgacccactgatgatagcacacttatggctcaatacgaggcacatcccatattgctaccaatatactccctatgtggccaaactaggagggcagtcccctcctaatataacaaatctgaaaaaaaaaagctgtctaaattcgttgtaatattggtgtttttagaacggagggagtagctctgattcacattgttaatcgcgccaattgatcttgttgagatgaccatcttacgttacgtgtggtgtcctagtgcctaaccagcacgacgtcggccgccaccgtttcgccagcaaagtagtacgctgaggccgcgcaccaccaccgtacgccgtctccggcaaggtttgctctcgacagtctctgcacgatcgcggctgctgctcgtccgatccaagtacggcaattgccgcgaccgatcaaacgagctaaaccgctgcatttgtgtaggccgtggatcggtgaagggctgacatgagccgtgatgcgtcggcaggagcctctacacgacatggtcgttcatctcgaattccctatgcatcccgttccagattgttacttataaccaaccatgcaccgagagacaacgtatatatgttctagttctacagttctactactgctgcatttccaacagaacagaggaaggggatggtttggttttccagttttctattttctgattctatacccagagttgtagcagcaacactagctagcttatttatatatatgggtacttggcgaggtactacctccatcctaaaatgtttgacgccgttgactttttaaaaaatgtttaaccgttcgtcttatttaaaaaatttaagtaattgttaattctttttctatcatttgatttattgttaaatatacttttatgtatacatatagttttacacatatcacaaaagtttttgaataagacgaacggtcaaacatgtttaaaaaagtcaatgatgtcaaatatttagggaagcagggagtataggtagatatgctaaagttaattactaactagcacttcagcgttacatcaaccagagaggaggaaggcaaacattaccctctaagcattaaccagtccctcgtattttgttacacatttaaaatgaaatatagggaaaaatacagtttatatttcacggccaagagtgaatttatttctctgctttgaggcactaaaaagaaatatcattaggaggtgggaaaacacattcgtctgtattactgttactgggcaaagatgaatgcactggctttcacatcctcaaccagtcaacctggttcgtgtttattattgtttgaatgatgaggatgaagatgaaaattaagtgtttcacgcaaaacgaggttgtaataacatgtgattaattgagttttaattattctaaacttaaaaaatatattaatatgatattttataacaactttcatataggaagatttcgtacaaaacacaccgtttagcagtttgaaaagtatgccacaagtatccaaaatttaatccaacttttgttggagaaaataatagggcacaaattgtcgttcggatagtcaggaggagtggcttcatggcttcatattatcgtattgtatttgatcctacaaggaatcataaattcccaatcttgagttttagtcatggctaataaattcacaactaaaagatgcaatattatatcatgtttaagagttatgatatttggcttaaaattgaaaatccaaatgaaattcctactcagatcaatattgttgctataaaaactgattttaaaatcaattgtaaagctcgccaaattttttttaatggtatttcttattcggattttgaccgtgtctcacatcttcaaactgctaatgagatttggaaggttttatctaattttcatcaaggaacttctaacatcaaggaattatacaaatatgtttttaaaagtagtacatgaaatttgaaatgaaatatggagagactttagatgattattttgtgtgctttaacaaagttttaagcaatcttggatctgtagattgatcttacaatactaattatccctaatataaaatttcactacatcttttgaaccgtcttggtatgttaattaggaagatgaaagttacatcaatttaagagtctgttgttttacattaaactcaaaacccatgacatgaatattctttctcgtaaagttgattttaagtctaatgttttggtttctttttcatcttctttttatgattgctcttcttcatcgacacctactgtttttactgtccttaatgccatgtctaatgaccaactcaagcaattcgttgggaaggacttggttgtgcttattaacaagttgtcttgcgttgtgaataatattaggtttagaatgtgaagagctacatcatacattcggcctgattgcccaaaactaggaagaactaaactgtggggtagactatcaacaagcatgcatggtaccacaattttgactctactgttgtgtgcagatactgtttgacttaaattcccagtacatcccattctcaaggcatattcgaaccccaataatgcgcgcaatgctcaactcatgtcatcttagaaggaaaatatactcaaaaagaagaaggagaaggaggaggaaggagattaccaaacttcaaaattttcatatgttgattctgacaccggccggaaaggagtagggtgtatatatatgtatatatatatggttattggtcggtgtagggaagtacacatccaagtgttttaagtcctaaaccaaccactcaagtgttaaatatagtacagtatgttcatcgcacaaattttgacaatttgaccctttgcaaaaactatttttacaaatgaaccgctgctaaaacttgtttcaaatctgacccttttgctcaacgccaaatcatgtggcgctgagcttagacacctcagcgccacgtcagctagcgctgaatgccgtgccacgacagatgggagactaagtcagcgtgccaacgtacattcagcgccatgctatttggcgctgagatgtctaagttcagcgccacacgatttagcgttgagcaaaagggtcagatttcaaataagttttggcagcggttcatttgtaaaaatagtttttgtaaagagtcaaattgtcaaaatttgtgtgttcatcatagaggtaagtgttctgaatttatgactgcacggtagtctgcactatggaatgtgtttctcatcaaattggtgatctaggtgtgggccactttctcaaagacactaaatggagagatataaaaacggacggaaacaatatatcattttaatgaaaaagattatggtccaatttttttcttgttttttagataatggattaaattaacctagcctctacatcccacatggatgtgcgttgccaaagaatttttatatttaccaatttaactataaagtaacaataggatttggtgttaaaaaaattagaagaatcaaaatttagagatggaaactgtggaaaatggtacccttttatggaaacgagatctgccacagttttaaccctaaaacaaacacggtaaagacggtcggtaattagtgtgacttcgtcaatatatcggtttttcaaatgtgctcttaaagataagatgtgcgtgtgcgcattcaaatgggtgagtgcgcacatgttgtttacgtcttcaacaatactcaattttactttaaggtccagaacaaaagcacaggttttacatggtagcatggtgaatttttttaacgtggtttttgcaaaaccaaaaatcaatatagaaaatgacttgattttggcaacaattggcagttcgtcggtaccgcgatgcaagggttggctgaggtttgtgactggcgagtagcacggtccatggtggcatggtccctcctgctgcagaagcctacggcagcaacactccaaccacctcctagctcttgtgcatagaaaacgaaatgtagtagagcataaccaggaccgcattttcataaagctaagatgaaacggagcatatgcatatcgttgtctttcatatcgaattccctaccccatgagtcctattcccagtgtatcgtaccttatctcgaattgagtcggtgcatcgagctagcttttttgatatgcgtgatgtgtccttactccttacatacgcagacaataacagagtcaatatctatatatcgataagtaatccaccatgtttcagcagcacacaattttcattatatttacagcttcgatgattgtatgctacacatacatatgaccatgcatcatgcgggaggtgtcctcagggcatgcggctttcctgttccctgccatacgcaacaggaacagggaagccgcatccgacacgtcataccatgtgttggtgtacacgtcataccctgtgttggtgtataacgccgcgccaacaaaggtttgtgcgtgacgagcggcaatggtcgcagttgcactgctcatgcgagccaaagatacatatcactgtggcctttcaaatgaactaaagcacatcatttgcttgggccatggatctgcgagaggctgacataaactgcgatgtcttggcaggagacgctcacaagattaccaggcatagggaattcgagatattaaaaaaattgataccccgagttacataatacttagaggtataaccttttacaaattttacatcgtcatacaaatagtaaaattaccctcataaattagagaagcaacgtaagataatcatatgacttaaacctatcatttttttttttaaaaaaaggaaactgcgtgtagagtcattgtagaaatcgtgtctatctttgataaatggaagattcttgccaatgataaatggaagtttagtgatatttgttatctttgtctttaggttagaattctaagtagttttctcttttttcatcaagttaattcgtatttattcgacatgcaaccttgtcttaaagtaaaggccagaataaataaaaaatatatttaaattacttaactagttaaggaaaattcttaaaatttcgaagcaacataaatcgttgtttgaattcaatatatacaagttgaaaaaagaaataaatctgactattagtagtgcttgtactacctataattaaattttattttctcgatacatagattgggtttggaattattaagatagatgatcacttcaaaaaacagagtttttataaactacttttgatgacatttgagagcttagaacaaacatttgaggggatatcccttcaagataagaaaccatctcctacactgtttctcctccaaagcaaactcaaatcaaaaccaaatttgacgacagcatcaatccatcgaacaactctaaagaaaccttcctttcctagatgaaccattctgggtgattcaggaagaactgaccaccgaacaataatgccccacataggactatcactttaaccatgctcttaaccacagtgttgaactcaaattcccaacacatcctattctcaagacatctcatgaacaaactaccaattaatataatacttgactctagtcaccttcaaaagaaacaaaggaaggagattgttggaacaaaatccatcggagatcaagcaaagggaaagaagggatgtagttgttctctattcattcatcgtccccctgaaagggggatgacattcttatatagtagtacacaagtatgggagattacagagatagccctactggacctgagctagggggagaggctgtaggtcaagggattagaaagtgaatatcatatttatatgtgggtattttagaaactactatgaaaattaattttcacatacggttgttgacatgtagacaataaaagagtcaacatccacatcttggtgttcgaacaacaaccgattctcatttacagaatcgaaagcattacacgctaaaggttttctttgatgctatcttcacgaatcgcacaagcagcctagctagagaaaatcaaacgtcattgctagatatatagtaattgacaatatcatcttacaaggcaaaatcgtcttacaaggcggggcctgcatggcagatagcattcgctgacacagctgcatatgcctgcgtatgcatgctatttttgtataggattgaacaagaccaaacaaacctaccagagaaggggtgaattatagggaaaaccaaaaaccaaaaatcttttgcgaaataaaaaatttacttcgaatggagtagatgacgaacccctgtacgtagctgctggtcaaaccgcctcgaagccaccggtttgactgtcgttgtttgacggtcagaccgcgcatacacccgtggttaaaccgccgatctcccgccggttagatcgccgccttgccttcggtcaaaccgtcgggacacagaaaacactggtatatgacaaacttgaagatgtagattgattttacatgttgcgtcccgaggcgaccgactacgcctcctggctgcacatgccagaccggctaaggcttccacgtgacgagctgcacggtgtatgctgatgacccttgcaacccgaaccgggacaacgccttttctttgttatgctctgcacataaaatgaactagaacacagcagttgagtaggtcatgaattcgtcagaggctaacatgacctgctatgcctcaacacgagtctctctgcgttgaggttgtttgtctcaaattccccatacatctcattcttagagcagtagtgcatcatctgttggtttccaaaaaaaataaaaagaatagcgttttactttttcagtctttctcacaaaacctagaaagcagatggttatagtttgcagttttatatatattgctgattctgttctaaggagcagtggctaacttatttatggacacttgaattttgaagaggtactagcacttcagcacaaccagacgagaggagaaaaaagaaaacattactctctgaacatttgtactccctctgtcttaaaatataatttttgatgaatgtgatatatcctataagtatgaatctggaaaagctttctgtccagattcagtcataagatatgtcacattcacttaaaatctcttatattttgggacggtggaagtaacaagctaataagacatagtactaggaggtggaaaaggcattatttatgaccaaagtacaaggaaaagacagtatattttactgtttatagtgaatttctttttactgtctatagtgaatttctttctttctgatttaaggcactaatgagaaatagcactaggaggtggaaaaatattttttctatgatgcttgcaactggtcaaagatggatgccgtggcttgcatagcctcaacttgatccaggtgaacatcatcaattcgtgttctgtccacgcgaaaaatacttctgtgctcaaaatggtttgttctatttttatcgatgcgaggagtggctttcttcatcggaattgtgaaggcgtaggcacattaattgtgccatgccaaaaccggtcgcgttggttaggagcagcttaaggtagattcaatcacccgactgaaaaacctgttgattatttgatttacctcgggcaactgaagaagactgctgcagtcatgcagatcgatagtgtccagaggtccgcagaggccttgggcgacgtaccagccggcaacaattcttcactactacagcagaacgaggtgatcttgcacatgtgcttcattatgcatgacgggctcggctgaggatcgcgcacgacgatcagaatgtccgtagctcctgtctcttgcaagcaaaggcgccaatcgcaacgccgatcaaatgaactagagcgcatcatttgacgaggtgttcaatctgtgagggggcaaacatgactatcgatgcctcaagacgagctttggttggtcactttagttcatctcgaattccccatgcatcccatcctcagggcatcgtatcatcgaactaccgggacaacattctactactccagcttcaattctcaccgctgattttctcataggcagaggatgaagagatggtttgggtttatagttttctactagtgctgggttgcctgagtagcagcgacaactagcttatatatatatatatatatatatatatatatatatatatatatatatgaagtgacctgaaattaccagcacttcagtactctctcaagagaaacaattgagtagtagttagagaaacccatgcaagcattttctctgggtcatctaggctataacctgcagaggccggcccagtttcgttatctttggcaaaggaaaacgaggcccatctatgcccatcgaattttgggcctaccgaaaaagatatgcctatcataaaattgaccatagaattaatccacactgattttagcctacacaagtaatttccatgggaagatagggtgaaaacagatcagattcgaacggatggtcgtaccatattctaaaccatattttttaatggtttcggagctggtacagatagtgtgcatatgcggattgtctcagatgtcaaaaatgatgcggactcagttcagaaacggattaaaattatcgaatgttacatgtatatacaatcaacacgacatcaacttagcaatacaataataaatgaacgatcaattgtaagtactatatgtttaagtgctaaaaaatgtgaatacatgatatacataatataaatatgcagttatgcaagtgaaagacgacatggtgagagtcttactctaggcagtctaggttaattgatgaattataatatttgatagttgatacaaaatcgctaatgcacgatctgtcgctagaatctcagcgtcgtgatcagtttcctttccctttttgccaggcttgtgctcctgaaatcttctctcttttttttaccgctttttgtggttgtttctcttttttttttttgtcaccggtttcgatggtaccaacaagatgtgcatatgtgcagagcaaaatttgtatgcggctacctgcgtgggcctgctttcggccgaatagaaagttcataccatctttttcttttttgatttaaatccatctatggaaacttttcatatctaaagtttatgcgtataaaatttctagatcaaaagtttgtgtgtataaagtttgtatctgtaaagtttatacatggatgtttgtatgtcagaagttcttacatacttcctccgtttcataatgtaagtcattctaatattttccatatttatattgatattaatgaatctggacattcagattcattaatatcaatatgaatgtgagaaatgttagaatgacttacattgtgaaatggaggtagtagaaaatagcacgttgtgatccaaaaccacaacctaattacacttagatgttaggtcaccccagaccactaaaaaactagtacgttttattagggattattgggcaatagacatcaaccaatgcagacaactatatctaaaactgaaaagaaaaacaagcgcgtggatgtttatacaattatacctgaaaatgcattaatgcaatcgtacacacgggcattaggggtacccgtctcccaatgcgatcgtacaagcgggcattagggcatgtacaatgacgtctaataacgggctctcttcattgtcatgccagtaaatttggtgacgtggaagaaagagaggaaaagaatacatcgttgctacacatgacaacggctcagagtcgactgttaacatttattaacgaaaaaattgttgcaagagggtggaaaaaaggaaagaagtataataaaaactatttagtgcattaattaatggtttagaaatcttattatctctactattgtaggaggatagtctctagtgacattaattagtatagagagctcatattagactctacctttgtacatgcccccgtctcctttccctctttgccagacttgtgtgtccgagatctgttttttctttcccgatcacgtattccgtgtgcacgtgatccctcgcatattagagctacccaatttgatgggccgactcatattgtatgcaacatatagaatggttacttatgttaacaattttagattatctggcaaatagcctaccggataatccgcatccagctgattttagagataccatatccttatttgcatccgcaccacactacccgtatccgtatctttatccgccagatttttataaactcataccatatcgtcatttcgaatggattcagagtagatcaaatatcatccgatccgtttaatgtggttatgtgaacagttcgtattgagtttggagtatgatcgtttaaagaaatgtcctaactaagcggagcatctttccatatcacacaagcaaccactaccacagaaaagcaaatacaagtcggtactatagatgccggaagtggtaaaaccggcacatatagaactttacctgcccgcaccaaaccacgtgccagccagcctgcaaaaagcaaagaaccggcacttttaagcgattatagatgtcggttctaaagaaaaacggacacaaataccataggtgccgttttttaaaaaaaatcaacaccctgtaaaatcgagccaagccgcacaggggagggtgatattttcaagccgttcttatccatctggccccacctctctctctctccttccttctctttcttctcctcttctcctcctccatctctcgcatgccctcccctcggctgtcttgcacgtccaccccacccagcgtcagcggcgacccgacggtggaagcggcggcagcgcctcccctctgccagatccggacgggaggggaggcgtcggcctgacacgaggtgccagggcagaggcggcagcgcccttcgccaaatccggtcaggaggagtcggcgatggcctagtggcaccctcccctctatcaaattcggcgggagggggcggcggaggcggtggcggcagcgtctcccctctaccagattcggcctgttataaaagcagccccgaaatcacatcggaaaccaaccgcggaagaaacgccataggagatccacacacgatgacgacaccgaggcacgatatttgataacggagttcagccgaggcctacatctccggggcactgattacgggcgctccttcccgatccagcatatacagcgtatcagagttacaacgactcacagccggtcgccgccggcagccgctccctctcactatgctatgtcgccatgcggttacaacaggcacgccccctctatttatgagaaatcctaggacagaaaccgactcttactctagtcctatacctagtacaactccaagtcctaaactgtaaccgactatgtacacatattcgacataaactctaacaaactccaccttggcgaatatgccatgccaacctgaattcgttacttgctcgaacctccgtgtaccaggacttaagttgatcctttttcgccgctcacaccgagctgcctcgacaagcctccaccaggttcaccgtaaacaagagactccactatacctgcaatttcttcctcctgactccacctgcaacagtgctccaccttctctcatatcatcacagtcgtcttgccaagcgaaattgaattccttcctagctatcacgtcatagacttcccgaagactatgttcacctccatctaccatcttaaatttgacttgatctaatccatggccagataaccgatgtcatcaccaaatagataaatcaaactcactagacttgaagagaaccctttcttctttgtcgtcttatgaaccgaactaacgaatccaacatccacgctttccgcatccatagactgagtatccgataatttgagaagatcattgttgccttgaatcacccgaagaaattaccaccatagcatttgctcttcctcttcagtgacgcagattccatatatccccatcatgcaatccccgcagatcctggatatatcctgtactaccaaacagctcattgacgccctcaacgattttcattcgctgttgcccgggattattttcacccactgaagattgtctttaccgagtcgtaccaacacttggcatcttactgccttgctgcatgcatcaatttcctttgctttctcgcaaatgccatgactccacaagatccaagcatgtgtatttgacacacacgcgtgtccttccctcagatcttgaactggccaaatcaatgcacgaatgaattaacgttccatgcagcccatagcctcgtcacgtgcaaagccacaacagactcaaccataaacagcctaaccagcggaccgaccggtcttttccttctccaaaaaaccaactggtttttctatcggtaagacccagtcaacacagaaggaccagatcgaccctcttctcgctccttcgctcgcgtctcctcggcccaagtgcgccgccgcccagcgcctacgcgcctcttcccagccgccactccttctgctgaccatgagcaccagagcccgtcgcaccttaccactcctccgcgtccccaagaaatagcgccgccgctgctactgccgcagcctaggtttctcttcaacgctgtcgcccgctggaaggcgctgccacgcacgggagctggactcccttgcgccgcctcccctcaggacttcgccggtgagggcaaccaccgttgcttccgccgtgggtttcctgccggtgaggatgccgacgcccacgggagccacctccccgatacaggagcgtcgccgccgccccttcgccagtacctgccacctcctcgcaggagtcggcccgcgtcgaactcgccggcacctgcacgacgactacaccaagccgtgctcctaccgctcgcagttcgtcgcccaaaccccccgccgcccaagaaatcgggtacgatctcttcgttgctttggttggtttgattcgattgcaatctctgcaatcctgtggaatccctgctgcttctattttgggtaaaacttgactccgattccaaaacgaatacagtcctcgtccgtgccatgtgtattgaaatcgaaccgtgcccgactcctataccatgacctccaccaagtcaagtcctgcatgaacccagatcgggcctgctactaccagcgccgcttctgtctccgtcgccggcacgcctcaacgcaaaatcgtgcacaccaccacgaccctgacctccaagcttcacgtacgccagcaacatcctggttccagagcaaacacacacagcacgaccaccgacatcgtcaacgacttctgccgccaatatgtactgattctatgctgacgcttctctgttctaccatccatcgcatgtacgctgctaagtagcaatcctccatgcagtaccttgtcgttaacacctccaaaacagcctgtaggatccacccgctccgactttcgattgaacgccatcaatctagtcgcgaaccgaagccgacaagtcgcgtgtcgtcttcccagccgccgaatgacccgagtgctacatctagccgtctccctgtcgaacgcagctcatcgaaaggcctaggccacccgcccagagtgttcgattccaccgatcgagaacgccaatcacctccagcttcaatcaaccccgagcgtctggccagccgctccctgttgaaaatagctcaccggaaagtttgagccacccgcccgaagtgttcgacccaccaattgaattgccaatcgcttccgccgccatcaacccgagcaccacgtctagtcatctccctgttgattgcagccatcgaacggttcagaccaccgcctgaaatgtccgattccaccgatcaaattccgttgatcgccgtcgtgctccaccttgcgtccatgtccgtcctggacaccctgtgtagtcgtcgcagcgtggagcaccaccctcgtacctctaccatggatctcccgtaggctctgataccacttgttataaaagcagccacgaaatcacatcggaaaccaaatgcggaagaaatgccataggagatccaaacacgatgacgacaccgaggcacgatatttgataacggagttcagccgaggcctacatctccgtggcactgattacgggcgctccttcccgatccagcatatacagcgtatctgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataatggtctagcgatggcttcagctccactcccacaggcagctcaactggggtataagccaaacgtcttctccttctggatcctttttcttcaaaggaggttgattgattattgcaagaatgagcatatgacatactcaacaagccacacagcaaatttgcaagtgcacaaggataccaaaggatggcataatataggctcatttgcaaaagcaacatttagcaaaacatttaagagaagtgaaacagtggagtaattaatcagaaattttaatcaacactgaacaacacacccatgctgcacaggcccaaccatcctgaacaaccatacccggttgtacagatctaactccaaaccaggagctaagcaaattattaccaggtataacatccataattattgtgagaggtgtgagactaatcacgaaaaacattgctcaacccgcccataaccgcaggcacggctattcgaatagttttactctggccagaggtgtaccactgtacccacaagacacagcctcaacatcatgtctaccatgcgtcgcgatactggaaagtacccgaatagaggctgtgacaataccctctgcacatcacaactcaccacagtgcaccattcctggatcataatcacccccttataaaacaaggcatggactccccagcgacccccgtgggcttgtctccgccacttctcagtctggtgctccgcaatgaaccatgttatacaaaaggtaaagccgttgcccacgctggcttgtggttggcacggttaatgtttcacaacagtagcttgcgaaccggtccttaattgccatgagcacgaccttcaaaaccatgtgctcacaacccaccattaatcatattttaattaccaattaattatcataacacgattaaccatcgtgagctaccattaaatataaccataaataataatgtactacatatgattcatcccattagtgagctaatgtttcgaagcatggctaagcaattatatctaacatctagttgaaccaatatatataaatctcaactagtcaaattataatatcccaaggtatcaaggaatagagtaatcaatgcaaacaggccataacaaaggaatagattcacaccacccagtgacattcgaaaataaatgcacagttgaaataaatatagaatttaaatataggatcaacatgctcaaaggattgtatttagtatctgtgtgacttgccttgcaataatcggtcttcaattaatcttttgaacactcccgacgcactcacaaaccttcgcaacgacggaaacgacaagctaacatgcaaaacgaagaaaaagactaataaaaaccaaataaacagtacaaaaacaagcataaaaagtacatataaagtaaacaaacatgtggatcatgattttagatgaatttagcaacttgaaccactcaaaaccgagttacgatgatttagttatgaatttccgaagatttaatctattagaaaaactggaaaaagaaaaacgatgatgacgtcatgatacctcatcaatggccggaccaagatggcgacctcgccggagattggatggtcggctgcgactttgaaggacatgtacacgtagaggacgacgagacgaacctaacggtactcaccctcgaaccaaacgacgaacgacgacggccggcgatgaggtctagcggcggcgcggcttcggtcgacggtggcgccggagctgcggtggtcggcggcttcgggggtcaggcggccgggcttctccaccctcccgcgcacctaatggtggtgacggcgaccggcggcgacgacggaggcggcggcgcgacgcggatggagctcggccggcgacgatggcggggtggagcacgtggcggcggcgctacgaggcacgggagatcacgggagagggggcaaacgaaagaggaggactagggggtcctatttatagccttggattgaagagatcggactcctctcgcaagaaatcgatccgggaaatcaaaaactcggttttggagataaactcgaaaacgagttcgattcggataagatactcaacgattagctcagatttttggggtaaagatagaggaggataagaggaatatttcccctcaactaaattgaaaaaaggagcaacggggaggcgagatttggaaggaggaggcggtggcactgtgcacggcacggctggctcgggctctgcctgagttggaagatgaacagtagcgcggggaggggaagtagacttcttgccgggcttttcttttctcagcctgattagaagagggagcataactggactttggctgagagaagaagagaggatgcaggctcgggttggaccggcggaagagagaggaaggaaaggaataggccgattcagcctaagacaagggaggagaattttattacttttccaattaaaataatcacttaaatgatctttgaattgttaaaaatacttccaatgctcaaataatttcaagaaaaatcctgaaaatacttggacactcaaagtactatacaaaattataattagaccatttaatgattaatttaatatgtgggtaattactgaaatgttctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagtatcagagttacaacaactcatggccgatcgccgccggtagccggtccctctcgctatgctatgtagccatgcggttacaacaggcacgtccctctatttatgagagatcttatgacagagtccgactcttactctagtcctatacctagtacaactccaagtcctaaactgtaaccgactatgtacacatattcgacataaactctaacacggccgagaggggaggcaccggcccggcacaaggtgcggctgtggcctgacggcaagagagatgacaatggcccgatgggagttgtgttctttctgttcatgcttttctttctgttcatgtgtgttcttgttgttcttgcatgtatataaattaaattgttgtatgcaatctggttggggcgaaggagatttactcgatgcatcgactcaaatcaagccgatgcatcgagccgtttttttattcttgaaacctcaaaggtgtcggttctaaaccagcactgaaaccaacatccattttctcttcataacagtgccgccttcgttgtaccggttgaaaaaaccggtacctatggggtttcccaaccggcatctatcaggtgttctatggtagtggatgtaagaaaatcaaagagatgcatgcatatgcctgctggatggtgaacacgatccgattaacatgaggcaatcctagctaatagatcgtcttataagcaacaacgctccatgtttccaccatcaaatcaatgcactctgtccacacattcaggctcggctaaggcttccccgcaacaattggcacggttcatgctattgtcccttgcaagacgaacaggaacaccatttctgtggagattaccatatacgcacaaggcaatgttattcgactggttatagagaataacttatatgagtagaatatgtatagatcaggactcgagtattatgttaactggcgtatcaaggaaatatcttgtagttctagtcagttatgattgtaaagtatatatagagctttagactgtaagggataaagtctcttgtaatcctgactacttcgcctatataaggaggggtcgggtgccccttgagggcataaccacaccttagatcgtcagatcaataacataatcagcagaatatttctccggacaggagtaggtattacttctcatcgagaaggcctgaacctgtataaatcctttgtctcataacccatccactttcctgcttgttcgctacccctttaatattgccgaaatctagtttcgacagttagcgcgccaggtaggggtagcgtcaagtttttttgccaactagtgcgattggatctacatcaggtattactttgccttccctccagggcaggcgtaccgcttcggcagcctccactacaagaaaaatgctttgtagagacatttttctagtactatagagactcttttcaaatgcctttacaatactatagaggaattttaaaaaatgtctaataagtgtcttatggtgaattgtctctacaaacgaagatgcattttataaaatgtctataaggtggtagaggcattttctagagacattaaattgtaccacaaccatatgaaaccaatgtagaaatgagaaaaaaatattttcccttgttttttgtccatccttgaactcatgatctcttgaacaaatcattcttatcttcaaggcactaaccaactcaaccccatgtcattcattgtatatgtttatgccttaagttacttatatttagccatttagtatacttttattgtaagaagtgtctctacagagtttaaagtgtctcaagcaaatgtctttacatgttagacacattttaaagtgccgaaagaatgcctttacaagataaaatctaataaaatgtgctgaaaatatttctaaagtgtctctagagtaaaagttttctagacaattttgaaagtgcctatataaagtgtctctacgctataaaactcctgatcttagaggcaatttgcaaaatgcctctacaaaagtgtctttatataatgtttttgttgtagtgctcgacttcatcaccgacaacttcggcaagatcactcttctcgactaggattcgaaccagtcgagaagagacggcggcttggccccgtttggtctcccgaactcggccaagatctactccaacatcatctctcccgagttggcttcgaaccactagggcgagacccccaagacttctttctcttcactaagcccagctcaagacacaccggtttacccggtgatcaccatgcgactcctagacgacctcaccaccatattcggatcaaggacatcctctccccgcaggtctcgatctaatctgactttggctcatattgaatctggctccagggaggtcggtgttatcttccagccactcggatcttgctcatctaccgagatcgccagctatctcagcccttcaagcaatggctcttgtgcgaacaccgagaccatcaactacagcgacgtcgacgatgagtacgacttcgacaacttcgcttgctacgacgattactatggtctactatgacagtttcaacgataacttcgcttgctacgactaattctatgacttctttcttatgctctcagcacacaggatgaactagagcacagtatttggcgaggtaggaaatctatgagaggctaacattacataggatgcctatgcacgagcttctctacattgaggttgtttgcctcaaattccccttgcattccattcttagcgcatcacatcgtcgaatcacagagatagcgttctactatttctcacaactgctttctcacaaaacagaggaaggagatggtcatggtttgcaattttatggtgccgatttctgccctgaggagtagtggctagcttatttatttatgggcacttggaattgaagaggcgctagcactttcagtgcctcacaccaaccagacgagaggagaaaaaggagaacatttcgatctgaacattggtaacacattatttggccacatactcacatatatatataaccaaagtacaacgcaaggacagtatattttattttctacagtgaattatttttttctgtgtgatttaaggcactaatgagaacttgtactgggaggtggaaaaatatatttttctatatgatgtttgcctcaacttgattcaagtcattcaggtggacatcatcaattcgtgttctatttgatcaatacaatcatatgtacttggacgatcacaggattgaaacctatctatttaccttgagcaagtggagaaggaagtgtagcgtaggatcgaacatcaagaactaagccaatcaaagggggggggggtgaatggttgatgtacccaaaaaccaaaacttttagcggaaacaaaagttaccctcaatttcgacgaatcgcggtctgaccgaagtagatgcgtcggtctgaccgagattgtatctccggtctgaccgccaagataaactgccgtcgccggtctgaccgctactaacccgtcggtctgatcgctgcgatgccgccggtgtctcgccggttagaccgccgaacccgagtaaacacaaatcgaagaactcttgatgtagatgacaactttattacttctatctgtgtttacaaagtgcaacaatagcactcctcacgaaaatttcgactaaactcgaaaccctaactcaactctcaactcaatgctctcaacagcaatactaggaagtctcacgctccctctctatttatacatggggtaggcagcctaaagccacgaactaaactcatacaagaagtcctaatctatctaggaaaccttgtcgtacaagaaaccaactttacaaactccaattatatcaaatttggactccttccaaattcaactttgcatcccatacacacacaatatgtccatcgtatgccatataaaatcttcaccaaccacgtatattgatcgttagcctaagtatcccacatgatatctgaccgtccggacgtcaccttatctccaagttgactcctgatccatcaccggcaaaactcccccgcgaggcatcaagtcacatacacatgaatcaaacaaataaaccatattcctagaccaagctatctccaacttaactcattattagcaaacaacagtattacatacgtatagtatctatctagaagccataaatacaaaatatccacggatatccaatcaaactacccgaaaccgaaaccgacgcagagtcggccggtcagaccgcaggctggccgatctgaccggcagcacccactcggtctgaccggacctgacaaaacagcagcacctgaataacacttgtaaatccaatcatctccaaaaccacttcaccaataatcctcaaatattaaaaactataatctcatatgccaattgttcatcatagaataagaatcaaacacaatttgattttacatctagtcatgcagatcgacaggtagtggccggagctctggcgaggcaacgagcgacataatagacccagagttcttcttttcctttttctagactagtcaaggagggagtggggaggagcttctcctacctgaatgttggggaaggggtaaaaagtttcatatcacgccatagtttccttttcgggaatacgcaaaaggataacgcacctttgtatcaggaggaataaaattttacaaacgggaccaaacaaaaaggaaacaatagccaagagctgagaaagaaaaagaaactaaaaaccagaggaacttacccctattctcacactacaaaatagatgacctagtgacctagcaccctacataggaagtgcaggctacaaggccctggcaagccgccagagggtggtttcctgcaccactctggcggctcctacgtcatggccatgacgacctcgggccaggacggtgtgcagcggctgaacacatgttattcctttccttccaatccaaatagaccaagcaccaagggtagggtgctaagaaaatcattacactgcttaggaaatcatttaattactgtccaattaagttattctctctccgttttaaaatgtttgacattgttgactttttagtacgtgtttgaccattcgtcttattcaaaataattatttattcttttcatattatttgatttattgttaaatatactttcatgtacacatatagttttacatatttcataaatttttttaataagacgaacggtcaaatatgtgctaaaaagtcaacggtgtcaaatattttgaaacggagagagtacatggtgaaacattttattaatactgcctttgtgaaatcccagaatcaactggagaagacaaaaaaaaaacctaacgagataattatgcacgcgagaagttattctgcccaatgctggtcgtttcaccggcaactccacgcactgaaatctcgcaacgcgcgacgagctctcctgaggtttgcgtgacgagcaggacggccccagaagatccttgcctcttgcaaaggggacaatcgcaacgccaatcaagtgaattggagcactgcaattggcaaatattttcagtctgctaaaggctaacatgacaaatcatgcctaagaaggagccttggaatgtcatcgttgttcatctcgaattccaaatgcatcccatcctcagggtatcgcatcgtcgaactactgacacagacattctatagacgttctcttctcaccgctgcttttccgacagacagaggatgaagatggtttgggcgtacagttttctagtgctggtgatactgccgaagtagcaacaacagctagcctttttatgggcacttggcaaggtaattagggttctgtttggatcgaagggatattttttaagccctcccttaaatagcctaaattgtcaaaaaaaatctaaaaggatgagctaattgagggctatttgaaaataacccaccaaaaaaactattccacccaagaggtgctaattggggctattttgggtagggcccactgaaaaattgcattttctctctatctctctccataggaagttacattaaagaccaaatagctcttaaaataaccgttggatccaaacaacttagggctattttattggagggttattttcttgtgaaaaaaaatagctctcaaaataactctttgctagttctccaaacagggcctagataagatatatggcacttcagtgctacaccagccagagaaaaagaaggaaaacattactctctcagcattagctagttccatgcatttcttttcacacatataaaacactagcgatatcgtggtgctctctctattggtaaaattatactactagtagaagatgatctgaaccgttcattattaagaaaaaatagtaatttactaatactacagtgattaggggtaactttgtcattaatttttttcccacctagatcaatatatggtcatctataaatatgtggtcatctattgctctggcatcattcatattccatcaaaaagccaaaagaagaagaaaaaaaatgtttgcactcgtatgaggagtactaattagcactcgatgatcaaacgaccactaaggcactaattaatcactatcatgcgccaattgaattacttctgaagaagtgacgtttccaaattgcaggtttctggaaaagcaaagacctgaactgtttcttttgcaattttttcttgatttcaatacctcctcaacatctttgctttgactagtatgccatgcgttttgtttaagtgacgtgtctttttttttcttcaatacctcctccttagaacgctaaaattgtttttcggtaattaacttagagtgtctatatctataaaaaaatgatttcgtttggggtggtgtattatattgtttgatttggtatcactttcctagtatgttctttttaacaataaaaatttgtttgatagtccctccgtctacaaatttaaaagattttgcctatatataggcaaaatcccttatattacagtgctagcaaatcgtttactggccaattaaaaattgggttaattggatccataccactataactttactaaaataaaaaaatgtcactattattcgttatatcggctacatgtcactggaaatttctaaaattagaaccatgctactccagtcacttttttcatcctcctctctcataccgtctccgttcctgtctcattccgaccaccgcggcggacttcccgacgagggcggcatcgacggcgaactgggtgaggaggtccgggtgagtcgaatctacgacggcgagggccgcgtcgactgcgagctaggagaggaggccctaccaacgccaccttactgctggtggaactgccatgcccagcttcatcgtcaacaagcaatggccaaagcgaaccaatccgaacaaatccaaccaaatcaaaagaatttatcctttctctctttttgttttctcatcaagaagaggaagaactcacggccaagaaacaaaagtcgagtcgaatcaaatctaatcgaagaaatcatgctcctgttttgcgctcatccagcgatgaggcgttcacgggtaaggccgatgcagcggtggtgccacccctgcatgcagcaacccaagccgtggaaggaggcggaggaggtcctctccggctacggcagcgacgtggaggagcagtggcggatgcagaaagaaatagcagtgggtctgagcaaattagatagagttacagtccccctaccatctacatatggtaaaagaatttagtgggttctttgtgggggctttcatagtcttcacgccagtagcgggggctcgagacccgccgctcccgtactggatacgcccctgcggaggcccccgtgctggatccgcccctacggaggaggtcgtgcaggctcccaccattcacaagggtatgccgcatgttcacaagatcgtgcagactcccctccacaccaactgggggaagaaaaaaagaaagaaggaagaaacggcaggacgacgaggacacgaaggagatgatggagagctcgacagggttgaccatggcgtggaggatcccaacggcacgtgcggcgagcaggtggagggcgtcgattgccgcggtagggtgggcgctggcggagaggagggaatgggcgcggcggagcagggatgcggtgaggacgacgacggtggttgtgatgacctcggcaacggcgtcctggcctcctgggaacgagaggacgggaaggagggaggggatgaggacgggaacggagacggcgtgagagaagaggatagaaaaagtgactggaatggtatggttccaattttagaaatttccagtggcatacagccaatatgatgaataatagtagcattttttcaatttggcaaagttgcaatggcatggatccaattaacccattaaaatttgctaggaagtcgtttattgtccaactaaattttacattgcaaaagcgaagtaagcatggctgaactggttatattccttgtggtggatccaaatcaccccattgcttgtatttacaactaattattctttcagtgataggcgacttaccgtcaacagcaagacatttatggtgatttcgtcaatctcaagatatgccggcctagtattgcgaaggtgcttataaggatagagtgtgcgtgtgttgtgagtgattgtgtttgtactatgtttctaaaaaaatacatggtaaaaaggttaatttttaacacaatcttaacgaatcccataagcaacctagagatgacaaaacatatctctcatgagcaagactgcgcgcgaacagggtgtaacaagatttgtataaattaaaaccatcttatagctaaatataaatattttgctgacatggttattattttgaagctaatagcttactacactattagacttgctctgagctggtcgaccgaagtcccgtctctgtcaagcagatgggccaatcacaaggccgatcaaacgaacaagagcacaacatttgtcagggcatttaacctgtgaggggctaacatgacatgcacttcaatgtggtgatccctcaaatgggctttcagtacgtcacggcgtcctggttcctcatctcgaattccccatgcatcccatcctcagatcatcgctgatcatcgaaccaccgatcgagacaacattctaacacagctgcttttcccatgggcattggatgaatatggtttattgggcatttgggttttacagttttctagtgcccagagtacgtagcagcaacaagttagcttaaatttataacatttgctctggtccaataaaaagtacctggcaagcaggcaaggtacataggtactccctacgttttaactttgatcaaagttaaactactctaagttcaactaattctgtagaaaaaatagtaatatttacaacgccagcataattttattataaatctataattaaataaattttaataatatatttgtcctgggttaaaatatattactacgtttttctataaaactaatcaaacttagagtagtttgactttggtaaaagttaaaacgtcctgtaacctaaaacagagggagtaggagatttgctccggtccaacaaaaaagtagctcgtggtaccatcattatagtaaaggttaatgtttgcagtgtcataattgcaaatccccccacggtaccaaatcgttttcgatcgttgaatctaacaatgcccatccggtcgagctagatccaacgatcaaaaatgatttggtaccatgaggtaccgatacctcgagatatttttaataaaattttgtatgcaaaatgtggtatctcgatgtaccaaatgttggatggtaaaattgctcgtatcatacatatatggagtgacctcaagttattaggacttcagtgctacaccagccaaagaagaggaaggaaaaaaggaaaaacattctctttagttgttagcgtatataacgaagtgtagcaagaatacatgcagtttatatttcactgctcggagtaaacggaatttgctaaaaaaaacgctcggcagatttttccttttcccttaaaacttttgaatttttggccgtctgatgtgcttcaggattcaaaagcgtgatcgttaaagaatacgtctttgatgaccaaccaattttttatccgtgattttattaacggtggtgtttttctgccatggttgttttcactaatgacagtaatattatgccatcgttgtagccatttttgtattaacgactgtgctacattgcataagcaaccaattaagctgtacctaatcaggactgaaacctattgatttaccttgaaaaaggaaattacatatagagtcactatataaatcgtggctgtcatccactgtgattttccttttacccttgatagcatactcaaagcagagccaaacttgaggaccgaactgacttgtagagcaactctgaatatacacaacatactttcctagatgaaccatgcttcgacgttcggaatgaattgattgaagaacaattatgtaactcatgtctagtatatgaatggctaccaacaagcatagtgccacaatttaaccctgcaattctaggtactgaccaactcaaattcccaacacatcctattctgagtattctcagggcatctcatcatcaaaacaacaaatgcaatgctcatctcttctcgccttaggaagaaacaaatgaaggagatcatcaagcgtcacaatgttcatttgattctgcccctgaggagtagggcacatatataggttatgtatttaagtacattcagtggccgagtgacttagcactaagtgctgcaccaaccagttacagtttgatttagggagtgcagtactacgaaacactttaaaaattaaggtaactttaaatctaaataaactttatagcacagtagcacagtagtagaatttaaatctaaactttgattttgcatgagtattgaaaacattttatttgaagctttaacatgagtaatttctatcattataacttatcgtataacatacgaatttacctagggagtagctatatttatctacttgtctatttcaattctaactagggagtagctatatttatagcgtcacatttttcataaaaaaatagtcaaaatcgtttttacactgtaaatatattcacttacattataattacaccgtatttacattaatataactacaggataagtataatgtaactatggtgtaattacttggtaatttctcagtttcacttttcaccgttttctttcttctcttttacctttctgtctccaactaaattcaatggatgatgtgacatgagtttctttgggcaataaaaatgagatattcacatgagtaacaacaaactaaccgtggcaagtatggagaagctggactcgaggtctcggtcaaaaaaggcacgtacacaagttttactgattttaattaacagaaaaatatgtcgacacattgcctcccaaatttttatttttcaattttcagctcgagaatcgatgaacgatctcctggacgggccggaccgcctgggtgcacgttcacttagacgagctgcagtgatatcttgtcagatagtaaggtcgtatgctcatcacacacagaatggacagatccatgttgctgtaaccggagcatgtcaacttcagggtctctttatcactcaacgctaattccacatacatcctattctcaaattaagcatcgtatcgttgggccaccggcacaatgttctactactcttctcatcgttgatttccagcagacagagaggaattggggatgatcgaggtatatagttttaggacttttacggtaaaatatactgctagtacatactgcaagtatatatgatttaacggtgtagattgatttgattttttttgttaattagattgcagtataaagtttgaaagggtaattttatcttttcttcgttattctatcatcaaatcgtgctaccgtcacgtgcttcgtcatcaaatgtcactcaagatgctcctcctctattgcacgataagatctaagacgaggtacttccaattaaattcaatctgaacaaaaaattactaaaatcttatttttattttctatcaaattcctaacatgcccatcaatatactgccagtatatactgatagtatattgtaccgtaaaagtcctaatatagtttttgagttctgattctgtacgttctaatatcccaaggagctagaagcagctatagcttttatttataggcacttggcaagttatactacttaggacctcgctgccatgccaaccagaacaggcggagaaaggaatgcgttagtctatgaacattagtaacacacgattttgtcacatgtatataacggaagcataacggaagtacttcctccgtttcacaatgtaagtcattttagcatttcctatatttatattgatattaatgaatctatacatatatatctgtatagatttattaacatcaatatgaatgtagaaaatgctagaatgacttacattgtgaaacggaggaagtaccgttttttctccttcgctcttttctcctcttcgccggtttagggttagcggcgggaggcagggcgatgagccggcggcggcacagcgcgccatcgtccccggacagcggcagcacgacgctcttccctctgctcactgataaccattcatatctaaccttatcgctgcatgatgttagtttttacccccgtcaaagttgattttagcagtattttgttcgtcttgctactgtgattagtccgaatctatcaaaaacaatcaggcttaggaactatgcattaccttaaccaggaagagacgggtaaaaagaataagtgaattattaagaaaaaagatcattaaattcaagagatacacgcagataaagagtgatttagcctactttgtttgtggacagttccgaaatatttaacatatattatatgaatggtattttatttctacatagtgtgatcttcatatccaaatattatttgtagtgtatacattctgagaggtaacctcacaactaatgtgaagtggtaattctatctagccaacccaccttcatccctccatccaaacaattgataggatcattctaacccattatatctctcaaatcagacaaaaaaaaaaggtatgttctatccccttaaccgaaaaaaaatagaatcatcccatccaaaaatagggatggacctaacccgtcctatcttgtccccaaatcaaacacatgctaggtgtctgagtgtcgcttctatacgtatgcattacaaaatcgtcaacacatgcctccaaaatttttatttttcaattttcagctcgagaatcgacgaacgatctcctaaggacaagttttatagtggaggtgagtgtcacatctaatttaaaccatattatattcttattaattaagagataacaagtacaatatgtcacctctagtacacaaaccccaatattagtttactctcatatcattttatatttttcttagagatgctgtggagattgccccttgtatgaggggtggctcattctctctctcctaatttctctcctccaactcatcacttaatcctatgcgataaatttagagataaaatgtaggggtttacagtacttgccctaaggcaggcaaacggctggaccgcctgggtgcacgttcacctagacgcgctgcaccgacatactgttagatagtaaggtcgtatgctcatcacacacagaatgaactgatccatgttgctgtaaccggagcgtatcgacttcagggtctcttgatcacccaacgcaaattccacatacatcctattctcaaattatgcatcgtatcgttggaccacctgcacaatattctactactcttctcatcgttgatttccagcagacagagaggaattggggttgatcgaggtatatagtttttgagtgctgattctgtacgttctaatatcccaaggagctagaaagcagctatagcttttatttataggcacttggcaagttatactacttaggacttcactgccatgccatccagaacaggcgggagttctggctgagaaagtaatgcgttagtctctgaatattagtaacacacgattttgtcacatgtatataacggaagcatgacggaagtaccgtttgtgcgaatttcactctctgtttcaaggcactaacgataaatattactccctccgtcccaaattatagggcgtcctctttttaagaaaaatcaaacttgataacttttgtctaataattatactaacaatatatatgctaaatattgtgcatgttatatcactagattcatattttaaagtactttcatgttatgctaatttcatatttgttagaaacataacatgagataaattaatggtcaaattatgtcatcgaagaccgtgtaaaaaatatagaccttataatttaggacggagggagtactcggaagtggaaaaatacaatggtgacaacacatatatgtgacggagaagagacttatcaatgaaacctcatctgtgacaagtgaacatccatcattgatgactcatccatgacgggtgataacttatcacacatcacacataagaacttacaatgttatagccacaaattcatgattttttaagtgacatttatatgcatgttatagtgaaatttaaatctaagatctctcaaaacatgcaaaccaatcttaccatctcattcatagaccacttgttgataggtcttttgcatgtcttttttttcactattcttatccaaacatgaaacacaaaattgacactctagataactagaataatttcaactataaagttgcatatctcgtcgagctctacaacttctatgtatggcatgtctccatccaaggtcatttcaaaaattcaaaaaatattttggaaatagatcacatcacttataacacatattcaaatgaaaaatattgtgaattataaagttatatatctcatcgaactctttcacttcgatataggacatgtctccatccgagatcttttgaacaaaaagtaaaatcaaaattatgtatttcaagatagatttcaccacttgtaatgcgggaacatatcctatgcacataagtttttccgtatacactccgtgcacaccaactagcaaatgtcatagaaaattctagagaaaatttgacacatacttccaatagtattacacctatatatgaaattttaccttcaaattcattatattttagccgtaacaaaaaatacaaaattttgacatatttttatccttaaaactgttagattttttattttttatggctaaaatataatgaatttgaagataaaatttcacaaataagtgcaatactattgaaaatatgtgtccattttttttagaattttctatgacaattgttagttgttgtgcacggagtgtgcacgggaagattgtgtgcataggatatgttccccttataatgcatattcgggcatgtaaactatttcaaattcaaatgttgtcaattttaaagttattgatctcctcgagatttacaactttcatataagacatgtctctattcaagtttgtttgaaaattttccaaaaaaatgaattttccctcatccgtgacggcttgtaattaccactcttcacaaataaccattacggatgagtgctctcatctttaacgggttatctcattacacccgtcatggatgacatgttatatgcgacgatgtacggttgtgacctgttataggtcatccgtgatgtttaacatcacagctatatatgatccatcataattgaccccatatcggtgacgggccatccctggtagttatatctcaaacgtgatatcttttatccattagagatgaatcatcctaaacaggtcgcattagcccgtcacaaattccggaatctgtactggtcactactacttcccaaaattagatgttgtggctttctcatgcttcaatttgattcaggtgtacagcatcatttccgtgttgtaacttgtaatgcactccccgctcaagaaacaaagcgtgttctgactttcaaatgatatacctttgatctacaatttattttattgatacaataataatcacttagacaaatggtgaaatatgatcgatgagcaccattaacttcgatccctcgaaagaacagaatgctatatatggattcctcagtgctcgtcctgaacacgaaacctgaaaaaaaattttcagcctcctcaatgcatttttgtggaagcataaatcataggtcactaccacataacacgagaatagtgccggttgggaaacccctttctatgtcggttttttcaaccgacactacgaaggcggcactgaacagtaaaccggcaccaatcctattttaaaaaccggcacctttgacaccactcgtgagcaaaaaaaaaaagcttgatgcatcacaatctctgcatcacaatccctaatccccaatccccaatcacagaactcattcacagaaatcacagaaatcatttcactaatatcaataaacattccctaatccccaatcccaaatcacagaactcattcacagaaatcacagaaatcatttcactaacatcaagaaacattgaagaacatcacacaaatcatttcacagaaatcttttaagaaacatttcgccagatccgacggagggagggagccgccgccaggccgccaccgcctcttgtcctgccgccgcatcccccctcccttccgccgccactggaccgcccctccacggccgccgccgggccgccctccccggatctggcagaggggagggcgcgactgccgctgacgcctccgccggccgcggatagcaagagagagtcgagaggggagggcgccgccgccaagctgccactgcctctcatcccaccgcagcatcccccctcccctctgccgccgcatgtcgcccctctgccgccactggtccgcccctctgcggccgcccctccccggatctggcgaaggggagggcgcagccgccgctgccgcctccgccgaccgagagaggagaaagagaagagtagagagcggagaaaacgagaggagagaacgagagacggagagacgaagagagagaccgagaggagacgagcactgcggagcggccttttctcctcaaagcttcgtggtggggcccatcggctcggctcaattcataggtgttgattttttacaaaaaaaccggcacctataatttattatagattgtaggtgccggtattaaatactaagggttccggtttttttaaaaccggcacaaaatagagtagatgctggtttttatttagaaccgacacctataattacttaatggtgtcgttttttgcgatttcaacccgtggaggtgggaaaacccgaaaaaggcctataggtgccggttttagaagcactaccggcacctatagtgccaacacctatttgatgttttgtagtaatgggtttatcacatgctataggattttatacatctggtactcaaaacccgcagaacattgtggccctagcggcatatttgtaaacaaaaagtaattttaaataaaacttgttagtgatctaaaagcaaaggctgaaaaataaacttcacttaaaaaccctgaaatcaacttgaagtataaggttaaaaattcaaattttagatgataaacatgagtataagtgaaaagatgagactgttagtttgtgcacaacgggaatagcaagatgcctgtctcgggctctcgactaagccacactgtggagccccccgggtgcacctagccacctacaagctaagctgtttgttcatcactgactcaatcacttggtaagagcaaccacagtgtttggttcggccattgtattgattgaagtcgaatggagagtgaaatcgatagctgcagtgtgaaatcaatttgtggggcccataaaaagaatccatcaaccaatcagtgcgtctactttctaatttctatgcatgtatggacaacaaatattttttaactctctagagttcgacttcaacttagagttcgatttttttttctgacaccatgagtcggctgtcacaatgtgtatggttcgcttttctctgccttaaatcgattttactttcacactggagatgctctaagctcatatccgccttgaaggtagatcgagcttaactcaacttcggcctagaactagattgtgatatgctaggttggtaacgagaacaactatggcgttgcaaccatagcatatcaatggcaaatcctagagctcgcgctcgcattcctcgtgcatcccattctcaaagcatcgcatatatcgttgaagcacctaggatactgtgtgttctacactttctggaggagatggtcagggtttacatttttctagtgcgggttctagccagaggagctagtatagcacactagcagctagcttatttatgagggtaatttcaccatcactgaaagatatatagaggtaaaatttaatatttgtaagtactaagtttctcaaagtactaaaaattcttgctgtaaaatttagacacctcgagattcctttatttataggcacttggggagaggtactaggtagcatttcacttcattacgagtgacacacaacaagagaagaaaggaaattgtttactatctaaacattagtagcacatattgtcacatatatatataaccgaactataacggaagtacagtttgtatttcacaacctagagtgatttattttctatgttctaaggcactagggagaaatattgctggaaggtggaaaagtatcgtcctcttcgctagcgtattgttactgcctgaaaatgtattgtcactcaccgccgtcggtgagtgatggagctaggtgaggggagggagaagagagtggattagggaaagagataaaaatgagagaaatagagatcaggtgcgaaactgataggcggggtctatcaatttttttaataaaaaattgctgactggactgtcacgtagaaccaaaaccaccgcggattgagccccgaggagagtggggggtggaggtgagagttatttgtgcggtttgtatagttgggggtgaaggatatctgctttcatgcatggttcgggagataattcaatcgaacgtgatagtttaggaagtaattcgtactttttccttaaaacaacgtacattctttttcacttttcaggttccatcaaacttttatttttcatttttcagctcgagaatcgatgatcaatcgtctgagggtgtgattagttcgcaaaaagaaaatttttgtgtgtcacatcggacgtttgactggatgtatgaaggggttttcggacacaaatgaaaaaactaatttcataactcgcctggaaaccgcgagacaaatttattaagcctaattaatctatcattagcgtatgtgggttactatagcacttatgactaatcatggactaattaggctcaaaagattcgtctcgcgatttctatgcaaagtgtgcaattagtttttttatcatctatatatttaatgctccatacatgtgtctaaagattcgatgtgacgtttttggaaaaaaaattaggaacttaacaagtcctgaggcaaaacggccagaccgcctggagtacacgcgctgcactgatgaactgtcaaatcgtaaggtcgtatgcttatcacgcacagaacgaatggatccatgttgctgtaaccggagcgtatcgacttccagggtttctcgatcgcccaacgcaaattccacgtgcatcccattctcaaagcatcacatgcagggataaaaacggattggaaacggacggaaactagctttatcatattcgttttcattttttttttcgaaatcggaatcggaatcgaaaacttggatacggaaatgaaatcgaatattatcgaatatagatacggagcgaatacgagacggaacgaatacggtagcgaatatttaccggtatataaaaaacccctcaaattgagtttcttgatcaaggaagagatatcgtttattattttagttcaatatctccaacatttatatcgttaattttatagacggtcccacaaccgtatgtgaaaatcaattttcatggttgttcctctaagagatccatatgcaaatatgattatcattttctattcccaagaccttttactacatgtataacttacttaccattgtataaattagagattttatttattttacttcacatcttcgaaacttgtaatgtttgtattatattttaaatgctttcaaatacaaatgttataaactacaaagtggtagatcccgttgagctctataactttgatatggaacacatctccatcagatgtcgttgaattgtagatctgagatttcgtaaaaattaatatggtatattataatgaatatttagacccataaatgacctcaaataataaaatagtcaataataaagttgtagatctcatcgagctctacaatgttgatataaagtttgtcttcatctgattccgtatgaaaaggttatgtatatagacatgttttttatataatttgctcaatgtctgcggatatccgaaacaaattccggatagtttccgactgttttccgatttcgaaggatagtttccttactgtattcgttttcgtttccgagaaaaaatatccgaattcgtttccgaatccgagaatttccggataattccgatcgaaactatccgaatccgaaaaatggtccggacggacggaaactatccaaaccagtttcatccctaatcgcatggttggagcaacggcgtacaatgttctaccctttaacacaataacagcgggttatgtagctgctggatccctagctgctggatccctctctagactgtcagtcacccgggtgcacctacaatcagtgtgttgttcggtgatggttgagatcatttggtaagctctcctcgaaatcttaccaatcgagctgatctcgggtaggggtgtaagtggctaacccgcgaaacctatttatagactaaaataagccgcgagcccgcttattttgatctataaataggttcgcggctgacccacttacacctctaatctcgacctcagactgatggactgtgatacgctaggttactggcgtgaagaactatatggcgttgcaaccgtagcatatcggccgccaactctgcagcttgcgttcgcgttcctcatgcatcccattctcaaaagcattcgcgtcgtcgaagcgccgagacagcgttcgacttctacactatctgactctgctttctcatggacagaggaaggagattgccaggggttttacagttttctagtagcggagtagcagcagctaacttatttatgggcaacttggggagttgctaggtagcaagcacttcactttagtgccacaccaaacagacgatagaagaaaggaaaacattactctctgaacattagtaacacacactgccagatatatataactgaagtacaatgaaagtacagtttatatttcacaacctagagtgatttattttctatgttctaaggcactaataaggagaaatattactggaagatggaaacatatcgtcctcttcgctagcatattgttactgcccaaaaatgtacgttctagctttcacatcttcagtttgttacttggtttcaggtgaacagcatcagttcgtgttgtagtgtgctatccacacctgaaataaagctttgttctgtcctcgaaataacatgttctattttattggtacaatcatcaattgggtgatgaaatagtcgatgggcaacactaacttcctgaagttccttgaaagaatgggataatctggagacctcatagctcgtcctgaatatgaaaccaacagattgaaaatgttactgaactgtttctcctgtacctttggcagttctagagatacaagcaaatggagaagttttgtaacttacatggtagtcatacctacgatgatgaccctgcaaatgtagagaaacaaaataagatgtcagttgtgatggccatcaaccggtgtcatattactgatactagcctatgcatcagcattagcaaattgtacatgtatatggcagttagtggttagcacgcacactacctctacatgtctccacagtgatgatgtctagaattcttacatgttttgctgacagaatgtctattacttttttttcttgctacctatcttttacctgatctttgtaaattttaatacagctatagattttcctgttatatcctaaagcaagcagatacaagctaaaatttttgatagattattatggtcggtgtttgatatattagaggcaacccctctctgaaaggagtaaaaagaccagctgaattgtagaaggaagaaagtattccacatgatagcagggagaagaaatgtactctatatctatccctgtaacggtccctgcctcggtgccgatccctgtctcttcttcgtttctctccttcctctcgtgcacgccgagcctcctgtggaaaagaagcatctgttagcttccctatgaactggaattgctgagtcacaagacccaactcttcataataatgaacaaacagaagagtaaccagtgaactaaaagcaatcacaaacctcgtcttctctagccttcctccgcttttcagcctcctcgaaggcctccttttcagcctacaacacagaaaaatatattgaaatgggggtttccatgacatgaaactaatggcatggataaatttacaaatatgcgttctgtgttgttattccaggtgagcctacctctttatttgcagccctaacttcatcaacaacacttcttgcatactccgggtcgtcacaaatcaaaatgttgtcaaaaactgaaccagctttcacctgcataccacctggaatgttagcttacatagcatttatgccattcatgtaaaggactgtgtcgtttgacacagcctagaagcagcattccaacagaacaagcatatttaaccaagaaatataatacctgccaaacctcaattcccacatactgcaaaggtttcagcacatataggtctgggtcgtcctcaaattctgtgaaagatgcatatacatcacttaatattcacttcaaatttggaaggaggtgaggtccagctctaagtcagatatgcagcaagaaatgaaaaacgctaacatagtactgttaaaaaaaaaaagcccatcatttctcacctggattatcaatccatgggatcttccattttcccttgtagttagggttcttaattttctgcgtacagaagcatgttaaaaaaatgctacaaaatgtggcaatgaggagctaatcagtcaataaaacaaaccttgcgtttccaacgtcccttgtattctggattcggtatcattctaggcttccatacaccatcatcatcatcatcccatgactcaggctgatttagtgtagaaaggaaaacatatgtcatcctgtgttatatttattaacttagcaaacacaccataagagccattgaggtcatgctgggttcaatatagctaatagcagatagaaaatgctaacatgccataggatgtttctaatgaaacaagcttgaacaggtaaaatggaacctttgtctgcactcgggttcttctcataatattaagaacatatgacactatgtccattataaacggatatgccaattaaatgcgaaaatattagaagctggatttacagcgtaattcttaagtgcaaacctttttgtcctttggatcaggaatctctttaggaatagagtcatagccctggaaaattaaggtaaaagattacataacgttctttatttgtattatcaatgtataacaaatatgaaattgcaaacctctggtttaacttcatcaggatcttcaatatattccctgtcatcccaatcttttggctgcaagagaagacaaatataagag

SEQ ID NO: 69991 - DNA, 8910 bp, Oryza sativa
ttctcagtttgcagatcgatcacttaattagagcacatgcaaaatatgtaattgcatatatagaagcagctaatcgattatagaaatgggattgaagcaacaaatcttgcttgttcacggaagaacatatattcagactgaatgactaacttgatataagatcttaattgaacagggagagctcctccctccagctattgtagacttctcttcaacctctttcctcttactgtttgcgcgaattattttactccaactatcttagatttcgtgttctcttttcctagtttggactatatttttaattttcaattactcactcaaagcaaaaaggaactgctacttgttgtattaggtggttttgtagcacaatctatcttaatatattaccaaaagaggatagaaaggagatacatgttcgctccgggtccctataaattacaaagttaatagaagaaaatgagaaaaatgcatcattcgatattggtagaacgaatttataacattagatattaattgatagagttgcatacaaaatgcaattgcatttgcagaaaaaagacaaaattatataccagatacaattagggaaaatcgcattatcagttgcacaggattagctaattatgtacagggtttacactttcggaaatggctgaatttttttgtcatttcagtggtcaccgaaatttcgtgaacctcgggattactggaacttttttgcacgaaatatttgatattgtaacaaattttaattgaatttgactaaattttgacttttttttaaaaaaaatggacaatctgagaaatcctggagagatagttgcttggtggtcggttgcttgatgtatatggacacacatttgaagtattaaatatagactaataaaaaataaattacagattccgcttgtaaactgcgagatgaatctattaagcctaattaatccgtcattagcaaatgtttactgtagcaccacattgtcaaatcatggcacaattagactcaaaagattcgtttcacaatttatatgcaaactgtgcaattgattttttttgtccacattttatgtttcatacatatgtccaaatatttaatatgacagaagaaaaaattggaagtttgaatggatccgaacacagcctagcctatgtaccgatttatcggccttcattttctctctcccatgttatagtgtgatcttgttgcagacttacagttgtggttgcagtagtggtacatatgcatgatggcagtcaagcatgtcgtgttctggataatattgttgaacgccccgatatatgttgaccgctctgtttagatcacgaaaagaatatttttaagtgtcacatcgaatgcttgatcggatattgaaatgggtttttggacatgaatcaaaaaactaatttcataactcgtctggaaaccatgaaatgaatctagcctaattaagccgtcattagtatatgtgggttactatagcatttatggctaattatagactaattaggctcaaaagattcgtctcgctatttaccgtataattagttttcgtttttatctatatttaatgcttcatgcatgtgtccaaagatttaatatgacgtttttggaaaaaaaaatttggaaaataaaacaggcctcagtacggctctacctattgaaagcatatttctccggctatgaagtgtagctaggtttatctgctttaacagtagtttctttgtaaactccgtaatctgttatgaacctttcttttccattaacggaagagggagaagaatagtttcaatgttataaaaaaatccagcgtgaacaagaagcgtcttgtgcccatagtagaaaaaaccggaccgaacaggcagttcaaccggagaaaaccgaaaatagaggttggcatagttcggtcgaatagaaagacaggacatgcaattgaatcgattcagaccactttaaccggcaggttttatgatgaactgggcaataaaccgccttcagtcggaccagactaaggcaagtcattgaatgaatgggcgacaggacagcctagttagttcttaggctcgttttttgggccgcacttgttttttttttagcaaaaatcaaatgaaaaggtgcgttggtggggagtcaacccgtggtcaagggttgcaaggcaactgccgactgccgtagccatcctaccagccagatgtttgtattgtaaaatcaaaggtgtttttgattattattgtgtgatgaacaattgggcattggaaattattggttttgttatttggaatttattcacgaagtggttttggagatgattggattcataggtgatcgcaggattttattattttatgtgaccggtcagaccgggctgtgtatgccggtcagaccggcggtgaccaagcggtcaggccggtcagactgtgtcgttttcggtttcgggttatttgtttggatatccgtgattatttcatgattatggcttctagatggatactatacgtatgtaatactgttatttgctactaatgagtcaagttggagatagcttggtctcggaatatggtttctttgtttatttcatgtgtaggtgactcgatgcctcgggagagtatttgcggtgatggaccgggagtcggcttggggataagacgacgtccgtggtggtcagagatcatgcgggatacttaggctagagttgatgagcgtggttgatggagattccatatggcatacgatggaggtattgtgtgcgtatgggatgcggagtcgaatttggaaggagtccgaatttgatatgattggttatgtaaagtttgtttcttgtactagagggttttctaaggtgtttaggactcctagtatgagtttggttcgtggctttaggctctctacctcgagtataaatagagggggagcgtgaggcttcccggtatcgctttagagagcaattgaattgagttttgagttagggtttcgagtttagtcaaaatttttgtaaggagtgctgttggtgcactttgtaaacacagagagaatcaataaagtcgtcatccactttaagagttcttcgatttgtgtttatcgggtttcggcggtctaaccggcgatctaccggcggtcaaaccggcggcaagcggcagttagaccggcggcattcgggcggtccgaccggcggcggcgacaggcgcggcaggcgacatcggtggtcaaactgggtgatctataccagtcagacttacgacatccacacgatcagaccggcagatcgatctccgtcgatttcaagggtaacttttatttccgctaaaagttttcggtttttgggtataccaaccattcatcccccctctggttggcttagttcttgtgattcgatcctacaagtggtatcagagccttgttttcttctttggatttttatcgatctagagtttttaccatggctactcctgctaagttttcaactaagcctcatgtttttgatggaaaggatttttctcattggtgtattagggtgcaatcttatattatggctgaagattatgatatttggagaaaagtttctcatccttatgtgattcctgaagctattaatactgctgctgaaaaactgcttttgaacaaaattgcaaagctcgcaacattcttttgagtggtatttctcgttcggattatgatcgtgttgcgcactttcgaactgctcatgaaatttggaatgctttgagtaactttcatcaaggaagaaataacattaaagaacttcgtcgtgatattttcaaaaaggagtatattaaatttgagatgaaacctggagaagctttggatgactatctctctaggtttaataaaatttcgagtgatcttagatctgtagattcttcttatgatgctaattatccacaatatgagatttctcgtcactttttgaatggtcttgatatgtctatttgggtgatgaaagttacatctatttaggagtctgttaacatgtctactttgactttggattcactttatacaaaattgaaaacacatgagatgaatgttctttctcgaaaagttgattctaagtcgagtgctttggtttcttcttcttcctctttggatgttgatgcttcttcatctaaatcttcttttcttactgtttttaatgccacatccgatgatcaactcgaacaaatcgaggaggaggatttggctttggttgctaacagaattgctcgagctatgaataatgccaggaacaggaaaagaggtggtccaaatcattgctttgaatgtggttcaattgatcatcttcgttcgcattatcctaagcttgggagaggcaaaagagaagacaaagatggtgagaagaccaacatcaacaacaagccgaagggttcatcccaagggaggaagctggacaatcttaggaaggcttttcaacaagtttgcgccgccttcgagccactaagtgatgtagatggtgaaagtggagatgatgataagggaaagaacatctccgatgtttgcttcatggcgcgtggtgaatctgacacagagtatgaagataatgaggtaggtgcttttgaggaagctattaatattttgagtgcaaaaaataagaagtgtgagaagatgtatagaaaacaggaatttatcactgaatctcttaaatctgaaattgctagattaaaatctcttattcctaatgatgataattgctcaaattgttaggttttaatgaatgagatttcaaaaattagagatgttaatgctgcacatgatttgaaaaatagatcttctcttgcttgtagttttgctttgcacacacgcactttggatgagtttttttaactaaaaagttgttgtaaaaatatataattgcttttcatgctagattgatgtttaacatgatttctgctaaaaagttaaaacaacctcatgatgttttcgattgctcaacatgtaatttgaataagttgaaattgaaagatgctttaggtcgtgttgagtacatggaagatgttgtgaaaaacaatgaagtgctttcttgccccaaatgtcataaaagcaaaagtgtcatggtagattgtgaaaattgtgctaatttggaaaaaagaggtttcttatttgaaaaattctttgctaagattttctgatggtaaagagaacctcaacatgattttggatcaatcaaaggttagcacacataaccgtggtttagattttaatccttatgctcataattctagacatcctcctgttgtgttaggtgttggtgctagaagtggtgagattttggttaaacctgatactaacaaaactgtgtttaaatctgctggtatcatgtctaccttgaatgcatcttcttcaaaatctcctgttgttgcttgtgttgctaagtcttctaattctacgaatgtgtctaatcatcgccaaaaatatacttgttccttttgtggcaaagatggacatattgttggtttttgttttagattagcacataaacagaaaaaggagagagagattgcttttgcaaaatcaaagtggcaaaaatctggttttccctcgaggaaaccggtcagaccgcactaggtcctgcggtcagacctgctactgagcatcggtcagaccggcggtacagaagcggtcagaccggcccccggtctgaccggctgctgtacctcggttagaccggcctcggaggaatttttctgaaaattctaaaattgattttgcacatggatatatgcctattggatcttctggtcgtatgtctcagtactggattcctaaatttttattatcatctaaccccagtactgaggcttcaacttctgcttctgtgtaggctttggtggcaagaaaggagaacgtgtggatcgtggattccggttgttcgcggcacatgaccggtgtcacgaccggaattaacccaacgggcgttccttacgtgcgtgtattattccttgtcccaggaggcaaggtacaccaaaagttgatacatttcagagtttatcaagcggaagcgtaaatagttaatttattatatgggcggcgaaggcccagcacacacaaagacaaatgggaaacagcggaagactagggcaatgaccataggcgcttgacggcaagcacgagctagacaccaaagccttcatcttccaggggttcctcttctgggtttcggaaaaattgagcaagactgagtacaaccaccgtactcaacaagacacacccacaagtgcaggataaatgcaagggagtacaagggggttataatataaagggttagggtttgcagtaaacagcattaagagacacttagttgctcaaagctattttgtaaacacgattccagagctatacgatattattaatcaaggccgtgaacccacacgaacctgccttaacccaaggtctacgatgattcagaccgaactggcaacccgaccctgggtcccagctcgtcccaagccaacccaggccaaccattccatattttagttgttaagctggttttaagaattaaaacactaacttgggtacattgctcggcatgcccataaccgagggcgcggctattcgaatagattatactctgatcagaggtgtacatctttacccacaagacacatcttcctcacgtgtaatcacgtgccacataccaccacggtatacggacggaagacgtgacatagtttccaacccatcctagccatagacaagagtaccgacccaaccccacctacggccggaacccccgggacaggtaggcaggactgaacccctagcagcaggacaccggccctgtgccatgacatctcgactaccgggccgcagctcgtgtagccttcatttgtcctagagatatccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctaatatcaaaaccatgcaccccgagcccagcctaaaaccattttgaggattttgaatagagggggaggtgtgaatccaattccacaataatccaaccattccatagtgtccaggtgatatgaatatcccaaagtctagagttgtaaaaccacctaatgttgcctaattaaccagcgaagcatctacctaaaatcatactagtggtactatgagtagagtgtccactagttggggttttgtttattctagggtgaataaggaaataataacaataacaataataaggtcataacaaaggtaaataggcatggctagataaaacagtaataacgcgggaatttaaataaagcgataatgcaataattttaatcaacataattttataaactgggattcaatatgttcaaggatgatgtgacttgccttgctcgctttcccaaacgtcggcttcaacttccacgaagagcggatcttccgaagctgcagcgtctagacgaccaacggaaaagaaaagtcttttactctaataaactccatataacaagcaggaacaaagcacaaaaatgggttcttgacttcttaaggaaaaattagagacttgaacggtccaattccgaattcaaatggccaagttatggccatttgaagtttatatgctctttaaatgaatatttgcgaatttcttcagttaaattttaattttaaaagggtttattgcgttagccgaggggagggggcgcgtggaccgggtccacgggagtggggcccacgcggcagtctcacggtccacggtggaccgggtgcactcgggctcacaccggccggcgccgtgggtcccacgcgtcagccgcacccgagggcgcgggcggctgacggccgggccccacgcggcagccgctcggtgcgcccgaaggcggccacgtcggcgcggccggcgggaggcggcgcgcccgcgcccctatggtggccggcggcggccatgggcacatcggagcggcagccgagagaggggagggaaagggggaaacgaggcggtggtccaaggctcaccctaggtcgacggcgacgacgaaaaggcaaccggagcggaggaaggcggcggcgcggctcgggtcaacggggacggcggcgctccggtggtcgacgagcgaaacggaggggtggacgaggtcggcgaggatgcggcgaagccgaaggaggcagcgccgaggtgggaggtggtctggggcgacgacggcggcggaccggagctcggcggcaatggcggagagagagagcgacggcgcgagctcgattccggcgaggtggaagggcggcgagaggcggaaacggacggaggaggtgcagggagtgtttaaatagggttggaagggggagagagcggccggcggggaaggaataggcgcgggaggtccggccgccatcaatggcgccggcgagatttgcgggggcaaatccacccgtttgaacgcgagagagagagggaaaaatggggggaaagggagaggggatcacggggagtgattttcccctctttattgcacgcggggacggctggaggcggtgggattcgcggcggcggcggcgctagggcgcgggcgaggcggcgggagcggcgggaggaaggggatgacgggtgggccccacccgtcagcgagggtggcgggcgggcccgcccgtcagcggcgcgcgcgcggggagaggccggatgggccgcggggagaggagagggagggggagtgagatgggctaacccgcccaagatgtaagggaggaaaggggactctttagaggttttctttttataaacaattttaactttgttatttgttagaaatattaatttgggctctgaaattgccctaaaattatttacgcattttaggctttctgcgaaaact

SEQ ID NO: 69992 - DNA, 4308 bp, Oryza sativa
  unsure (1)..(4308): unsure at all n locations
gcgggccgccgtcagggcgcgcgcggagaagccgnnatggccgcggganagnaaagnaggggagtannatgnctganccggcccaagagganaaggaggaaagnngnactttttagagtttttctttttataaaatcattttaactttgtttatttcttaataattattatttgtgctctgaaaattgcactaaaatttatttacgcattttaggcttttaggaaatatacaaaaatcctccaagccttatttaacttttaactttgcacattttaattgttggaggctttcacacggattttaattattctaggcataatttagaggatgtattttagagtccttttgggacgtgacaaccggtgataaaaattggttctcctccctcaagaaggcatgcaagactgaatcgattatctttggtgatgcttctacatgtgccgttctcgctacaggtttggttaaagtaaatgaaaattttgaattgaagaatgtagctttggttgagtgctgttggtgcactttgtaaacacagagagaatcaataaagtcatcatctactttaagagttcttcgatttgtgtttaccgggtttcggcggtctaaccggcgatctaccggcggtcagaccggcggcattcgggcggtccgaccggcggcggcgacaggcgcggtaggcgacatcggtagtcagtccgggtgatctataccagtcagaccggcgccatccacacgatcagaccgagaccaatttcggtcagatggatctccgtcgatttcgaaggtggtgaagtggtggagacgccgcaatcggatgcttgtcccagctgcagttgacactccatttcctagaaccacaagcggccatcaatctaccttcctgtttgagttccggccgactgtggttgtgtggtccagtgcaagcagttatcgacttggtcgcagtgaccatctagtcccctcaaactcgtccaaaagatgatcgacttctttacaagttggtggtactgaaactaggaatgaaaaatttaatttgttataaatttgttttccaacctaaaattgttttccgttttaaattttcttagcctatctatactgcagcgtgacaaatctcttatcgaattcaacgctggttccgggcggacggccctgcctcgtggcgtggcgcggttcgaggatgtaaacgcgtgccataattttcgtggcctcgctccttcaatctcgcgactcgtatggcgcttcgtgatttatctggcaggtgcgatagactcatcgaccccatagagtgtcggcgtgcagcccaatggtccaagcagccatacaagcatgtaagccccaatgaaaattttgacagtgcaaggccctttttttttccctttggctatagcagtaattttatacatcagggaaggagatgcatttgtgaaatttctgaacataataagcaagctttcaacagttgattctctatcatcacatgcttaaccttcttctgaaatgcatatggatttcccactctgctaataagaagcagcaaattcacttaggttgtgtttagatccagcggtaaaattttttaccgtgtcacatcggatatacggacacacatttgaagtattaaacgtagtctaacaactaaacaaattacagaatctgcttgtaaactgcgaaacgaatttattaaacctaattaatccatcattagcaaatgtttactgtaacaccacattgccaaatcatggagcaattaggtttaaaagattcgtcttgcattttacacgcaatctgtgtaattagtttttatttttgtctatatttaatacttcatgcatgtgtccaaacattcgatgtgagtgtgaaaaaacttgccagggaatctaaacagggccttatactccatccatcccatttgaagtgcagccatgattttccgtgctcaactttgatcgtctgtcttatttgaaaaaaattaaaaacataagtcacacatatagtgctattcatgttttatcatctcataaaaacaaaaatactaagtataaaaaaaattccaataagatggatgatcaaatttgggcaaaaaaaactcatggttgcacttacaattggacgaggggaatatcacaacataatagtgtttaagaatttcatttgaagtcctcctgacctgaatgtcaaagcatgctgcctttgtaaaaaaaacacaagatttgaagggattgtgagcgtgttggatattaaacacgggacctgggggttgagaccatatacctcctatgaccgcatatcaagtgtatctcctatgttgcctttgtgacaatttcagtgtgtcctaatcagtaaataaggaaaaacatttgtcagttgattgtttgacatgtttacataataaagttgtttcttcagtagcttagaatttaaccgaccaactttattctgttcactttgacaatagagatacataagatagccggataggtgatgatggatcatataatacttgaaattaacaatcaagacacacattacttggcaattgatttggtagcatagaaataccacaggttggaaaatgtatattatatgttcctttcaagaaacagaatgtatcaatgctatcttatttcctgataacttggtttcacagtatagaatgaattctaaaacgtttagataatatcacataaaatgagtattgcacggtttataaaaccactagtagaaagcgcgtcaactagtgtgcctatcttatattctaatgctgatattgctagcaagctttgattaggccacgtggtgcctttcccttagcaaataagtctctagattatttgagagaaaaaatgacgccaagacatggtcactttgccaaaccatctccagattcccacgttcggctttgtggagaaataaaaagattcgtcaagaaaaannnnnnnnnnnnnnnnnnnnnnnnnnnnactatactgcagcatgacaaattagtagactattggcaagcatgcatatattagtaggtgcaactaatgaaattcgagtccaatatcccctacatactccctctgttccataatatagggcgcaactgattttttgaagtgtaccagaatatagggcgcccatgcacatgcaagcaagtagcattaaaacaaaagtatgctctggtcgacttccgtgcgcatgcatgcaaaggttttcaatgcgtggagttggctcttcatttcttgcatgttgcttacggcctctttctttcttttggttgctttaaagctcttggctcactggccggactccatttacaagctcacttgcattagttgtaacacatcggcgagcaccggcgagcagcgatggatatggcagagaagatggtggagtgcccggcgagcggcaagacgaaggccaggagttgccggcgcatgcggcaacaagcagagatggagttcggtcgtgcgcgatcgattcgtgtccacgccatccgaatgcggtagcgtgcgcaaatggagctcagccgtacccgagtgctttgcgacgccgccgtccgcatgcggcagcaagggcaaatggatatagctcttgcgcgaatggtttgtctccacgccgttcgcatgcggctgcaggaggagcgagctaaccacgtcaatgattgcgaggacagcgatggatgccgaaacctgtgatgacagcgtggttgaatcgacgatcatgggcgaaggtctcgcggccagcgctgatcatttaatcaactccgacgatgtacggtatgttattgattcactagcgaacgacactattgttccatattcactcgaacagaccgatgacaaggaagacagctagaattattgtatctgtctctatggaaatggcaaaactaatgttccctgagtatgtgagagagtatgcacattttctaatttgttcaagatcagttctttattttcaaattgttccatcctctattttttaagttcggttaaatgcaagttctttttgttaaagataaaatgaaatcaaacatgaatactccatttttttagttgttggacaaagcacagttacaagagtaaaatcctaagctatgcattgatgaaatccaatgcatcaagatagatttgcttatcacattgcaaccttattggcagcagaccattactttccaatgttcccttcttcagatgtgggatggcataatgttgccctccttttgcacgcataatctctctcacgcaaccctgttgtgtgagaaacacacgattgatagactnctgtnccatctgatagtgcatngcaatcaaaccctg

SEQ ID NO: 69993 - DNA, 784 bp, Oryza sativa
ttaatataaaaaatagggaacttactttattcaattgttgtacaaaaaacaaagaaagaaaagaaccaatacatgtgttgggatgttcactacctagcacttgcttctgatatagcaatgaaagacatgcattgtggttacataacactgatggtcttatgagagtaggttccagctgctagtagttaaggggacacagttacatttaaaggaatatgggcacgtggaaagagagaatttgaaaattgaggcaggggattgctgaggcacccattctaggaacaattatgtgggtcaatcaagtcggtcagctaatgtaatataatccttctgacatcactttgttcgtcagtttcacaaaaactgcctggtttgactttcctcattctgaagtgaaggcaaccagatcaagcagataaagtcactttgtttttgatgaggacatcaacaccctcggtacatccacatctccacaagtccaacttcatagtcctattacccgtgctcgtgcacgtcaagtcaactatcaggtgagttcattcttgagtccatgttcatcatctttataccccagagacacgtgcactcttgttttactcaggaacaatggagaggatccagaggggagaggattcgcgcaggctggattcggactgcaggacagcaccaacttttgacgatcgccacgacttcatacgaactccgatttggcgtgcaagtacttcatcgaaaacttatcaagtctatttcaaatggatccggcctcatgtcaaagatggtctgg

SEQ ID NO: 69994 - DNA, 760 bp, Oryza sativa
cggcccggtgacgcgacgcgcgacgccaggaataacgggtcctgctgccggtacagggggcgcgccgagagggagaggggacgtggcccggcggcggcggcggcggcggcgaagaggggaggaaggtggaggggcttgaataatgccatcttgggcgccgtggcggtcccggccgtggagagcttgacggaggcggcggcggcgagcatattggcggcgggaatggtggcgccggcttcttcagttacagttactgtgttgtgttgtagccggccgtccgtacgtctatggcggcgatgggtaggggggaggtgttggggggaggaaggtatttatagggagcgcgcgaagaagaagggaggcggttttgtgcatgtatgtcgccagccatggcatctttctcaccgtagtgaggtttttgatttttgctgcctctgaattattgcctttcttttttcttcttaaaatgtgcatttctttcttttttatatacagtttgtccgctgtgtcgtttttcgatattacaattatttgcgattaatttatggtcatgttttatacataatgctcggttaattgtatataatgcactatcgatccaccatgcacgattaaattcagctataaccatattgggaggacataaatactatgcattatgttaagaaaaggctagtgcttccatgatttgtgcctgctaagggcttgttcggatcacaggataggaaaaagcataggaatagaacggggatccactagt

SEQ ID NO: 69995 - DNA, 521 bp, Oryza sativa
tagttacgtcctctggaatcgctaatcgagttaaatggagtcgcgcgctagcggcgcgtacgcgcgcgttagctttccgaatctggcctggtgtatggagtcccgaacaggcccataaattggcgttcggagcccaaaacctctcgcatttccagcccatcaagtcgcttcgtcctgggcttagcccaccacgtctctttctcagtttctcggcccgtccgccgttggttggctgcttccgctctcctccaatccaaggctccccgcgtccccgcccttctcctcccgcgccgccgttcgcgcgcgagaaaacgaggcggcggcgatatcggatggatgatgccactgccctctctctctctctctctcgccttcgcgcgcgcgtgctaactcacagcattggtaagtgcgaggtgatggtgccattgctgctcgtgcgggatgcggtctcgtggtcacgaggttccctatgatgcccgcgacgtgttcgacggtttgcgcgagcgagggaggcgcggcgg

SEQ ID NO: 69996 - DNA, 1822 bp, Oryza sativa
caccgcggacttgctttagctcctcacctgagagtgtcagaatggaccgcccaatgatggtgttgatcgcctttgtctgggtgaaaatgaggtcctggttgctgaatacaaagtgattggccgccgggccagccataagcaccgtcggtgagccaaaaagtgacatcttgaacacagggccatacttcttgatcctgtcctggtaccactggtaatcagtattactgcggagggcacgaagaagggagatgctctggccaatcactgggaagccaagggaacctggagggagattataggatgagtacttgcgcctgatgacaaagtggaggaggatgggtatgagcaaggcaagcagcagagcaaaaggcatggatgaatccattgatggagtatgttgttatgcactatgaaggttggctgatcagtttgtggatttgtatacatgtatatatgtaggcaaaccagagttgttttctttctccatgatagacaagggtgtatggttgaacaaatttgatattttctcccgaactcagtaaaaggcctagttggtgaagctgaatatatcactttctcaaaagtcatacaacaaacaagcaaagattacaaattgagataaggggacagaaagatcattgtcaccagagtaatgagtctgattcatgataataacttaaaatattagtttataagtaaacaattctattacgccacatgataggagcagcttagcacgacatatgtgaataactggaaataaatggaagccacagctcaaagaatcacatttatgctagccaatataatttctagatttatgctagttaaagaatcgcagttcctcctcaaatgaaagacacaaaaacgaattccctaaaaaaactaagggaagaacatagacacaagcaaataaagagatgaactgaatattcctttggatctaatattagtttgaggaaagatgctacatacagcagcattaaattttgcaaagcaagcaaagcaaaccattgaaaagatctggtgacaacaatttggtcatccctaaggaaacgatccatgtcctatcctatgtaataagaaattttgaacaatattctagatttaattcttctgcataactgcaggactctcgatcaacaagtatagttttagccttagcacaggccatgtatgcaggacagccctttttttttggcatattattatgcagaatatttgccaggaaaaacaggtagacatttcaaaaattagaagcaaattacatacttagtggtcagaaaagtttagctccagttctatatatgtgcctgtgcacaaaatgacacatttaccgtagccgcagttcttctgaaaatggcatggccctgcaatatagattacagaacagtacttcacaatatatctagggtgtgttcagttcttgaaaaaagttggaagtttggaaaaaaagttaaaagtttacgtgtgtaggaaagttttggatgtgatgtgatgtgattgaaagttagaagtttggggtagttgggggtgaactaaacacaactctataagcagacgattcctcccaaatatagcatggccgtttatttaataacgtaggcaaaatcaatgcattatcaggatacaccacaatgacctcgagggccacttagatcctgaaaaactgggcaaaaaaaggaaaggaaaacgacaggtcggataacatattctgaaaatccacatagtcaacttctaagaacaaaaaatgtacacagacagatggacttcgaagggatagactctacccaatatagattcggagatcacatcatgaatg

SEQ ID NO: 69997 - DNA, 530 bp, Oryza sativa
atatatatatatggtttcatacatttccactaaataagttaggtacggcattgttatttctccgaaataggctctttcaaaatagagcaattttacggtccttaagaagtaccatgatgtaccacttttttctattgtaaatttggtacctcttgatatctatgtactattaggtaccaaattttacactgaatttttttttgtaccttatggtacctcctgaaggaccgtagaattgctcatggtcctcattgctcccatgttacctatttaaagaaagttaatttttgttagaaaaataagttattctaacccaaacatggaataaactttacagttcatatttttttccaaaaaaaatacatgtgaaaatattcaaacttgggtaaaataaaaccaaaccaaatataccattagaactgtagttaaataaacttaaattacaaattaagcaccatggttttaggcttgacattgtgtagttcttggtgaatgaaaatctacaaacctttcaagctccctgaaataca

SEQ ID NO: 69998 - DNA, 687 bp, Oryza sativa
  unsure (1)..(687): unsure at all n locations
agctctctcgnacccttgatacgtaagcatagggaaaactgtgtctagagattagagatctagaaaaatgttttgctaatatattttccttttaagaagcccagtactatttggaaagcattatcagttatttcgtccatgtacataacnatctgtgcaaggcttgccaactatgttatcaatgttatcagtgtgttattttcttattttgtattatcaagcacagttctctttccttcctatgtcatggatttctatgcatcctgagggaatgaagccgtgccaattctgtttttatgtttactgctgtcctagatgttctacctttgtaaccttcctgtgcttcatcattgtcatcagtccattcactattgcaggaatccaaactcaacccttgtgctagggtcttctctccttcgtttgcaagttccagaccagtacttgcagctgcaccctctgttaacccaatctacatctcaaactctgtagctggagttccaaccgggttacctgtatttgaaactaactcagtgccaggcggttcatccctgtccagcaaggctgttcattataataacctggctgctgcaaactatgctatttcacctcaatatactcagtcagtaagttctttgattaattcttttataatatcattgttgcttcaatagttcatcactttcttca

SEQ ID NO: 69999 - DNA, 661 bp, Oryza sativa
tattaagtgctaaatcgtattttagttgataatattaaaaaaaaatctccatacaatttcaagaaacgaaggctgcagcttgggataatcaaattacataaagggaatccaggcacggagaaaatgagtacaacattgtatcggtctttagctctgttttctttagatagtgtttcgcttggagagcgagcaaagaaaagaacgaaaatatgatccgcagaaaggctgaagacagcattggcacccaaatacaagctcaatgcttcatgtgctcacaaaatcaataacctttttttaaccttctgttgcatctacaaatccccaaatcaagcatgtatatcacgcacacaccaatctatacaacaatcagcacagcgcgtatgcacaaaactacacccattgtcaccgtgtgtgcgttaactaaccgtgaacttagctcatcttcttcttcccggtgttcacaggctcgagcggcttctgcgagtccgggaggctgtcggcgtacagcgagtgcaccatcttcacatactcgtcgatcctcttcttcacccacccgtccgtttcgatcggcggcagcaccttcacggtgagcggcgccgggctgacccgcaagctgtttttcttcacgccaggtgcgtgccggtcaccaccatcgcacgat

SEQ ID NO: 70000 - DNA, 606 bp, Oryza sativa
cgcggcggcgaagagggtgatgctcttcgcgccgccgccgccgagcccggacctgcccgtcgaggtggccatggagttcctcggctcgccggacatggtggtcgccgctcactaggagggcggatcgtgatgtatttgctgcgatagacctgtagatttggggatctagctctcccttgtttcgatagttttgtggtttatgattttttttttccttgtttggttgtactgatatgtgaaaacaaagacaaaaaagaatacttatgctttgatttgctaaaaaaatacgaaagtgacagaaaagagttgcaatatgactggatgctcttactgtgatctattgaatgctctgtgaattgaagctattttgttcttgatttttctatgggtatagcatgttgtatttttcattgccgtgtgaaagtaaagaggagctggtattacttcagaaattgaaagctatttgtctacagtaagtaaatttgtttggcaactaccctcttatctgacataaatcttagtatgctttcttggttgtaactgctagtaaccaaaatcattagtcagagctgccttcgaattaactttggtcatgtttttctctta

SEQ ID NO: 70001 - DNA, 10042 bp, Oryza sativa
tcatgctcaaatggtcatttgagatctgtgtgacttgccttgctggccttggaactcttcaaagtcttctcctgcaaaatcggactctccgggaacgtcggaatctaagcagaaaagagcaaaatcaccaaaacagcacataaacaatcatgaacagtacatgtggatatttttaacatgtagatctcaattttagaaaaatttagagacttgaaccaactaaatccgagcttagatgaattagttatgaatttttaaagattaaatcggattaaatcatttatatagattttaattgaattatgacgcaataaagaattatttttgaaaaggaaaaaggatttattgcttcagcggctcgggtttacggtggaccgggtgcacaggaatggtctacggaatggacggctgagatctaatcctatccaaaacggatggccgagatcaacttgatctaccgcggtctacggctgacgtcgacgatgacatcggcgatgacgtcaccaccgggggcggctcggccacgcacgctcgccggcgaacgatggcgcggcggcgcaaacggagggcacctacgggtagcgggcgacgcggcgaactcaccgcaagcacggacggcggcggacggcaaccagacggcgacggcgacgaggttgaagtgacggcggcgttcggttcgacgacgacggcggtgctccggtgatcttcgacggaaacagaggggtggacgaggacggtgacgacttggcgaacctgacggtggccttcccgagcgacgacgacgacctaagcgacggtatgatccttttgcttcaatgccctgaactcacgcttcttcaaagcaacaactcctacaggtatgtgtgtcttcttgaatgcctcagtgaactccgcccaagtgattggttgtccttctgctctgttcacccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttagtagtactagaaaaggtaggtggcctcacacgaagaaaatcagctagcttgttctgcggcggtggagcattgttgtttccttggttgagctggttctgcatctgctgtatcatcatgttcattaattgagtctgttgagccagaacttgagcaagagttgggttatcttcattgttattatttccacttccactggtgcgagtgttcaccatctgttgcatattagagaagatagaaggagaggggttacactaaagacaagaccttaaccaggttaacactgatctgatgtgtgtagaccattatattgttcaggttgattaagcaagcaacctagtacagttacacactcatcaatgaactactccaatgatgggaatgcaaccatacctacacacaaagcaaacaaacgttctaccctactaactattcttcaaagacactttggcggcataggtttctaaggtaggatccaaacttcattccatcttgaccacttggcacttcggtccttcctcgatccacttgactgacctccataagtagacctcattggcgtcttcaagtttcaacaactagtttcagaactactcaagttgaaagcaggaggggagaggatgataaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcatgaaatcctcgtccaggaatcagccgaggtacacaaattgacaatttaatatacagattcatcaaattaactaaaacgataaatacttacttaagaggcactaagtcctcaccaagaagaaaactgcagcggaaaataaaatctagcgaagctccggctacactcccacaggcagctcaactggggtataagccaaacgtcttctccttctggatcctttttcttcaactgaggttgattgattattgcaaggtgagcatatgacatactcagcaagccacacaacaaatatgcaagtgcacaaggataccaaaggatggcataatataggctcatttgcaaaagcagcatttagcaaaacatttaagaggaataaaatagtggagtagttaatcagaaattttaatcaacactgaacagcacacccatgctgcacaggcccaaccatcctgaacaaccatacccggctgtacagatcaaatctccaaaccaggagctaagcaaattattaccagtataacatcattaattattgtgagaggtgtgagactaatcacgaaaaacattgctcaactcgcccataaccgcgggcacgactattcgaatagttttactctggccagaggtgtaccactgtatccacaagacacagcctcaacatcatgtctaccatgcgtcgcgatactggaaagtacccgaatagaagctgtgacaataccctctgcacaacacaactcacgacagtgcaccattcctggatcataatcacccccttataaaacaaggcatggactccccagcgacccctgtgggcttatctccgccacttctcagtctggtgctccgcaatgaatcatgctatacaaaaggtaaagctgttgcccacgctggcttgtggttggcacgattaatgtttcacaatagtagctcgcgaaccggtccttaattgtcatgagcacgactctcaaaaccatgtactcacaacccaccattatcaagttttagttggcaagtaattaattaaccaatcacgattgaccatcgtgaactatcattaagccatcataataatgagtcataagttatcccaatagtgtgctaatgtttctaagcatggctaagcaatcatatctaatatctagctgaactaatatatatagctcaactagttaagttataatatcccaaggtatcaaggaatagagtaatcaatgcaaacaggccataacaaaggaatagattcacaccacccaatgacattcgaaaataaatacacagttgaaataaatagagaatttaaatataggatcaacatgctcaaaggattgtgtttaggatctgtgtgacttgccttgcaataatcggtcttcaattaatcttcttgaatacttccggcgcactcgcgaacctttgcaatgacggaaacgacaagctaacacgcaaaacgaagaaaaagactaataaaaaccaaataaacaatacatataaagtaaacaaacatgtagattataattttagatgaattatgagacttgaacggcctcattctgacttcaaatgaatttattatgaattttacaagattaaatctatttaaagcccatttaaaaagaattaaataaatttaattcaatttatggaaaattttaatatgtagatctttattttacacaatttttgcaacttgaaccacattaaactgagttcaaatgaattagttatgaatttttaaagattaaatcggattaaaacacttatatggattttaattgaattatgacgcaataatgaattatttttgaaaaggaaaaagggtttattgcgtcagcgctagggtttgcggtggaccgggcgcacggcaacggtccacgggaacggacggccgagatcaaccctatccaaaacggacggccgagatcgatcctatccaaaacggatggccgagatcgaacggtccacgacgggtctacggcagacggccacgatgacgtcagcgacaacgtcagcgatgacgtcagcaccggcggcgactcgggcggctcgggcgcgcatgctcgccggcgaacgacggcgcggcgacgcgaacggagggcaccaacgggtagagggcgacgcggcgaactcaccggtgaccaaagaagcggcggaggaacaacggacagcgccggcgacaaggaagaagcggcggcggagatcgggtcgacggtggtgacggtgctccggcggtcttcggcagcggcgaaggggcggacgaggacggcgacgcgacggcgaccacgatggtgacctccccgagcgacgacgacgactggagtgacggcggcacacggctggagcggcggcgacaacggcggcacgaggcggcacggcgctagggcgctacaagcgacgagaggcgaaggcgagggtggcggcggttagaggagagctcgggggtccttttaaaggggctagcgagcggcggcggaggcccacggcgaccggcggcgagaaggaaagattaaggttagaggagagagatcgatccgaatcaaactcgaatccacggatttccaaaccgaattagctcatgattccataagagaaaagatagaggagatctcaaggatcatttgccctcaatcaatttcacccgatcgggaaagacgcggccgaatttggaaggagacggcggcacggctcggctagggttcgggcggcggcggcggcgcgaggaaaacgaacctgacaggtgggacccacctgtcagcggccgagagagaggaggaaggggcgcggcggactaggccgactgggccggggagggagagagaaagagagaggttttgggccgactttcggcccaaagccaaaaggaggatttaaaaacatttttctatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttagacttttaaaatcatttctaataattccttttaaacaacaatttataatttaaggatttttaaacaagaaaaactcttaacaattataattagatcattatttatcaaataattactgaactgttctttgtatcatttaggaattgagctccgaaagatccgagaatatttcagagagtgtaattaaccatggagaatttaataaaaaaattaaatccattcatgctttatatttaggaaattttatttcccacatttaacttcacttgtaaattaaagatcatttaatataaattctattattagtttattaaataatttataaatcctgaaacaaaaatcaggatgtgacagaggcccacggcggccggcggcgagaaggaaagattagggttagagggagaaaattgaatccgaatcgagctcgaatccgacgatttccaaacgaaattagcgagagattccaaaagacaaaaggaagaggggatcccggggatcatttcccctctattaatttgatcggatcgggaaaggggcgggcgaatttggaaggggcggcggcggctagggctcggctgcggcggcgcgaggaggaagacgactctgacaggtgggccccacctgtccgcaggagggagagggggagagcggcggctcggctcggcgggctggatgggcctggcgctagcaggccggggtgagagagaggggttttgggccgactttcggcccaaagccaaaagaggatttttaaaacctttttcaatttaaattattcgtgaaatgcaattctatttattaaaaatacttccttggctcaaataaatcctagaaaaatctaggaactatagaatcaaatgaagtatttaataaaattttatctagcccactttcatattggaatttattatttaaaattagatcttttcttctaggcttttaaaatcatttctaataattccaattaaacaacaatttataaatttggggtttttagggtgtgacatgtatcctttctgaagcaaatcatctacttgcctcttgacctctgctagttcattggctgccattctataaggtctcttatggatcggagtttttcttggtaccagatctattctgaattctatatctctcttgggcggcataccaggtaaatcatccgggaacacatccgggtagtcctgtactatgggaatctcttccaaacttacttggttcagacttgaccttaaaggctcagaaggcaatgcgtaaacagttacaacttgaccgtcattgctggtgagagttacttttctattggcacagtctatcacacctttatatcgggctaaccagtccatccctaggatgacatcaaggtctttggattctaatagaataaggttggccagaaatggtactccttgaatctctattctgacggaggggctacgttgtgacgagagtgcttggttgctgggggtactaaccatcaacggacgtctaagatcttctacctccatcccgtgatttctcgcaaaactcatagacaaaaatgaatgtgtagcaccagaatcgaaaagcactgttgcaggaactgagttaacaaggaacgtacccaaaatcacatctggagcaccttgggcttctgcagcagcaacatgattgacacgagccttggacactggtgcggtggagttgttctgtgcagggacaaccttcacgcgccggggcttcggacacttgtcagaataatgacctggttccccacagttgaagcacactcttggcttgtttcccggctccctcttggcaggctgatgctgggctagagttgcaacaggacgtggagcttggttgcggttgttgttgccagaattgttgttgaagaactgacgctgtggacgggcaaccaacgaagatcctccctgtgacactgcctgaggtcccatagcaagacacggcctctgactattcccctgctgagctttgaagtgagcaatcctgcgtttcttctgctccattcggttgtacttgtcctcctggcgaatggccatatccaccaacttctggaaatcatgataatccccagtcattaatgggtaagagagctcatcattcagtccttccaagaacttctcttgacgctcttcatctgtacgtacatcttctggagcatagcgagctagacgattaaattcatgcaagtattcagtgacagagcgagatccctgagtgagcgtcctgaactccttcttcttgggagacaccactcccgacggtatgtgagttttccgcaaagcagcagtgaactcaagccaagtgattggttccgcagtggtcctgttgagacggaagtgatcccaccactcagaggcagggccatgaagctgatgtgaagcgaaggagactttttcttgattagtgcactgaagcaggtccaatttcttttctatggcgtgcagccaatcactagcctcaactggattggtagtgctagaaaaagtgggcggcctcacacgaagaaattctgctaacttgttctggggaggtgcatggttgttcccctggttctgctggttctggaattgctgcatcatcatgttcatgagctgtgcctgttggaccaggacttgggcaagcgtgggattctctccattgttgttgttgttgttgttgttgttgtttgggccattcccattgctgtgagtaagcaccatttggcataggcaggagcacaagaagagaaacaaggaggaaaaaactacttaggacagggaattgatttttattaacttgacttttattgatcttaactgagtttcattattacacaaaactgaagactctcacacaacttaacttaaactccctaacactcgaaagcaaacaaacgcatgcatttacatcccaacaatgatgtaaaccacatgcaagacccacacacgcaaccaaacttaaacaagcaaactaacacaatgatctagggcaacgacttaacaaggcgttctagatcttccgggcatcggaattgattgaaggctcgttcggcttgcccccatcatcttgagtagctccccactcgacctttgaatgggtgcgcttcgattcttctccatcatcatcacttacgttaacgaccgaaggattcgctgagactgggacaacttcttcttcttccaccacacgaaccttaggcgccaactggtagcgagggacaaatagagctctcttccttgtggtaagacgaaccctggccttttgtggtggtgcttctcccttcaacgcggctagttccttctccaaacgatcaactttgtcctcaagcttacatatcttaccacgattccggtcttcacgatcttgagcagctaacacaatctcagcgcggaactcatccatggcccacagcatctcaaccaaatgccttgtggtagcatcattctcaattcctgcaggttcaaggtagctgccacggtcacttccctggggttggcgaggatggtagcgatactcagtgtcggccaactgatcactgtagcaatcgcgaagctctcctatggcgatccttgccacctcctgacaagcatgaatgtagtttccccctccagcctcgaacatcagcgatgggatgtcttcatgattagtgttcaaggtgaccttgacacggcacttctcttcatcacggtcatgaggaatctgggcatacaaaggggcagtcccaaatcctatggcgaaggacatcgtacgcaactcctggacaaatccctcagtaccgaacaagtactcaggcttgaagcgcggcatctaaagacaagtgaaaggagggagttaagacatttatccaattaatagcacaagtttttggattaatttgaataaagttagaaaatcaaagtaaaaggtaaataaataaagtaaaccaatcttgcaagataagttgaaacagttgaaaacagaatcacaaattttgcacttttgaataacaggtttcaaaagaaataaaataaaagagagttataaaatcaacatgctaaattatattgcaacatgattgaataaataaataaataaatgaaaggttgtaaaatctctgctagaaagtgggccattagtatagtaatagatgtacagtactaacaacacaggaataataaataaattttgaatgagaacaattaaagggactataaactgcatgtgccattagcttggtttaattaaaagagaaagagaggagaacagttctactttttcaatctttttagagggcttctataggtatccatttggcataacctagggtcaatgtggctctgataccaacttatgacgcccggaatttctatccaaaattccaaacgcttacatgtgtgtaaaccctcgtccaggaatcagccgaggcacacaataacaaattgataatagagtgcaataattactctaataaataagcgaatagaaagtcattacagaggtagatagttcctctcaaacaataaaattaggaaaataagataaacggcgcaggcgactccattccacaagcagcttgaccagggctacgcctaatcctccacaccttcagcatcactgtagaactcctatgatgaatgattgcaaggtgagtatatgacatactcaacaagccacgcagcaaatatgcaaatgcaaggcataacaaaggatggtataatatagtctcatttgcataaatggcatttaataaatacttcagaatttaataaaacagtaaagtatttaattaaacaatattaatccatcgctatacaacatacccgttgcataggcccaaccatcctgaacaaccattcccggctgcacagttctatctccaaaccaggaatataccattccaaaccaggagctaaacaagttattaccaattacagcatcatttattacggtgagaggtatgagactaatcacaaaagacattgttagacccgcccaaaaccgcgggcacggctattcgaatagttttactctggccagaggtgtaccactgtacccacaagacacaacctcaacatcatgtcaaccatgcgtcgcgatacttaacaagtacccgaatagagatggtgacaataccctctgcataacacaattcaaagcagtgcaccgt

SEQ ID NO: 70002 - DNA, 6457 bp, Oryza sativa
ttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcatttaccagcaaaagttttacaatactgttttatttaatcttgctgcaataaaataaatttagtatgttgattttataactttcttttgaaaccagttattcaaaattacaaaatttgtgacctcgtttccaactgttttaatttatttcgcaaagcttggtttactttatttacttacctctttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgcacgatgtcctttgtcattggatttgggactgcccctttttatgcccagattcctcatgatcgtcatgaagagaagtgccgagtcagagtcaccttgaacagcaatagtgaagaggtcccctcagtgatgtttgaagctggaggaagaaactacatccatgcatgtcaggaggtggcaaggatcgccataggagagctccgtgatcgctacagtgatcaattggccgacactgagtatcgctaccatcctcgccaacctcagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgctccagctcaagcggatcctccggtcatcatcataagtagtgatgaagaagaagaatctaagcgcaacaattccaagattgagtgggtagcaactcaagatgatgaagacgagccttcaatcgacctccgatgcttggaagaactagagtgacttgttaagtcgttgtcttagatcgttgtgttagtttgcttgctttaagtttgcttgtgtgtgtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcctaagtagtttccccggtttctcttcttgtgccctgtccatgccagatggtgaacactcgtagcaatgggaatggtcccaacaaccccaataacaacaacaatggagagaatcccactctggcccaagttcttgctcaacagacacagcttatgaacatgatgatgcagcaatttcagaatcagcaaaaccaagggaataatcatgcacctccccaaaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgtgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctacgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttaaaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcaacttaaaggtgccactgttttctccaagatagatcttcgatcagggtatcatcagttgagaatcaaagaggaggatatacctaagacaacttttaccactaggtatgggttgtttgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaagaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggccttgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgcattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcatcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcgatagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcaaaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtcttcagatggctccttacgaagcactgtatggtcggaagtgtcgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagtacataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctagttttaattaataaattccaatataaaatgggcccagataaaatttcattaaatactttgcttaattctataattcctagatttttctgggatttatttgagctaagaaagtatttgtaataaatggaattgcatttaagaaataatttaaattgaaaaaggttttaaaaagtcttcttttggctttgggccg

SEQ ID NO: 70003 - DNA, 17036 bp, Oryza sativa
  unsure (1)..(17036): unsure at all n locations
tttttcgtgattagtctcacactacccattaatggtaataatgtggtaattaatttgatgcctagtttggaatggataattcctggtttggaggtttaatttgttcaactggggttggttgttcaaatgtggttgggcctatgcaacacgggtgtgttgtatggtgtttatttaatattggttaattatacaactgttttactattctcttaaatatttattaaatgctgttttctgcaaatgaactgtattatgccatcctttgttatcctgtgcacttgcatatttgctgtgtggcttgttgagtatgtcatatgctcattcttgcaatattcattcatcagaagaggagtacttgagtgaaggtgatggtctggaggattaggcttgtcctggttaagttgtctgtggagtggagttgccatagctgttccgtagattgttttagtttaatttttccgctgcgtagaatgttattttttttgagaggaactatctacctctgtaataatttattatttgcgattgttaaatagttatttaattgtactctattatcaatattgtcattgtgtgcctcggttgattcctggacgagggtttaacacacatgtaagcgtttggaattttggatagaaattcagggcgtgacaagttggtatcagagccaccttgaccttaggataagccaaatggtaaaccttaagtagccttcaaaatattttgaaaatagaactgctcttctctattctcttataaattaattaagttggcaacacatgcaaggttatgcacaaaatttatttaattcaacttcttttcttttaatagcaaaaagttgttcttctcaaaatatttcttttttcttattgattagtcggcactgtacatctattatggtatcgacataatcatggtagcactagtactactcatctttcttgtggtgacactgtaccgtgcttaaaatagatcataagtattttagttttgttttagttatttgtcaaaaaaaatatatttgtctctatctaaaaagttaaattctaaaaatatttataaaatagctttttatgtgtcttttcttttattttcttcctttttggtcaaaaatcagttaagtctagttggtgcagctaacttagaaaaaatatgcattaattcttctcttccatgtttctttagatgccgccccattcaccgagaaatttgatcgaggtgttaggattcgtcagggagctgaggttgatggcttttgaggtaggttatgaagttgctcctgagtatcgccagatttcccatgaccccgacgaggagaagtgtcgtgttcgtgtgacgttggctagtgatagagaagaccttccgtctattaagttcgaagctggaggaagatcgtactgccatgcttgtcaagaagcagctttggtggccattggagagttgcgtcaacgttttgaagaagagttggattcatcagctttccagtatcatcctcacaagcctcatggtcaagactatggaacctatatctgtcctgatggtgaagagagtgccactctgatgcatgtggtgcatatgcttagtgctatggatgcagtaagtgtggagcgagacaaagcagctcatgacagggaaaactggaatcgaggcaagatttgcaagttggagagcaaggtgtaccgtctacagaaggaattagctgaactcaaaggagaaacgccgccgccaacacccaagcttcgcctcgtcgcaagaaagagaacctgtccgccacctcgtctccagttagcttcgaagattcgcgtgatgggtgaagctgtgcccgatcgtgctgaacctgtcatcgacatcataagtgatgaggaagaagaggaagaccctgaagaaagagagccagctactccagaggaagaagatccatcgcttcgttccgacgcaaggcgggattagtcgcttagttagatcgttgccgtagttcgctgtgttagattgcttgtttaagtttgtttgtgagtgtgtgggttttagttgttgcttacatcattggtgggatgtaacagcatgagtctagttcttttgcttgtcagagtgtaagatagttggtgagatagtgttaatgccacttaaatgtaatcatacacagttaagagcaatatagaatttaaattaattaagtaactccgttctaagggtgtctctctgtcgttctttcctgttgtctctgcttatcatcagatggtgaacacgcgcactggcaccggaagtggaagcggaagtggaagtggaagtggagctactaacaatggaggagatcccacgctagctcagattctggcccaacaaacacaactgatcaatctgttagtgcagcaggcacagaatcagcaggcaaacaatcagaatcagaatccacccccacctccccaaaacaagttggcagatttcttacgtgtgagaccccctaccttttcaagcaccaccaatccagtagaagcaggagattggttgcatgcggtggagaagaagttggatttgatccagtgtactgagcaggagaaagtttcttttgcttcgcatcagttgcatggacctgctgctgaatggtgggatcattttcgccaaggcagggctgaaggagaacttatcacttggcaggagttcacgactgcttttaagaagacgcatataccgtcaggtgttgtagctctaaagaagagagaatttagagcactcaatcagggatctcgttcggtcaccgagtacctccatgatgtcaaccgtttagctcgttatgctccggaagatgttcgcaccgatgaagagcgtcaggagaagttcttggagggactgaatgatgagttgtcttatgccttgatgtctacggatttccgggatttccagcagttggtggacaaggcgattcgtcaggaagacaagtataaccggatggagcagaagaagcgcagggctgcccaattcaaggcacaacagggcagtaaccagaggccgcgtctcgttactggacctcaagctccatcgtaccctcaaggaggatcttcatcagttgtccgtccccaacgccagttctacaataacaatactggtaatcgtggcaatgacaaccgcaacatggttgctcgtcctgcagcaactccagctcagaatcagcccgttaggaaggaacagggaagcaagccagtgatatgcttcaattgtggtgatccaggacattatgctgataagtgtcctaagcctcggcatgtgaagaacgctccagccccgaacaactccaatgttctagcaccgaaggcacgtgttaatcatgttgcagcagcagaagctcagaatgcaccagatgttgttttgggtacgtttcctgttaactctataccgcaactgtgctttttgattccggtgctacacattcctttttgtctaaaagttttgcgagcaaacatgggatggaagttgttagtcttgggagacctttactagttaataccccaggcaatcaagtattttcgacatagtattgtccttctgttactatagaaatagaagaagttcttttcccatcctcgcttatcttgctagaatccaaagatctagatgttatcttagggatggactggttatctcgtcacagaggagttatagattgtgccaaccgtaaggtgactttaaccagtagcaattgggaaaccgtttctttctttgtgtcctcccctaaatatcatggtgtgaacttaaaccaagttgctctacaagagattcctatagtacaagactacccagacgtgtttcccgaggatttgccaggtatgccacctaagagagacatagagtttcggatagacttggtgtcacaccctgaaaattcaaaatatataaattgttgtttaaatggaatttttagaaataattttaaaagtcttgaaaagaaaatctagttttaattaataaattccaatataaaatgggcccagataaaatttcattaaatactttgcttaattctataattcctagatttttctgggatttatttgagctaagaaagtatttgtaataaatggaattgcatttaagaaataatttaaattgaaaaaggttttaaaaagtcttcttttggctttgggccgaaagtcggcccaaaacctctcttctctctcctcggcccagctggcccagtcagccgcgcgcgcgccctcgctgtcgctgacaggtgggtcccgcttgtcggtcgtcgtcttcctcgggccgaaaccctagtttcgcgccgccgagctgccgtcgccgccgctttccaaatccggccgttcctttccttctccggccgatttgttagaggggaaatgatctccgggatctcctctaccttttctcctttggaatctttggttaaatcgctttggaaagctttggaatcgagttcgattcggatcggttttccctctctccaagccgcgagtttccttcgccgttgccgtcgccgtgggccttcgccgccgcctccgagcccctttaaaaggacccccggtgtctcctctacccgtcgccaccttcgccttcgcctctcgtcgtcggaaaagccctagcgccgtgtgccctagctttgccgtcgtcgccgtcgctccagccgtgcgccgccgtcgtttcagccgtcgccgtcgctcgggaagaccgccgtcgtgctcgccaagtcgtcgccgtcctcgtccgccccttcgccgtcgccggagatcaccggagcagcttcgccgccgtcgacccgaagagcttcgccgcttcctcctcgtcgccgtcgccgtccgttggtcttccgccgccgtttaggtcaccggtgagttcgccgtgttgtcctctacgtcttggtgccctccgtttgcgtcctagtgccgccgttcgccggcgagcgtgcgccgttcgagccgtcttctccgccgagccgccgccgctgtcggtgacgtcaccgctgacgtcatcggggtcgtccgccgtgagccgccgtggacccgatcgatctcggccgtccatcttggatcggttaaatctcggccgtccgttcgcgtgaaccgccgcccgtgcgcccggtccaccaaaccctagcccgctgacgcaataaatccccttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgcttctttttgcttagattctgtcgtttccggagagtccgttttcgcggaagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattgttatggccctttcgtacttgattaccttattccttgataccttgggttatattaatttgactagttgagctttatttatattggttcaactagatattagatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgggcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccggggtggttgttcagaatggttgggcctatacaacagggtatgttgtatagcgttggcttaatattgtgtaattacttaactgttttgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacacttggtacctggaaccaacccaatccataagagaccatacagaatggcagctaatgagttagctgaggtgaagaaacaggtggatgatttgcttcagaaaggatacatcagacccagtacttcgccatggggagcaccagttatctttgtggagaagaaagatcatactcagagaatgtgcgtggattatcgagcgttgaatgaggttactatcaagaataaatatcctctacccagaattgatgacctgtttgatcaactggaaggtgctacagttttctccaagatagatctccgttctggatatcatcaacttcgaatccgtgaggaagatataccgaagaccgccttcacaactcggtatggtttgttcgaatgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagagcatcttcgtctagctttagagaaactacgtgagcatcagctttatgccaagttcagtaaatgtgaattttggttgtccgaagtgaagtttcttggtcatgtcatctcgtctggaggagtggcagtagatccaagcaatgtggagtcagtattaagttggaagcaacccaagacggttacagaaattcgtagtttccttggacttgcatggtattaccgcaggtttattgagaacttttcaaagatcgctagaccaatgactcgtctacttcagaaggaagtgaagtacaagtggacggaggattgtgaacgaagtttccaggaactgaagaaaaggctagtgactgcgcctgtgttaattttgcctgattcgaggaaaggtttccaagtgtattgtgatgcatcccgacacggtttgggttgtgtgttgatgcaagaaggaaaggtggttgcctatgcatctaggcaattacgtcctcatgagaataactacccaacgcatgacctagaattggcagctgtggtgcatgcattgaagatttggcgtcattatcttttcggtaaccgtactgaggtatatacggatcataaaagtttgaagtacatttttactcaacctgatttgaacatgcgtcagcgaagatggttagagttaattaaagattatgatatggaaatccattatcacccggggaaagcaaatgttgtagccgatgcccttagcaggaaaagttactgtaatatgtcagaaggtcgacgtttaccttgggagttatgccaagaatttgaaaagttgaacttgggaataatcagtaaaggttttgtggctgctttagaagctaaacctactctgtttgatcaagtgagagaagctcaagtgaatgatcctgatatacaagaaattaaaaagaacatgagaagaggtaaagccatcggttttgtagaagatgagcagggaactgtgtggttaggagaaacaatttgcgtcccagaaaataaggagttgaagaatactatcatgaaggaagctcatgaaactttgtattccgttcaccctggaagcactaagatgtaccaagacttaaagcaacaattctggtgggccagtatgcgacgtgagatagcagaatatgtggctctatgtgatgtatgtcagcgggtcaaggcagaacatcagaaaccagccggtctgttacaaccgttgaagattccagagtggaagtgggaagaaataggaatggattttataaccggtctacccagaacgtcggcaggacatgattctatttgggtagtggttgatagattgactaaagtcgctcactttataccggttaaaacaacctatacgggacataagcttgcagagttatacatggccagagtggtatgtttgcatggtgttcctaagaagatagtgtcagatagaggtagccagtttacttcgaagttttggcagaaattacaattagaattgggtactcgtttgaatttcagtactgcttatcaccctcaaacagatggtcagacggaaagagtaaaccaaattttagaagatatgttgagagcctgtgttctagattttggtggaagttgggataagaatttgccgtacgcggaattctcatataacaacagttatcaagctagtttgcaaatggctccgtatgatgcattaaatggtcgaaagtgccgtacgccgctcctttgggatcaaaccggtgaacgtcaagtttttgggacagacatattgcgacaggcagaagaaaaagtaaagattatccaagagaggttgcgcgttgctcagtcgcgtcagaagagttatgccgacaatcgtcgcagagatttggctttcgaagaaggagattatgtatacctgcgggttacgccgttacgaggtgttcatcgtttccaaaccaaagggaaattggcaccgcgttttgtgggaccttttaagattgtgagtcgaagaggtgaagtagcttatcagttagagttgcctccgtcaatggcgggaatacacgacgtgttccatgtgtctcagctgaagaaatgtttacgtgtacctacagaggaagcagatcctgatcgtatagagcttcaagaagatttaacttatgttgagaagccagtcagaattttggaagtaagcgagaggaataccaggaatcgcgttatacggttctgcaaggttcagtggagtaatcattcagaagaagaagccacttgggagcgagaagatgaattgaagtcagctcatcctcatctgttcgccagttcttctgaatctcgaggacgagattccgtttaaggggggtaggtttgtcacgccctaaaaatcgattaaattaaaaatgcatattttaaatcatttttagaaattattttaaaagcctacaagctaaaccctaattttctaggaaaattttcaatataaaaatgagttagataaaattttattaaatactatgcttgctcctctattttctagaattttctgggaattatttgagcaagggaagtatttttaataattgaaacaacatttcacaaattgttttattcaaaaaagtttaaaaacccctccctaagccgttgggccgttttcggcccaacatcctctctctctcgcgcggccgaaccggccaatgccggcccaagccgacgccgcccgctcccctctctcgtggattccgacaggtggggcccacctgtcggatccatctcctacctccagccgccgaccgagcccgagccgccgccttccacctccaaattcgcctcaatccgactccgattccttcgggtttttgaggggttttgttcctctcgttctcctctttctttttccccaagaatcaaagagaatcgttgaggatttgatccgaatcgagttcgttttgattttatccctaaaaccgagttttaatcttttccgagccgattcctctcgtttggagttcgatctcttcaatccgagcttatataaagcttcccctcgtcgtcctcttccgtttgccccctctcccgagctctcccgtgccccgtagcgccgccgccacgtgcgccaagctcgccgccgccgccggccgtcttcggcgtcgtcgtcgcgccgtctccgccgtcgccgccgcttgccgtcgccgccgttaggtgcgccgtggtgagaggaatctcggccgcccgttccccttcgccgccgaccaccggagtcccctcgtcgccgtcaagccgagccgccgccgccatcctcctcgtcgccggccgccatcgttcgtcgtttgaagtcggggtgagtaccatcgggttcgtctcgatgtcctctacgcgtaggtgccctccaatcacccggccgaccgccctagctccggcgagctcgcaaaccctagccggccgccattgccgacgtcagcatgacgtcagcatgacgtcatcatctccttttctttttctttttcccgattttctaatagattaaaacttcggaaaatcataactaaataaccgtatatccgtttcaggtggttcaagtttctaaatttttctaaaatcaagatctacatgttaaaaatattcacatgtgctgtttatgcttgtttttgtactgttttgttgattttgtttatttgctttagtttccgacgttccggaggagagtgtttccgttgaggaagtttctgacgcgtttgtggaagcccaaggcaagtcacacagatcccaaacgaccctttgagcatgttgatcatgtttaaagctattattttattttaactatgcattgttttcgaatgtcatcgggtggtgaacctttcccaattaattaatggccgaagatgactttattttcctatgggttataatttgattagcatgaaccttatatattggattggttcggctaaatgctatatgtaagtttgcttagccatgcttagaaacattagctaacaaaaggagttaaatataaattatattacataattgttattattaattagggttatattcaatggtagctcacgatggtaaatcgtgtgatgttaattaattgataattaaaacctggataaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgcccgactgagaagtggcgagaagtccatgggggtcgctggggagtccatgccttgttttaaagggggtgattatgatccaggaaaggagcactgtaatgggttatgttgtgcgaggggtattgtcacgactcctttccgaggtaccgtggtggtactgaggcacatggtgacatgatgtggggttgtgtcttgtgggtacagtggtacacctctgatcagagtttaatctattcgaatagccgtacccgcggttatgggtgagttgagcaatatttttcgtgattagtctcacaccacccattaatggtaataatgtggtaattaatttgattcctggtttggaatggataattcctggtttcgaggtttaatttgttcaactggggttggttgttcaaatgtggttgggcctatgcaacacgggtgtgttgtatggtgtttatttaatattggttaattatacaactgttttactattctcttaaatatttattaaatgctgttttctgcaaatgaactgtattatgccatcctttgttatcctgtgcacttgcatatttgctgtgtggcttgttgagtatgtcatatgctcattcttgcaatattcattcatcagaagaggagtacttgagtgaaggtgatggtctggaggattaggcttgtcctggttaagttgtctgtggagtggagttgccatagctgttccgtagattgttttagtttaatttttccgctgcgtagaatgttattttttttgagaggaactatctacctctgtaataatttattatttgcgattgttaaatagttatttaattgtactctattatcaatattgtcattgtgtgcctcggttgattcctggacgagggtttaacacacatgtaagcgtttggaattttggatagaaattcagggcgtgacaaatattgttatttaacttttaatcgggtaatatctatcattggaaggcagccgattaggctaaataccaacgttgacctagattatataggatatccaccaccctatgaaacattcaacggcttgattgtctagatattatccttcttttcatacttatagctgcattagttgagtttgaccttataagtcgtgattagaatctcaatctctagcctactttttggttgccgattagggtagtatcggagtttcagccgatcttacctgatttaactcttttatatcttatgtgcttgattgacatgttaaatccgctctttatgttaagatcttgtcacaattaggtatattaagcttcctgtttgatatattttgcttgctttaatatcttaatatagaatagtataggagtattagccgatgcatgctggatctatttgatcggctatgccataaacgtctataatcttcttgttaatatatatatcgatgtaagtgatttatactgtctcgatcacttgatttaagtatatatcgacggaagtattatataccattgatattgatgtgaccatggctactacggacacaaccattgctcacatcatggatgaacagcacgatattaagttcaagtcctccaagtgctggaatccaattcggccaccagctacactgctgttttcaaatggccgccgaatctgcatacgaccttcgtttttggcccgtgagtacttgatggaaagctcttggagccttctttccaacggatctagcctcatcgccagattccatgtcgtttggccgcaatcacataaacaaggtgctgcgtcacctgtcttgtgcctctgggcttgtaactttgtttgggacccctacccaagtggggcccatgtggggtgcgccccaaccaggtggaggacgacccttggcaccccttagtcgtcctcccacccctataaataggtaggtaccccttcagggtttcttgggttttgtttggatgaaagtttagccattgctacttccttgcagcgcgcgtgtcggctagactgtccgtctgcttgtatttgaaaccccaacttatcattcgtattcaactcctatttgcatttcagattgcttttatcttgttcttgcttgtttcttcgatttgcttgcaggaataaggttgatttgcaccggcaacatcaacaacccacggaaaggtgtatcgatcgctaaggcgcaacgcaacgtcttgtatggttgtagtcgggtcgtcgacgtttctcccaaatcgtagttatcatcaactcaccgaaagatcgggccaacaacagccgtgagtgtcgagaggaactcagggttcatcagatatctacagccggtcgaatagatttagttctttcttgcctatttatgactgctgatcaattcaaatatgacatcggctcaaagataaatgatatgtcatcggcggctggccgatcggctatcgtttatggatttaaccactatttttctatcattatttcttgttgattgcaggatcaaatcaactggcacgctgacgaacctaaaggtaagatttttggacctgcactgaagttaagcagatcttccaggccagtgtgtatttttcgtatcaacagtcctggacttgttctggttggtagccatgtcgcaaacgtcgcactcagtcaaaacgagagttatcctctcaccagaagatcgggccacgagagagagcgtcatcagttggtatcagagcttcggtagcatggtgaggatttttttttatagatttattttccatacctatcaatatacaaaattaccgcaccacttttccctttaccaaacataggtttgtgatttgcaaatttcattcagttttgtgtctttgaatgctggtccgttgtcgtctctagtgctggcttcgtttagttcttagttgtggtttgagttttgcttttgattgcatgcagatcgggtcccgtttatcttggtagcatattatttgttctaatcagattgtgtcgtcgtccttgttcctgtcgcttgcacttaagcccagaaaaatagaagatctgtggtttccttctgatcggtggatttgtttctgaaattacgaggttgttgcacgaccgtttccctctggccgcgatctcctgtactgcttgctattttactggacaagcatgtatatctcttgatttatttggttgatctactcgattgtctatgcatgcaacaaatccttgttttcctctccagatctgcatgcatatccactgccgactgcctacatgcatgcacgatatttcctctatccattgccactgataacttctaggaattaaattctatgcgctgcaccagctccactggttttttgagttttagtcttgtttcacgtacagccgccgtttgacgggctgccataaggaactcggcactcaggtgtggcttgtcgaagtaccaggaggacatcggctatagggtattagctagtgtattagttaacaagaatgtatgtatgtatattagaagtatagaaatagatttccttttctaatttctttccacttagcttagataatatattctcagtagctgatgcttgtttatcagtctacatgattttcccatgggataaaataaatacaatacccttggaatactctcgagtgaaatgctacaatggtatatccgtgcgcttgtggatgaactctgtaaccataatataccagaagtatttctgtgccattgctgggaattatatttctagtaatgtcgttaagaaataccaacaaacatttctggcgccattgccgaggaagattcgtaatagagattacctgaactaatagcaggataaccttggttgttttcgcttttattgtgaaaacagggtagtgcatgactggtttcaacttgtcggaaaacttcaaagaaaatccaaaagctttcgtccgaagcgtcagaccgcgagtcgttgctctgcagaaaactctacgacatagaaaccagtcgtaccagcaccaccaactttcaggactatggctgacaagacccttcacgagttcgctgctccctctactgacaatgtggccattgggccgcagatcaacatgggagacgtggatttcgacttgaagtccaatctcatcacgatggcgcaggctagcccattctatggcaagcctaacgaggatgcctgttggtatttcttacgaccacagataaatccgcaagcgcacggaatactgctgtagcacttcactttcgggtgaccccaaaaggatatcgaactcagggaatgtgtgtaatctacctaaggctaagacgatctaaggacaacaaccgatggtcggcaggcttgagaggactttctatgtggcttaactatctaagctaagcaaaggtaatttcctatctgttgcatcaggcaccgacccctgctggtctgccagcgtggtttcggctatagctctatgatgcatccgaacgtggagattactaggacgggattcagggctgtcaccacctgccgtctacctctgacaaatccatgggatacacaacaaacaaaggtaatctctaacctagacaccacgcctaagttattaattactactctaatacttgcgcaggaacttccttatttatctagagtcctagtactagagcacttagtataaatactaaacaatgaacccgcaaagatggaaatctatcttactcaaagaaagtaattaaataacataagaaaggaacacgaatgcttactttatagaagaagttctccgaccccagagcagagtgtatcaaaagctccggtactcctccagaattcctcctacgaagctacactcatcgaggtagaagtcagataagtgccaaacttccgggcactcctccaaagctccccctcactctctaccttattctaatgtataaaagatacaatagagtctcttgtaattcagctcaaagttgtgtgtattggaatgagatgaagatctccttatataggctccaaatgacggttaggggtatgggaaatggccaaaacaccctgcaactgccataggggagaaatccaaaccgtccacatgaagccagatggcgggaggcgccaggattggttcggncnnnntnnnnnnnnnnncnnnnnnnnnannnnnnnntnncgnntntnntttnnncnnnnngttnnttattgggtcccttccatnttgcccatggttttgcccaatccttcagggctttggttgacatatgggccctccaatccgtgttaatgcgtcttgaatgcgcagaggtgcattttgtcgcatgacggatgtgttttctcctcaaaatacctgcatacacatatttcaccaacactagtggaaatgattagtaataatacctaccactaagttggataccatgttttattccattatatgtaggcattgacggtcaaatattatgatttaaggaccgtcaacagggtactcctaatgggcggt

SEQ ID NO: 70004 - DNA, 6424 bp, Oryza sativa
ccctcccctttactactttacctccccttcttctcttactactacaccatataaatttgaattaaaattcaaatttttaatgtgtacgtaaactttttacttataaactttgggtctataaactaatatttgaattcaaattcaaattcaaattcaaatttgaaacgggtatgtaaacttttgacctataaactttgggtctataaactaatatttgaatttaaattcaaatttgaatcgggtatgtaaacttttgatttataaactttgggtctataaactttaggtgtataaactttagatgtatagaaatactatatatagaaaatatttaattcaaattcaaatttgaacggatataattcaaattcaaatttgaatcaggtatgtaaatttttgacttataaactttgggtctataaactttaggtgtataaactttagatgcataaaaatactatatatatattttaatatttgaattcaaattcaaatttgaatcccgatataattcaaattcaaatttgaatcgggcatgtaaacttttcacttataaacattgggtctataaacttcaggtctataaactttagatgtatagaaatcctatatataaaaaaatatttgaattcaaatttgaatttgaatcggatatataaacttttgacttataaacttttggtctctaaactttagatgtgtaaacctgaggtgtataaactttaggttcataaatttactaaaataggaaagtaatacggtgccaaaaaaggaaaccaggtggagggagggagggggaagggggatcgatcgctacccttgtcgccgggcgatcgatcgcccattagcacttccgccgtcaacaatgccaacattcatctgcaacagttcctggagatctgtagcacatataccatcaagggcgtcagtccagacgccgtcaggctaaggctgtttccattcttccttcttgggagagcgaagcagcggttctatgccaaccatgctgctgtcaacacatgggacaagtgctctacggcattcctctcgaaattcttcccgatgggcaaaaccaatgcccttcgtggaaggatttctagtttccagcagacaagggacaagtctattccggatgcatgggaacgactgcaggagtatgtggccacctgtcctcatcatgggatggacgattggctgatcctgtagaacttttacaatggactcaccccgatgtcccgcgatcacctggacacggtgtcacgccctgaagttttcccccctttgcttgctttaaaaattggctaaataaatcgtccgaagaaattatcttaattaacctagagctaattccttaattaataaatgcaattaataattgaattcggcgtggtggaatttttcttgagttccccatgctccaatgcattaacaggatttttagtggaattttcagagccttggaaataattttttaccaattaaaaatcaccaaagtgcaatttttaatcccaggaaaatccttttttctctttttcttttcttttccctcctttttctttgttgggccgtcggcccatccctctcccgcggtcccccctccttgtgggccggcccaagccgcccctccctcctctctctcgggacgccgacaggtgggccccacctgtcggtcgtctcccacctccggccgctagagccgaagctccaaccgcccatgtcgccgctgcctcctccgctcttcccgtgcccacgccgcgccgctcccgcgtcctccccacgtcgccgcctcttcccccgcatctcccggcccgcgcgcgcgctcgagagggcgggattcgatttcgaatccacctctctcactctctctcctccccacgtcgccggccaaatcggccacctccccggccacgtccgccccctcccgcacctataaatcgctccccgcgtcttcctctctcgtttttcgcactcgccgcgccctcccgtgcttcctatcgtcgccgcgccgctcgccccttgcgccgccgcctaccgccgtctccggccacgcgccgccgccactatagccaccgccgcgccgcgcagtcgccgccgtcgcgctcaccgagcccgcccgcacctcggccgccgcttcattgccgcgaatcaccgccggagcccttttctcctcgcgcgccggtgagaccctctctcccctccgtctccggccggcaattcaagccgccatggtcgccttcccttccctaacccctctatgctctctcctagggtgccgccgccgcccgttcgcgccccggcatcaccggtcgtcgccgccgttttcttccttcgcgccggccgtcgtgctcgccggtgaggaatcccctttcctccttcctttcctctcccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgccttgccatggccggccggcttgagccgtgccgagcatgccgccgcccactccttccccctagagccgctgccagtggggcccgcttgccagccgccccctctccctcccttagtgccgctgaccagtggggcccgcctgtcggcgccaccccctcccttccgctgacgtcagccctgggctttattgcgcaataaattgattaaggacttttctttattagtaaaaacgcagtttatcttctaaaattcataagtaattcatccgagctccgtttaagtccattcaagtctcagtaaatcaagaaaaatgcaaagaatccattaaaaatagttttgtttcctgtttcagtagtcttatagcatgttttgcttgtgtgctttgtttgtcgcgtaggtttcggccgtttcgtcgatccgcggtttctcgaagacgttgctgaggtctcgtcagttcgagagcaaggcaagtcatgcaatacgtttgatcatattgtacccaatttacaaatatcccgcatttctattaaatgttgcatccttttacaatgtcatgtaggatgggtcctattcctcagccatttattgtttaccttatgccattgataacttaggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcaacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgttgagtacagtgggtagtactcagtcttgctctcttttcccccacaccagagctgaagatcttcctagttgaagctgttttgtcaaagttggtttcgtcgctgccgtcaaggattgcctgtggagtggagtcgctcgctgcttaagtcaagcttcccggtttatctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgactttgaccgtaagacaagccaactggaaaccctaagagccctctgaaccccttttttcatctgcatatgcctttttgcacctggaattgtttcgggaaaatttggagttttgcctctttggtttgcgggaaaaatcttggtcgttcattcggatcggattttttttttaaaaaaaaattattagctcagtctagggctttagaaaaattttagttggagtttattcgacagtcagtcgggaatttattgggggttatgcattaggtcgtgtctatattcgatgggggcaatgttatgcgcatcattttctatgcaactagtctatgcattaatttattgtttagttgcattagtgtctttatttgagttcatgaaaaatgttctatgcataaaaatcatcatgctcggttatttatttgagtcttcttttgcttggtttaatttggatttgagcatgaattggttcctatcccttgtctactttagatgtcggtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccccctgtttttcctccttttctcatatttctacctatccccttcagatggagataaggaatggttcacgcgactcgaacaacgccagtggcagcgaagagccgaacaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccaccttctcaagcaccaccaacccaatcgaagcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccgagaagcaggagaagtttctgtctggtcttgatgatgaattgactaaccagttgatctctagagattatgaggactttgagaagctggtggataaggctatccgtcaggaggagcacggtaacaaaataaaccgtaagaggaaggcagctcagttcaggactccccaggggaagagtcagaagcctcgtttcacgatgggacgtcacggtggaccttccaccatgattatccgacagcaccgtccctaccacccgggtagcttcaacaagaaccaccataatggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattcctttatttccaagcgttttgctggtgcacatgggttatctttagtg

SEQ ID NO: 70005 - DNA, 664 bp, Oryza sativa
  unsure (1)..(664): unsure at all n locations
agtatgcctcactttttagattagcagatgaacaaccacatgcttatgccaaagattgaaaatagtgtctgaaagattcaatttcagtatgtatgtgccactgacatacatactaacaaggttcactgtcactgattaattactgcatgacctataacagattcaccatgctttggaacttcatcatcgtcgaactcttcgtgcactatatcaaccgccgaagaaataaattcttcgtcaccatccgatgaaaactcatccaatagcatttgaaggagggtgcttcgacgactcatctcctctttttgtttgccacggggttggagcgtttaccacagggatgaagtgcaatggagggaactgatggcaggaatagaacaataatcaatctgcaaaattaattatcagatcaaacttaatattttccaataatatatatccacatatcaaaatatagacatagagattgactacgacacaagagatcaatgggaattgctaacgattaccctcttgatgacacgaattgctacggcatcttcttggtgtttccgtttttaacaaatcgcagcagtcaggacactggttgacttgcttgtgatgaccgcgctaagtcacggccgcgcaagtcccgggaggaagaagtcnatcggcgcttgtgcgg

SEQ ID NO: 70006 - DNA, 620 bp, Oryza sativa
tgcttttgctgtttaattgatttagatcctcgatttacactgtgaacttgaattgcagcgctagaagcactatggatagttaaaatccatgactcaaatagttaaaatcttctgactcaaatatctgtttccccaaaatccatgactgtgttgatctatactgtctaatggtagtacaaaataactattcagtttaatttttctatatctgattacttcctaaacggctcggaaaagggctcggaagttctactagagaatatatgcgtgcatgatattggtgttttgtgcttcaacttgataagctaaaatcagccgcagtaccctggtcaagtttttcattgtttgcatattgtcgtccaggaagatgaggtggagaagcgtccagttacaggaattctaaccatcgaaagtgggctgacttcgatctcgaagattgttatggagatgaaatacctgtatgagaaacataagcagtgggattggaaggttaaacaggtggagcagaagaaatatttggtggaatttccatccaaagatgctaggagggagttaacaagactcaagggctttgactttgaattatccaatgctagagctaatgttagggagactgagag

SEQ ID NO: 70007 - DNA, 513 bp, Oryza sativa
tgtttttgaatcagtcaaccttctgtgcgatgtaattgaagtaatcaatgacatagtatcaaatgctagggtaaagtcagaacacgataattcaacaaaagtgacagtcaaaatagacggttttccaagattaagctgttctacttcagcagatgcatccattgtacatgaggttctacatggagacaaaatgcacgtcgataggtggataactctgagagaatatattcaagatgtagttcgtggagctatacctgatccgcaggttcttctcaagctactctcttctgctagtcagaagcatcaaaattattctcagaggtaacaaaagaaacatgcacagcttgagcctcctcgaaaggaaaggagacgtggagccacagatgaggatgctgatattattattggcgggattgatgttgagttgtctagggatgagcctgaagagcaagagatgggacttggcaaatgatcatactactattctgtgtgagatatggggtctaaataagc

SEQ ID NO: 70008 - DNA, 501 bp, Oryza sativa
cgcgtgacatgaatcggatactgatgacataccatagtttttacaaaaacatcttcaatttttaaatcgagggagagggcgatgcagtcttaatcggacatgcggcagtgaaaaatcacgcgcgcgaggctgttgtgggcccagttgcggcagcgtgcaaaggcgcgtgtggataatggacactgccatcgacgtcgacatcgacaccacctgagtactgtagcttactgccatcgacggtcgttacaccatcgttgtcatccccaacgcccctgacctcattgacatcctcgccaccaacgacgtcgacatctccgtcgtcgagggtgacgccgccggcctgggcgaattcctcgccttcgtaggcaacctcctcttccccttccttgccttcgctagcctcttcttcatcttccgccgcgcccagggtgatcctgacaccagccctggtagcctcggttggcgcttggacttcgaccgctccaagagcaagttcgagca

SEQ ID NO: 70009 - DNA, 606 bp, Oryza sativa
  unsure (1)..(606): unsure at all n locations
ctccactatcgcaaacacttgctccttatctttttaatttcctcctaccattccacctctttccccctctcccttatcctcttcttcacttgctctcatcttctcctctcaaatattgcagcagctaggagcgagcgtggcgggggggggggggggggaggggcnnangcngtggcccggatgagggcagcggcggctcaacgcggtggtgggctgctggcgcggcgcggggcgaaggcgctggcccgcagcggctgtctgcggcggcagtagcctggcgcggcgcgggggcggaggaggcggcctacgtgggggcagcggcggcccggcgcggggcggagccgacggcccgctcgggggcagcggcagccgtgtgtggcggcagcctgatgcggcgcgggggcggaggcggcgacccgcgtggggataatttttaaatgtgatatggtttttttggatgatttaggagttcaatttttggatgaatttgtgatgttggatctgggatttgtgatatgtgaatgttggatttgtgaatattagaaaaaaaactcgatctgtgatttttggtatgtgaatgttggcaaaaaacgacgaaaaaaatat

SEQ ID NO: 70010 - DNA, 968 bp, Oryza sativa
  unsure (1)..(968): unsure at all n locations
cgtttgcattgcagggatcatctaccgcgcgtcacggttggtacgatatcgtttgtggtgtagcgattgcatggcgtcctggactagttctggttggtagccacgtcacaaacgtcacactcgattaaagcgagaattatcccctcactagaagatcgggccacgagagagagcgtcatcactcgttccccgtcgtgggccacgccgctgtcctcctccacatggcgggccacacgctaaaaatctatcttcaaaagtgcatattgaacgcaacttaagataacaaagctaacccaacaatcaagagaacatgtatagttaggcactgttcacttctaaataagatgtaggttttatcttagtttgcattatcacgctatttaaacggttaaacaatacatttcgtacgaaaaccttttaggcaaaagttattttaaaatatcaaataaatcgatttttaagtttaataaaataattaaaacataattaatcacacgctaaagatttttttgttctgtatgcttgtacttaatctttttttatcttcagtaaacttataaacgaaaacagaagcctctactttatataggttcagagagattcattcgccgcctcggtcggtataggctggctttatacagggccgcggtcgcgccgtcgcggccgcaccagccaccacaagcagccgtcctgggtcacacccgacctgtcccggccgaccccaccgctgcgagctgcggcgcgcgcaagcgggatttacagccacccacaccaccaaggcaccaacgcattcatccaaaccgccggccgccggccgccgggtcgtcgtcgtcttcacgcttccttgccaccgcgcgccctcccgggctagcccgccgggccccgctgctaccagagagggcgatggcgacggcgagcggcgtttncacttccctgcagcttccctccacgcggcgggtgggcggctg

SEQ ID NO: 70011 - DNA, 698 bp, Oryza sativa
ttattttgagacggatatagtaactcctcaaatatttattaggttgatgtagtggaggtatgaatctagaaaccgtttggcaaaccaccaaaccagtcaagtactcaagttttgaaaaatctcaagtgaaaatcaaacttcatcgtcaaatttagtctgaaactctgaattcaaccgttttccttggtaactgagcagtaatcacggttcacggttatcgaaaataccgctcacaaagtgttcatgagagtgatcggtgaaaaaacagttatgtaaggatccaggtcctctacaattaaactactaatgtagggtatgatattcagcgatagaacggttctataagagcgagtacaataattgacgataggagcaccacgtaggatttttcactgatgtggagaagagatagttgaagagagagaatgagcggggactaattagtcgctcggctccacgtgcaacccgaggttgtgggcccgctcgccacaacgatggcgcccctgcgctagccacatgccttcgtcttccctcgtcgccacggtcgtcacctgcgtccagcgcccacctcgccccccgtcggccacgtctgcctcagctactgcggatgtcactgcttgcgtccgcctcggccatggccgtcacgtcgtagacatcacccttgtccggtgcagcaacttccctcgtccaccttggct

SEQ ID NO: 70012 - DNA, 1265 bp, Oryza sativa
ctaaccgtctttatctgtgtttaacaagaagcgcatgcgtgtatatatgcagcgctgctgcaggagcaggcagatcctcaataaggagagagaacaattatgaagagaaagcacaacaggagaggggattatataactgcttgcactgtttgattttattttctgccgttactaattcataatacggattgcttggttcaagtggccacacggtatatttgcgtacacaaatttgaccgataacatgatcttgcttcttgcagccaaaataacagtgatggaaatagaaaagctgctctttgaacatcatgtgccggtaattacaaatatatcattatttttcgtacgtatatattaaatagatctgcagaggtaaccaatcagcaagacaatggcatctgcatcagattcaactgaaagctaattactttgctacttgcaaattactttccagtaaacaatggtacatgcaaatgtttatctttgagttacatattattgtttttagccaagctaattactttgctatgtttcttagagcaaaagtttaatgactataattgttatagctatctttatcatgcatatcatgcagattcatttaaggttagttcttttttttcccacaccttttacgatgtactgctccttttgtatcattccaaaagattggctacgcttcaaccattttgcttggttatttcattactaattttatttgccagacaagatgcaatttaatcgttggaccgacatatatatatggttcacgttcaattttcaagatattattaaatttaactaatctatgttatggggcaatttttaactatgaggatcttatatccattgtgtcatccacaggtaattacgattttacttttcatcaatctttgcccgcagattactcagagacaaagccaataacctactcttcacaacgctggagtacggcatgatggaggccacatcgacctccttcgtcttgcacatgaagatcagcagcgtgccggcgtgtgcatacactgcttaactgacgacgtcaattggatacacacaacctcagactctgtaggttcagactattttctccatccagattttgagttgatctttttttttcatcttggttgttttatttacatgtttctcatctgaaatgagatcagaactcaaccacaccatcataacgtctgatactataaaatttaggtattgatccacaaaatagaacaactttgttgcacatatgatgcaaatataaa

SEQ ID NO: 70013 - DNA, 669 bp, Oryza sativa
acatttgcaaagcctctacagatgaggaagcctgttgagaaatctgtcgctaagtgagagaacctgaacttctgtagaaattctgaagtctggagaagttcaaagaaggcaaaggctagtttagattaagggaacagaacctgcggttgtgatttctctgtactgctccatatggcattggacggttggaattgattgatgtaatcactggtgctgtaatctcttttcttaaatactgaggtgtcagcatttatgtctgaggctttgacgaatcggttgccggatctggagctggatgcactagttgcatttacaagtgtgtatggcaccttgtagaagctttgtagaactgtacttaaaggtaactccatattttgtgaactatgatgttcagtgttcgctccacatgatttgtgttcgctccacatgatgttgcggttgaaaaaaatttcacatgatgtttgtgttcgcttcacatgatgttgcgatggaagaaaatttagtttagtggtcgctccacatgatatgttgcggttgaagaaaatttgtgttcgctcacataatggtgcgggtgaagaaaaattagttgatgttgtgtccgctcacatagttgatggtgtgttcgcttcacatgatgtgcggttgaagaaaatttagttaggtagctcc

SEQ ID NO: 70014 - DNA, 703 bp, Oryza sativa
ccaattccacgcggtaggagtccgatctcttcaatccaaggctataaataggaccccctagtcgtcctctttcgtttgcccccttccccgagttctctcgtgctccgtagcctcgccgccgccgccggccaaccgccagccgcgccgcgccgccgcatccgccgtcgccgtcgccctccgtcgccgccattaggtgcgcacgggagtgaggaagcccggccgccacttccccgtcgtcgccgtgcgccgtagcccgccgccgccgtaagtccgagccgccgccgccgcgcctcttgtcgccggccgtcgtcggtcgccgtttgtcgcttcggtaagcaccattgggttcgcgtcgtcgtcctgtacgtgtaggtgtcctccaaaaccccggccgaccaccctagcgccggcgaggtcgttgcccgtgccgtggctgccgtcgatgacgtcatcatgacgtcataatcccctctttttcagttttttttaatagattaaatatattaaaacttcggaaaatcataactaattaaccatagctccgattcaagtggttcaagttgctaaatttttctaaaatcgagatctacatgttaaaaatatccacatgtactggttatgcttgtttttgtactgttttgttgaattttgtttggttgctttagtttctgatgttccggaggagagcgtttcagttgaggaa

SEQ ID NO: 70015 - DNA, 720 bp, Oryza sativa
cttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccatgcctgcggttatgggcgatcaaccagattcaccgtgattagtctcacacttaataaatcgacccaatgcactgtagttcaggtgggttggttgggcctgttcaacgtggtgtagcgttgatcagtggagatttaatattaccttaattactcaactgttttactgttttgcttaataagatgttttacaactgcctttatgcaaatagccacaaaccgtccttgtatccccttgcacgtctgcatcatcggtgtggcttgctgagtacggtggttgtactcagccttgctattattccccttttcagaagtgtagtgcttctgagctgaagacgaagttagaggaccaaggctcagaccccagttgagttttgcctgtggagtggagctgaagccccgctaggatcgcctttttccgctgctgtcgttctctttcggtgtgaggactaagtgcctcttatataagtattttacgctttatttacgtttggaactgtatattacttgtcgttttgtgtaccctggctggtcctggacagggatttaa

SEQ ID NO: 70016 - DNA, 633 bp, Oryza sativa
ttggtcttccgccgctcttttggtcaccggtgagttcgccgcgtcgcgctctacccgttggtgccctccgtttgcgtcctcgcgccgccgttcgccggcaagcgtgcgccgtccgagccgccgagccgccgccgccggtggtgacgtcatcgctaatgtcatcgtggccgtctgccgtgagccgccgtggacccgatcgatctcggccgtccgttttggatggatcgatctcagccgtccgttcgcgtgaaccgccgccgtgcgcccggtccaccgcgaaaccctagccactgatgcaataattccctttttccttttcaaaaataattcattattgcgtcataattcaattaaaatcaatataagtgttttaatccgaattaatcttcaaaaattcataactaattcatcttagctcggatttagttggttcaagtctctaaatttttctaaaattgagatctacatgttaaaaatatccacatgtactggtcatgcttggttatgtgctgttttggtgattttgctcttttctgcttagattccgtcgtttcggagagttcgttttcgccggagaagagtttgaagagttctaaggcccagcaggcaagtcacacagatcccaaaccaccc

SEQ ID NO: 70017 - DNA, 726 bp, Oryza sativa
actttttatttatcacggcgaacttggcaactgacgcggggctgcatgggtcttcgatctccggcgaaggggtaagtccaatgttctgctggcccaggcaattgtactggctacaatagtgtcgttcaaggctgcatcagtacattcgacctctaggattgctctggtttggttgatatatttgcttgcctatttatcatatgtctttgttaatctagtcttagaatctcaatttagctctatcggttgtctctcgctttagggtttctgctgatatcgactaaattgttttactggattagattagctaaggcatctaccaccctaaaaatcagtcaagggcttgatctactaagttgtctagatattatgtttcttttcatacttagtgttgcatcaattaggtttgatctactaagtcgagcttagaaccataatctctagcctgctaattgattgccaataagggtttcatcggggtttcagccgatgagttatctagacgttgcatcagcttataaggattacatacaagttggatttagccgatcgcaacaaagatttcactgtttaatctaatcttgtggattttatgacattgggactccagctgatgtattctttaacattcggatcagtgcttattctatcatatcattggtagctaattgacttctactagattatattattactatattatcatcagctgatcgcctttatacg

SEQ ID NO: 70018 - DNA, 651 bp, Oryza sativa
aagggtccgatcgatcgaggaagttgtgtgtactctagctgtagctgcactagtatcaggtattcgatcaggtggaattgggatcgatcgatcgatcacctgcgctggtgcggagaatgtttgtttgtagaggaggaggacgatgatgctatgaaggtttggctggccttagccccagccccagggcaaattaagtactatgtaggtgctcgatagctttcgttttcgcaagctgttgtccgaagtatttttttgaaacgtaactattgtccgaaagcagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttttgatttttttctttttttttaa
